United States Patent 8,067,671 (METHODS FOR GENETIC CONTROL OF PLANT PEST INFESTATION AND COMPOSITIONS THEREOF) - sequence listing, part 16

SEQ ID NO: 16316 - DNA, 2285 bp, Heterodera glycines
  misc_feature (1866)..(1866): n is a, c, g, or t
  misc_feature (1958)..(1958): n is a, c, g, or t
caatgcttttcgtcccgaatggcttaatcaaagccagaaaaatgctttagtttgcccctctctccgatcgcttttgctcaccgtccctttcgaggccccaatcgggcaaacaaaagtcaaagcattcgctgcaccgttggcctgccaagcaaaaaacatccttgtttagtcgatcgaacagattttggcctggtccatcccttctcacctttctgatcggttggcgttctgatcagttctatccatcgcgccccttggcactcggaaatgtccggctgaaacaattgggcaggggccgacacggggtttggcatgaagtgccaatcctcttcccatccatgcaactgggcattcttctgcaaatttatggcatttgaatcaaataatattaggtacgcacccctctccctattcccattctccaccatgctcccgcccctcccaaatttctcacttcggcacccgcttttgccgccctttgcaattggtccatgccgagcgtctgctggcggtccaaaggcaacacaaaacaaacggactgacgagcggacgaagcggaacggagagaacggtccaaatgggcgacattattctgaaagggcggaagaaagtaaaaatgaaaaaagggaaagaaatgggaagtgacagttttgaagtccaaaacggaaaaaaatgttccattttgaagggaagcggcacggtcaattccaaaaggacctttttaacaaattggaaacggaaacccctgaccagggatccaaagggggcaaaaggtcccttttggttcgaaccggtcccccaattccccccctttcaagggccccccaatgggatggggccccccgcctaattgggcccgggggaaaacaaaaaaaatcaaccccttggggaaaggggactttttgcccaccaaataaatttaaaaatttttttttttttggggcccaaaatttttcgccaaaaggaaaaggccccctaaacccccctcaaaaaaaaaaaatgggggcaaaaacaccagttttggcccccctttttcgccccaaaaaacagcaatttttccttgggggaaaaaaaaaaaaaatatttttttttattttattatttttatttataaaaaaaaaaaaatatttttttttttttttttttaaaaggggggggggcgcaaatcttctcccctctttttcccccccgccggggcgccctctttttctcttcttttctctccggcccagttttttctcggcggcgggggggggggggggggggggggggagaagaaaaaaaaaaaaaaaaaaaaaaaaaaaatttttttttttttttttttctttttttcttttttataagaggggaacccaccccccccccaccccccccccatattttttttttttttgtttttggtgatataaaaaaaaacaaaaaaaaaaaaaaaaaaagtgtggggggggggggggggggcggtgttttcttttcttatttttttttttttttcttttttttttttcctcgggggtgggggggggggggggcgggggggggggcgaccacataacaaacccaccaccacaaaaaaaaaaaaaagaggagggagggggggggggggtgtggttttttttttttttttttttttttttttttttttttttttccccccccccccccccccgccgcccccccccccccccccccccccccccccccccccccggcggggggggggggggagggggggggaggggggggggggggagccacccaccccccccccccccccccccccccccccccccccccctccctctttttttttttttttgtttgtttgttgttgtgggggggggggggtgtgtggtgggggcccccgcncaccccggggggcggcggggcggcgccgcccgcccccaccacccacaaaacaaacacaaaagaaaaaaataatattatattttatttttttnttttttttgtttttgtgtttggggccgccccccccgcgcccccccccccccccccccccccccccaaaaaagagaggagggggggggggagggggggggggggcgggggggggggggccccacccccccccccccccccccccccccttttttttttttttgtggtgggggggggggggggggggccccccccccccccccccccaaggggggggccccccccccccccccccccccaccaacaaaaaaaataaatttttttttttttttttttttgtgggtggggccgcccccccccccccccccccggccccccccccctccccc

SEQ ID NO: 16317 - DNA, 2610 bp, Heterodera glycines
tagaaattttcaaatttttttttgggttgaaaaagatctaccaagaattttttctggggtaaattagggtcctgagcacctttatgatgtttattttaagtttcagattttttggaattttttaaaaattcgaaaatatttttaatttttttggtccttggaaatttgggttaaaatttgaaaattcataactcaatggaggactggtcaatttaagtgaattaaagctttaaaaatagcaaaaaatcgggagaattttatgagatttatttggttttataatgttcaaaagaaaaaaagttattccagaatttctggaaattttcgatttttcagaaaaaaattcataactcggttctgaaaagtcattagagaagagtaaaatactacaaaaatccgcaattttttgctctattatataaattttatttcacctttttatcattttttaaaaaaaagatacaaaaataaaagtgattttgggcttcgggaccataggggggggggggtgcacatggtttttgagtgaaaaaaaattttcaccaaaaatcttccaaaaacatgtctttaggcgttatttgggccgctgatcacgaatacgtgatcagattttacttttgacatcgtcaagacctcagaatccctgtgtgattggggattctgggacatgttctgaggggggggggggggggcggcaggttcgaatccggccggggtacattatttttacgtgcattttttgattacttttacatgtttaatttcatttcaaattaaataaatattcaattaataatttccaaggttgtttttaattaataaaagagtattttattattaaaaaatttttaaattaaaatgcactcgaacgggcgcgaagcgcccgtataagcccaacaaaatttaaaaaacgggcgcgaagcgcccgttcgaggccgcgaagcggcctaaaagtcccagataattttaaaaaaattccaaatctccacaacaagagctaacttctaatcactgttgtacctcttttaatcacttttgacgtcttttaatcactgttgtacttcttttaatcactttttacctcttttaatcactgttgtacttcttttaatcactttttacctcttttaatcactgttgtacttcttttaatcactttttacctctttaatcactgttgtatctcttctaatctctgtaaggccaacaaaatttgaataacgggcgcgaagcgcccgtccaaggccgcgaagcggcctaacaagctaaaaaacgggcgcgaagcgcccgtatgagttcaacgaatttaaaaaacgggcgcgaagcgcccgtccaaggccaacaaaaattgaaaaaccggcgaagcgcccgactgaggctgcaaagcggcctaacaagctaaaaaacaggcgcgaagcgcccgtatgagttcaacggatttaaaaaatgggcgcgaagcgcccgttcaaggtcaacaaaaattgaaaaacgggcgcgaagcgcccgtctgaggccgcgaagcagccttaatagcccaacaaaatttaaaaaacgggcgcgaagcgcccgttcgaggccgcgaagcggccttaaagtcccaacaaattttaaaaaattcgcgaatctccacaacaagagctaacttctaatcactgttgtacctcttttaatcacttttgacgtcttttaatcactgttgtacttcttttaatcactttttacctcttttaatcactgttgtacttcttttaatcactttttacctcttttaatcacttttgtacctcttctaatcgctgttgtacctcttctaatcacttttgtacctcttctaatcacttttgtatctgttctaaaatttaaaaaacggcgcgaagcggccgttcgaggccgcaaatcggcctaaaaaggccacaaaaagggcgcgaatcgcccgtctgagtccatcaaaatttaataacgggcgcgaagcgcccgtccgactcaacacaatttaaaaaacggccgcgaagcggccgaaaagcacaacaaaaattagaaacgggcgcgaagcgcccgtctgaggccgcgaagcggcctaaaaatcgctgataattttttaaaaattccaaatcttttcacaacccgatagctaatctaggtagcgaagctcaagaagcgcgaagcgcttttccccagctaaatagccgacggttcacgcacccgctagttaaatattatatatatatatatatatcatttcaaaactaattgcctttatcataaaaagttgtaatttttgacagaattcgagatgaaagactaagtttttttaatttaaatttttcaattttcataaatctatttttggtctatttataaagaatttaaatattaaatttgcaattcttaatatatgattacgatcttcttgtttttatgaatttagaagtttctaagtttttaataataatagtgaatatgctatgtttcattgattttatttttattgtttcttttttaattatgttattttgacaaagaataaaaaaaatgtgagcttaaaaattaagcttagacatatcatataatttattttctaatttttcatttcctgttcacattatgaaa

SEQ ID NO: 16318 - DNA, 3594 bp, Heterodera glycines
  misc_feature (8)..(9): n is a, c, g, or t
  misc_feature (44)..(44): n is a, c, g, or t
tgcaggtnnctgacaaattgaagagtcaaaaatggcaataattntgatctttctcatatgttttgtgtatgtatttttgccacactgatcagctgcattggtgcccttcctcacttcgtaaagtccgcggagtaaagcggcactttgcgcttggacgccgcgcaccgttctgttgcggtgataaattggggatttctttgacaaaccatccatcatttcaattttgatcacctccatttgaccatccgatcgataaagtcggatttgttagcgtcggtcaccgacagatccttgcctcccggcaacaattctcgctcgattatctaaatatcatccatcaggcgattccacgtgttccaatccaatcccatgcattttttcggcatttcgccaagggtctgaacaaatgccaaccgattcgcaatagtttcaattgttgctttttttcgcctcttcccatcattcacctcaccagccacctcctccgtcacgcaaaatgccaatgccaatgtcgtcggctgatcagtgacttcattctcctcctccttctcctcttcagcggcccctccgatcggatggtcgcgcaaccagcacagggaatgccatagttgggggtccaagtctcgaaggtcgtccagacgtagcggactgaaaaatgccatgccaatttggccaacaatgggggaggagttggggggggggggggaatgggacgaacagttgggccatcattttgtagaaagggcgggtgaaaaaggagtcgagcagacagcgatgctgaacaaacacagacattgataagtcaaaacaaatggagagattcgagaataaatttgaatttataaggcaggggatggaaacagggattggcattttgtctgataactttttaaaaattcccgaaattggaataaattattggaaaaaattaccacaagggccaagccgagaactctgccgcacaattccatccttttaaagggaaacaaacggtgaatgaaatgccaattaaaagaatggaagtgccatttgaggtgatggtcgacgaatttggacatgggactgatctgaacgggcaaaaaaatggagggacaaaacgcaaaaatatgccaataagtgagtgacacctggacggtgtgagcattgggcccggaaaattcgaagaggccgtgccggggatggaacagttctcgcgagagtaggaaaaacagttcacgcgaggggccaccgtaatccaaccttgcaaagcaaaacttagcatacggtgagacattcggactcacccgtcctcacagtcaaaggtcacctgaagaaaattgaaattattgaccaaacgtgtcaatgactcgctaaaaacaatcattgaccgttttggcatcaccgaaagcctaatcaatcccaagcaatctcgatcaatgattattgaccaattttcagtcgcttaatcccctcctcccctccctctccccaattaccatcatttggcactttttgagctgttccgcgccgactgtcaaaaccttttcaaatgcatcattcattaagtgatcgcgtcgcaggcggaagctaaacaaagagaaaagctattataaaagttcgttttcgagtatcatttttatcttttcttttattctctctcgatcattcccaaatgccaattgttttcgtgccgattctcaatggctttatattgctttttaccgcaattcaaagcagtgaattacagtatctgtcccttccccctagtgcataccgtattctgcctggtcccttgccgtggcctgccctctccaaacattggtggaattgtgccaacttctgctccagaatggcatcacttcccccaccgtttgttcgttgtcttcctccaagtctctcgactccttcgctttgtctgttgtactgctccaaaatgctgatggccatcaccaagtccatgtcgttggcaaatcgcagcatggccaattcgccaaacttggctattatttgcaacttcttgtacacctttaattgatggtattttagatgagaggaagggtatttgagtttgtcatttttgcccctattttgaaaatccagttacgttcagccctgttggtcccaacagatgaagcatggggggggggagggaaatccgcttaagtgccgaccgtttcggcgatggccgggcacctctccgccaatacattgcgcacttcgtccgccctctgcgcggtccgtccccattcccagatcagctcattgcgcacccattgatcagcagaggcattgctccgctgatcagtgccatttgctgctctttctcttctccctccaacacagtcattttcattttctctcttccgtctcgcctctgtccctttgcgtctgatcggtggcgcactgcgcgtcttccgatcactttgaaagggaaggactgatcagacagacagtgagtgttaaagtgattaggcaaaagactagaattggtcaatttaagccaattaataaaattgtgaaatagcagaattggcacagcctacggtattctactacagtatggcaccatagcacaacaaataccgttgctgttgcgctgctgtgctccgccgttgcaacactttcgtcatccatcggtcggacagccgcgggtcaatcggagtgatctgtcgattgatgtgatcgacgaacaatcgctgcccattttgtccacagtcgcgcgcgatttgccaaccgacgggcaacggttgggtttggtcggcaaatgcgttgagaaaactgaaaggatgaagcaatattggccatggcattggccactgatcggtgggactgactcgaccaactcgcggttggcgcgaaagtgcgagaattttgaagggtctcgccgaatgcggtgcacaatatgcttcagatagagactttcattgtacatccgaagggcttcctttttaagggggagggaagaggaattgatcattttgtttggctttacacgagtattgattgatcagtcagtcaattggctaaccgccgagtgataatgttttagtcaaagatgtggaccatgtcactgatcattagtgtttggtccttggttatagcatatcgatcaatcaattggcgctgagtgccacttttaacggaatttccgtgcccaatcactcggtggacgtttctccggtccattttttgactaatcagataactgatcaatcaggtcaatcaatctgtggacggcctttctctcctaactgttctgatcagtatcccttcgttcacctcgttgtccgtcagtgactgtctgaacttgtcgttgtctatcacaaattgcagtgcctttgagtccgattcggccaccaccaatgattcattgctgcttctgtttccattagctttgtcctcacccattctcgaagtgtcctcgtgctcttctcggtcgtcgtcaatttcctcccaatttcgagcactttcccgtccgatcactgtccttctcgacgacgcgcttcccatggaaaagtgttcaattagaaattatcattcgcattttgtaaatgtacaaattgatcagatcattcagcccaattggtcaaatcttcctttacacggcgattcaat

SEQ ID NO: 16319 - DNA, 3148 bp, Heterodera glycines
  misc_feature (1920)..(1920): n is a, c, g, or t
tttacgaaaaattatgaatttacattcagtcccgaacctacaccggctggtccgggtccaataactattcgtttaaatttttgaaatttctcaccaataatccactatagctctcatttattgagaagactattaaatgcacaattctctattttataaaaatttttatacatttttaatcaattttttattttcgtgaaaataatcaacaaaaaacgaaattaattaagacatttggcagtaccttaaaaattttgaagaatcaaaaggaattactgataaatgtttatttcttgtttcttctgattttttaaatattatttgccttactttcgaattgttttaaaaccaacatattttattgtatagtttaacattcaatgcattatattgcattttttcatcaaaaaaaattactacaaaagcctaatattgtaaataatttaaaaaacgccttaaatcattagaataataaattaaatttaagactataaatttaattaaggggggtccactaaattcagtcataatggtgaacaaaattaaaataatcacaattcttttaataaaacaatttgaataaaactttgccagattatttttttatataaggcccaactattgacgaatcttcttctttggcatcacaaagtggcccagtgaattgaccaaggtcttgttaaaagcactcaaatttcacgagacactaactattcagtcccattttttttgtttgtctaaaacaaataatggatttttttaaattggtctctttatgccacccgagcactctttgaataattcattaaaaaatttcgaaaaaattgcatttttggaagatgattttaaaaaacataaaaatttatgaactcaaaataaaattctgaaatatggcttattaaaaagcccaaagtttctctttcgagtagtatatgataattatagaacagataaataattcaatcgatattattcaataaatttattttcacgaaaataaaaaattgattaaaaaatgtataaaaatttttataaaatagagaattgtgcatttaatagtcttctcaataaatgagagctatagtggattattggtgagaaatttcaaaaatttaaaagaatagttattggacccggaccagccgggtcgggtttcgggactgaatgtaaattcataatttttcgtaaattttactcatttaagattttaataaaaacttaattatggtggattaatgtgtctatcgaagagacttaatcatttgggactcagtggccttggcccgcaaaaatgtgcgctcggcgattagaggcagcaattaattaattttgggctctttatttatttttgatgaatgagaattttaaataatatggaatttcgaaaatcacattttatcagcttctttaattgctataagaaacaaagttttgaatcgaagaattaattggattattataaaattctgaggttgaagcaagcaataatttattttttgcgtgcccaatctgtggctacaaaaaccattttaatttaaggaagtagagaagagaaagtcagtagcaaatctaaaaatggacctttttgaattggattaattggcataaattactaaaataagtttaaatgacgacattttcaaaatgatataaaccaatgttttttatgcgattttctcttatatttgaaggatataattgaaaaaaaatttttttctgagatataataatctttttttttttgttttttaaaattatttagcaaatttaccggtcaaattgcaatgaatgaatgactttttcattctgtctcaaagagttaatttaataattctatcatttacaagtaatgccaaacaataatgaaatttattttaatttctcaaaaaaaacattttttctacatttttgggttttctntagtcaagtaattgaagttctcgtgtataaaaatgtattttgtgcttgcctcattataataataataatatttcatgtgtcgtcattttacaatttataaatccctttaataatccattattaaaatttttctattcccaattaaatccgctccaagtccatattttatttatttttcctaaaaacaaaaacgcagagatcaattaggtccatttattttaaatcacccaacaaaaaattaaaaatttttcgaagaattttcacattgagcgattcgctgctaaatgcccttaacagctaaataatcattttccaaatgatatcccgctatgatgacgtatgattaatctctattaatccatcaccactcaaagtatcataacaaatgatttgggtcgactcgccgccgatacggcggtgcgatcagatcaatcggcggcttagttggatcggacattagcagcaggataattatcattctttatttattactagggctcgcttcgctcgcgctagtcaaattttaaaacaaaaaatgagtatttatgtttctttctcttctccttcttggtgttgacgaagtctatctatctcatcatctatcattcacacccccagcaggactctcttttgtactcgctctctctgtctctctctttctcagctattctctccatatctctctctccttctctcactcttcaccctcactcttttacactctctctatgtctatctctctttctctctttctctccctatctcttttccaacgtgtctcttcatatttgtttattacttcaatttcttttttcattttttactcgaaaaaaatcccgctaattcaatctttacaaaggccaaacagacgcactcaccaattattcataggattgttgtggaatgtaccgccattgacgagatcgcccacacccaacgcaagcgaaaggcagtaaaactaactaatgatgatggaaggaaacgacgaggggatgaggggtccgccgagggactgctaatgcattattagcattcatcaattctagctattatcgtcatcagcagagaaagagagagaatttttaggaatttttaaaaattatcattaattttagaaataagtttatgttaattagttgagaaaattttatatcaaaattaaagagaaaaaaactcttacaaaaattcgattttaaataagtttttcattcactaaaacaattaaatg

SEQ ID NO: 16320 - DNA, 2574 bp, Heterodera glycines
  misc_feature (2433)..(2433): n is a, c, g, or t
  misc_feature (2500)..(2500): n is a, c, g, or t
aaaggacgaactcaactatgaagtagcacatttctgcttctaggtcgagtatgattttaattattatatcaatcattcatttttgaatataaacaataataacaattgtgataagcgttaccagttttatacacaacattggatgcgataacctgaatcacaaatatattaaataaaatcaattttaaaatagaccatctgtcaaaatccgcataaaaacgatattcacgaacaataaaatagtgtttgaatctgctgaaattccggtttcaattaatgtatgttgatattagggatgcgaatttagtgacgaaaaatctcgaaatagttaactaaaatagtgagcaacaatgccaaaatagtgaaaaaagtccgaaatagtgacgttttagtggcatatttttcagccaaaaattgtgcaaaaataaattattcactgattgcagttgcaaatgaggtacatttcctttctaatattttcacagcaaaaattgacattttttaaaccaaaattttgccaagaaaaaaaatttgggggatgaatttttgataaaattttctaattcttaggggcgcattttgaaaaattttagatcgatttttaggggtgtattttttcaaaaaaaaatttttgttcgatccttggggtgtattttttgtttttattgcatttttgataaggaattttccaaaaaatgccgaaatagtgaaaaaaatagtgataaaacgtcaaaatagttaattttcactattttagttactaagcgccaaaatagtgatttctagtgaccgatagtgacatcagaatcgaaaaatgtcaacgcagaaatacgttttttgagctcctttattcaaaacaattgagtaaaaaaattagtaaatcactaaatgtagcgaccctaatcatcagataagccaaaaaaaaaaaactaaaattttaaattaaaattaatataaaaaaattaaaaaaaggcttcttcgtgatcgtttcttcgtccatctttcaccattaaaaattccaatttttatgcatatcggaagcaagaaaatgacacatttttgccatttttgggtcaattttcagaagttgtttaacagaaatgcaataaaaatgatttttattgacgcgatgacattttttggcgacatgttcaaaataaatttcaaaaattttccactaaataaatcatcgaaaaataatctcccagtctccattagtctaccaatctccaattatctacccctttctgaggaggttgaaaaataatataccatcatggcatataaaaagagtatatacggtagacagtttaaaaagaaaataaaagaagttatcagcagcgatgttaagacgttcgttactcattaaaaaagatcattttttaggaataaaaaacatcaaaaagagcgcagaaaaagaaaattctatgtaaattagacgaagaaaaaattgaaaataaataattgtagagcaaacgaaaacaaaaaacgactatccgaaacaggggtgtgcaaaaactaaaaaaaaattaaaaaacaaaacaaatcacgaaaacgaaaaattttaaaatccgaaaacgaaaaaatacacgctttcgtacgaaacgaaaaattttttaactaagtgctgatttggcattttggtgcttttttttgtgctgtttcgtcattttgagaaatttttaaaaatattttcagcaattttcaaaaaatttattaacaaatatgcaataaaaatgaaaaatacaccccctaagaaccgatccgaaaaatttcagaaaaatacatccctctcttaattttatgcttttttccaattttttgtgctgattttgcctttaattcggattttgcacttatttgagggtttttgaaaattgatggttaaattcttaaaatagtcaaagtcaagcaaaaaattatttgttttatgatttttatttcgaactgcagaacagtaaaggaaaactcagtagaaacagcaaacaaaacaataaacaaaaataagaaaaaagctaattaatcgattaaaaatgtggttagagaaaaagaaatagaaaagaacacgagaaaaaaaaacttaatggttctaaattttaagcaactaaacatcggagttttatataaattgattttctaactaagtttggaacaattagaggtttgaattttgttgcaaaaattatacaatcttaaaacttcggacaaatctgaaaattcttggaatttttaattattcagagtgcataatctcaaactatgacaaatacgaaatttaatcgagatatttagaacattaaaaatccaaataggtaatattaaaaaatgaacgtttgatgtaaaatttattaaactttcaattgaaagaattcattaacaaatttttaatttaaaaaaatgcattttgggcatttaatatttttatttttttanagcaatttttcaaaatgagcataggataattcttaaattttcaacatattttttaaattagtgtcanattttggagaaaattgtcctaatttaacaaaaacattatcaaatttctctttaaaaataaaggatattttgtta

SEQ ID NO: 16321 - DNA, 1293 bp, Heterodera glycines
  misc_feature (48)..(48): n is a, c, g, or t
ctacatatcttcagatttgttcaaaaaggaaaataaattactcacttncggcatcaaaattatacaagaaaatcaaggatgagaacattgaaatgaattcactttgttaaaatattttaattaattaattaattttttaaatttagtttaattattaattgctaattatgttcatttaagcggcggatcatttggaaaataagctgaaatctgttgataataaaactgattcgatttatcaatggcttgacaatgcgattggcgttatgtgcagttacaaatttgaatttcaaatggatgaaaatgttcaacaaatgcgcacaaatttatgcgaacaaaaaagcattgaaaaagcagcggaaattttgcaaaaaacaactggaaaaagtgaatatgtaattgatctgtccattttcaaaacatttatacaaaaaactcaaaattttacttcgttcatcaaagatcaaaacataaaaaaccttcgcaaatttgttggatatttcggtgcagcaatcaaaaagtgttacgcaggtatttttataaaataaacataaatagcatttttttaagttccaagtgtcgactcgagaaaagtcaaggggcagaccggtttttaaagtagccattgtgtgaaccttgaaaattcagagcaaaatcacaatcacataaatttttcgagactcccaaaaatcccgtaattagggaaatggcaaactttaaaaaacagtttaactcggtttgaaaaaatgacaaaaaatgtcaacttgggtttcgattctatttatgtaattttttgtaatattacagtgaaattggaatttttagctcacttttccgcgaagtaacaaaattcttgaaactttaaaggaatggttttagattttaagtaaacttaaaaaatcggattcctgtcaaaaaaaagtctaaaaaactgaaattcctagctaaccctggtgcacaatatacaaaattatataattttttttgaatatttagaagcaaaaattgtcccaattattgttcaaaacgtacataacacaagacgattaaagcgtaatgattacggtgaggaggaaatacagcagctgctcgtggacgcaaatttttccaaaattgtcatccatctcggggccgccatggacctgcgcttgtgcccggacccaccaccaaatttgctcgatcgcaaccggggccgtgccgcgcgaattgtccgcgtctttctttttgccatttttcttgtcatctttggcattctgctcatgcgtttttctggcctaaatgtgcactccatgg

SEQ ID NO: 16322 - DNA, 3002 bp, Heterodera glycines
acgttgcagtcgtcgctgtgcgtttgcacgtccattcctcacacggccgcggtggtggaggaggaagaagaagcgacgcatggccggaagctgaagcttaaggagcacccggtgaccgacgaatacaaagtgtcacatgaggtttacgcggtccgggctggggggattttatccacccatgctcaaccaacagatcgtcggcattggcgaaagcggtaaagttatggtaagcgagcatataaatattgatcactgttttttgggctttgatcagagataaaaaccgttcgccaatctctcaatttttactctgataagcgggcttttttaaataaactgttgtttccgagtaaacacaatctttggtgaccgatcaagcagcagttttctgctgcagcactctgatcattgataaatgctgatcacttatcgaatttttctttttcttctgctgatcactcactttctccctaaggcgtgtttccataaacgacgcggcgaaaagtgcgcgctcaaagtgttgcgtgacaatgcgcgcagtcggcgcgagttggcgctgcatttgtcggtggttgggcatccgcacgtggtgtccattgaagacatgttcgagaacagcttcgacggactcaaatgtttgctagtggtggtcgaattcatgggaggaggcgatctgctgaccatcttcgagcagaacggacgattggcctactcggaaaaatgtgacaaatggtcgacaagtccgaaaacccatcccctttcccataaggtgtggcccgaattgtgagccaaattggcagtgctgtgcagtatttgcacgagcggaacatcgcacatcggtgggaaattttaaaggaaaaaagatttttggatttcatgagttccattaatttttactgggtaaataattttttaattaattaaaaagtaagttttacaaaaatttttgaaaattagcgcaaataatttttagttgccgaaggttcaaagaggtcaaaatcgtcctgaggcgataccccaccaagccaaacttttagggccttccctggattccctcacaaaacaattgctcttaaatattgaaaatttgaataacgtcccgagaaatatgtcaatctcgagaaatgtcattggattcatagtgagttttgcagggacattaagctggagaacattctgtgcagttccaacgcagtggaaaagtgcaccttcaaattggccgactttggcttcgccaaacgcacggaaaagggccgactgatggagtcgccgtgctgcaccccggcgtatgtgtgccccgaggtgggcaatgtgctaaattaattaataacggaggcaaagggacactttcagattctgaaccgcaaccattacgacaagggatgcgacatttgggctttgggagtggccacttacattctgtgagtcacagaagggcaatttttgctgccacaaaatggcactccaaccccaaaccgtctctttgttttcagtttgtgcggttacccacccttttattccatgcagggccttccattctctccggggatgcgcgaacggatcagtgagttgagaaaaaacgaaaaagtgccaataaaagcgaattcagtggagggaatgttcgccttccccgaggacgaatggggcaccatttctcactcaagtgaaactaattcggaccaaaaatcaaatttgattaacattcagctaaaaatatcatcgctgcgatgcttaggacggaccccacggagcgaattaccattgaacaagtgggcaatggggggggggaggggggaaagtgcgggtgccgattggacactaagcccaagtttgtaacggaatccagaacatgattccaagattacaacattatactgtactagttctgaaactcctatcatggaaacccaatcttataaaatggccccgttaaattcgattttccgggctctaaattaagggcatctttggcaccaatgcatagcttttgcttcattaagctgatggcttcctctttggcacgtcctccagcccatctttctaatgcttttccgcttccccccgtctattccgattcgtcgctttccgacggtggtttcgagtctgccgcggagacggctaagattttctcatctgcggagagcggaagcgaaagtcacacggaatgcgaatgcaaagtgctgagggaaaagactaaacggagggcgcacttttttgtcggcagtggcgcgaagtcatcgctgaacatgccgaaaatgggcgtgccattgccacgggaacgcgtgtacagcatacaggtggacaaagcagggcagggcatttttatggaaattttggaggggggggggaggcttattttaaggcatttgggaaatataaaagcgaaaatgcaggaaaatgtcagccatgcgctttcgatgatgcgatttggcggagattcctgtgcactgcaagaactaaaaacagtgaaaaacaacgcattgttggagcggagaagagcggcaaaaacgaaaacagcgaaggcggaacaccaaaaagttgagagagacggcgaataatgggcaaagaaacagaggaaaagcacacttaagaagaaagcgttcatgtaattgtatttttgtcattttattaatgatcataaaacattgtgccagactttgctaatcaatggggaggggagaaatgttgcaacttttgggggtgtttttgatttgtacttcttgatcacatttactgctgggagttttggctttgccattctctcactccgtttgggtacgatcgcaaaatcagttctccgactgccatcattgccaccgtgacaaacacgaccaatctgacaaatgaaatgaatttatcaatttgtttggctttgatttgtgtctcacccgacgaatgcgatcagaagcacgcggtccaaaacagtggcgagaaattcccattcgtaggcgaaccggcgcctcaatttcaggtcaagcattgctgctgcatttgcgcttggg

SEQ ID NO: 16323 - DNA, 4079 bp, Heterodera glycines
  misc_feature (1370)..(1370): n is a, c, g, or t
agatgtgtcgtcatcatcaaaggcatgtaaacagaaccgttaaaggcccaattacgaagaaattcagtaaatccgtttagtccatcatatctttcataatattcgttgaccactttttggctcgtgccgtcttcttgccttaagaaacccttcacctaaaataacaataaaaaatgaaaaaagttttttttcattaacctcaatacagtcctcagcatcaaaaatgtagagccggttcaacgatgtcagtgtgcgaatcatcagacatccgcttacacgatagtcacgatggctcctgtatgttggagttagtgttgtaaaacgaaagaaacatacccaaggtttggtagtggcgtaatacagccaaattcacgagcaacttcctcaagcattggcacccattcgatcagtcggaattcggtgttgaatgtgacggtcatttttttcaataaaatacacaacttatttatttctaacgtcattcagatggtttgtgtccggtggaatagtgcgcttacaatgtgtgagaggctgatagaacaaagggcaacaatcacacaatatgcagtcgacaacaacgaatcgagcttttgttgaaagatgataagtgggagcaaattgaagagctggttggggttttgaaatgtgctgaagaaacaacaaaaaggttcaccgccgagccaattttatttgtccttcctcaagcaagagcactatatgatgatgtgtttttgactaccgtcgctccaaattagcaccctgttagggttgggacccaattgtccggtacccattttgaccctttgctttacttgtatttccctcttcccttcattatgtcacgcccctttttccgcccataaatacccgcgatgttgaccctccccgttcacttcattcatttgtgttatttttccttcttgttatttaaatattgctccgcatttattttgtgtctttttcccctctgctccaaataaatattgattatttgtttgccatcggccggcataacataccccaaacggcagaaaaactttttttttgaacaagtctcttccccagatgaattacaattattgaaactatttttttgttcattttattaaaattgttatataatttctacatattgatgaaattttgtggggtttttccaaattaacatgtaaaaattaaatttttaccaaccaggaacccggttccgggcccggcaatttgaaaacccgagttgaccgggtttccgggttgaacgggttttgagaggcctggcccggaaccggttacttctggaaaaacagccccggcccgcccggcaatctggaaaacttcattagttttgccactcttcaaaaatggagacaaaaatntagtaaacaataccgtcctatatctattacttgttcctgttgccgaatttttgaacgcttaatagcaaaaaaaacttactgaattcttacttaaaaacaatcttatctctgaacaccagttcggattcctaaaaagtagatcaacaaccctcccaattaatctcctcactggaagactggtacaatgcgatacttagaaaccaaaaaattgatataatttatttagatcttcaaaaatcctttgatcaagtcccgcatgatcttttaatatacaaactcaaaaaaacggaacaacgggcaacttattaaattggcttcgggattttcttcttggaagaacctttaaagtaagaataaatcaaaaattttcaaatgaatttcctgtcaaatcaggagtcccacaagggtcagttctaggacctattttatttttaattttcattaatgatttgcctgaagaaattccaaaagaaatctcaattaatgcagatgatacaaaaatttatcattgctattcaaatgaatcccaacgtaaagttttagaaacagctctaatttcagtctttaattgggctgaaacatggggcttaaatttttcagtaaaaaaatcttccgtcttatatctaggtaaaaataacaaaaaaataccgtacacaattaaaaattcaactttccctgaatcaaaaattattcgtgatctagatattttaattgacaacaaactcaaattctacgaacatgtttcaataattctccaaaaagctatctcaaaagtagaattctttttaaaaaaattaaaaccaagacaaccaatacttggattacagtttataaaagttatattcgaccccttttagaatacgcaaccgaaatttggaatcctcgaaccaaaaaagaaataaaggtacttatacagttttatttatcgataaagaaaaaatttgccatcagaagggcgggaaccacttactctgatgactgatcaagtaaaatagtcacagagtaagtgaataaatatcaagtgagatcacaggttaaaaataaacaataacgaaaaatttatatgaaaataaaatcgaggtcaaagtcaataaaatgcctcaaaagttaataatttctttatacattggtgctttcagaatcaagagtcaattctaataatttttaaaggtgtttaatgagctagacattaacgttttattaagggcattccaggccttgactgatctgttaacaaaagatttggaagattttttagattgtaatttaacatataaccggaaaaatgacttgtttcgagtatttaagttagttcttttaaacagagaatttgggtccaaatgtgtaaaaccacgtaaaattttgtaagtagttaggaggtcaaaaatttttcttcgtttttcaagagtagctaatttaaaaaattggagccgttggtcatagggaatatatggaagacaacattttctgaaagcaattcgagtaaaatatttttgacatttttcaattttaataatatgtgattttagttgcggattccaagattcaggggcatattctagaagtggacgaatataactaacataaatatttttccaaattgcaattttctttgatttaataacacggaaaagtaaacgcatacggtagtaggcgttacgggtaattttgcttatatgttcggaaaaagtaaatttattgtcaataagaatccctaagtcacgaatagttttaacttcacaaattgcattatcattaattttatattgttccctggggttattctttccgaagtaaatgataaaagttttatcaatagaaattttaatataccatttcttagaccaatcagagagaatatttaaagcatggtgcatagcaattctatcattttttgttttatgtacggaatataatttgacagcatccgcatataattttatagaaatttgtttaggaattaattcccgtaaatcattaatatatatcagaaacaaaagaggcccaagaacagaaccctggggaacgccagagctcattttatattcagaagagagagtattatcaacccgaaccctaaaggtacggtttgaaagaaagtcagatatccagtttaagattttacccctaataccgattctatgaaccttatataaaagtaaattatgggggataacatcaaatgctttccctaaaatctatatagacacaatcgatattcttattattataaataccatcataccaattttcaagggttgaaattagttgtgttgtggttgatctgccctttataaatccaaattgatgttcggagaataaattgttctttaaaagaaaatcggaaatagcccaaaaaataaatttttccataattttgcataaagaacaagttaaggcaataggcctatagttcatagggttacttttttccccttgtttatgcaaagggataataatcgattgtttccatatagtgggaagttttcctgtatcaagggtgagtctgaaaatttcagtaacaaaaggagtaaacgaaagagaacaattttttaacagtctaaaggtaataccgtccggtgatgtgttatttctgttaggtaaagttttaagaactttaccaacagaaataatattaaattcaacgtcgtttattgttggagaagaaaaagaagtatcaaaatcaagagaataattatttacagtaaa

SEQ ID NO: 16324 - DNA, 1274 bp, Heterodera glycines
caaccgggaaattttaaaaattcaaaaaaattttaaacattaaaaaaaaattcaaattttaatttatatcaagtgaaaataatacaaaattatttggttttttatttaataaattaaattaatgaaaattttcaaacaaattttcttcaattatttcaaacaattaatcatttttggactaaatcatcgaatattaatagaaattcagctttgattttcacatcactttttttcggagcgctttttcaaaaaacttttgggaaagaaggggtccggcggtcgataggcgccgccgggggaaattttaaaaatttgggtgcaatttgttaacagattttcaacaaaaaaaggttggtttttgcgattattaagctcaattggtaggattttcatttaaagaatgataaaatatgtatcaatttaaaaaaaactatgaggaatcatattttctttataggaaacccacgagtatacaaaaaaaaaaattgaaaataatctaatttctgtagagggattgaaccaggggaaagaagaagggaaagtcaaggagactagccattaggccatttgcacacttaggcagtattacttttaaagaatatattaattattattttttatttttccctttgactccaattttcttcactaatttttcactcagacccccattcttaccagtgcttgtttttcccggttcccggttgccctaccgggaccgggacctgagcttttcaaaatccgggaccgggaaccgggacctctgaggaccgggaattcccggcccagtcccggcgcactctacttaaaagtgaaaaaagtcacattttggtgacattttgccaagaatttgattggcaaaccccaaaacttccccccgcgtcgtctagggcctagcgggcttttaccggaccaccccggtccaggttaattgtctgatttagagcccgatcccgttcattcaatctctaacatcgcacgaaaactacgaaactgatcccaaaaagttttttggaaaaagcgcgccgcaaaaaatttcattttgaataaaattttccagaatgtgattttggccccaaatgatgattttttgtcggccaaatgctgattttgaaaatttcagttggcagctctaacgctaataaaatattgttttaagtctatttttcatgtttttattgcgtttccttcactctactatttgtttttgaaaaatcttatttttgtggtaaaatcttagtttagcctcgtttgtccttattttgaaaaaaaaa

SEQ ID NO: 16325 - DNA, 1379 bp, Heterodera glycines
atatccgtcacccaaccttacagttggtggccccgattgatttttttatttaataaagcattacaaacatgcttcccttggttttcggggttgctgatacgaatctgaaatcagattaatacaatttcgaacccataaccccgaattcgaacatttttcgatttttttgaaaaaattttttttttcgtcgccttcagtgaaattccaatgaatatacagcgatttgagaagggtgctgatcattagtatggtaatgaaataagagataacaaataattaatatggaaaagcgaaatttaacaaaattcgattttttttgcaaaaagccgtgaaaattggtcctgtttctattattggatggcgagcatccctcagaaaaacccttacttattgaagtttttataacaataaaacttgtacgatcagtaataataaacggttgcattaatgcttcgtaactcatttaatttcagtgagaattaactaattgtaagataaaaaaaggttttttttttaaatttttgtcaaatttccttttacaacattttaggaggcaaagactacgtggtgaaagcccaagtgttggccggcggtcgaggcaaaggcaaattcgactcgggactgcagggcggcgtccaaattgttttctcgtaggccaatctttgtcttttttttcttttaaatgcgcaaaaatccgtttgaaattgcccttttcgctattcattcatcgaaaagcaatgcaattaatcaaaaaaaaaatatacccctaaatttttgttgcttaaggcctaacgaagtgcgcgaaaaagcgagccaaatgatcggctaccatttggtcaccaaacagacgacggccgagggccgactgtgccaggccgtgttggtctccaagcgactgttcacgcgcaaggagtactacttcaggtttggcatcagcgcatgcgcctgggaggggcgggggggggcggcgaaaaattgggtcgaattctttcgaaaaattttttttttgaatttgagccaactttttcgaatgattgatctgtccccggaatatattatttggtggcatggcatcatcttatgattccaagtctcttttatccgtcccaatttgtccactcttttgccttttcagcatcactttggaccgttccaccgccggtcccattttgatcggctcctccaagggcggagtcaacattgaggaggttatttcccgttttcgtttattctgcaaaatggttaacccgtttccattcaaagataagaagaaatgtattgaaaatgggtttttttttgaatttttcaaaataagtctgatttatgccaatttaaaaatttctgtgtccattaccatcgccgaaaagcgtgaaattgaa

SEQ ID NO: 16326 - DNA, 2649 bp, Heterodera glycines
  misc_feature (1694)..(1694): n is a, c, g, or t
  misc_feature (1767)..(1767): n is a, c, g, or t
aggtcccccccctttactttttgataaaattcaaaatctgtcactttcatatagcgccgaaatttctattaaacttacttttcctttctctgttttattctcattggtccttaaatgataatttatttatatttaaaatttaattattacatttttcgattgtttcccttttcttttcggccctcctcaaaaatgaaatgggcaattaacacaattacaataataaccgtaattgtatttaattttaacagtaccaaatctatgcctaggcaagcctcggcttaacctttctcatgccattcgatccacccaatgcttcgttttgtgttttaattacccaaaaaccgattattaataaaattaaattgtataattaaaacattcatcaatgatacattcaattctttttttttttattaaaatccatcttccgcccactttccgaccatcgattcactcgttggaagtaatgttggcaccaaaaccattaaaattatttcacattttttgatattgcccaactgaaaatttaaaaaaatgtctatttacaagtggaaacgcttttttcttttgttttttattattttctttctttttccttaccgtttcgaatttgccgacccaccaaatgacaaggaaaatgagaaagtcgaacggaaatgcccttttagtaacatttattcattcgttttgtctccatttttcattgttttattttaagaaattggaaaattttcgcgggaaacgccccaacaggtggccaattaagcaaatggcaaataattgagtacatttaattgttcaggtgcacctttcactgaccgatagaatgaatgagatgaacatcagctggttgacttttgaagacggcaaatatttcacttttaaataaatttattggcaaaaattttagttgagactttcgtcgaatattggcacgaagattcaaaaaacagaaaagaaagaaaatttgccaaaactattaagcacgaattcagggactttatgaaggtaatcattcggaaaagccaaaaaattgtttttgcattttgtttgccccccaaggatgaagtcggcttcaactccgatcagaaattggccgccaacttccgctacatgcacaccgtaacgctggagggactgtatgacgactcgacatacggtaacacttactgtaaccagctgctaacaaaattctgctcgcattaacttcaaaatatttaaactattttttaagttgtcaatatttggccccgtttcgctttttaaccggcaaattgtcattattacacaaaaataaaaaaattaatggggacgataaaaatgcagtcgatctccgtcagtttgttgtgattcgttgccttttcgatcaaaaatccgtctaaatttgtgattggttcgtcagatcaaaagaagcgtatcgatggttcgaatcggctccatttcttctccacttttccagcgctgctgtactcatcggcccggttccctctgaatgtcggccattgattggccaattgtatcggtcggttctaagccctctccccccgattgatctatcactgattgatcagtgatcccacactcattaatcccctcctttttctatcgatttttgtccctttgatgttcccaccttgtgcctttgttcagtggtgctaagaatcggtttctcggtgccgctgatccgtcanatggcatttgctgttgctgaacccatccgttggggccgagcagaaggaacagcgatggctgctggtcctcccncagcaaaaccattcgactggcgccgtgactttgtgccgttactgcgctggcgacacaattcagtagagaaacggacaaaagcactaaaaaggcaaaaaaaaaaatgtgaaaaaaagaaaaatggaaaacgaacggaatgccaaaagagaaagcatttgacgaaaagccatcaaaaattgagagggaattgaacggctgcgcttaacgattgaagcaacaggaattaaatgttttaagaaggatgtctggacactgaaacaacactttgtgagacaataaaattaattcttcgtggcattcattggccaatggattaataatttaattattcaattatcgactcgcaagggaatgacaagggcaaaggagaacgaatgaactgttctcataatgtttggttagtgaggaataacgaacactttgaaaagaaacagtgccaaaattcaattaaaagccggcattttggcatgtttttaatcataaaatggcaatttgcggtgattttttgcagagcttttcccacttttctctaatttacccccataagaatggcatactgtcacgaaaggatttacaacggcaccaaatcctgacaataattaaaatgaaaagcttttgtctttgctaaatccggctcttcggagaacaacggaatgaatgatggcggtaaaggcgtgtcgaggccaaggccacggccaccctcatcatatttaagccatttcattgtcgggggggataatattcgaaatggcgacggagaatgacggaagcggaaaaacgaaataaggacggacaaaacagaacagcaggcaaaaagaaaaaagaatgaatgaaagtaatgggcgaaggggggggggggaagaagagggggggggggggggg

SEQ ID NO: 16327 - DNA, 2484 bp, Heterodera glycines
aaaaaattcattaaaaaaattaatgcatttcttataataaagtgaagacaaatgaatattatgcctaattaaaagagataaacttaaaaaactgaaaagaatattttaaaataataaaagaaagattaataatattattatcatgaaaaataaacttaaaatggaacactaattttttggaaagtgattataaatgttaaactttaaattccgagagattcatactcaactcagtatcgtttctattcttgctaagtcaaatatcttaaaattaattcagaataactagttttataaggtttttacaaaaatatatattattataagaaataaatcatcaaagaaaagtaacgtttcatcattaattgaatttttcatcttaaagaatcatgagtgttcttgtattattgcgcgattatgaaattaaaggaattaaaataaattcaaaattcaagaaataaatttaagagagaaaaaaataatacttattctagtagtctctctgatctatctgatccaatgttacacgtgtcaaaaaaacatattatttgaaatgaattaattttaaaatttacaaaacacaataatgttttaatccagtccataaaacaagatttaattaaaaaattcattaaaagtaatcatcgttaaaaaattcttttttatcaattcgaaatttaaataccaaatttcatattaaaatttataatagaataaaaattcaaagttaaagattaagcagatttttttattcaagaacctcatatgagcgccattctttatcgctgccgacacaatactagaaacgacgaattcttcaacaaaaaattgctcaggtaaagcacaaaacattgtttggagtttaatcccgcgatttttttatattgtaaattaaacaattacatgtaacttctaaaaatttctatattttataaaatatctaatgataaattaatttaaattgagtgcttaatctttttacttgcacatggtttcgaacataatatgaaataataaaaaagataaatgtttttggtaaagcgcaacgctcatttaaatcagcatgtgcgacattctatataaattcttcttcataaaaataataatttctataaagacgacgcatattccgatttttaaattaattattaaattcaaaaatacatatgaaaacggatataaataaaaatttcgaaaaaagtcaaataaagttactgttactaatcataaaagaaaaaactttaaatatacaaaattttaactttataaatgggcacctagaaccagcaaaagaatggaaaaatgaaagattgagtattaaatgtgaaatttgtgtatctgttttttacttccaaaaaatttttacatgaattatataaaaaaaaagaattttttgatttataaatagtataaaaacattttttctttaaatcagatttgatgataatttaaaatagtatttgccgttttactaatttattttgattgaataaaattgttttggcgcgattaggatagtttattgtaaaatttctcgcatttattatgaaagaattgaacaagaaaagatggaatactaaaactgaaattacatctctgaaattttctattcgatcagttaaaaaaataaattttaatggaaatttttctaaaatctcctaattttatggtttgttgatcatgaaaatgaaatagtttttcgaagcaaatataatatatattagaaattataaaattttttcaaaatattatctaccgctttaaatatcacaaaattcaattatttgcatttttcgcagaaaacagaataagattattacaaaaattttgagatgtatttttttttgcaattttgaagctagaatctaataaagattggtatttttaaatttaaatccattttttagcgtatttttaagtctgttttagcaagtattgaatataatacatttttcggaattttttatgatttaaaagatatattttggtagttttagtcaaaattttgctccatatttggccataaacaaataaaaataaataaaatgtttaaaaaaagaactgaaactaaaataaacaatatacattataagtcataaaacttctttatgattataattttaaatttattaatgattttattgaatattttaaattcttaaatatttaattgtaacaaagaaataataaaattaattcaaaaataaaacccaaaagaagcaatgtcaaatttattttagataaaggacccaacccaaaaaaacatcaagcaaaatctaaacagactaatattatttatgatgaaacaaatttagataataaaaaaataataatttgctataatagtctcagttatcatttaaatttatattgcataattttttttattcgcctgttacttcaacatttacgggccatggtaaatccaatgctttaataaagcctgtatgaatttatgtcaaatattattaaaaaagaaatact

SEQ ID NO: 16328 - DNA, 1517 bp, Heterodera glycines
  misc_feature (1456)..(1456): n is a, c, g, or t
atgcctgtctgttttgccctttcttttttaagccttaatctctcttttcccagcctaatgtttccacttaatctttttatgtttccattctgtccttttcctttggcgccttaatatttaccaaccagactgccctcgtattcccccctctcgatgttctcgacccaccacccccttcccacgaatataaaagcgatcaaatccctttatttgttagttcttttaactcattctcattttgtgtcaggttccctgcctgcccttcctttgctttaaaatttgaatcacttactcacattttgccttgcttttgcttaaataaatttccttttaacttgttgtgaattgactaagttttgggtacgaatccacttggggacatagcactttttggtgccacgaccagggagtaagccgtcagtgctcccctgattcgtagaggaaatcggactggtcaaagtttagtacttccagtgccgaaattaatttgagctggtcaaagttaagtacttccagccggagatccaaaaaacagaaaactgatcaaatttcagtgagctgatcaacttgtgtagtttcagccgggcttagtgccaaagaaaacaaaaaaaaatggtttcgagaagtcaatcaccgattgatcaacaacgaaataatggctctgactaagtcgatcgccagacaagccatgtcaatctgtaagcaagccccgggggagaaagtttatgaatttgctaatcggcttaatgaagttgtccgaactgtcttatctggggaaaatgaaaatgtaatacaaaagcgtcttttggaggaatttttggacagattaagtccagatttacaatttgaggtaaaagcaaatcgcccagtggattattctaacgcatatgagttagcccagcattttgagttgttaatagctggccgaagaggaagtcaaatttcggtcgctgagcttagttcgaaagttgaggcccttgctattcaacaacaaagctccggcccaagggggggatatagccagcaaaataagagaggtgtttgtttttattgtcaccgccccgggcatttgataaaggattgtcgaaagagaaaatacgagaattcccagaaaaatggtcagagaaaccaaacttattttaatcgggaaaacaagagggataatcgtaattggggaggacaatgggaaagggcaaatggcgattataatgaaaaccggaatcgagaaagggagaattggaggactagacggtctccaacccctgaggggagaagaacgtggataagagagaaggagaacaatcgacgttacgaaaatgccgatgattacagtacaagagagcggtctcactcgcccgagaaaagagtgcgatttcaaggagggagaatcccagcggcgagaatcgcaagccctaattgcagttttgaccctttttggaggaactttgggtacaanaggtagtcccatgatttgtctgcccgacgcaccaacaagcctatggtcactacctgctgac

SEQ ID NO: 16329 - DNA, 1056 bp, Heterodera glycines
gttgttcatagtagagtagagcgggaccgggaattttgggcaaacccgggaccgggaccttttcgggttgaaaaaccgggaatttttggctgggaaaaccgggaaaaaacccgggactggtcccggtcccgctctactctacatagttcatagtaattatttaattcgataccgtacttcaaaaaatttttttgggggataataatcgagggagaggttctattcgagggtggggttatattcaaagaagtatgataaaatattgaaaatttcgagattgtttgagacaaaaatataaaaaaataataaatgtatatttatttgttattttgttacttaaaaattataaaatttaatgcctttttacgttatatttagggagtgtaattatatggatataaaatcgcgaaatatggccttaaaatatggaccaaaaatcgcaaaatatggacataaatggcaaaaatgtcaaaatatggacataaatttttcaaaattgagtgcaaaatttcttcaaatttaatggttgaaattgcatatgtatgagatacatttccaaattttttgactcggtaaggcgctttgacaaagacggctttcgttttgcaattagtcggtcaacattcggaaattggtctcgaattttttcggcaattacgtgcaatcattttaaaagaaaaaaaacataaaagctaaaatttattaatttttttagcgcaaaatcaacaacaaaagcgaaattttcgcttttttgcttatttttgacataatttattaatttttaagaaaatttaaatttattcaatattctcgagaaattttggcgaaaaaatgattttttgaaaaatttttcgggttttgggctcaaaaaggctaatttagctgctgggggccgttctaatagaggtttttttgaaaaatgccaaaatatggacataaaatatggaccaaaatgccaaaatatggaaatatggacataaatcgcgaaatatggaaaaatatggaaaatatggatatagaatccttcctagaagcttcaaaccaagctaaaaacat

SEQ ID NO: 16330 - DNA, 1548 bp, Heterodera glycines
aagaacaattgctaataatgctgccaatttgacacaaaatccttttgttttgtcaaaaaataatgcccaacaaaatgcgaaaaggcatttcaaaggtttgacatttcaaaaattaccctctcaaatagaaaaattaaaatttagcaaaaaatgataaaaattattgcaatttgtccacaaatcttcaaacgtttaattcgctgaattctcagagaattgatgagcatttaaacaaataatttggataaatattgcattaaaattattaaaaattaaattatttagccaaaggaaaagggctacaaattgctcaatcgttggaaaataagcgaccaaatttgtcgcataaaattcactttgattacatgaatcagttgaagattatgctggccaacaaatcggaaattgaaaaagtgcgaaacgcaacaattgatgccctcgggggagaatttgaaaaaggaaaagtatcgtaaacataaataatattaaatgaaaaactgattaaattacaacaggaaaatgatgcttattcaatttgcgcattaaatgcagcattagcaaaagccaaagaaatggtcgaacactcggaagaccaattggccgaagctgaacgcatttcgaaattgcaagagtaatgtggaaaacgatcaaaaagcatgacaaagtgccaaaaaggatgtaataaggtcaaaaaaatgaaaaacatttacacaatgccgtgggcattgtgccgcggttgcgcttcatcggtttggtgctttggcatttggccgttcggtagagtccgttgattgaccagcagcagcacgacggggcaccactgctggtgttcactgccaaaatgaggccaaacattgacccgcatgacccgacggaatggcaaacgatgctttggcaattcgaccaaaatttggcgaacgcagcgatggcgacggaaggccaaaaagaggcgaatgaaggggaaattgaggacggaaaaggggagggggaggaggagcaaaatgagggggaagaagaacgagatgtgtgccaataaatagagagtgcagagaaaaaaacatctctcattttggcgtactatttatttatctctgttaatagagaaaaactgaatttacttcgtgacgtttaacttttttcctgcacgttaaatccacaccaaattttgcatatcgatagagcaaagaattctgcatctttctatagtgaatgtaattttgtctatggtcaaactcaaaagttacaagtttggaacacccatatcttttttctgattcatcaaattgcttagcatttgcttagaaaaagtttctccttaccaagagctttcgaatgatattaagattgtacaatttggttggtaaaaacctccaaaaataattcccaaaaatggtcatttttttaattttttgcacaaaaataaataaaaatattcatgttgcacaacggactcgaaccaacaccctttgtccctttactatcttacaaaaaccactgagccacacatgcaaatctttttggaactgggaggccaaaattgaaacggtg

SEQ ID NO: 16331 - DNA, 1266 bp, Heterodera glycines
  misc_feature (22)..(22): n is a, c, g, or t
ttatacctctacccaaattatnttggttattgtaataaaatattcttaaaaattatggcaaaattaaataaaaatttagtggtcaaataaaatataataaatgttttaataaatgctctactcaagtggtcactatatataaatttaaaaaaaacacttttatataaggggtgtttttctgacaaactgaaaaatgaattttctctttaaaatataaaaaaccatctaataatttgagcaaaatttgctaatgattgaatgtttaattgatcataaatagtttttatcgggaagcataagccatgaataattggattttccagggaatcccgagcttttctttttactaaaaaggtcttctgagttgagaatcctgaaaaagggaattgcacccatttttggaatcgcaaaacttaataacccaaaacatgggttcaaatttttcacaatttcgccttccaatcaaaaagaaaattttagcggtttaagaacaataaaaaaaatttggagtgatttatgcccttgattttcttgcttaaatacacgccaattttgtgcatgcacttaagttcaacccatggcacagtcacaatgccaaagtgcgtggtgccatctcagccagacaattatcacgggatttcgcaatgccctttattgaaagcagcttattcaaagctttatgattttattaaagggatatattttcttttgcctctccaatgcacttaagtctaacccacgacacaatgccaaagtgcgtggtgccagagatgccagacaattctcatgggattttgcaatgcactttattgaaagcagactattcagagctttatgattttattaaagggatatattttctttttcttctcaatgcacttaagtccaatgcacagtcacaatgtcaagccaagtttgtgccagacaatcattgaattttgtaaataccatccattttttttattcaaataatttaataaatattatttttactgggtgccaatattttttgctctaaacacagccggcggaccccgcccaagttcccaaaaagtttttttgtgaaaaggttctacaaaaagtgccgtgaaaagcaaagaataaatcttatggtgtttgatatgcttatttcttctacaaaaaatgttaaggtgataatggaggctgaaatataatatttgatcattttaactagagtgagcgtgaccgggacttaccaggtcagaaaggcgggaccaccgcgggactatcccagagaaaattttt

SEQ ID NO: 16332 - DNA, 1859 bp, Heterodera glycines
tcccccaaagtgcgcaggcagcaaaaaagaaagtgtatttcgtttatggtactcaggtcacagttacagctgtacataacggacgcggaattaatcttggagcaaccacgggagaaggtgttgaatcgaaacaatatttggagattgatacaaatgtgtggaacggaatgaatgacaatgatcagattgttttccatgttcgcacaccgcatagcgtggtaacaataaaattagaatgatcaaattactttagggggtgtattttctaaaaattttttggtcatttctttggggtacaaatttttttgtttttgcatttttgttaatgatttttctgaaaatccttcaattaggtaacaaaaataatgaaataggtataactaatagagtagaaaaactcccaaataggtaaggataggtattataaaattgggtccatgagctcaaaaccaacgtaaaaatggtttttttcccgcttatctacacgtattaaatgcgcaaacattttggtatttcctaaaaatcccaagccctattcattaaaaaaagacttgaggatttgcaaattggagaaatttagtaatcgaaggttgctcattgatatgaataggactttcaaagataattagagtggaattgcttacacaaaacagctatgaaaatcggaacttagctaaatttaaaaattttgtgaaagaattttatttatggtaattcatcccttttattttaattttatgtatttttactgtattgaccatatcatatttttctaattgtattcatttctttgttttccgctataagtgcaactatgttgccttgcggtttgctcaaataaataaataaataaataatttttttttgccaaaattataatacgaaaacccgttaacaaatagagccaaaatttcctggcgttgattgactccctaaaactcttttttcttaaaaacttcctcaaaaacggaaaattcattccaagtttttctttaaaaattagctcaaaatcgcaaaatttgtacctatttttaatcctgtttaaatcaagttaaatatattaaaatgattttcatttatctcatctcttttttttctcttttttatctaaaaattagaattaataatttatattgaaaaatttttcattaaccgaaacctaaaaccgagggtaccgattaacaatcggtggtgacctaccctttttaatgtctaaaaaatcatcggcttaaatttttgctaatttatctttttcagactaaatgtgacaaagctacagtacgcgaattacgtcaaactgatcaaccgaaagactttgctgatcaaacaatccgaacagtttaatgatgaagatgagtaggaagcaaaccagcagaagaacggctttatgtatttgacttcatcagatgtcattttcattgctttgttgatgccatttttggcttgttgaaaaaaaacattttttaaaattttttgtttttctgttatttcttgcagattttggggatcattactagagaatagagcttgcgcgaacgagattcccgcgtgaaaactcgggaatacgtttcccatcttttttcctggacgagattttttacgggaacaggaaaaaaggcgaaaagaccgtcccgctttttttcttttcccgttcagggaaaaaatttccttttaatggttgtcaattgattaaaaaacagaaaaatttcgaatttttttcggcagcgaattttttttgaaattttagaattaggtattaaaactgttaatgaaaatttgttgaattataaaaattttgttcgttattgtggcccgtcgcatttatttggcccgtgccatcgccgctgtcgccatcaatg

SEQ ID NO: 16333 - DNA, 3011 bp, Heterodera glycines
  misc_feature (664)..(664): n is a, c, g, or t
  misc_feature (2929)..(2929): n is a, c, g, or t
  misc_feature (2942)..(2942): n is a, c, g, or t
agacaacagctgagccatactttcggatgcattcgtcgtaaaatccttaaaagtttatttattttttaattaatttttattttttgacaccaaccgtaaacttgtgtgatttgccgcgattcgtggttccctctaatcagcacgattcttcaaaagaaaatatttctgaactgctcgcaattttccaattgcctgtccgggtagcgaattttgagtgccaacagcagcagaaatgtctccacggagttgaagccgcggtccacaaagtcgccaaggaaaaggaaatttgtgtccggcacgtgaccagccactcgaaagagttcttttaggtcgtggaattggccatggatatcaccacaaatctaaaagacggaagtttgtttggtttgcattttaatgtgaaagtccagaaaaggagaaggggaccgtcacgggagcatcgattcgctgcacatttccctcctgaagaatgatttcgcgggccttcgaacacaacactttcacttcttgctccgtcagacactcacaacgcatcagcacttctatctgtctgcaaaacaaagaaatatttagtaaatgcgtgtcacttcgtccgtcctctcttaccggtcgatgtcggcgattcgcattccaatcccaccggcggcgacgcccaattcggtgngaatcgtggcacgaggcaaactgtcaccaatggcatcattttcgtttaccgaaacaatgtttgaactcatatgtgttggatttgatgacgctaaatccaaaactggatcagaatgacgtccatcttggtctgttccatttccattttcaatttgaatctaattaaattgcaagggaaaatatcgtgtccagacatttgcgacctgatatttgcgactatgtccaaaatcgggtcaaacttacattttttcaatcttagaggtcttaaacagcattgaatttaagaaaattcgttcttttgggttattaggaacaataattatgttgtttgaaagattaattattttttcaaaaatttgctgacgataaaactatcacataaaatcactttcaatcgcttatttaaagctgtttagtccattgaagatagaaaaaatgtaagtttgaacccaatcttggcattcaaacccggcattagttaattaactggatttcctatgattaggaattttatcaaacataaatatacttgttttccatttgaatgcattggcgtttttttacgacaatgattttataaatttttcgatcattaattttcctttttctgtgaaaatcacactcaaaaagtgtataaatatggccacttttcgagtcaaaaatcattccctccagttttttctcattttaatttttaaccatcaatttgtcttctaattgtgtcacacatttcatttagcgttcacacattttgccatctgtcaaccaatcatcatcgtcaacatcgtccgtcaacagttcaacaacaaaacgttcaaaatgtctgcggaatcgccaacaacatcacaacgccgtgctcgcagtcgcaagacgaagaaacgtgcggtcagcgctggcgagaccaaaccactgcgacgctcggcacggattgcggcacagaaagcggcgaaggaaaaggcagccaaagtgacgttttcggacagcattcctcctccgtcgtcactcattcatttccccttttttcagcagaaagctcgtgacggctccaccgcgtcaacgaagtctgctggtcgtggtcgtcctagtcgctcgccgaagaagtcaggcccgaagagtcgtcgctcgcccgccggtcgtggaggaggacgttctcagacgccgcgcaagaagaaacaaccgatgaagaaggcgccgggcccgagcagtcgcactcctggtcgacgcgtgaagaaaccgccaacgaagaaatcgcctgctcctcgccgtgcaaaaacctccaccaagaagcgcggacgtcctgccaagaaagcggaacaagccgaaccatcggacagcgggacagccgccgacagtgaccgcgacgacagcgaacgtgagttgaaacggggtgtgggaatggcacaattccaatttgtgtccattaattaaactgaattttcagattccgaagagagtgccactgagacgaagaagaagccaacccgcaagactgccggtggacgtgccaacaaacagacgaagtcgcgtgggcgcaaaacaaccaagaagacggaccaggaggaggagcgcgccgactccggatccgaggccgaagctgcaggctctccgcgcgacagtgaacgtgagttgaatgggggtggggaatggcacaattccaattgtataatcctaatgaaattgaattttcagattccgaagagagtgcctcggggacgaagaagaaaccaactcgcaagagcgcggctgctggacgttccacgaaacagaaggcgtcgcgcggaggacgtgcgggaaacaagaaggcgcaggaagaacgctctgaatcgccaactgaatcgggctctgatcgcgaggaggatgaagaatgaatgagccagccggagaagaatgctgcttcacgagaccaccgcgataataacactaacccccatttaaaaaaagagaaattgtatctctatatatgtatgtatatattgtatgtccatatccctgtggcattgtcttgctgaatgtaattctcccacaaatggttgttgttctatttaaatatgccatatatatgtgtattttttataattgtaatatgtttgccctgtttatgcatcttttatggtcatttattctcattgccgaataaatacatttatttatatgaatgagtacattttccatgtcatcaattagggagtccaaaaatatggatataaaatcgcgaaatatggccataaaatatggaccaaaatcgcaaaatatggaaataaatttnttcaaatttgctnaaatattgtaaaacttacaaaaaatggctaaatgtggtattaaaaccattttagaaaaaaaaaacatga

SEQ ID NO: 16334 - DNA, 2070 bp, Heterodera glycines
aataatcttttcaaaaagaaaagccgaaacggattctcacttaaatgtcgtttggcttttgtgtgcgtgcaatgagtttctggcaatgtcaatcagtcgcagcgcttctttgacatcgatcatttccacttcgtccgcgagacggagacgcgcaagagccgtacacatgcgaattgccgcctaattatgggacgtaaataaaatattcatgcgcaaggggtctcgagacaggtcaaaatttcgaatttctgttaacaaattgcaaagtcggattggtcgagaaaccctttgcgtatgtttgaaaaagggaaattgcacaagtaaaagacgaggggaagtgaaggtcgagtcgctgctgttcttcgcctcacagcgcatttcgacgtatttctccaccagcacttcttttagggcattgggcaccacgggttccttacgtttgcatatcgaaaggtactttctaaaaattgcaggaaataatagcgtttgattaatcatttgcctgaagagtttcatgttaattggttcgaaatcggcttgcggttgttcgcctttacggtgcacatatgttatatggtcggccaatttgcggtcggtttcgcgatcaggcacatcttggataagccatagcaggtcaaaacgagacaagagagcggccggaagttgaatgttctcttcaatcgacttgttggggttatagcgcccaaatgcgggatttgctgctgcaataatcgaagtgcgagcattaagcgaagtcattatgcccgccttggcaatcgaaattgtctgctgctccattaccttaaaaccaaaatgaagccaaagcaattgctctgacaacacttcgtgaattgcagtacggtctgaatccaccattttgtcaaattcgtcgatacaacagattccccgatccgccagcacaagtgccccaccctcgagtgacatttcgcctttattaaaaaccatttttgaattggtttgaaaagtttaattcaccagtcaactgatctttgaccactgctgccgtcagtccaacgccacttgaccccctcccagttgtgtactgacttcgaatggcaaggcgatcaacataagtcagaagttgtgacttcgccactccggggtcacccatcagcaaaatgtttaaggcccctaaaactcaatgtaacacggtaaaaataagtttaaaaaatctccaatttttagcatttgcggacccgataaaaataaaattagaaatttcttttgcagtgattaagcggataaaagggggttgatcacaaatcttgcctcaatttgccaaattctgaatcccggaccaaaaatcttaacaattgccaataaatcacctctaattttcattccatttgcgttcttgttaacaccaccaattaaagcgagaagcaaagacttctttacatcgctgagaccgtaaatttcgggcgcaatactgtaagctaaaagaaaaagaatgaatttgaaacacccaatggaaaccaaaacaataacataaagaagtattcaaatctgctaacattttgcttaccaatatgttcataaaaattctcatggctgactaattcgatttcctccgcgttcaactctccatccaaaagatcttcatttgtatcacgataatttttgacatgctaaaaaatttaatatgcaaaaataactataaaatgaaaacgtacataagcatcgagaaacagctcagtaacaagacctccagccatttgccgaaacccggtacgaagcattgggatgagaacgccgcaaatctcgacaacatcgccaggaatagcctttctcgtgttttccccactgagataaatggtcattgagcgagggatgctgccaactccgacttggtcactctaattttaagtgcggtgaaaaggatgcaagttagacaaagcaattaccaattcttgaatgcgcatttcttgaaacttcacaaatttagaaccgcggaattgcatctccaaacggccattccgctttgctttcaatggcattgtttgcttggacaattgtacagtggcgtataagacagtgaattcacctatc

SEQ ID NO: 16335 - DNA, 844 bp, Heterodera glycines
  misc_feature (17)..(19): n is a, c, g, or t
  misc_feature (44)..(44): n is a, c, g, or t
gtagttcgaatacaccnnncacgcaagataatcaactttccaancaaattgcgctttcaagtctcgaacagccaatggtttcgtcacatccatcgttttgaaataaagttcactaaaataaatatttttactacaccatgaagtttatattttatcacaaaaagtgaccattatcttttattaaaggtaccatacaatctgcgaaggagttcaggtggatatgccttagatgggtcatcttctcgggcattcatttcacctctggcaattttcaacattttgtccatataaaggcgttggaagataaatgcgtcaagcgcatcaataaccgcaggctggattagaaaagtaaattaaaatgtgaataatatcaaaacaaaacttcgttgttgccaattgtttcctggacaagattttgaacaatttcataaaagagttgtcgataacgcactgtattgaaagtaatccaatcggaaagttcggggtcatgaagatgcacctaaaaaggccaaatgggatgagcagtatttatacaatgttacatcatcttgttcaatgtagagagcaatttgctgtctgtgagcaatttgactaatctgatctcggtatttgaagactttgcagccttcttcgtcctcaatgtaaaattcgtgcaaaaaatctttgatccgttctttcacaaggtcataattgggttcagccgccatattataaatctaaagaagaaaaaaaataacaagcatatgccaaatgcccatgccaataagcaaattcgttttattcaaatttattttattttcataacaaacatttttcaaattcaaatttaacgcccttaaaatag

SEQ ID NO: 16336 - DNA, 2327 bp, Heterodera glycines
tttttgggaaaaaaaagcctttacaaaataatccccttggagaagggaggtggaaaacaagatttcaaaattttcaattttttttagtttaatctactcaaaccggttcagaattcaataaaaattacattcacggtgcgaaaaatggggtttgacaagtttattggggaaaaaaagactttacaaaataatacccctgggagaagggagtgggaaacatgatttcaaaattttcaattttttctagtttaatctactcaaaacggttcagaattcaataaaaataacattcccggtgcaaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattttgaaaaaaagactttacaaaataatacccctgggacggggcggctcgtttcccccccgccgattcccccccgccgtttcccccccgccgtttcccccccgccgtttcccccccagccgtttcccccccgccgtttcccccccgaatcagttcccccccgcatcgtttcccccccgagaaaatttaaaaaaaaaaattgctaacttagaaatttttcaagaaaaaaatcttagaaagtttttttacaagaaaattctaagaaaaaagaaatttttgagaaatttttagcgatttttttgaaatttttttgaaaaatcttagtaattcaccataaaaatttctcaaaaaattttttttcttagaattttcttgtaaaaaactttctaagatttttttcttgaaaaatttctaagttagcaattttttttttttaattttctcgggggggaaacgattcgggggggaaacggcgggggggaaacggcgggggggaaacgaggtgccctcaaaaagtttgcctgccaatttttgaatatttttttcgtcgggacaccaattcttgatgattgccaatttggcattatgcaattttcgagtctgggacctagaacgatatttatatttacctaggagactattcaatattttgtccgtgttttagtcccggtcccgacctaccctattctatatgtaaatgaatacatagtggtgttaaaaattattggttttatctgattattagggatgcaacttttagtgatttaactattttttctgctcgattcttttgaagaaaggagctcaaaaaacgcatttctgcgttaaaatttttcgattcccgcccccggcgggggtgacgggggcggggtccgaaccctaatttcaacattttttggaaaattccttaacaaaaatgcaataaaaacaaaaaatacacccctaagaatcgaccaaaaaatttttttaaaatagaccactatgaattgaaaaattttttcaaaaattcttaccccaaatttgttttcttgacaaaatttttgatttaaaaaatgtcaatatttgctaagagaattttataaaggaaatgtagcacatttgcaactgcaatcagtgaataaaaattattttttgctcaatttttggctgaaaattatgtaactatttgccactatttcggaatttttctcactatttgtcactattttagttaactatttcgagatttttcatcactaaaagttacagccctactgatcatcccctcattttttaatccatttgaaataatatttatatttttttttcgtttaaccaaattaaaattttttcacagtccaaatttaattgtttttttccattctttcagctgtcaaaggcgaagatggaggagctgtacaagaaatacgaactgaagctggacgaaattcagcggggcatcgccgaacagctcacttacatgtgcgacggcaccattttcaattcacaaattttgaaatttcatttttttaaaaatgcttcagggaacaggtgtgcgtcggcgccgagcaccagggctcaacttaccattaccatcaggtgggtttatgtacagcacataaaacaactttttttggatgggtacagtaatgctgggatgtggccgaaatacagtaacaatgatattggaagacaattccaatttggcatatgcatttcacagcatttattctgcggccttttttccccgaaaaactcgctaaaggaaagggccggcggtgccagcgggcgccgccaggtgaaaaattgagaaatttggctatatttttaacagatttgcaccaaaaattgttcggctgtggtctt

SEQ ID NO: 16337 - DNA, 2822 bp, Heterodera glycines
  misc_feature (67)..(67): n is a, c, g, or t
  misc_feature (123)..(123): n is a, c, g, or t
  misc_feature (182)..(182): n is a, c, g, or t
ggaggagagaagcgcattgggccctactccttggatgggtggattgaggcggaacgacgcgcaatgnaagtcaatggtaattgagttaattatttttcaccattattataaaatgggcaattntaaggctgcacgtggcatgggtgcaaaaagtgctacccaaacgacaacatgctgctccncagtgggaagactgcggggcaagtgcgcgaacgggattccaagcggatggaatttctgagagagaaggtcaaccgagtggacgtctactgggaatgcgaaatccatcggatgctggagaggagcaaggaaatgcgcaaggcatttgaagactatgtcgatgatggcccgctggtgatccgcgacgcgtttatgggagggctaactggaccgctgaagctgctgcgcaaggctggaccgggagagaaaatctcctattatgacttcacatcgctctacccgtacataaattgagcacagttaaatttgtaacaacttttaacattttttccttcacagttttaccacctgctaccccattggcactcccaaagtgcatgtgttgaaccaggaagtggagtggcgcagtgcagcggacaacccctaccctttggcattgctcaaagtgtgggttgtgcctccccgacgcgtcgacgtcccagttctacctgtgaaagttggagagcggctttgcttccccctgtgcatcacttgcgccaaagagcacccgacaggaggagtggacaacgactaccactgcgagcattccgacagacagcgggggtgggtgagcacgtgcacctccattgagctcaacgaggcgttggacgagggctacctcgtcacaaaggtcttccgtgtcctcgagtatgagcaaagtgacgacaagctcttccgcccgtacattgctgagtttatggcccagaagatccaggccagtggatttgacaacagtatcagaggcaatgcggagaaggaacaacagtttgtccgagagtgcgcagagcagtttgacatcaccatcgacccaaccaaaatggcggtcaacaaagggaagcggtccctggccaagctctgcttgaacaacttatgtgagttttgtcgtccattattattatattaaaaaaaatagggggacgattttcgcttaacaactttggtctcgctcaaacactcatcactgacgacccagcaactttggcggagtacctggacaacaaatccatcaaagtgacatcaatcgacgagttggacgagcagcacatactcatcacctatctgcagaagaaggattgggtggatgagcactcatgctcaaacattggtgagacacacacactcacaataaattgttaaagtacttcagtcatctctctatggaccacctcagcagcgcgcctcgttctgctcaaggcaatgcagaaggtggtcagatcaccgggctcggatctgttgtacactggtaagtcaaactacaaaaaaaaattttgtgcacaaacatttattttagacactgacagcctcatcctcgtccacccggaggagcggtgcccgttgaaaactggcccccacttgggccagttcaccgacgaataccccgaccacgacattgtggaattttgcagtggcggagcaaaacaagtgcattttcagttcatttttgtttacttttcaattttaccacgctttagtatggtctttgtctgcgacgcaagggcgcggaggcgggagcccaattggaacatgtgctaaaagtgcgcgggctgacgctaaattatgatgtgatcaacaatcaagggatgcgctatgaaaacttcaaagaggaggtggtccggtacgcgacaagtggtgaatacgagccgataatcatcaataccctaacttccttcgcctaaacatcagggagggaggtcgggtggtttccatgcctatgcaaaaatgctatcgcccatttgtgggaaagggaatcatcggggtcaatttcaatgtgctgaattttggacacacattgtaatttgtacattatctctctctcacacacacacacacacacatatgactgtttcttttgtacctcaagttgtgtacattttatgccattttattagtttttaataaaaatttgtgcattattagtgaatggaagatgcaattatgaaataattaagcattagaagatgtcatttttaggtagaaaaaagtgcataattaagctaaagaagacacaatttttgaaaaattaaggaatggaaaatgcaatttcaaattaatagatggaagtggtcattttaaggaagaaaaatgcataattagtgagcaaaaacaaaactaatataacggtacagtactctgtgagcattcattgcgtccgatgtcttcatccatgtctccctcaaatactaggcgcattgttgtgtcggatgagtttgacgacgattgtttgtcgtcaatttcagtgaaaagacggcccagccaatgctcgttgttgttgatgtccatgtccatgttgtcatcaatcagctcaagaagttccattggatagtgccggtcctcccctccccccgaaaagcgttcaattatgcacggtgcatacgggaagtgaagctttatgcggtgccgtgcataaaaatgtgccgccacattgatgttgaacgggttgcgcaattgcccatatgcaggaagaaatgcggcgccttgtgccgaaattccagtgacgaagaaagttttggtcatcccattacgatggttgtaggtggtgcgcactttgcgtccaatgatgttagaaagacaagcggccgatcctctgggtggtgagccggtcg

SEQ ID NO: 16338 - DNA, 2042 bp, Heterodera glycines
  misc_feature (11)..(11): n is a, c, g, or t
  misc_feature (1990)..(1990): n is a, c, g, or t
  misc_feature (2012)..(2012): n is a, c, g, or t
taaaagttttncgtggcaataaaaaatcatattcaaaaagcgttggttacgtacaacatcgacaattttatgaaattttcttagcttataaaacttggtgaatactagagcaaataaaaccattttatgctcattttgaagggaaaattctggagaatattgtaaattttatttggtttggccttaaattgtggacttggctaaaaaagaattaaaattattgaaaatttcacctagttgaaaaatttttccctatgttcaaattttcttcaaattttgcctaggatagttttttgaccccatctatcgaattctcttttgttatttgaaagtttcttttctaactcgagattggctcttccatttttacaagggaaaatccccggaaaattttaagttttgcaaagttttggcgttctgattactaaataaataataaacttatttgtacttggagcccaaaattgaatcgccgtgtaaagcttttttttttgatatatttctatatttgtttgaaaaaattattcaatgatttcatcaaaatcttttttcaagtcatttactagaacatttttgggaaaggtaaaacattacaccttttttttgcgtgcgcttttttcataaactttttgagaacatgggcggggggggggggggtccgggggaaccggccacttcggcgcgggccatttcggcgccgattcaaataacttttttcattatcaaccaaattaaatatttttattatcattcgatagctcttgagatctctattagtagggctgggaattatatggaaatccatatttttttcctggactgtggaaggcctgaaacgcacgaaaaacatgtttttagcttggtttgaagcttctaggatggatttctatatccatattttccatatttttccatatttcgcgatttatgtccatatttccatatttttccatattttggcattttggtccatattttatgtccatattttggcatttttcaaaaaaacctctattagaacggcccccatcagctaaattagcctttttgagcccaaaaaccgaaaatttttcaaaaaatctttttttcgccaaaatttctcgagaatattgaataaatttaaattttcttaaaaattaataaatttatgtcaaaaataagcaaaaaagcgaaaatttcgcttttgtggttgattttgcgctaaaaaaattaataaattttatctttcatgtttttttttttctaaaatgattgcacagaattgccgaaaaaattcgagaccaatttccgaatgttgaccgactaccgtatatgctctaattatagcccagtctctattaataccgcagtctccaattatccccccccccctttctgaggagtttaaaaaataatcacccagtctccaatacggtaattgccaaaacgaaagccgtctttgtcaaagcgccttaccgagtcaaaaaatttggaaatatatctcatatgcaatttcaaccaataaatttgaagaaattttacactcaattttgaaaaatttatgtccatattttgacgtttttgccatttatgtccatattttgagattttcgcaattttatggccatatttcgcgattttatatccatatttttaccagccctatctattagcctgcaaaatttcaaaaaatttcatccgtttacaaaaaagttatggccaaaaaacctcaaaaattgactttttcttggctttttcggcgccgcgtgccataacttttttattgttgaatcattaatttctattttggcatgtaaatatagagcacacatagagctttcaaatgatgccagaatggctaaagttgactgacaaataaaaaagttatagcatttcaaaatttgcggcggcgccgaaatggtccgcgccgaagtggccggttcccaaaaaagataatgtttttctctggcactctctatttattggtacacatctcgttttttcggacggntgtgttaacaggtcttgcccanaatagctttatttcgagcggagtttttttt

SEQ ID NO: 16339 - DNA, 1309 bp, Heterodera glycines
taaattgcgaaaaacattttcccacttttttgttgaatttttgctgtttttggagcagtacacgcaacacaacaaaatcaaaatgtaaaaagtgactttggcgaacgcaaatttttcaattataattttttttccttattcctcggcatcattaaaatgaagcgcacccgattcttcactttttgcttacgacattaattttggcggaaggaaaagctcaattaaatggcggcacatgccaatgtaaaaaatccttttaatttaattggaatttcaagctgaacatggcgtttgatgttcgaaattgagatttctcgtactctcaaaaattttattggaaaaaatcttttttttttaattttgtaaaatatctgaatttatttttataaaattattagcccataaattattcagcgggctgttgttgttatgctgttgttcacagttccgttcggtgtgtcgacacgacggcacaaactgtgccggcgcacctgcacaattttgtggtgctcccaagcaacctgagcatgaatgaagccttggacaacaataaccaaagtccacagtttgagaaaacagtaacccaattacacacggacatccttgaaattggaccttcacactcgaaaattgtccttgaattcaaggtgtccttgaaaatgcacattcgaaaaaacatcaaaaatttaacagtttttgaaattttcgaccaaatttttagtaactaaaatctgcacttaaatcgcacaaaaatccaattattccgattcgaatgtcaaaggtgtctaaattaaaaatgaataccatttatggggcagcataaaaaccgatgtttgggtgtgtcttcatgaatttttttaattccgaaataatatggcattagttaatcatttttaaaacatccactatttgctcagtttggtcccattcgatattgttaatgtttggaatggcttttcctttgttgttcctctttgcttcgtcttaagcatttgaaacattgaattctttctaaatttgaactggctaaagaattgactggagaaaaattggctttagtgcactttatgagtccagtcaattaattttattcatggtttttatacaataactttaagtacaaaatctacaaaaatttaataatacgagaaaacaagagattgctaacaattcaagaaagttactacgaacataatcaacgttacttaattaatcaatcttttttggcaattcaaatacttttaaattcaaatacttttaaattcaaatactttttatcttatccgtcgtccttgtgcaaaaaaaagag

SEQ ID NO: 16340 - DNA, 2764 bp, Heterodera glycines
  misc_feature (46)..(46): n is a, c, g, or t
  misc_feature (53)..(53): n is a, c, g, or t
aaagcaaaaaaaaaaaaattatttattgtttttaagcgatgtaaanaatgtgntctataatttagaaaacaaaaaatcctaaataaaccaattaacatattcgaaataaatttattttcatattttttaaccaagttagataaagtaaactttcttcaaattttaaagttttcctagaattccttaatattgttgagatctgtttctgccaaattaatttttttggtaagtatagggggctggtggttccgacaggctccgccggggaaatctcgtaaattttgcaacaatttgttaaacgctggtgcaccttaaaataaaaaaagaaacgcgagattttttggctgttttaaaaataaaagaaatttttgaatttttttgttagtaggtaaattttcagaattaaatttttaaaataattgtactttcgcttactttaagaaatatttaaaaaagaatatgaaaataattttattgtgtgggggtcgatccaaggcagaaatcaaagaaagactggctattttattttttgggttttatggtcaaatgatagattaaaatctatttatcttcacaaaaattttccttttttcccaattttcaaaacatatttctatataaatgaaattttatttattcaaaatttgggacttttccattttgccgaatcccttgaaaatgtcatcatcccggcaaagtaaagcttttttctagggtagttttaggcgctaatcaaaagtctggcgtcaaaaaattgcaaaaattagtgtgtttttatctatgatttcgccaaaaaactcagaaatatgtctaggattctttaaaaaatacaaaaaatgccctgagggccacggagcggcgcgcctttagcgagcatgcgattacggagcaaatagtggggcgcgcgagcgagcggagggttgcgagcgcctggttaaggtcgggtcgaaggcccaatctcaggcgcgagtaacccggagcgagtgagcggcgccgcacctacaggccacagtagtcgagagtacagtgctaatcaccagcttaatttgaaaagtgatccgcctcatccaatacaaaatttgtctgcgctataattttggtagagatatcgtagaatcctgaaattagtatcatttcggaccctcttgatgagaggatttttttaaattgaaatatcgacaaagtcatataatgaaaatccgagataatatcatagattttttctacagtattttggtgccaaattcttgattagcgccaaaattatgcttaaaagtgccttcctttgtggggtcatgatttttaggggagttcggcataaacggaaaaataccaaaaattgtttttaataaaggaattggaagagaaaaatgagaaaggcggagagaactgactctttgaagaatgttaatttattattaactattaatgatgctaattaaatgaaatattaagttttaataaaattgttttttatacctatttgtaatattagaatgtttctcatattataaaaaaaaatatttatttttattttataaaatggaaatgaaggattgtaataaaaaatgccaacgaataaagctaaacaaaatacaaaatcaataatggtgaaagcaaatgtattgcgtcaataagaaagtgacttttattacgtcagaaaaaataaaaaattatatttttttaatgtaatgctttataaattgactaataattagggatgcaatttttaggctttaaaaaccgcaaaaattggtaagctttaggtccgaaaaaacctcaaaaataggggctaaaaaatggaaaataggcactaaaacccctcaaatttagggggtaaaatgacaaatttattcaaaaagataacaaaattaagccaaaccagtattgagataaaataatttttattcacaaattcacaaattcttgtcgaaaaaataaaaataaattttgtggaagaatttatgagaaagtttttcatttcttaggggtgatatctctataattaattgtacattagatatttcttattttctgactgtctgattttgttagtgcctctgatcactctgatcaagtttaactccgccccttctcgtaattggcccatttcctagcgatcacctcaattcattcttagaaccgggatcacaattactcccgatccgctccccttccgtcctgtacggatcggggtccctttcccctttttactcattattagggatcggatttttagtgataaaaaatcccaaaataattaactaaatagtgagaaaaaaaattccaaaatagtggcaaaaatagtggcgaaaaagttccaaatttaggggtgtaattttttaaatagctgttttttaatttgaaaataatttaaaattaaggaaaaagattttattcactgattgcagttacaaaatattttcttagaaaataatttttaggtcgattcttaggggtgtatttttgaaaattttttaggtcgattcttggggtgtatttttcgtttttattgcattttttgggaaattttccaaaaaatgccaaaatagtggcaaaaataatgacgaaacgccaaaatagtggcaaaaaattattttagtggctaacttccgaaatagttttttttagtggcgaagctccaaaatagtgattcctagtgatgaatagtggcactaaaaacgaaaaattttcgaaaaagaatgtgtttttcgtgcatttctcgtcgagttaaagccgcagaaaaaatagttaaaaaactaag

SEQ ID NO: 16341 - DNA, 3679 bp, Heterodera glycines
aaatttgaagtaattataccctcaatttagaaaaatttatgtgcatatttttcaatttttatgtgaatattttgcgattttatgtgcatttttttggcggccctattaattactactgtccattaagaatgggaagtttaaaacggtgagaagcaagcgaaaactcttttaaaatggtccaacataaaaccatactacccgttttttaattgttcacatccaaccctacctcacgctaatttgactaattgattataagtcctatttggaataatttctcaaaaaaaaaaattgtaaatacggcgccgatttagtgtttgtgccgttggtgccgtttcagttgatgacagggttccattactgttaattatcattaagccggccatttgccgtttatccatgtcactcatcattgcaaagcgttcatggggaattgcctaaattaaaacttcctaagtcatcaagaaaattatttttaggaaagtttataaaaatagcaaaaaagctattattttttctgtttcaattctaaagaaataaattccaagaaattttttaagatattaaaaaaaagctaaaatttggtcaaaatatgcttctcagggataaatttaagaaaaaaaattttctttttatttgtgcacttttaaaaataattttttcgattattttggcgcttttttattttttattgatattttgactaattttcagaaaaccctgaaaacgataaatcaaaaacaatgaataagatggtgctatgtcattatttaaaaaccatcattatgtgcgttatttaaaaaaccatcaaaatgaaaatttttgcttataactttgctctaaaataaccaaattttaatccttgaaatcattcgatagaaataagtgttctttagaagcctgtaaaatttcaaaaaaatttattaactttaaaaaaagttatggcaaaaattgttcaaaaaccaaggttttttgagttcctcgagctataacttttttgaaacttaacgaaattttttgaaattttgcagactgatagagaacagttagtgctatcgaatgatatcaaaaattaaaaatttatgctttagagcaaaattataaataattattcgacaaaaattttcataattatggttttttaaacaacgccccgactccgcccaaataatatgacctgccaatggcctccacttcgctgattgcatttagccacccgactttttgcccgaaatcgtcgcttttgtcgtccttcatcggtcaaaaattcagccaattttgaagcatcttcgtccgactcggatgaacaggacgaggatgaatcagcagaagatgatgaagagtttttatgtttattatttgcaattttattattccttttgttatggtgttttttgcacattgcaacatccaacagcaaaagtgccacaattagcacaacagcgacagagaaaaggcagcaacgctttaattttaaaaaataaaaataaattttagctattttttcatttaataattaaattttccaaaaaaaaaaagtttaacaaagccactaggctagtaatgttcttgaaccccgaatatttaaatagccaggctttttgaattgggccaaccgagactcaaatccggaaaatgccttgttcctgattataagccttgttttagtgccagtataccggatggaaacagaattttcctaaaaatttggactcaaagtgatttaaaaaagattaaaaaccatagtacttaattttaaaacggattcttaaatgactcaccatttattttatttaaattaaaatggagataatgtttaaaataattatgattattttttcttgaatgattttgcgaacaactcaataggttttataaagaaattctgtattgaattttagttgcagtgattaaatttttgagtcttaatttttaaaaatgattttttaaatttgtttagctttcaaaaatgacgaaaaatgcaaccttttgcaatttaacattcatcaatttgtcattttaaatgtgaccaaatattcgaggaaaattaacatctattcaaatggaaaatgacaattaggttattaaattgattcagaattaatttgaaaacttttataatttttgatttaaatatttttttgctgagaataattaaaatcacgctaaaaatcacttgtaatttaatgataaaaaggtacaaagaataggaaaggttattcttttttttattattcttttataatacttcagattttaatctagcatctttaattgacgtaaatttcccatttttcggcattttattttttcaataaatgccaatgtctgcgataaattgaaaagcttctgtccccctccccagtaattctattattggcctgattttctttatttttatttttttggttttttaatgaagaaaattttaggcctaatttgctcattacatacaaacaaagtcaaatttatcatgtgaaattgggttgaataagcacagccacgcattagctgagtttataaagcaatttatttacaaatcactttaaaaaatgatttttacagaattcttataaatttttcatataaaaattgtttattcaaaattacatcgataaattaattctcttacaaaaatatagcatatatcatcaccgctaatacaattaatttataattaaaaataatattttagtttatttatataataaattatcattttatttgctattaagaaaatgtttaattttggttctgctgtaatttattttataattcttcaacatttctcattttcaatttcaaatgcaaattctttagtgagtttttgataattaattgctaaatcaattttaattaggcaaacgacaatttgctaattgcatttatgaaaggtcatcagaaaattcaaatcagtgaatattcaaagcaaaaatacgaagctcatcttggcattgtatattatatgagaacgaattggaaatgtgacaaaatttggaagaaatttgacgaatttgaactgaaacaatgccaaaaatatcgaaaatatttgaatattttgtatgaatttttgtacaaaaaatacatcggaattccttcagtgaagccgaaatttgcacttaaaaatgaaaaatttgaatttgatagtccaataattaatgtcattaattgccttgccaaaatttcgcagttttattttaattcaaaatggagtgatcactatgatcatatattaagcaatctgttcttttaccattttgatataatattattgaatgagaagagaatgaattacgaagaaaaatttgaaattgagccaaaaatgccagttaatgaaatgattttgaaattggcaatttacacagcaaatgaatgccaagaaagtgttgacgaaataattcaacaaaattttaaagaaaatatgaataaaatgctgaaaaatgcggaagaaaaggcaaaagaaggcttttcgtcatggagaaacaatgccgtaaattatgacaagcacaaaataattttgcgtttgaaattcgatgactcaaatacttgggttggcattcaattaaaataataattgattttcaaattaatgccaaattcagattgatgacgctttattttcggtgtttgtgcaaggaatggcaacaaattatgtgaaattttctgaacttgtaaagga

SEQ ID NO: 16342 - DNA, 2982 bp, Heterodera glycines
tttgtcagaattggcaaaaaactgcgattatttgctgactgaccgcttgcgatttgtaaatcggcgtcgcattctttgatgcgttgggcagcatcacgaactcgtgctgggtaaatgcagacggaggcacagcggacctaatgggacttggaaagcgtaatgttcggggtaaaatgccagttttcggccacaccttcgcgtcactttcggtcggactcagcgctctgtcgaccaaatttttcacccgttccggcgtgtcatcgccagacagtgtggtcaggtcgatgtacgaaatcaatcgttgcaaattggatttctaaaaaaataaacaaaattagaataaatccaatcggtgttttaggtatttacatatttcttaattatacctcattaataaaattttgtgcttccctatgaatacggtcaaagagctgctgacggttggtggagttcgcctctttttcgctgaaaatgaggtcgaatttgccgatttcatcaagcagtcgctccagatcagagtttagtgacatgaaaattattaagctactaattgcaaaattaaaaataccaagcatgagaatgtaggtaagtaatttaaaatgaacattcaattaaatcagggttcggatctgtccttatttataagatttgtccttatttggagggtccaaatcttacaaaataaaaatgtccttaatcgaataaattgtaaaaatatctgatttgaagcaattttgcgaaatgttcttatttttgaccataaaattttgcgggattaatcccgcgggatcccgtcccacaaagaattttgagttccaatcccgcagctggatccgcaaatttgaaatttccggtctctactaaatttatcaagccaaaaaatttaaaaatttgtgaaattggcatgatagcaattttaaatagaaaaaattttgcatatcgatagagaaaaaaatctgcatattgtaatacagccattttatgttttatacactttttcatgagatataaataaaacatgaaaatgcatttcttttcctctcattttgacatattattttcacatctctacatatcaaaaaacacaaatttgcaaacgctaacaatttttgttaaaatgatataaaaatgttaaaattttaatttcttattttattatctataaataaacatctgatttaacttatttgaagtgaattggaagctttgatctctgattatgaactagatcaaacataaagacactttgtttttcatttgagtgtgttggcgttttgttgtttacgccaattactttttggcaatttttttcgttttttaccgtccatgactgggactggagtgaattcatgttctctactgccaaccattgcatatttttttcccaaaagtgcgaattacctaatcatataatatgtaattaggcaatttgtattgaagcagtgttctcaaaatatttctgtcaactgaagcgccaacaacaaggtaattgtcgtcgcgtttggcgccggcattgccgtttggtgagtcgtctgatcccctttcatttaattaatttctaatgccatttttccatatttaggtatttgcgtaagatgatgcgtaagcgagaggaggaagaggaacaggaggatgaggcgccgccgggggacgaggccccgcccccgcggaggacgaggaggacgcggaaaatgacggcgggccgggcccgcagcaggcgcagccccagaaaaaacctttgccggattttttcgttcaggaggaccctcgagacggtgccaattagcggcgacgaaaaacttatttctccatttttggacaaaaagctgtaaacaaatcgaattaaacattacaaatgtttcccggtggcgcctattggcgccgccggatcaccccccctgtcccacaaaatttttgaagaagcgcgccgcaaaaaaagcgtttttaaagcagaaaaaaattcaatttaagtatcaaaattattagttacatagcctattccaaaaaacttttaagaagatattttcttgataagaagccccgaaaacccccgggttggtcttttcatgatagaaaaataattttgggtgggacccagattctccaatatacgaattcattgatacagttattcttttctttaagttatgtggagaaaaattgctggctattgtgggttgttgtcgtctcgtttggcgccggcattgccgtttggtgagtcgtctgatcccctttcatttaattaatttctaatgccatttttccatatttagttatttggccaaaatgatgcgtgggcgagaggaggaggacaataatgcggagggccggaggaggacaataatgcggagggccggaggacaacaataatgacggagggccggaggaggtggacaatgacgacggagggccaggccagcaacagcagcaaccgaaaaagaaaccgcttgctgacttcatcaccaataattaattaacggacgattggctttttgttcctgcacatttattcaacctgttctattgaatttaggctttcatcaaaaattttttggaaaaataaaatatgaaatctaaaaatcgaagattttttctggtactataaaggtcgcccgaaaaacgcaaaacaacaaagttttaattttttgctttttgttcggggttcgaattctattcatgtcagtgactagcgttccctatacacaccgagtcaaaatacgagacatgtgtcaataaagagagagcactatgggtacgcgccagtgtcagacaaaattgctcataacgccaaatagcgcatttggcgtaaatttttgcgcgctatttcaaaatttacactggtatatgccttttttgcactgtttattttgatcagccataactcgcttcatacccaatcaaactaaacaaatttggtatctaagaaaagatttttaccaggagaatcttttcctaagcgaatgttaagtaatttgtcatctc

SEQ ID NO: 16343 - DNA, 967 bp, Heterodera glycines
tttcagtacaccaacttaacttcatccacgcacttttgcttttatctgtcttctatttggcttttccctctcgcactgttgaagcaagctttcagtcaagacgaccttcttttttgccatctaaaccctgtgatataccgtgccataatggtggcacttgtatggatgggacttgccgttgtcctcatggctggggcggtccgcaatgtgagaattgtgttgggagagtgaggtgaactcttccacttaaaactccactttttgtattttaagaagggttgtatcatcttcacaaccgaacgggtcaatttctgatggaccgaataattacggggcttctgcccgctgcatttgggtggttgagaatgagaaaaccaaggacggtgcactgttgttcaaactggacgacttctttgccgaatgctgttgggacatgctttatatttacgacggaaggggcgtttatggcgacctattgggcgtattcaggtaacgttttccaagttttctgtttattagttaattataattctgtgtttaaaaaattaaaaattttcaaatttcactttcgttcgaattcggtccggggtttgaaagaggccaaaacaaatgccatatttatgatcagcgacccaaaaacctttagaaatatcttttaatgacttaacaaaaaaaaaattgtatgccgaaaaaaggtgaaaaaattttcaaaatagtccactttgcaagtaacgcagaaaaagatatcaatttcttagatctttttatgaaaacattaattgaaattagcaatcttttccaattactgaagtttgttgatgtgattctttatttagtggcagtttgtcaggacgtgaaattctggccaactcgggcgaagcaaattgtttattttgccagtgatttggcatttaatttacccgggtttaacattactttatgcggtggacatgccttcaaaattgca

SEQ ID NO: 16344 - DNA, 888 bp, Heterodera glycines
  misc_feature (880)..(882): n is a, c, g, or t
tttttttttctttttataaggttattggagtgggtgaacattgaaaatcttacgcatgataccaccattgttgggtttggttgacaatgaaaaaataccttgctttacccctcggaggggcctctgattacgctgataaaattttgctcattttcagtttgcaaaaggccagtaaaaatatacagcaaagagtttgaggcaattgcacgttatgggcacagtgcgtttgtgagcggtgggaatatgttcatcgtcggaggattcaatggggagatgctcaacgacgtgctgttgttcacaccgggtgcccagctaaattcacttttgtaaatgctgttgcgttgtttagccaattgtgacagtcaggccaccaatgcggaggaatgtttgcgattgtccaacggcgtgcgctgtgttttccacaacaaatcgtgcaccaaaactctgcccaattcgtccttcaggcagtcctttctctcaattgccaagggcgaaacggcgatggtctcttaccaagaacactgtacagggactgccatgggagacaagtaaagacaagactggttgattacacacttgaaaagtcgtatcatttcagagatgccgtcgaattgcgcacctgcactttgttgaccgactgcaacaattgtctgcttcaaaagggctgcggttggtgcgagagcagtcaggtgaaagatgggaagggtgatttatttcttaatgaccgacaattaggcccgtatctaatggagcgaagcatggatcagtgacataatcagttttttttactgacaatgagaaaagctttcttttgtcctgtgacaactctgttttcttgagagttgcctcggttcctacgcccaattgtgcgacctgcagnnngcatgc

SEQ ID NO: 16345 - DNA, 1926 bp, Heterodera glycines
ttgcataaaaaaaaatgttcgaattcggactcgggattcgaaataggagcgaaatggatgtttggcatatatccgaccaattcagtcctaaacaggcattcacgcgaaaacgtcctgccccgattcttttgaggtgcatttgataatttgtgagtcaaaatttgattatccaaaaaatgggtgagaataattaaattaaattttttaatttagcctattgcccagatcaaaacccacactttgatttaaaactactgagaatcgggaagcaaattagccataaaatttgccgaggcttttgcaaaatcctagctcgggattcaagacagaaccctgagagtatgtgaaaaccacagaacgactaaccaaaaaattaaatgttcattgccaaataaagagaatggttttattaggatgtgtaggcaaaataaaaatgtgaaaaacgatgctcgcattctgcatctcacccaccgttaaacgacatcaataacaattttgttccccaaaatgatctcaatttagtcaatgccaaatgtaacggagcagctcagtgggccggcacggttgggccccagcatgcttttccactatagcttttgtctttgtcatccaaatccaacaatcttggtatcattcgaaagctcttcacatgctctattagccttacaaaaagtgaaaagattttcaagcttatgaaaaatttatgaagaaaaaacttgaaaagtttcgacttttcgcaatgtgaaccccaaaaaacataccaattttctcgctggtatttcccgaagctaggtgtggcctttatttgctattctttcattttgttaatttatgaattatgattaaattctataaatttgaataaaaatggtaaaattttggtgataagtacatatatttctgaaggttttttcaatcaatccgagtcttgtacaacaactatttcgaaaactgccctcgtagaaaacgatgctgaccgttaagtgtcgggaaagacgtcttaaactttcaaaaacccaacatttttgatgctaccaacaggaccttttataactaaaattgataaaaattgtcaaaagtttttatgtatacatatatttttgtttttcgaaatgtttttgatcagctaatggccattttccaatggtccgaaaagtctcaaatggcggtccataaagcccctgtaccgtaaaaactgagcttttcttataaacaaagaaaattctgacttagcctcgaaatttaattcagattttacccggttcaaaatccaaagaaaatcggcaatattgaatttacagtttgtattttatttattgtgttaatcttttttaacctttcacgttcgcgtacaaacctttataattgttttgttcggaatctgtataccctggagttgaatgacatttaggaaaaacaaaaataacattaatgtttaaaactccaatataaaaatttggtattcagattttaatttcagttttcctatgaaaacctctgtttgtttttatagcttaaatgttgttcttaaaagttattcaaaaaacaaaattttgaagcctcgtatcttttttctaactcatcaaattgcttagcatttgcttagaaaatgcttcgcctcatcaaaggctttcgaatgatattgtccaatttgattggcaaaaagatcaaaaaaataatttccgaaattagtatttttttaattttttggacaaaaataaataaaaatattcatgtgcacaatggactcgaacctccttcctttgtccctttactatcttacaaaaaccactgagccacacatgcaaatctttattgttaaaggagctcatttctgggaaggtgtgtatatcaggggctgacttgtctcagaaaagacgagagcgagagttcggcgagaggcgagagtccccaaaaacacgagag

SEQ ID NO: 16346 - DNA, 929 bp, Heterodera glycines
  misc_feature (914)..(917): n is a, c, g, or t
atcaaattgcttagcatttgcttagaaaatgcttctcctcatcaaaggcttcgaatgatattgtccaatttgattgcaaaaaagatcaaaaaaaattatttccgaaattagtatttttttaattttttggacaaaaataaataaaaaatattcatgtgcacaacggactcgaacctccttcctttgtccctttactatcttgcaaaaaccactgagccacacatgcaaatctttattgttaaaggagctcatttctgggaaggtgtgtatatcaggggctgacttgtctcagaaaagacgagagcgagagttcggcgagagtcccccaaaagacgagagcgagagttcggcgagagtcccccaaaagacgagagcgagagttcggcgagaggcgagagtccccaaaaacacgagaggtcccaaaaatggtgagagttgtcccacccctggtatatatatacacaccgtttcaaaaaacgagatgtgtaccaataaatagagagtgccagagaaaaacattatctttttttctctaattttttgtctccttttggcgtactatttaatatttttattattaggaaaaacaacatttatttcgtgacgtttaacttttttcctgcacgttaaatccacaccaaattttgtatatcgatagagaaaaaaataatacattcagtaatacagccattttttggcttatacattatttcatgagttattagaaaaacaaattttcgaagcctcatatcttttttcaaactcatcaaatcgcttagcatttgcttagaaaaagcttctcattatcaagagctttcgaaagataccaagattatccaatttggttggcaaaaaccttcaaaaataattcccaaatatcgtgattttttaatattttgtacaaaaataaatgnnnnttttcttgttgc

SEQ ID NO: 16347 - DNA, 3043 bp, Heterodera glycines
  misc_feature (942)..(942): n is a, c, g, or t
  misc_feature (3035)..(3035): n is a, c, g, or t
ttttatgtaagaaaatttgcgaatttatgtaaataaaaatatgtataaaaaatgctaaaatatgtatgaaatatgtacaaaaatcctcaaatatgtaggaaaatatgtaaataaaattttttttaatggttattttttggaaaaaaattcttcgtaaaaagtgaaataggcacaaaatgccataaaaatgaccaaaataggcttagatcatcttttaataaatttaaaattaatttttgataaatcattttttgaaaaaatcgattttttagggatacattttcaaaaaatttttttttaatttttacaaaaaatttctataaattctcaaaaatcctcaaaatatgtaaaaaaatgaaaaatatgtacgaaaaattgcgaaatatgtacgaaaaagtccaaaatatgtataaaaatatgcgtgataaatttcttttacccatagaacaacaaagaatatattaaaagctataaaatgaattttattgaaacaatgggatgtataacctaaaaaaatatttgatacgttcgatgcagaatttttttctctatcgatatgcaaaatttggtgtgtatttaacgtgcaggaaaaaagttaaacgtcacgaagtaaatgttgtttttcctaataatgaaaatattagatagtatgccaaaaggagagaaaagttagagaaaaaaagtttctctgcactctctctttattgacacatgtctcgttttttgactcggtgtgtgtgtattaacgaagttaggaaaaagttatgacctaaaaaagcaagaatagtcactgattggacgcgtaaactggaatagagccgattttttgttaaaaacatgaataaagaactgaagggacagcttttagtagagacaggacaagagggtcggtcgaaacggtttcggttaaaaaccgaaaccgacaaaaccgaagaaaaattnttcggttttttcgaatttgtttatttattttccaaaaagcaataaactcagggatggtatccgtccttgaatggcaaggacgtccttgaaaatgagcatttggaaaagtttaaaaaaaatcaaagaaatttgagaaatctttgtaattttcaacaatattttgattaaattatggcattatgtaatttaaaaatgtaatttttgagaatttttgaaattttatggcattaagtcactatttttcttaaaaaattagccaaaaatcgcaaacttggaagccgacattgggcgataccaaccctgaataaaccattcgcgccctttgttgaccttttttaaaattttgaggcgtaggcccaaaacagaaaagtaccctctgcttattcgtagtttttggctaatttaaaaaagccagattaaattaaagaataattttaaaattaaatcacaacttacgacaaaagtgtgctaattgtagaaaaaatgaacagacggtaagcaatttttaaaaaaattaaaattttaatttacccaaatttttttttcatctttcagttggatttgtggcgacgtttggatggacattctgccatcttttgaccgtccccaactcggactcaaaatggcattgctttccgaccgtttcgatgttttggtggacaaacatttcgatggaaaaagcgaattgacaatttggaggatgatcagagttggcaaggacgaaggaccaaaagcgaaactgtctgtacagatcgatgacaaatttgtggattttcctctgccggaccgtccgctgccccacaaaattcgttttaaggatcttcggataaagcaattttatacttttatatgttttaaagcatattttatattttatcaggtatattgaccattccgtcattgaatttatccgtgtcaacaaacaaatttgggacataagtggcaccaatttggggttgtctattgcgtatattcaacaaatttgggatgtttttgtccgagaaatttggcccgtttttgcaacaaacattcgccatttgggctttcgcagtggcaacgatttggacaatttgtgtcgtctcatttcaccgacaattctcaccgatctcaatcatctgaattcaatcggtttcaattatctgttgcccgacgtaattgctgacgatgggccaaatgcaacttctgctggccaagcattgttcaaatggttgcatgcgccgaccaccgatggacggccgaaggaattgaattgtaatggttatttggtttcacaggatctcgaatggatcaacaatttcaaagaggtggtccttgcccggtgctatgtcattataaaaatccatcaaaaagggaatcgcccattttggtgcagaacgacatatcatttttatttaccaaccaaattaaatattttgcaggccaatagaggaagggtaataataccgatgttagcccctttttcgaagaagaaaatttttgaaatttttttcgagaaaaaattatttttgtggttttagggtcggagaatccgaatctatcattaatttcgacccatgtcgaatcctgaactcgggttcgcgcaaaaattcgaattttttatttttggtctaaaatggctggaaacaaactaaaattggacaattcactaataaaaaatcatttaaactttttgtttagtcatttctccgtgccaccacttcggtcagttacaatgtgcgaattactttttataagacaacaacgccaattgagccatttgaattggtgaatgaacggaccaatgagaaactgacatttatgaagaaagatggcggtggtgaattgcttaatgcttggctgttgaaacggtgcccaattattgttggggagagggcggcggcggttcaaaaagacgacaatttggaccatttgaacggagttcacttcagtctttatggtgattgcattgggtgagcagcagcaaagaaggcgccttacttttgtataaaatacggtgctgacgacagtttgctctgtacagtacatactttcccagcaattttggcagggccagcaaaacagacatgaaaagtggggggggggggtaaaccganaatttttg

SEQ ID NO: 16348 - DNA, 1162 bp, Heterodera glycines
  misc_feature (30)..(30): n is a, c, g, or t
  misc_feature (144)..(144): n is a, c, g, or t
cattagcaattcgtttgtgcttactaatgnacgaaaaagaaaaattggcagaaaaatatttgccaaaattcgtattcgcattgaaaatgtgcacaacaaacactgggtaaaaaggcgtgtttcattttttattcattaagaatntaatctaatatataatatatatttatacaaggaaattaaaacaaaaagaaatatttggataaatatttgtaaaatgcacttaattaagttttaccaaattctatttcatcgaatacaaaatcaaaattgcacaacaatctgttaagattaatttaccaaattggaatttgccttataatgtttatatgaaaaatgaaaaggaattaaaaatggataaagctgaaagtaaatttgaaagtatttaatagttcattaatattattttttaatagacaaagagattgtgaaaaaattgagtgaattaatggaattgatcaaactgaaaagggtagagaaaggtaataatcttaaatttaataaaaaattttaaataatattgtttttttttaatagtgaaaggactcaaagaaaaatttgttgaattattggaaaaagatgaaggtaattttgaataaaagtcaacaattttttaaagtattatttttataatagtggaaaagctcatggaaaagctactggaattgaaaaaattgcaagtggaaaaagccatgggtaattttaaattattattatttaattaattaattttataaattatttctctaatagtcgaagagctcttaaaagaattgaagaatgtttataaagtataaaaatgtgaagagaaaggaaaacatcaaggccggaagaaaagcagaaaaaaggaacaaaaacaaaaaagaattttctcccattatccaacatttcttttttcactttatctaaaacgatgtaaaaaattttgcacatttatttttgaaccaaattcttcgtattgttattaggctggacacaaattcgacaaattcatctgttttatgtccatgattttcatgcgtatacaaatttatttcagttctttatccatcaaaaaaaacttcggtttccaaaaactttcatttcgcctactaagcgtaagctcgaacttgagcccgtaggaaatcaagattttcatgagagaatatatgaaaaactccgc

SEQ ID NO: 16349 - DNA, 2476 bp, Heterodera glycines
tctcatgcaaccgttgcaattcggtatgaacggcatgtatgcgccagtcgcttggcctcagcaaccgatgatggcttatccaccaccaaattttcaaatgttttgtccgccaaattttgttccgcaaatgccggttcaaaattttgtgccatttatgaataatttggcaccaaatgcatttcaaccaaaattcctcaaaacgcaattcaaccaatgagagctcagccaacaaatgttgtgcagcaacagcaaaatccgccgccgacaaatcaggcgatggcacaacacaaccctcagcaggaggtgatccggcaaccaacagggctaagtggcattgaatatgctatgatcctggacaggctgcacgacattaaaggaaacgagggaagtgattcgatcctcaactttttcaaaaaattttcacaatatacgagtgaatggccaaacaaaaagctaatcgaatcattagaagccaaattgagtggccgagccgaacgtgcctacaatgctgctttagcgacagagccgttcgcgtacgaaaacatcaaacgaaacattttgcagcagttggaagaaacggattgtagggagatgagtgcttttgacgacctcatgaacggtgtgtacagaaaatcgggggagaacttagacgatttggcaaatcggatttcgaatttggtgcgtagagcgtacccgggattaacccaaaatttgtccgatgattactccataaagcatctgatacggagcttaaacaaccccgagctcgctctaagtttggagttgcatcgccgatccgagatgagcttcgacgagtttgtggctttgacttcacgagccgagacaacacaaagggcagcgaaaagggcaaacacagagcgattcaagccaaataatggaagaattttccaacaaccacaacagagcgggcgtgattttggaagtggttttaagtcaccaattacccaaagccccgtggtttgctataattgcaatgaacctgggcatgtgtcacgtaattgcaataaagcattccacccaaatcgtggcgaatcatcaactcccgcccaacaaaatcaacaatgggcacaaaattctgctgcaaccggtgcaaaccgtgtctttttgaattcaaaaaacggaacatctccagtggttcggtctcaaaattttctgaagcaaaattgcatcagaatggaggaagaagtgagaactgatgctactgttggtggcgtcatgcttgaaaggaaagtaattgatttttttaaaaattaatacagcaaaggccaaacagaaccagagccaacggaggaaaagccgattatggggaaaatggtaacggtggaacttgttattttggagacaccaacaactgcaatgttggacggtggagctcaaatttctttgatcggcggcaaattcttttatgatttggtcacgagtggaaagttaaagactatgaaaagtggttttaaacgcgtttcaacgcggatctctgatgttaatggtaaagagttggagtgctttggagtgattactcttccagtctttagtaaagggtgcattacaacaaacatttgctttcacatcaccagcgcaccatttgggtatgatttgctcattggtacgaatgcgctccgttcattgggcttttgtcttttcgacatccctaacaaggaaatgatcaattttgagtaaattcacccgaaaaaggaaaagtctgttggaattctttatcaaacgactctcaaaccgttatcaatgaaactggtaacattgtccagttgaaaatccaatggaacgaccaagaagtaattgtcacatcgtcgaatgagaaaagtttgcatagatttgagcccaactgttggaaaaataaccgccagggaaaataaccgttcccaattgtgaattcatcaattgaattcgtacaagttggcgaaaaagaaatatttgtcgaattgtttccggcaaatctttttgctgaggcggacgattcgcttgggtcgcccattgttagtgaacaaccttaaattggtatcgaaaatgaatgaagttaagtgccaaagcgtggcaattctcgaatgtttgaaaagtcagccaaaagacatgtctgatcgagagtttttacctctcggacaattgataagcgaatttgacaacattttcgcaattcatgaggaggaattgacacagacggatatggtcgaacattccattgacactggaaatgcaaaaccgattaaggcaaagcgatagacctgtcccgtatgcttaccgagaaaaagtcgccacgatgatcgaagattatctcggaagaggtttgatcgggccatcgttttcaccctgggcatcaccctattgtaatcgtcccgaaaagggatggaactcttcgcttttgcgttgattatagagggctgaattctgtaacggttaaggatgcttttcccttcccaaccatcgatacctcttctgttag

SEQ ID NO: 16350 - DNA, 2495 bp, Heterodera glycines
atcccatttttgagccaattgcgtagggcggactctcatggggcgagcagttaaaattgggtttctctccagggagaagaagttcaaacttggcacgggcaatgtcctcgtggtcggatacgacgccagccatgccccaagggcgaccacggaagaattgtcgatgatgcgcaggaagggcattcaggcgacatcgatggagccggacgtgataggggtcagttacgacaaattaaacaattaaccgggggagtgactgttccggcaatttattttctgtaaaacgcttcccctttcttttctagttttgcgccaattacctgaaggagccgaacaatttctgtggcgattatttctttcagcctgcaaagcaggacatttgccatccggaacatttcaaggcgaaagttctgtggatgctgcgcaagttaaaagccaatcgtgaacgcccgccttcactaatcgtattaaataaaagagggactgattacaaattgcttattaaatttgttttaagttcattattcgcgatggactggacgaaggcaaagtggacaatgtgaggacgggagaaattccccctctttttgtaaatgaaagttgcattttgtattgttttctcacaggcgttgtccagtgagattgggctgtttcgcgaaagctgttctcagatcagccaatcgtggaagccgaaatttgtttattgtttggcggacaaacgacacaacagacgctttttcgaggtcgaggaacggctgccggacgcggcccagccgcgcaatgtgtgcaacccgcaaccgggctccgcggtcgatcgcaagttgacccgttcgggtgttctcaacctctacgttcaagcccatcatcccgtacgcgtaagtgaataaaatggctagaagttgcaaaaaacaatttgtttaggggacagcgaagattcccgagtttattttcccatgtaacgaagtgtgtgctaccaaggaggagttggaggcatttatcaacggactctgtcactcatggcaaattgtgaaggcggcgacgtcactgccggtccccgtttaccaggcccacgaacttgcgaagcgtggaaggtccaattacatggagctgaggaggtattcttcccgaaaaaaccaaattgacccctctcaaaaagaatggcgcccgaacgaattccacggagtgctgacggacaagtgatgtgcgaacaattatccgagttgctctcttacaacgacagtcctctcagtgaaacgcgaacaacggcttaatccaaaaatcagataatgaaactgatggactaatattataaaagcagtaacaattttaaataacaacaacatcgaaaaagaaaaagtaaacggagggacaaatcatttattattggagaattggcagaatttggaaattgaaatacactcatttataagctaaataatttattttgtggtcatctcacgcctcattaccattcccagttcctttcaccattccctttcctttgaccgattctgtcttattgtacctgatccctttgtctttatttatttaacagccaaatgttattctttttttacttgtcatgcgcgtaatgatttcattacacctccaacagtgattgattatctccaacccttcaaactaatcacatcgtttcaccattgtacctttgcagaggccatttactgataaaagtgaaaaggaccagatttgcttgcatattctatcagttaaaaagggggcagcgttctgaaatttggcattgaattaatgagggggtttgttattttggacttatgacgagaggttttgaggcttctgatagcgagcttgacctgaattccaatattcaaattcggacagagtaaattttaaaatttaattttaggaccaaacaattatatgtgtgaaaattcgtcataaaatatacaatttcagggatgggtaatttctagagatcgacctggatccaggtcccgaggagcctggatttttcctggacctggatttttgtccaggtccaggcttttttcaaaatgtcgatctctagtaatttctaatgttgaatataaaagggaaattttaatttcaatttttcggctttatgttcgattcggttcctgggttcggaaaatccattcgtttgccatcgagtaatacgccaattgaccccatcccctcaaattaacgccacaaatttataaagtgaatcaaatatgcaaaatgagatctgtgacagcaatgtgaagagaaaacttctgctggcgaattaagcaagaaaatggtcacgaaggcgtggaaatttgaaaatatcgaatgttccattccaaaggcagaagacatcacgacggtgccgacacagctaaaagaagtctttcaccgcttccaacaactgcccatcgtaagcatccttaaaacgagggattaaaatgtcccaattagtgatcattaatgtttcgaccaatttgaaacaaatgttacgaatgcttcttctg

SEQ ID NO: 16351 - DNA, 1666 bp, Heterodera glycines
caacaattgaatacggtagcatacagtgaagggaggagggggagcacgattttcttttaatttttttgaaaaaactaagaactcttcattaaattttgaaaaaatcgctggaaattttttgaaaaatttttttcattgaattttctaagaaaaattttctaagaaaaatttttctaagagtttttcgtgaaaaatttctgtttgaaaatttttttttaaatttatttcggctgtgttttgtcctgttccggggatgtacttggatacggtcgcatactgtgacgggaagaggagggagcacttttatggaagcagttcattcccccccccccaccttccgccattcctgatttcgatttttgccgaaaattttacgaaattgacccgtaccttccttgtccacctatgacgggggagggagggtaaatataatgcaccatttttatatgataacctacagtgaaagagggagggaaaggggcgtgtaacttgaatacggtagcatacagtgaggcgcgagggcggtgcaaattttttatatttatacaaaaataatttgttgaaggcggtcactcatcagcagcagcagaaccaacaactttatgacgaaacgcttgtcagggagtttggccaaatttttatgtgcccccgggagttggttgaacttcaccggcttggccggtccgcgtttgcccgtgttgcggtcgggctgtacgtcaggcagcacatgggccaatgtgttgagcagatcaagcgcgtgtcgtttggtgccacgccgtacacaatgtacggccaggtgttgaccacggtgctccattttgagcatgcccaccagtgcaccatcaatgcgctgcatttcttcggacagcaaagcaaaattgactttatcaagcggcatctgttcaacaaacacatcaccagcgagcagcagggaaaagcggttcgaatgcgaatttcatatttggttatgaatggaatggctttcccgggtgccgattggcaccgtcgtgaagcatttaaatttttaatttgttgccagaatatgcccacaaaaatgtgccacttttgtttgggacaggaattcatttacattcttccctttaaaatctattttttgaaaatgtcattttgttttttaaagcttgcgcctatgcaaatcaaatttggtccaccaaccgctgattatgtcaggcgcaagagtcagcaattgcgcgacgaactcaaaaagtgaacacaaaaccaattggaaaatggtccaaaactttgctatgagagagacatttttattattcattatcaatttgttgattttattttttcattgttgttccattttatgtgaaataaataaatgtgcctaaatgaaatgtacataaatttttccttttatgggtgtaaggtattccaaaagtcttcaaattcgttaagctaaaggtctcgaaataccctaatatgatgtgaaaaatcattttggaagaaaaattatcaaaataattttatactgtacattaaaatatgacgattcgtgtaaactaaaaccgatgatagaattagcatcatattcttcatacaataatgttaaatttgcaatatattttgaattcgtttgtatgtttacagataatacaaggaaatatttaatcgttttatctttgttatatttaat

SEQ ID NO: 16352 - DNA, 1653 bp, Heterodera glycines
ttgattggaaaaatagggaaaccaataaaattttcaacattttaaaaatgatttaaatggttgtatcagttgcaatcgttctgtttttatccaaaaagtaaatagagtccgcttcacccatcacaataagtgtaattccaccatcgggtactggttttttgaattttatgtttacagctgtacatccctttttgatcagatcgaataaaccgccatgatcgtctccgctgtttgtcatattaaacacataaatacagtgagtgtgcaaaaatgaaaagtaatcaattccatttccatatgtagagttggcaaaaccaagcgcctcctgcatgtcattgtagggacgaacaaatttccaattttcatagtcaatgtcatacggggcctggggataagagcgaccattggccacaacactcaactcccgtacgttaaagtgttgaaagttgaacgggctccttttggtgttccccacataatctgaatttgcgacaagtcccattgttacgcggcgtggaacttggaccatgaacaagtttgcattaaattcatagcgtccagggcttatgaacagtgctttcatcattgtctttcgtacagcataccgtgctggtttcatttccaattttttcgccaactcaagagccaaaccatccataagactgacttttttgcagtaaagtttcaatccaacaagctcaatattatatggctgaccggggggtctaaggtgtcaattaacaaaaaattgtcgtcatggggttgtattgttatgtcaatttcacaatgattaatcaaatattggggtacattgaaaagatcggcatcgatttttgcaatgtattgtgctgttcgacctcccaaataccgttgtcttctgcttttgaatccttcggaatttgagttttgtagattgttagcatcttcacggtcgtatccagcagcagttaaatgcgaaactttagcttcaagtgattgcgaaagttcatgagagagataagttttgtatgccatcagtgaattagagttgaaaatttcacgaccatttattgcaattttcatgtctcgtatgaacgtgtgtccgatcaattgtatcggtacaacctgatcattagtatccaaatgtccccattcaccatttggtggtgtcaattttcgcattcgaaattccgtcaaaaggtaacactttgacaggtcaatgtagttttggctcgagtgtattttaaaatggtaaggtgtgtcggtgagtgggttactcggcaaaatctcgaaaacctttgacgatgatacggtaacatttgtcgggggtatactgaaaaagtcaacagcattggtaattgaatcaatgctgctcgagtcaattttgtgaaatgccattttatcttcttttttttaataaagtccaaatgcgtctgatctgagtcgctttttgcttttaattagtgggttggtaatagtttttccaattaaagtctggtgcgatagaatgggtgatttgttagcttttatacgctttcttcgtcctgtaccaaattgacgttgaaatccacccttctccaaaatgttgtccgcgcctcgtttaccctcagttgtcaatgtttctattgtccccattaaccccggcttttcatcgatcattcgatttataaaacg

SEQ ID NO: 16353 - DNA, 1813 bp, Heterodera glycines
  misc_feature (134)..(134): n is a, c, g, or t
gctggcgtctgttgcgcagggcgatggtcaaccgacacgacgatcaggcacatcgggctaaaaaaaaactcgcgcacaatttaaatatcgatttgtaaattcaacttacggcaatggtgacccaacgcagcacngcatccaatcaagaattgaatgttgtgcgttccatccgcacaaaaaggttcctgaaattgcaaatagcaaaattttaaaaaaatttaaaaaaaaaacaagtaagcaccgccaattgctggtgggacgcgttgacgaggatgggttgcaccaattgcgcaacctttaaaataataaaatattagttttttattttattttttattattgttaatatgacttggccaaagggcggcatttggccgaaaacggttggtagctgttgagccataaaataaaggacaatttgaatttttcgctgtaaaaaaaatagaaaatttgacttttttttaaaatattgcgtagcttttcttttcttaactttaaaaagatttctatttttcctggctttccgctttttttaaagattgcgcagcttttcttttattgactttaaaatttctatttattttttcttggcttttctttgcttttctttttaatattgcgctgcttttcttttcttagctattaaaatttccttaaatttttcattgcttttcgtattgtttttttttaaatattacgcagcttttcttttctgaatttaaaaatttccttaaatttttcaatacttttcgacttgttttttaaaatattgcgcagcttttcttttctgaattaaaaatttctatttattttttcatggcttttcgtttttttaaatattacgcagcttttctcttcttcattttaaaaacttctatttatttttccttggcttttcatttgctttctttttaatattgcgcagctttttcttttcttaactttaaaaatttatatttattttttcattgcttttcatcttttttttttaaatattgctcagcttttcttttcttaattttaaatttctatttatttttcttggcttttcgtttgctttcttttcttttctttgttaaattaattaattaataatttgttagtaagttatgataagcaaaataaatgcacaaatataaaaatattggacagaacaaataaataaaatggacagcaaatcaatataaacggaagaaatggaaatgaaaatgatgggttggtggagaacgggtcgttgcagatgggtgatagataagaatctagcgaatgggaggggtccgcatcgctgtgcacagttaagtgacaacagtggggagggggtaaacatttgaatttttgaagttcagatggattttataggccgtcattgcaacaccccctaagctgaacgacgaaagaatttcatctctagcaccatttcaagcagtactttcccgacgccccgccccctcgcgcacccccgagacttgcgcagcaaaactcgcgcaccccttgtccgattgacttcaaatttcacaggccatctttccagcagcctctaagctgaacgacgaaagaatttcatctctagcaccatttcaagcagtactttcccgacgccccgccccctcgcgcacccccgagacttgcgcagcaaaactcgcgcaccccttgtccgattgacttcaaattttacgggccgtcattccaccaccccctaagctgaacgacgaaagaatttcatctctagcaccatttcaagcagtactttcccgacgccccgccccctcgcgcaccaacgagactgcgcagcaaaactcccgcaacccttgtc

SEQ ID NO: 16354 - DNA, 3186 bp, Heterodera glycines
acgaagtgcaacggacgatgctcgagttggtcaaccaattggacggattcgactcgcgcggggcaattaaggtggccgggggacatgcggaacacgtggggaaaaggcatccaatgcgtgatactcctaggttttgatggccaccaaccgaccggacactctcgacccggcgctcgttcggcccggtcgcattgaccgacgcattgaattttcactggtaaattgttatcagcgtacactgctcattcttgtgaatcatttcagcctgacgtaaaggcgcgtaaaaacattctccaaattcacaccaaacggatgagcatcgagcgaaacattcggtcggtcattattatcattgtcaacacataattatcatagtttggttttcagatacgaattgattgctcggctctgtccgaacacgacaggtgaacatccccaaaatgaatctccatttcaactgacggagcaatgcaacaaattaaccctaaggtcgtttcgctttttaggtgccgatttgcgcagtgtttgcactgaggcggggatgtacgctttgcgtgcacgtcgtaaggttatcacggagcaagactttctcaaagctgttcagaaagttgtacgtttttcctgttttctttactaaaaataatgggaaatttgtaggtgaaaggctatgcaaaattcagttcgacgccgtcctatttgacgcacaattaaaggaattgaaagagggacattatagaaaggaaaattctgaattcatctaattaatgcgtcgatttgtttgttatatttattgtacaatgataggttttattttattttaaatttatttaactataactgtgcacaactgacattattgacaaatgagtacgaaatcgcccaacaaaattcaggcaaaatggcaacaaaggcatattctctggtaaaacgaaaaattgaaaagtgatcacaacagaacgaatgacaaatggaagagtcaagcgaatcataaaacttcggcaccggacaaaaaaagggggcaaccgcctagatcattggtcccgaaaattttttctgaaaattcttataacacgtttctaggggtgttttgaggcactgagcacgaatccggcctccatttcgacctatttgtaacaccggacctgaattcgaacattttttataacttcaaaaatcatgaaaacatgtttccagcagttttttgggtcacgctgatcatgaatacgacttctatttcgcctaattccgaaccccgatctcaaattctaacaaaaattcgaaaattcaagttctttcaaatttcacttttgttcaacctttgtttacacacacggaaacgaactgaaagccatcaccgatacgcattagtggtacaataaaatcgtttaaaccattttagactaaaaatcgaaaaattctaattttcgactctgtccgaattcgggtctggtgttacaaataggtcgaatgattcgtgctcagcgccccggcggggctttcttttttcgaaggatttcttttctgctgatgaaaatgaaatttttccgttcgtcgtcccttcctttgcccccttttgtcatttgatcgaatttaatcacagtttttaagtgtttgtgcacaaaaacggaaatgggcggaatggaatgttctaagaatgaatgagcaatgaaaaggacggcggccttttgcaaatgttttttttcgacttttttgttcatctctgaggcgacgacaaatccaaccattggctgacgatgggtttcaacgggtcgaagttatgcaacggcacttcagcaacaccgaaagtgggcgtactgtgcaaaagaccgtaactgaagggagtaatgaatcagtccaagaaactaattaatgcaaggggaaagggacatcagttagcacagcagcgatatggatggcatttagcaattaaagcattaaaaaagcctactttatgccgtctttcacagccaagtgcagcttgaaattggggaagtcggagcagtgaatgtcaaactcgaagctgaaaatgggagagtttgaacatgagacgattgttttgttttggctttttacttttggttaaattgcgggtccaacgaattgggcaccatttccgtgtgctttctgcccttttgcacttttgtcgtggccgggtggccatttgcggaaggcatcagccgaagtgttacgtatgggtccgcgtggccctctttttctattggactcaaatctctggaagaaaagggagggaaagtccggcatgtgattgattacccggctcactttgccgcaatcactgaaacgatcagtttgaaacggtccccgtcgtatttaagaccgatttgaatacgaccggccgaagaaagcagcgacttccttttctttctgaagggggagcgattagcgaggaatttgcacagggaaattcgaatacttttgactagttagaatgaaataaaggccctcttttgaggggcgttgaaaaatagagctcccggggggttctaattcagtaaatacggtattagtctttttgtcctcactttttggtgtgttttcctccgattaatttcccgagaattccctccgctctgttggacagcagcgaagaattgaccgtcctcagcgaactcttcgacgagtcggactgagtccgccccacggaggacgccaatttgttgccgtgcacatccaagtcgggtgacaagtcgtcattgttcatcgtcgcggatgaattgtgaccatttgccacaattttcgccggctccgtcgccgcggcggccaattgccgattctgaaggagagaaaggaataaaacgcacaaaagaaagaccacgcgaaagttggcattggcatgggtcgaagaaatgcccacctgaatcacttcgttttccaatttcacattgtgtacgttctgctgctgctgtttggccaggtcgtttccgttgtgattcgactggccgtcctcctccgacagcgacgaattcgttcggtcgccccgttcgatatgcaccgctggaaggaaaacggggtttcaggtaagaaaatggcgtttaaatgccgaaaatggaccatttccgtatgtcgaggacaaatcccgggcctcgagcactttacggggcggagtgaagaactgaaagaagaagcaagagtcatgtcattgtgatgactaattagggtcattaa

SEQ ID NO: 16355 - DNA, 1867 bp, Heterodera glycines
gaaaatttattgttaaatactagagaccggcgcaggacaggatcctgcgcaggattttgcaggatcccagtccgcaatcctgcatattttggaaaatacaggatttacaggatttgcaggattaatcctgccggatcctgtcctgtaaaaaattttgaattccaatcctgcaacaggacccgcaaatttgatttttatgcaggattcagcaggatcctgcattgattttttgaaaatttttaaaaatagaatgccaaatattcagaaactttcttttttcaaaaattttttttttaataaaaatttttcgtttaaaaacttatccttattcgaaaaaagtttatacaattgaattttttatgtgttttgctacctaaaaagcgttaataaaatttttttcccactattttcgtgcctattttaggatttttctgcctttttaagtgcctatttcgcgattttttgtgcctaaaaatcccatccctatacataatggattatggctttttttgcaaagaaatttaaataaaaattattttactttaatttaagctattattatgagccacccaatttggcaaatcggtctttttaaaagcattaaagaagattcagtcgattgcttggagtgtaagcaaaaaaacgttattaatttttcatcttcatcatttttttgtttaaaaatatattgaatacttttttatactttgaaagacttttttattaatacataattttttgaaatttcctaaaatccgcaatcctgcgcaggatcctgcagattttaaatgcaggatttgcaggattaatcctgccggatcctgtcctgtaaaaaattttgaattccaatcctgcaacaggatccgcaaatttgaaatttccggtctctaatcaaaacatctgtcttcgcgcttagaaaaatataaaccatacatagcacgcgcgccacacgtcgcagcaaattgtatggacccagcacggtgaatgtggagttgtttcttctattgctctccaactaaaataatgaataaataaatatctcaaaaaaaaaggaaaatgattttcctacttgcaaaacaaccacggctgcgagaagaataatggccattccataccaggccaagtgcggtgagttgttgatgcgcaccatgttttgaacaaacacaatgttgacgagaatttgacgggtctttgcggtaaaggcgagcgaagtgtcggaacaatcgatgttgttccccgttgccaaatccttgtttttgttctttaagtgatttgcaccactacctcaacgttgggttgacgctggtttggtgcacgggacctgacaaaaacaataatgtaagttttggagtcgtcaatttgtaagcttacgttcctcaacggaggcacatcgtagagctttcaaccaaaggtcatttttaaaaataataagtaattaaaggctcgcatgttatatgaaaaaagaactaatttaatatattaatgagaataaaaaagcgtggagtgcggggaagaaacaaacttttgggacggggattccccaagaaatgaccaaaattttggggatagagagacgacacaaacaatacctaattttaaatattcattttttatttgaaaatagcgcaattaatcgacgaccttggcgcatttttgcaccgtttacgcgccggcacatcgaaggacagatacaatgaataatatagcaaaataccaaaagtcgataaaaaccagcccaattcatttgttcagcgaaaccgatcaaaatctttagccggagaaaaggtcattttactttttttattttaatattattattaataaaaagaaaataatttaaattttttatttttttttctaaaaataa

SEQ ID NO: 16356 - DNA, 873 bp, Heterodera glycines
ttggggatccgacatatggggattttaataaaacaaaaaaaatatttaaaattataattttatgtccaaaattagacaaatttacgtctgctttagctgccagagttaattccattgcaagaaaaaacaaaataatattttttaaataactctgtttccggactgagatttgctttgcaagtgagtcacaaaaaattaatttaaagcaccgcagaaagtcactcgaaagataagaaacagaatagaagaaatcggcatttgtggtacgcaattagacagcaaggccgtcttgatctttttgaatgtccttgacgaatttctgttcccgttggcgatgggaaaggcatttttaaaaaaattggtaagagatgtactgtacataaaaatatattgtgatttatctattgtgttgtggttagtatgcgctcaacattatgctacttccttgtggtgagtccggaaacagagttattttaaaaaatattattttgttttttcttgcaatggaattagctctggctatagcagacgtaaatttgtctaagtttggacataaaattattatgtttatttttttgttttattaaaatccctaaatgtcgggtccccaaatgtcgggtccccaagttgcaaatccccaaaagtcgggtagccggcataaggcaaaaattgaaaaaccccgaaccccgaacgatttggcaaccccgaccccgaacctaattaaaaacacataaggcatttaaaatggccaattttcagtgaaaatctgtaaaaatagtcaaaatttcaaatttttccttcggcgcctgacccccaaatagaaatagtggattttattcaaaaaatgcccaaaaatttctgatcaccttatct

SEQ ID NO: 16357 - DNA, 1174 bp, Heterodera glycines
tatcgcatgatttccaagaataattaatgaatttggtgcttctaagtaaagttacgataaaagtttgtcaaattgactttttaactaaatttcattgcgtttaccccaatttcaaaatttaaatgcattaattttaatttttaattttattttagcctccactcacccctcgttttgccttcgttcgccgtcgttcgttgttcgtctttgcctatttgcagatcaatagaatgtttgttttgaccggctgccaatgcatcggccgatgatgaggttggctaaatagtggaatttaattttgaattttattactaattggcttactctgtctatttctctctgctcattttgcccattttttgattgcgtctccgccaccctctctccgctttgggcattttctgtcgaatttgcgctgcttttcctccgcttgttttgcctctcatttccatgccccgccgccgcccattcattagccaaaacaaaaattgttaagaaaacgcgtaaaattttgtcgtttttcatcttaatcacttttgggcagaattttgaaaaaaattggtaaaattatttgtatttttaaaaatatatatttttttatttttgtaattttattataattaataatattaataaagaagagaaatttagatgaattttataaatctttaaagaaatattgttgtcatcataagagacaacactgcaaaaatttttacgtcaatgaaacaaaaaaagagaaaatgatgaaaataaatgtcatgaaatacatatgcattaataaaaatgaaaagtcaaattaataattgtttttttgtaaaataaatctcagagtaaaataaattcattcattatatttcattagccaatttccttccggcggatattcgaaattttacgacaaacaaattttgatatttatattctctcactaacaaaaaatctactttccttgcaaaaaacaaaacgaaaagcatgaaatattttacttttcggttttaattcaaattttaacaaaaatcaaaaattcatctattagcacgcaataaaaacaaaatgcattcaaaaaatcgaccttcaaattacaaaaaccttaatctccattaaaaatgccacaaaattcatttaaatttgaaaaattccaatgatggaattctcgattttaaaactataa

SEQ ID NO: 16358 - DNA, 1064 bp, Heterodera glycines
  misc_feature (66)..(66): n is a, c, g, or t
tcagtctcctgtaagattcatagatgtatcagaagccgcgctacaatataaatcggcagagttatntaatagtgaggcatgctgctttccttaagcaaggattttttagctaacattaagcaggtttaggccttcagccagctcaaatttgaaatgaaaaaattaaattatgaagaaattaaaaacgaattgtaaaatttgtttaaaattaaattcaaatttattgatgtgttcaagaataattggttaaattaattaaaagaataaattgttttattataattaaaaaagaataatgatttggtgttccgttggccgcaaatgtctgaaatattcgtgggataaaaggcaaaaaatttatacaattttgaatttttttaaacatcttgacatttttttgtaaaataaagtaattttgcttttaataaaaaattgaccattctttgcataatttgttaacaaattgaactcttctttttttggatccagaaaatcttaatacaaaaaatcaacataaagttttactaagaaggatatattatggacttgaattgtttactgattttttaaaaatctgtcaaacaaaattttgaattttcatatatcatttgaaagagaaaattttgcctttttattaggccatattataaggcctatttgctgcttatatcgtgtcacattcagtcagatttgtttaaaaaaaatttatatgagtgttcataaactattgattcaaggcccgaaaagtgttcgactggcctaactttctgaataggagaccaattccaaaaaatcatgcgattattatgttcagacctataagctctacacaaagcaaatttttgacatttttcaatacaataggaaagaatttctgaaaatccccttttctcaagaacctctctttttcaggaaattttgttaagacaaataaaaaatttaatgcctcctcaaatgtgagtaatttagcaagaccttggaaaattcacggcgccatattttgtgaattcgtaagtgaaaacactaatgaattggtgaatttaatcacgaaataaattgaaaaa

SEQ ID NO: 16359 - DNA, 2555 bp, Heterodera glycines
ttttcttttcaagtactcatttcttctcctttctctctattgactatcactaatacgtgacggtcctgcaacgccaatatctgaattcagtgatgcctggctagcaacattcacatctgtcaaaaatcttgttcgtttagcataattatgttcagacaaaacatcatctatatcatgttcaaaaatctcggtttcatcttcaataactaaaacatttccattttccaaaaactgttcatttccaactctaatactaagatttatctgaaaaacatggtccaaattcattgctcggataatatggcgtttttaaaatctgtattaaaaaacaaagttaattaacaacacaatattaaaacatataggtaaatttgcaaattgaacaaatgagaaaaaaataaagataaaaatttattaaatgaaattaattgatgaaatgaaaattcaaatgattgaaccgaccttttcattgtaaaacttcttttacatattattaaacacaattaatgtagaaaaattcatttcaatacaaatacttcctctcttacaatgtcacaaatcttttacaatacaaaacaaaatacttttcacatagtaataaatcagcattattaatttttacttttttttattacttaactgagaaacaaaaaacattaatataaacatttttaagaaaaatttacatatatgtataaaccaacctcataacgatatttaaatccacttcgtaataagtaactcctcttgttaatacacacaataaattgcgataaatccatccagttgaacgaaatgtacaatcgaataattgacatccgctttaattacaaacaaacaaaatttccatttcaaagttcaaaacaaattctcgaatcaaaactttttcaatgcaatatcaaaaacaataacatttccattgagcttgacataatcaaaaacaaataatactaacataaatttattcataactaatcaaatcaattttaattcaataaaaaggaattcatttacaaaaacattttctttttctttacaaaagtgttaagagcattcatttccagacgctttttgataataacaaaaacaaaaactttttctcttaagaaatgcaatagaaagcattcattgcgatttcattatcattaataaacatacaaaaactattttgtcattaaaaacgaaaaaaaaaagagaaatttattttaactgtgctttttgcaaaaactaattaaacaaaaatgaaaaaaagcaaaaccaaacatttcttttcaaattcatttttaacgcaaaaattaaacaaaacgccacacaaattcaaacactggacacacacaacagacaccaaactttttatataaggacattccttttgacattcattcattcgcattggatattattaatttatgttcgccttaataaaagcttcttctaaataattatcgactttgtcctaagcgagcagtgacttagcataattgtttgacccctaattgagtaattgcttccctctttacaccaaacctgccgttctctgactgatttcatgaattttccccactatttccttgcaaattggcatacccgtccttggaaacggagcatggatgatgggaaccctggatttatataacattttaatatttgttttatctttttaaatctctccctcaggtgcccaaattttccggtgccgaaatttctggtgcccaaacttcatgtcacctttttggatccactgcgtttcggcgctcacgtttcggcgcgctcgtttcggcgctcacgtttcggcgtcagcatgtttttccactaaaacttttttctttgtcatccaaatccaacattattgatatcattcgaatttttctaagctattgattcgcgattagacaattaccaaaaaagttatacatgaaattcgaaaagtcgaaattatagaagttttttcttaaaaaatttgtcaatattcttgtaagcatcagccaaaatccttttctgattgttctttatccaactcattctgtctccttcaatcttaacatattcatcaacacaatactgttgaaagagctttcctccatataaaatcggattaaattctctttctctaattgccaaactataacacaaatactgtagtcttgtcactcttctgttactgttctctgtttcatttcagggtgtcaaccaagcgtaccacgcggataaacagtgggtaagtcattggagtcaccatcatatcagtactattcaaaatctttaattcctttccacgttctcgaatcacaatcttggcatttggcacttcaccatctgccccaggtacataaacagctgccacttcattcgctcgaggtacgttgtaccccaaacgtctgtccaactgcttcccggtctcaaacaaaagcttgatctcggctggctctctgttttcagttctcgctctttcagcttcttcgtcctcttcttctttcatcatcatatatgcatctgcaaatgggtttacatttcttatcacttcataaacggttctcaacaattgcgggtcaata

SEQ ID NO: 16360 - DNA, 2088 bp, Heterodera glycines
  misc_feature (2025)..(2025): n is a, c, g, or t
aaataaaggcaaaaagagatagagagagaaagaaaagaagggagagaaaagaggagagagagagaagaaaagagagaaaggggagagagagataaaagagaagagagagagaaaagtgaacagagagagagaaaatgggagagaaaagaggaagagagagattgggagagagagagaaaagtgaagagagagactatgaaagagagagaaaatgggagggagagagaaagcaagttggaagaggtgagaaagaagaaagataattagatacctcaaatgcttattttgtgagccccgctttgtcttcgaaaaatgtttaaataattttttaaatttcgaaaaaatttcacacccgaagcattgcaacacaacattcggcgctgttcacctgcacacattcactttgaagtccacaaccgatggaaaaatgctaaaaattggttaaatgaattaatggattgtttgttgatggccaaatgagtaccaagaatttgacaaattcctctcgactgcagcactcggcatccgcatcaaacacaaactgatcacggcccgtcaaccgctccaaaaattcactgccaaacatgcccttgggggtaggaagaaagaaaaatggaccgatggcatgggatgggaggaaataaaaatggtcaaaaattggtaccatgaaatattcgttgtacgtgcagaggccgtcctttggcacttccgcaacgagtgagccatttgtgtcccgaaatttgagcgttaattggtcagaagttgctaaaatgtttagtgtttgtttttaagtaaatgagtttttctacttgcgcttaattaacgaaaatgtgagaaatttacttttaccaaatgggttgcccgacatttgcggatttctaaaagccgacatttgcggacattttgtgcagtttttaggtcaagttttaaaaataacaaaaaaattctttccaggagcgggaattcccatcctcttcccccttgttatagaagcatgctgttgtttatccaatttactatttttttaattaaaaaccctaaccctcttataacccaccaatcccgaacccccctcaaaaagaattcaccattgttagttggccgaagaagaacacattcggcaggttcaacaaccatttctggcgccgatttgtcgtctttcggcgcctctttttgcccattttcaccgccgaagtcctcaaaaatgtgctgatgatgtttaagcagagcagaaaaagcggacaaaatgtcacagcagagacggccctgaaaatgattttttttttaattaccaaattaattacgaacgaaacaaataatttgataaaaacgcaaaaatactggaatcttgactaaaaataaatttacctctgcactttggtcgtccaaagttcgccgctcaatgactgtttccttgacaagccgtacaacaaattcaagcagtacatcaatgggctgaaatttgtggtgaagacgagtgcgacgttcatccttacgcaacaaaacctgacaaagttttgcaaaaattagtgaaatattaacaaatttttccaagttttcccgtgccaagaaattttttttcttgaaattttatttttgtttgaaaattttgggtttaattattaattaatcaaatatataaattagtgccctaaattaaatttgggtaccaatgccgcggcaagcgaacgcacgcgctcccactcggcgccgcccgcgacggcttcttccaaacgcaagcggagcagcaagtgctcgcccatcgacgagtcggccagcagcgcgtggtcgccaagcaaacggcggccaaagtcgcgtcggaagtcacagcgagtgcacaacggggcaaatctgaaggggcggggagggcggagttcacgatttatacacggtgaataacccgcctcccacccggtcatttgggggacgggacaaaagctcgccgaagaaattacaaaaaaaaatagaaaattttcaaaaaacaaaaatctaaaaaacgctgaaattttttggaattttctttanaaaaaaatttcgaaggcgaggggaaggggacgacggaggcaggcgatctaggggggggggggg

SEQ ID NO: 16361 - DNA, 2998 bp, Heterodera glycines
attttaattataattttatgaattttgaaatttatcaccatttgtttcactgaattttttttagcttttcgtcagaaataattaaaaatgtaagtgttttttagtttgaaaatgcataaatgtgagggttccatttggaccagggtgtcccgtatttttctagataaaaaaacaaaacaaatcacggtccatgcctggatccaaatccgggtcaaactctacaaattttttcaatccaaatccaccgaaaagtgtggcatgctgcacaaaaagagtaccaaaagaaaatttttatttttatttattttaaatattttttcactttaaaaaagtggctcacttacattttcgctgatcaacacaatgctttggcgttcgtccaagtgggaaaaggtggtgatcagcgtgagcaatgcgtccacaattttggcacgaattttcatcacttttttgcgctcggccaacgcttttccatcggccgacgacgacgatggcccatcagaagtaacagaagcagaggcatttgaatggtcagcaaattcttcaatgtccgactcgtcctcctcctcctccatgatggtcttccgctccaaaaaggaggacggatcttcaaatttaaaggggccaatcaatgcatgaaatgggacgtttcggcgcagtccaaatttttggactataacttcgtttattttcaaccaaatcaaacaatcttgatatcattcaaaagcctttcacatgctctagttgccttacaaaaagggaaaatgattttctagcatgtaaaaaaagttattaaaaaaaaattaaatttatttggttttttgtttcgaattactaaaaaatgcaaaaaattttatttttttgatgtttagttttagaaaaatgaagagtagctcaaagactttaaacaattataacaaaaaaaatttgaaagacaatggaaaatgctcataaactttaccgtccgtttccaattcttcgggtgccgcgtcttcttgcaatggcggagacatggccttcgttttgagtccttcgaccaaatagtcgtccaactgttgaaaatgtatttgaaaatatgaaacgaaaaaaaacgcttttttttacccaaaattggccatgatcagacggaggcgaggcggacggactaagcgaaaattgggggtccgtggaaggcgacatcgacggcgaccaggcaacatttccactaaacagtaaatacaataaaacataggaaaatcgggtcgtaatttagagttatatttggtaattacggatagatgaattgggttttgttatcatgaaaatgggaccagaatttagacatggaaaatacgggctttttgttccggtgaatgatcaagtcatgtcatgggcctgttcgggaacggtatttttgaattatttttcatattttttccaaaaactttcttttgagttaagattaaaatcccgatcccgaccattgtcagtaccaaaattccgggctttagttatcttttcgataaaaaaaaactcaaaatttaataataaatttcaaaaaaaagtaagtcgagccccgtgtaaccgagttgacggaggagaagcggccggcgaatgcgaaggccaggcacttgtggaagcagaaaaatccttgcaaagaggctgaaaatgggaaaacaacggattttcgtcaagttttccatggcacaaaaaccaaaatttgcctcgtctgtgccgtgccgtttccgattgccatcacttttctggtccaccatttgttcctcgtgctgaacatttgcatctgacgactcgtgctgattgtgagcatcgccaacagtttcacactccaccaaattttcttccaaaaagcgattaatttgcgcaatggcagtcggcaaaaagtttgggtgctaaaaaaaaagtaaacatttttattcaaaaatgcatggagagtgtggaatctcaatagaaacccctagatcttttgtccattcttttaaaatttcaattcagtgggaaaataggaaatctttagccaatttttgtcaaatttggccattttggaatcaaattttgcaaataaataaataatggaatgattgcgactcggcggtgccattaggcaccatttttttaagaaataaaaaaatttaataatttcccattttactggaaaaaattttaatttttcattacggggggggggggggaacacgaaaatattcacccacatttatggtcagcagcagcgcgtggtcgtgcaaaattgacttcaaatcggtcacaatgaattgttggagtcgcagcaaatccctgcggtcgtcgcactgttccgcggtcgcaagacggcacagaatgcggtccaatccgccgctttcgcgaagccacgcccgaccatggacatccttttttgaacaggaaacagtaaagaaaataaatcggatgaaaagaaaaaaattttttgtttccaaattgcaagcagaaaaaaaaatttacgacttattttgcaaaaaaagatttaagacaacaaaaaggcaacggtgaacaacggaattgttatgccaaaggctcagatttcaataaatggccaaatattttctacttttttggcgacgaattaattaattgtcccatggctacggaatttggctcaaaatgattgattaccttcaagaagcagcagagaaaacgacagtgcacatcagagagagttgtcttgaaaacagaaacttttattactgttttaaaaattttttttataaatatttaaaaaaaaagcccagacgaccacaaaaaattccgaaaatcgaaatcccgtccatatatacctcgtcacttttcaaaatcgttgtgatggcgtcatgtccaagttggtagcgcattgtgtgcgaactgtgcacacagcggaggaacagttccgtcaaatggtgcgcgcgtttggcattttgttgccgatgccggggatggtcaagcaaaaattggaggaacagctcaacacattcggcactggaagaaaaga

SEQ ID NO: 16362 - DNA, 1418 bp, Heterodera glycines
  misc_feature (31)..(31): n is a, c, g, or t
  misc_feature (1341)..(1341): n is a, c, g, or t
  misc_feature (1374)..(1374): n is a, c, g, or t
caaagtgttcagccagcagaccaacggctcntcaaggacggtgccttgaatgaagatgatgctcgtttatgaaagcagggaaaatggcatataaaaggctaactcacagaaggcttttgccattcactgtgccaattcggtcgtccctgccaaaattgcgtgctccgatccgatgcatttccatggacaattcctccgcaactccgtccaatcctttgctaaagaattttcagtaaatctgcacatttttagtggacgaacgacaaacaccttttgaaaacagtttgatgtcgagcatagccacctttataataacaaaaataataataaataataataataataaatttccaacgaaaaatagatttaaaaagagcgaaaaaatcttttttcattaaaagatttaagtgattttatttgaatgcaccgagttgttcatcagagccggagccaaccaaagcaaattgagaagggcaaaggctaaacgaaggctaatagacgaagaattaatgcataatttaaaaaattcacatttgttgcccagtttcgaaatcgatgcctttcattcgcgaagcgaaccacaaaacacagccaatggagtcgtccaacacctaaaatttaaaaatatgagaattatcatcaaatatattcgcacagtttttgaaggcgcaatggcatcggcaatatgcttatgacggcactctatcagctcctccttgcaaacattgaccaagccgagggaaaaggcattgaaacctaaggcaaaaatcaaaaaaatgactaaagagacgataaaaaggagttaatttaatgagtttaatttcaacggaatttaaaaaatagtaatttatttcgtgagtgattttgctccaaaaatgccatcattcccgtaattacgtgcagccgtagtttgatttgaacaatgtaaatcttttaaatattcaaagtagccacaaagtcgccttaggcaaaaaaattgatcaaattaatcattaaaagtatatagaaaataatcgtttgaatcgcactaaaataccgtataattaggcaacacataccgtatttctctgtgctgcggcttttcagatactcaaaggcggcgatgctttgtgcccgatcggatgcttcgttgaaattgtcctacacacaaaaaaatggtgtagtaaaatttttcgggcactatttataatatttatctccactatatttctccgctttctgccgagccaaaaaagcatcattttaattttttgaattcatttgcttttaattattttttgtcaatgtttccagcgcgaccttcgctttgtccccgaaggcgacactgaacaaacgaatggnccaactctttggccattgtttggcttggtcatncatcggaggggaggaagcagaagaaagcacttcagcagccatca

SEQ ID NO: 16363 - DNA, 1707 bp, Heterodera glycines
caaattgcccagtgatttccccaatttgagcatggtccagcagcagttgctgttgctcatcagcaagtgcagcaaaaggctgaaagtgacacagaagaaagtcatttatgattatgattagtgatcactaattattgaatctgtgaaatcaggattagatgggatttatttaatggacggaatggcatatgatacatgccactgctcaagagcatatggtacttcccgtaccacttttttttgcagttagctttttgagtctcgaaaatcatttcagtctcgagagtgccaatatatatatatatagagagagagagagagagagagagagaagcatagaaagacatcgtgctgcttactctcaataaaatttgctgtgccccttccgctgttgtgaaattggcaccgcctttgaacgcgttgaagagggcattttggccgacagattcatgtgggtaataagtgtgggcgcatatcgtttgggccacaaatgcgctgagtgatggcaaatggcattgaaagtcgcgcagtgccgagggcattttggcattgggaaagagcttaaaattaaagaaaaaagtctattatctataatttagcaccacccactttgaactgggaaaatggaggcaatgaaagacaaacgatgtttcccggcggcacttcgtgccatccgtcagccattcccttaatggacaacaaaacagtatcctccaccatactcttcacatttattttagcatttacttcgctttcttcatttgtggcatttcgccccgggaggacggacaattggaaagtgccaccgtcatcagatttgacattgtcggcataggcactttgtccaattcgcatccgccaacacaatgatttgcgtccaaaaacgtcacggccaaagatcaatcgtcgccgggaggcatcctccgctccggcgggggatcgctgtaaaagtcacacaaattttaaattggtcagaaaggcaatgcatctctcgccgtttgctgctgtaccaaaacggcacagaattcgccatgttgccaatcgaagcgatgttgctgaacatcgccgagttcggcatgggcgtcgggcggaaaagtcaaattcaattcattgaacaaagcattgttatcctggggaaagccggggaaaaattttaattttgatcatttgacgattatttaaaagttgtacccgggaaagtgcaaaaaatgtcgccatctccgctgaataatgtattgaaatagtattcatttttattaacaaaattaaaaacagttaaaggctaaccaaagggaggcccaaaattagagcaaaatcaaaattattatatgaagcgattttagcgcaaaaatactttatttattttgaataaattgaattaaaaaacaaaaatttgtgaagagatcggcaagaaataattgagcgagcaccaacaattaacaaattggacatcattaagggccattcttcaaacgtagcgaaagcacttttggtgattgtgcggcactcgcgttttgaacagcacggagtcggcacggaattgggagaacaccaaagggttgtagccgtacacgcgggcgaagaagcgaatgcactgatgacgctccacaaaatgggactgatccttggacaacatttcggagcaagtgggacaactgaaagcaacaatttcaaatttttgaagctttttggtactgtaattaccgt

SEQ ID NO: 16364 - DNA, 2841 bp, Heterodera glycines
  misc_feature (6)..(6): n is a, c, g, or t
agaganattgaggacgacataatgtttttaataaggaaaaacgatgaatgaataagtcatccaccgatcgaagaagcgcccccgggggaggcgggggagaagaagccaaggccaagttgggcgagggaacggaaggaaaaggtgaataattgcccccccccccccaatcatcccttcccctcccctgctgtcctccctcttttccagcagggcaccgctttaagcgtgtaaaattgttttttattcaattatgaaacggtattttgtcttacagtatcctgctaatttcgtcatttgaggaaaaatggggagaaaccaatcggagatttattaaagaattaacaaatttcaaaaaaatctaaaatttcaaaaaaggcgaaaaattaagaaatagacaaagtgagcatgaattaattagaaaaagattttgactggtcattttgaattcttaaaataaaaattgatacatagaaatcatgaatttttccctgatttggttgaaatttaaaatttgttaagctcttacataaaactgatcagcaagaatgggtctgatcacatttgtcaataatattggattattattgtttgatcactcttgcatttcaaatatttaattcatcattattcacccgagttaattaatttttgtgaattttggaaaatgaaacccatcatttgtgatggatgtgtcacataccgccgatcacattgctcgtcggcagtgccatcgtcagcacgtcgaacgcggcgccgccgccaatgcatcggtgcccaggcaacgcacggctcagcgcagcaccgccttaccctgaggaaccatggtgttaattttaagagtattaagtgataattaaaatacactaattatatttgtttgagggggggggggggaagtcatttcggccatgtggaatggaaaaataaaaacttatgtatataatttgaatttccagcagatgggaattctaaacttttctgggcacgtatttgaaaaaaacgcatttcggacttgtaaatttgcattttcgctaattaaaaagggggataacacccgtaaaattagcctaaattgattattaaatcaattattaaactgaaaaacaattaaaatattttcaaaaagagagaaaaaaaattaggcaaaaagagttaatcagggaaagacttcgattgatcattttgtaaaaatatgttttttaaaattaaatgtatttgttttaattaaatattaaatctttaaataaaagcgatattttgaaactcaaaagtccaatcttcaaaattaaaatgatggtaccaaagagcaaaagaaatcatttttcaaacataaatttttggttggacttaaaaatttatgtttaaatcttttactattattatttaaaagaaattgacagaaaaccttaaataaaattatcataaataatgggtccgatcactttcaaatcaatccaattatattaattgatcagaaaagcggtgtttaattggtcagctactaatctaatcatttatcaccaaaaaaatatgaacgatgaaaaaaaggattgggctgaatatttttttgtaacatattcaattccttcacctcttacagaaaactgatcagaaagaatgtccctaatatgagttattgtctgttcacttgcactcaatatttattcaatattatttcaccgtttaattattttttgtgaattttggaaaatgaaacccagcatttgtgatggttacataccgccgatcacattgctcatcggcagtgccatcgtccgcacgtcgcatgcggcgccgccaacgcaccgacgtaagcgcggcaccacttcaccttatttgttaggggaattacataggtatatgaaaatatgtattttgaaatgtataaataaataaatgtatgaaggggcggggggggggggggtggttcggccttgaggcacggaaaaagcaaattaaaaagtatatgcattcgtggcacggatcatccccaactcaatccatatccattcataattcatccaccgcttgcggtccgcggttttttttcgggttatcttccttttaatttttcccccatttcgatttttttcgattttaatccaaattcgattttaccccgtcagtgccgtcatccgcacgtcgcacgcggcgccgccgccaatgcatcggtgccaggcgacgcacggctcagcgcagcaccgccttaccctgatgaggagccatggtgttaattttaagagtattaagtgataattaaaaagcactaatggggggggggagggcggaacaagacaaaatttcacaccgaattttttatttatttttaaacttagaaatcatataagaatccaaaattttataggtaaattccataaaaatttctaaaaaagttttgaaaaattgatgactaatttttttttaaaactttgtttaattagtaagtttttttgaaaatttttccaaaaatctcttaaaaatttttaaaaaaatttttaaattcagcagccgaattttggggtgcacccggcgagggtgcagttcgtttcggccataaggcaaaaaaaggaaaatgaaaaatttcggagttccaaatttgcagtttcatcatttaaaaaagtggggatacgacacgactcccaaacgattagccgcaatttttttacactttaagtttgattttgttgaaatgagaaaagattttttacaacatttcggtggcaagtggccgtaggggggagggagacgttttgctaattgttttcattcatcccctacggggacaaaaagttgaaaaatggtggaagaatgaaaaacggaatgaatgcaaatgttggcatt

SEQ ID NO: 16365 - DNA, 3721 bp, Heterodera glycines
  misc_feature (562)..(562): n is a, c, g, or t
cagggtttccagatcaaaattttcaaaagcctcatttgacaggcaaaaaagcttcattttgggtcaaaaagcctcatttttacaaaatttattcaaaacacgtttaaaatgttcaaatattatatttctgattgtccatcatcaaatggagaaattttttgttatgtagaaatagataagcattttgtgaaattctaagtatggaaaaccgaagttgattttttgcggcgctttttcaaaaaacttttgggaaacaagggggccggcggtgccgataagcgctgccgggaaaaattaaggattttgactatatttttagctgattttcattgaaaattcttaattttgtgaattttcggaaaaagacaaaaagtcatgggacgcgtaaaaccgattagaaccaaagaaattttaatcattgcctacagtttatattagtagggcttccttttttaggcacaaaaaatcgcgaaataggcacctaaagaggcataaaaaccctcaaataagcacaaaaataggcaaaaaaattttttattaacgtttttagaaaattcccggncgggaacgggattcccgcgggaaaatacgggaatcccgttcccgtttcccgtcttttttgcctgacgggatttttacgggaacgggaaaaatgacgggaatcccgttcgggaatcccgccccgttctttttcgttttcccgttcccgttcccgtaaattttttctcaaaaacgggaataaaagtacactgctaagaatgggggtctgagtgaaaaattttgaaggaaattggtggtaaaagagagatttttttgtgaaaaaaataaatataaattcattttaattcattagcgtacatatttatgtagcctaatggttaatacttctggtctttcattatttgtctcctgagttcaattccccattaggataggttatttttcatattttctttaaattattttatttgaaatttaattaataagaaagtttgtctaactttaaaaaatattttttaaatagccataagcccacaaattaatcatttttaagacaaaatttgttaacaaatttcactaaaaatttcaaaattttccccggcggcgcctatcggcaccgcttgacccctccctgtaccacaaaggattttgtaaaaggcgctcacaaaaagaagagattttaaccaaaaaaagattttgtaaataagttgaaaacatagaaaaaaattctctacgaatattttggaattttaaaaataatagacaattttaatgaaaattattgtacatatataaaaaatcagaaatggcctcaacaagcaaatcttttggtatttttaaaggatttttcttattacacatacaaaatttaaagtgcaaaccgaatcgacatttgacgaagaattcaaaaaatattgttcgggcgatttgattgggcaggaattggaccctttggattggtggaaaattaacgaaggattttgaacaaatcaattccgaaaattctattttattaaattttttgttatttttgtccatttaattttaaaaaatactcaatcatttacacagagaaattttttaaaccgtttaaattataatattttcacttgaaaaataattaaagtaaaaaatttttaaaaaatcaaaatttttcattaaaaaaattttttcccgtttcccggcgggattcccgttaaaattgacgggatttttacgggaacgggaaaaagccgggaatcccgttccagtttcccgtcccgctctttatcgattcccgtttcccgttccccgttcccggaattttttttttaccggactctaatgaacagtatttcccaaagctcacttttccttcagtaaacataacattcgtttttggatttgttatttgtgttttcggttttttcctctttatttatttataattttttcttgattgccgacccgtctatttattgtaatcaataatttttagtttcttcggctccagtaaaaatggaatagattggacaatctgatagcgaataaaaactttaaaaataacgttttttaaagcgattacacatagaatttcaaaaaaattttgttattattcataggcgatttggtccatttggctttagaattcaaaaatattttaatttattttattcataaatacttttttcgggaatgtatttgttggtgtggtaaactatttggcgcttcatttttgctcaattctttgctgaaaattatgtcgctatttggacttttggtcattatttgtcactatttttgaattttttaggccctaaatatatccctgattaatctctgccgagcatattttaaatgagttaagaaaatctttttataaggttagtttatgtggttttatttaaaaaaaagaaaagtgcagggatagccctcccccacaacaatttacctcaataataaccatattttcggggaacttcatttccgctgtccgcctggcctcgttcattcaaagcgttggcattttcctgctattcctttttcacattcatcaggcggaccttttgaaaccctagaaaagcatagaaattactttttagattttaagaacaaaagggacagaaattttttgaaatttttcataaatttattaacaaaagcacgtaacgcagagaaaaatccggtttttagacaattttggccgtcgcatctcttcttgaaaagcggtcttttcttcttcttggtacccgcctctggacatttagcagttaggaatgcttcaccggcactatgggtacgccccactgtgcagagaaaagcctagtactatctcgtcgtttctctttttctttgtaatttatctctgtttggcgtactatctctttattttttaattgaaaaaacagaattcaatctgatgctaatatcttttcttcaatgctaccaatccttttcaaattttgcaaatcgatagagaaaaaaattctacatagtttaatactgattttattagtaattatgctaacaataaaaaagttattagaatagactaaaaattgtttctttttctctcgttttggagtactattttctgtctctaacacatgaaaaaacatcaaattcgtaaatgctaacaattttggttataaggatacaaaatcactttgtacaggcattttccagtgtaaattttgaattaacgcgcaaaaatttacgctaaatgcgctatttggcgttaagagcaattttgtctgacactggcgcgtacccagagtacaccggcgctgattacggcatcaaattttgttaatgcatataaatgaactcggctccgctgtttgagaacctagcccgagggtggtcggtgctaaacagcgatgccgggctcgcccccccccctccaatcactgcccctcatcttcacacccatcaaatcctcctcttcctcctaatccttcagcttcatttctttctctgctcctcccgctgatgttgctcttccccctcaatgatttcaattatgaacattcaaaacgaaccctctctccttcttaattcgacttatgctgctgcggctgcccccgtccgcgggtggccctctgcggctgtggttggtttgatggacggtaacgacggaaggcattgtactataaagtaaaaatgtaaaaagcatttatcataatacagctgtaaaccttacaaaccaggcaacctcctcctcttcctcctgcacctcttg

SEQ ID NO: 16366 - DNA, 2831 bp, Heterodera glycines
  misc_feature (1936)..(1936): n is a, c, g, or t
catcggaatttcggccaacatccaatccttccagtcggcttctgtccatttcggtcctcaatttacctgggggcttggcctcgcttttggtgtttatatttcggcacaaatttcgggttcgctaaattggcattctatagcaatcaattcccttccatatcaggtggtcatttaaacccggccatttctttggttcagttggccaacgggtccatctctctggtccgttttgccctgtatatttttgcccaattgtttgccgcttttctgggcagtgctgtggcatttcttggccatttcggtaaaactaaaattaaattttgcactaattttatttcagagaattgcatgcaaattcaaacacgaaatggcaatcaagaattctgtaatgcgttctcactcatttgtttaatacatttccgatcacttaacagcacaacttttcgccacttttccaagtcctaatttaagcatttggggcagtgttgctgatcaggtcatttccatttccattttcgttttctttctttttttgacaccatctaaagcttgaccactatcttttcctggattaatttaaaattccctctttaagctgatcggtactgcaattttggccttttgtataagtctgatcatggacaaacgcaatcgcgtccccattggactggcgcctctgctggcgggcctttccctgacaatggtctgttccttatttatgcatcaccgatgttccttttttcaatcgaaagatcgcgttgactttcggcacaaatggcggctttgccataaatcccgcaagagatttggggcctcggctttttatgctttgtctgggactcggctgggaagtgttcaggtgggcgctgattagtgaaagtctccgcctacccatcgctgccttttccgttttccatgtgatcgatcatccattcgttcagcaacaacaatttctacttttgggttcccctagccgtgccttttgtcggggctttggtcggtcattggctctacaaaatactgatcggagtccacggcctccaggaactgatcgaaatcagcggagccaaatacccacgggacgaccgaggctataaggcaatggggaagaatggaaaagaatgaacgagtctttaaggagtacaattcgaacccggcctcaattggaatgtctgaacaattggtgggcttcagcagcagaaaagagatgttgagatgagaaaatggaaaatgagagaaacaaaatgccaaaaattgaagcaaaatgtttaaagtcgaaagaaagcgctattttaatttgtcgaaatcgcattaaacccgaattaatttattaaaatttgacttcactcacattattaatgcaatttgggcacacaaaagaaatgaaatgcttttggcttttagttgcccagggaaacggcaaaagtaagggccaataatggccaaatagtcgtgccattggctctgctcgttgttttgcccttttcgaatagcgttagtccaaagagcagtatgagtgccgaaggagtggcgaggggcggtggacgcaaatgaaagtcggcactttttaaaacggcggaaattcgcagtgaattttcaaaaggcattaaatggtcctttctcgcgcatcttttcactcgaatttttctaagtatcacatttttgacttatgtgataacagaaagagacttaaactcaaaaatgcatttgcttattcatttgctcaaccttttggcaaatgcaaaagatggatcggtttagcatcgacacatccagggccaaaaggtgggttaattaattgtttaattgtaagaggcgccgagcattgcttctgacggataatagctccaaaatgacagcaattcccaagtggtgtcattttgtgcccaacaacttggcattcgagaatttcctgagccaaaaagggatggacaangctgtgacatttactggcatagcgtggtttaccaagacatgaaagacacagtgaaagaggggggacgcgtcaacaaattccctggttaatgctcaagttcccctaattaggcaattaagctaatttagggatgagcgaattggccaaaaaggtttctttgactgtggcgatccaatcaatgcgcgaattgttccccgacgaatatgccttttacccccaaagttgggtacttcccgcccaattggacaaattcaaaaatcactgcacggatcaaagggacgccgacaaaggccaatgttttattgtgaaaccggacgaaggtcaattctgatgtggaaaaagagagatgggggagagaacgaaagctgctttaggtgcccaggggacgggcatttatctgatcaattcgcatgatcagctgaagagcaccacgacacggcaattggtccaggagtacgtcaccgacccctatctgttgccggatgacctcaaatttgaccttcgggtgtatgcggtgattaaaagcatcaacccactttccatttacgtggccagagaaggcgctcactttttattttttgtttatcttgatttataaccttttatctaaaaggataggaatggcacgattttgtacggaaaaatatgtgaggccgtgccctgagaatttcgacaaattttacgctcatttgaccaattactcactgaacaaagagaacaatgcgtacatgcacagcaattccctgagagaacagctgagaggtgaatttggcattttgccaaaaaaaaaataaatgaatcgcaggaagcaagcgactgctgtcgacggtgttccatcagatggagcgaaaaggcgtcagaacacggcgattgtggaaggacgtgaagctgatca

SEQ ID NO: 16367 - DNA, 1222 bp, Heterodera glycines
  misc_feature (145)..(145): n is a, c, g, or t
cagccccgtcgcttacggttgagcacagtctgagcaaaagtacggctaagtctgcggggactgaagctgaaacttctgccgccgaccagcccaacttccaagttcgctccatcgtcgacgaagttttgttctttggcataattanaattggtcgggtttgccactcgctgaacagatgataaaagtgccattggtcagggactgtcttttgcttgtgcttgacaaattgcagcatttttatggggcaaaagaaagcgaaaaggaaaatgaaaggcgcgaaaagtgaggacggacgggagaaggcgaaaagcaaattaaggttaagaaaagcggaaaggaacagcgaaatgtcggcggaagaagcgccacgaaattgggaggctttgtcggtgaattcgaaagggaccgaaggaactgccgcaaaagcggagggagagaaggacgaagaggaaaagcggaggaaggcacggagaccgcacctttccgaggcatgtcacgcagtgccaacaaaagcaaaagcatttgccaagaaggctttttacggtcaaaagccccgctgtttctgctgctgtttcaggtgttcccgctccgttatggccaagtgagcatgcatttgctggtgttggacagggccgtctatttgttcctccaatttgtgtccattcgccactctctttcaatttctctgctggcccttaaaatttttctcaggcattttttgccaaacatttgaatttttctcaccttttgctctgttaagaaagtgtctgctgatcgatgtaatgtctttgccagaattggagaagcaattcgataaaatcaattcgtatttcaacagcaccggcaaaagcgtcccctcgggggcacccgcgttgcctttccatggctttttgcaggtgctacgatttatttggtcaaagctccgtcctttcgaacttcatccctttttagcttttctttcatatcgcaaaactcaaatttcccacaaatgaaaacggagagcaaaataacactttggcctccgttgtgcgtctttttgcccattgcgacgcgacccttcgcttttacggagtgcggtcgacgcggctgagacgcgcggaagtcaaagggcggcacgagcagcggacggatgggtacgcaaaacgcatgaaaacagagggggcggggaaagggaaaggcattgaatggacaacgcattttggtcacattccaaattcgagaa

SEQ ID NO: 16368 - DNA, 1369 bp, Heterodera glycines
ttccgttatcaacgataggtaacaacggttgcggtttccttttaagacatcgcttccgttatcacccatgtaacaatgggtcctcagtttttaaataaaacatcggttcctttatcacacagaggtaacaacggttccggtttttatataagaatcggtcctttatcacacagaggtaacaacggttccggtttttaaataaaacatcgttccgttatcacccagaggtaacaacggtcggttcctttatcaaccataggtaacaacggttccggtttttaaaaaaacatcgcttccgttatcacccagaggtaacaacggtcggttccgttatcaaccataggtaacaacggttccggtttttaaaaaaacatcgcttccgttatcacccagaggtaacaacggtcggtttcgttatcaaccataggtaacaacggttccagtttttaaataaaacatcgcttccgttatcacccataggtaacaacggttccggtttttatataagacatcgcttccgttatcacccatgtaacaacggttccggtttttaaataaaacatcgcttccgttatcaaccataggtaacaacggttccggtttttaaaaaaacatcgcatccgttatcacccaccagaggtaacaacggtcggtttcgttatcaaccataggtaacaacggttccggtttttaaataaaacatcggttacgttatcacccagaggtaacaacggttccggtttttaaataagacatcggttccgttatcaacgataggtaacaacggttccggtttttaaataaaacatcgcatccgttatcacccaccagaggtaacaacggtcggtttcgttatcaaccataggtaacaacggttccggtttttaaaaaaacatcgcatccgttatcacccaccagaggtaacaacggatggtttcgttatcaaccataggtaacaacggttccggtttttaaataagacatcggttccgttatcacccataggtaacaacggttccggtttttatataagacatcgcttccgttatcacccatgtaacaacggttccggtttttaaataagacatcggttccgttatcaaccataggtaacaacggttccggtttttaaaaaaacatcgcatccgttatcacccaccagaggtaacaacggtcggtttcgttatcaaccataggtaacaacggttccggtttttaaataagacatcggttccgttatcaaccataggtaacaacggttccggtttttaaaaaaacatcgcatccgttatcacccaccagaggtaacaacggtcggtttcgttatcaacggaaggtaacaacggttccggttttaaataagacatcg

SEQ ID NO: 16369 - DNA, 1163 bp, Heterodera glycines
aaaaaccatcgcatcggttatcacccaccagaggtaccaacggtcggtttcgttatcacccataggtaacaacggttccggtttttaaataagacatcggttccgttatcacccataggtaacaacggttccggtttttatataagacatcgcttccgttatcacccatgtaacaacggttccggtttttaaataagacatcggttccgttatcaaccataggtaacaacggttccggtttttaaaaaaacatcgcatccgttatcacccaccagaggtaacaacggtcggtttcgttatcaaccataggtaacaacggttccggtttttaaataagacatcggttccgttatcaaccataggtaacaacggttccggtttttaaaaaaacatcgcatccgttatcacccaccagagttaacaaacatcggttcctttatcacacagaggtaacaacggttccggtttttaaataagacatcggttcctttatcacccataggtaacaacggttccggtttttaaataaaacatcgcttccgttatcaaccataggtaacaacggttccagtttttaaataaaacatcggttcctttatcacacagaggtaacaacggttccggtttttaaataagacatcggttccgttatcacccatgtaacaacggttccagtttttaaataaaacatcgcttccgttatcacacagaggtaacaacggttccggtttttatataagacatcgcttccgttatcacccatgtaacaacggttctggtttttaaataaaacatcgcttccgttatcaaccataggtaacaacggttccagtttttaaataaaacatcgcttccgttatcacccataggtaacaacggttccggtttttatataagacatcgcttccgttatcacccctgtaacaacggttccggtttttaaaaaaacatcgttccgttatcacccagaggtaacaacggtcggttccgttatcaaccataggtaacaacggttccggtttttaaaaaaacatcgcttccgttatcacccagaggtaacaacggtcggtttcgttatcaaccataggtaacaacggttccggtttttaaataaaacatcgcttccgttatcacccatgtaacaacggttccagttttaaata

SEQ ID NO: 16370 - DNA, 2702 bp, Heterodera glycines
  misc_feature (2640)..(2640): n is a, c, g, or t
ggggaacggggagagcggggatgaccctcctcaacggggtcccattcgcaaatcggggaacggggacacctaaattcgaattttattgaagaaaatatttaggacgactagaaaattataccaattgagtagatttttcgaaatccaattaatttttaaatgtacgcacccaaatgcaacggttgctgtgcccgcggaggcaaatccgcgctggcgaacgcgatggccttcaggtaggcaaactccatgttggacagcttcagctggcgcgttttttgcgcaaacaaatgcaacagcgcaatctgtcggcacaactcctcgtaccgttcccatttcagttgaccgtaacggcaccgtatgccaaggtgggcgctgacggtgcgcaacatgtgcgccaagttcagttcatgcgcacgctggacaagcccgagcaggaatagatcacaccactttcccttcatggtcgactcgatcagtgcatgtctgaaaaatgtttgttcaaaagatttaaaaaattgagacccaaagaactagaataaattaatagacaaaaaatgatgggtttaaaggattaaaaattgttgacatttgaaatcaaattaatgaaaggattttgccaatgaattcctaaagttagtttggctaaatttttgatccccaaaaaccgaaatacaacaacaaaggttaggaaatcttctacttaacctgtcttggcaaatatttatattgattagctgctatctttcaatggcataaaatagcaaaatgccattaattaattaatttgccaagattttgtgacattatgccaaggaaggggggatggatagttcaaaaactcactggtcacccaacgcgtggatgcccttcacccaatggacggacataaacagaaggcgcgacacgctttcgcagatcacgcggaagtccacgccgttcatctgctgttgaggattttgttgctgctgctgttgttgctgtaggtgctggtgatggtccaacatcggtggcattgacagttcaaatttggcattttgtgcactgatcaccggcgattggagcgatgccggtgctggcggggaattgcttaggccgaccccacaaccaccgccgacgccatgcgacgatggcatggcaccgccgtcaacggagaaagcggtggacgagccgcgcgaggaggcggtcggcgaatcgtctaactcgaggaaaagtaacggatcagcaccagcagcagatgatgccttaaaaggatgggcaaaattgttaaaatggcaaagttagaactgacatttggaaaaagccttgacctggattgcatgtagaagtggacttggatttcccggacaaaaatccaggaaaatcaaggtccaggaaaaatccaggcttgtcatgtttctggacctggatttttttcatattgtatttgacctggccctcgatttgattgactaaaattcagaaaacccaggtgtccgaaaaatggcctggaccaggatcaggaaaaatccaggcctgggtccaagtccaggtcgagctctagataaaacaaatcagtttgggggttccaaattatcgagagcctaagcgaactcggatttggtgagcagttccttgctcttgggcgccgctttcccacgcacttaagaccaatgcggtctcgacgagtgctttagtgccactctcgattccaagtctcgagagtcatgagaatcatcaaatgccatctcaatcactgaccaagtgatgactgttttccaataatggtgctccgtcctgctggtgttggttgtggctgttgaatgcaaaatcgcgcttcaacagttgggccagcagtgacgggccgtcggcgaggccacaggcggcagtgccggtgccatcgccacacgatccgccgatgactgtgccacctccgctgccagtggtcagcacagcgcttggcggtgacggcgactgtgacgtggtcggcgggctcagactgcctcgaagcggcccaattggtggactggcgccggcccggctcacaggggcagcactgagactgtcaattagcggcttcagcagcgaaggcgagccgtgttgttggaatgtgccgggaccgatggtgccacaaatgtcaacctgaggagagggggcgggtgaaagctttctttgaaatttggtagttttttttatcatatttcattaaaatttcaaaaatttccccggcggcgcatatcggcaccgcgggaccccattttaccaacaaaatcctgcttttctaccgggcgccgaaaattttgaaaaagaatttacaattttttattgtttttatttttttgaaattcaaaatcaaataaggaatagaaattttcggtaaaaattttattggtttagttttgacacattggctctaaagatatgtcaaaatttaaaatataattaacaatttattcaacaaatcaattttgctttcgccgcgttaaccatcgctgacgacgaagcggcatcatccgagcatgaatggggggggggaatgagcaccgcttgttgttggccagcggtgcgtaccgactcgtgcccgagatgggtgtgccgccgcggcagcagccgcttcgctgctagcaccgccgctttccttcccctgacgatgtcgtatcacanaattcggggtgatggtggtggttattgatgttgttgtgttgggactccgccggcaaccgatg

SEQ ID NO: 16371 - DNA, 2804 bp, Heterodera glycines
  misc_feature (2634)..(2635): n is a, c, g, or t
  misc_feature (2671)..(2671): n is a, c, g, or t
  misc_feature (2748)..(2748): n is a, c, g, or t
attgaatttttaatggaatttttcggaaaaaacgccaaaaaaggcaccaaaacggcaaaatgccaaaaaaggcatttaaggcacgaaaaccccaaaaagacataataaaagtctaatttttcttaattttcaagcgcaccttgggttatttaagaataaaatcgcagcgtaattttgtttttgtttttttatatgcacataatcgcaaaatatgcgcataaaattaagcaccataaattcatttacatataaatagtgaaaatatgcaaataactttttccaaatgagggcaaaattttgcataaatatacaaatggaaatatgtaatagaagcttcatatcaagctaacatggttttagtgtgttttttgataaatatactgtttgggagtttggctgggctgataacggcacactctattggcaacgtcaatgttaaatgatcgtaaacataattttgataatggaacgtgaatttgtagcaaatttttaattgctcaaatattaattttcccttgtaaaaatagaagagccgatctcgagttaaaaacataactttcataaaataaacagggatccgatagagggggtcaaaatatgggcctatgcaaaatttcaagaaaatctgaccctaggaaaaaatttttgacccaggacaaagttttttctttttctctcatttgggcatactatttccatgtctctgacatataaaataacacatggttcatttttttgccaataaacaattttttaaacttttgactaattaagaaatattcttcagaattttcccttcaaaatgagcacaaaatggttttgtttggtctattattggccaagttataagctaaaaaaatttcataaaatcaagggtaaaatatagtgtgtaccttttactgtttgtatttgttcttttggcgttctgtatttattattattttatttatttgctttaaaaaattgaaatttatacacaaacacaaagaggatttgaacctgagaccccctttttgttgactaactcacagaccactaagacaaaaaaaccaacttatttgcgcttggagcccaaaattgactcgccgtgtacatatttcgggatttaacatttttttgtactttttagcattttttcctacattttttgcatttcccgtttttgttcgcaatgtttgagcttgcggaccagtctgacggtaccagcggcataaagcagttgtgggctttgatagacccaatttggaaatttgaccgtgccgaattggtcgactgcatggcaaaacgggtcatctacgagactggtaatagccccattttttaaataaaatttgatgggagcgggtaaaggaaaacatttaaaatccgacaataaacggcacaaatacttgttccataattttcgtatatataaaagacagaaaaattttctgctccctctgcaatttttcgctctttaaggcaattgagggccaagtgtccaccttttcgaaaatctcaaaatttgaaaaagagttgatgaaacacattttagggattatcggggtcgttaatcttgaatctcacattcaattccgaccaattctgcgcccctaattggattcaaatgataagccgaaaaattcgaagagtataactgttcatgtgaaattaaatcgagcccgaaaatccctaaaatgtattatgaacttttgtaaagtttaatttatatttttttcgaaaaagtgggagggggtaccacctagaatggccatgatttttaaaaaacgttcgggatttgtatttgcgttttatttatttgattttttttttgactttcagatgaccttatcgcactggacaaaccattccaaatggcattttcgtcgggcccggatgaccagccccaacttgacaggattttacaggttacccccattttaccatatttttgaaaaaatgtggaccaaaatgacaaaaatagtcattttttggcgaaaaacggcttcaatttatgcaaaattcttgctattcgggatttctaaaaaagaaaatacaccctcctccccctaaataatcaaattttttatttacccccccccccccaaatccaagggtcaggctatggccttgaaactctgacacctcggaaaattgaaccctttcatcgggtattctaacaagaaaatctattaaattttcacaggacttaaagaagcacattgcgcccaaaattgaccggctgtttctcgtcagttcgttggacaaaaactgcagtggcgtcatcgttttcgccaagtgagtcgacagacatttgaccctgaacatcaaatgcaagtttggttttgttttttgacaatcaaaatttagttgttttttttaaattactcacaaaaaaacgaaaaaaacttttttcaaatgcatattttttcacgaaaaaaacaaaaacaaatttaatgtcactgagaagtgacggagcggggggggggggggtgaaaattcgaataatttttgggtctacaccaaaaaaccaggagccaggtcaagcagttggagatgaaggcccaactgcagaacgacgccctccttttccgttaccgagccatttgcaagggcgttccgaagttggccaaggcgcgcatttcaatcccattnngatcaaggttgtgttttttcaaatttaaaaaattanaagcaccgaaggcggaaaattttgcatttgttttttagcgggtgtattcgttttccaccgtcccctgaaatttttanaacagaaacatttgcaaaaacaaaacctaggatttttaacagttttctctaagaaa

SEQ ID NO: 16372 - DNA, 1389 bp, Heterodera glycines
tttttcttgaaaaatttctatgttagcaaattttttttaaaaaatttctcggggggggggggaacgagctgctcccaattatttcccctaaaaaattgcttacaactaaatgccactgtttagccgggccaaatttacgtgtactgttgccgctggcaccaatgcgatttccaatttgactgccaagagggcctcaccgagcacatttggacatcgcacaccaaccaaagtcagtttttctgtcggacgtattttttgaatattttggctcaatttaaaaaaaaacaatttgtttttagtggacggcagtgaaaatcctttcgtttgcctgtgggcctcgtgcctgaaattccggcgcgagacgaagcccttcccggcactgcaaaggctgaagcggcacctgagggaacggcatttgaacactgcgggacgtgtcatttgcccaaagcagaggacaaagttggtggaggggccaaaaatttaaattcaaaaattcgctatacaatcggtcccattgaaaaaatgtgacaaaagcgggcaaaaacttcaaaaattagggtttttttttttaaaaaaattccatttgagtaccatggtagggcgaattgttccccaaaaaagcgcaaattcaaaatgaacagcttttggcaatgcatttttgctctaaaatttcatttcccacacattccgtttcattgacgtcagtgcgacagaatttaccattcctttcccccctttttacccaaaaaaaaaattcttttttttcggctaaaaccacggatctcggcaattttcggttagctcggcgctttgagaccccctgttttttcggttatttcgttagtttcggttgtccaaccgccccgcccattccattttcggtctttgttcattaattgccccccccccccccacttttgccaggaactttttcgtctatttgccgcctccgctccccggcgccacgaatggcactggtccgtccacctcctccgcctcgacggcactgtcctccatcattgccgcctcctcctcctccgctaaggggagccatcacagcaatttgctgaccggtgtcgaggccggcggtcgctttgtgcaccatccgttcggcaagccaccgccaaatccggtgccgtccaaagtggcgtcaccaaacgatggcggcggcacagcgggcggtgacgggcgcacaacaccatcgtccaccaacagcggcaccaccggtggtacgccaatttttcagtttttacaaaatttttccgtgccgctggggcaacaactcggcaaagatcgaacagtttgtttctttgttgaaaaatgtagatatattattccaattgtttgcaaaaatgcaaatgattcgtaaaaatacggcaaaatcgtttt

SEQ ID NO: 16373 - DNA, 1379 bp, Heterodera glycines
cccccccccccccaaacggggcgggtgcccattttgcccagcgcccagttcataatatgaaaggagagttggtcaaccaaaattttgtgaacgggggggggatcagcggcccaaaacaatttttggaaaattttaggtataattttgggcgccggcccgagaaattgtttggaaaaattttatgaacttttgttaagaaatatattcaaaatttcaatataacgaaacatttttgtatgatttccctgtcttcggttaaaggtttcttcacctcgtccactccgctggtggccgccctctcacagccatccatttcctcctcgcccgcctcgacacgttatggggtgaacacgccgaaatcgtcgtcggctgcgtcctcctcgacctacggcacgacgcaaaactatggcggcggcgctgctgccgcactgtgcaacggcggcggtggcggaccgttgccgagtccggcgggaacaccgggcggaggaggttcacggcaacagcagcagcaacaacatcactatgtggtgcagcaacagaccaatgctggaggagcagggtgtgacggaaacggaagataccatccacagcaacaggttgggtggcgatcggaattaattcgttatacacaacggcccaattttgggctctcagtgcaaataggtttattatttatttagtaatcagaacgccaaaactttgcaaaacttaaaatttttttggaattttcccttgtaaaattagaagagccgatctcgagttaaaaactagacagctaaaaaataaactgtgattcgatagagggggacaaaatatgggcctatacaaaatttcaaaaaaagttacccacaggaaaaaattttttcccagggcaaaaatttcaataattttaattcttttttagccaagtccacaatttaaggccaaaccaaataaaatttacaatattctccagaattttcccttcaaaatgagcataaaatggttttatttgctttagtattcaccaagttataagctaaaaaaatttcataaaattgtcgatgttgtacctaaccaacgctttttgaatatgattttttattgccccgaaaacttttattaaagaaaaaataattctcgcctagtcaggcccgtatccagcaggagggaggacccgtgccccccccccccccccaaaaaaaaatttcaagaaaaatgagtaaatttttttcaaaattttcataatggacggcgcctattggcccaactgccgggtcctatttttatgcccctccaagaccttccccacccaaaattttccaaaaactttttttttgaaaaaagtttaaggaataaaaattgggacaatactgtcccaatttattacaggagagtcg

SEQ ID NO: 16374 - DNA, 2157 bp, Heterodera glycines
atagatacgaaagagagacgcgtgtagcaaatgggagacgtgctgctgaaccaccttccaatcatcctacttacccacccaacagagagcacacacattgttaaacagattgaaaaaatttgcgtttgtaaaaatgaaaaacgacacttgggtgggggttagggagggggagggtcgaagtgaataccggtaagtcaggaggggggggggggtgtcaaggattgcaaaattcttatgaagtttcatttgaatgccttttgattgtcctttctctattcgttcacctttccatcaatgttcatatttcacacataaaaactaatatattctgctggtatatttggtcacattggcccctctttcgatatttttcccacttaaaatgcccttcctacagttataaaagcgtgcctattccgctttgttgttgttgctgtcccgcgtcattcggtgatttttgtgccgtcctttccccttccttttcctgctcttctcctcccttcgttgtgttatcgttgttttgtttgtattcagttgcgaatttgggtagggtcaccagcggaacatcgccagttggcgccgctcttccaacattaatctcccaatcagtcaaagaaggcccttcttcatccatctgttggttattttgtgccgcatttctaatccctttgcttttccgtgggtcgcttggttttggcatgccttcaatgttgttaagcagaatcaagattgggtgtttcttctgcgctcctttcgccgccgaggtcgtgccgctgttcggtgattccggcacatctgtggcttcggcattctctggtgcctccgtctccccccttggcattcccttctgcttccgaaattgttcatctaccgcgctctcttcgttcgtctccgtgtcgctgcgaagactgcgcacagctcctccattccctccattttcatcaaattcggacggcagtgtcatatccgagtggtcgttggccccctcttcctctctgtccgtcccttcaattggctccaccatttcttcctccgtcacttcgtcaaccaattccaattgctcagctgcactgccattcagaatgctctgcagattttcatcctctgctgctatggatgttcgccgttcgttctccccttgcccaattattgggttgcaaattattcggttgttcaatcgaagcggaatgggacagttccgcaacagactgtcgggaagtgcagcagacgcgccgcccggcgcagaaaagaaattcgagggaagcgacggggaattttgtgttgaatttgttggcgttgtcatacgcaaaagaatggacaaaacgaaaatacaaacactttttcagttgtctttgattttggtgagcggtgtgaaagccgacggacagaaagcgaatggggcaaaaagagaaacattttgaaaatgctcaatgctttttgatcgccgcatttttaattgtatacgttggacctgcaatggcaatttgaagtgtgaaaagcgacgggaagagaaaaagcggcatgggaatgccaagcgaataaaattgtttttattttcactttcaccaaaaaagcacactatttgatagcatttctatgggctttcgaatgataatgcaagataaaatttggtgccataaaaaaaattcataaaaggctcagaagattcaaaaatttggaaaatcgacacaaaaaaaaaatgatcgtgtcaaaaaaaaccgttttttattcaaaaataaattatatgaaaactgtcgacagtttatttaatttcaatttcaatgtaaataaataaaataatgaccaataagttgcaactttaaagagcgccgaattatccgaaatgaagaaatattggattaatggtaattgaccagaagaaatggggaaagaagggagaggagcagacgaacggacagacggcgaataagggggaaatggcgaaaacggaggacgaccgccagacagacgaagggggagagggggcagagaggatggggggaggaagaaaatattaaattagttttatatgctattttgactggtaggcgagacgtccggtggacagtgtgccagtagacgcgatgtttatttggccatatgtcaggtaataaaacttggatattagtcgctgatgtgaacaatttatggattcta

SEQ ID NO: 16375 - DNA, 1518 bp, Heterodera glycines
tagcaaaagcataaaattgagaaaaaaagtggaagtgaggaaaaagattctaacgagtgaaatggggaaagagcaaaaaccttgagatgaaatacataatgtggggaggggattagggaaagttagcgagataattgaagattttaatatgcatttttatttgactttgtcctacttttttgggaatttttacagaatttttctattttttaaattgaattattcgtgcataagtgtttggggcattacgttgtccaactaggaaatgagtgcatttagtttcatttttttcttgaacgaatgtgctacaagggagcattccgaactgtgactgctctgatcactaaaactacttttatcgtatagagtggcagatttgctatagccaattttcggcttttttggctaaggagcccaaaaatatcagaaaaaatcgattaaagttccgaaaaatcggcaaaatggtcaattttttaaaaattcaaaaaaattcaaaattgtgctagagccataaatcttttttaaaaatgatcagagaaagtttctctatcaatgtttaatttggttgagtttgacaaaagttatgacgatttttgtgctgaaaaaaaggtacgagtcggggcagtacgagtggcctagtacaagttgagtttcgttccacagaatcaacttaatgggctgactgaattaacagataaacaaagtgccacaacccaaccaaaaaacaatccgccatttgtttttacaataaaatgcaatgggtatttttgacactaatcctactttttcacctcttttgcacaatttgcgtttgtttatttagaggccataaaatttgcttgccttttcctaaaatacatacttattgtgtttccagcagacttcttaagatcgctgatcaaaaatataacatcaattagaaattctgtgaaagtcaaaaatagggggaggggagggcaaaccaaccgaacagttgaaacaggcaaaaacatttgttagcaacggcaccgaaggaggcgaactggcggttcccggctgtcacatgcttttcgcatgcgtgtgaacaatacaaaactaacgtattcgacgttctttggctctgggctttgggaaggaaataaaatgagggaattccttccccggttttccctttgcatttgccccggcaatcgataagacataaataaactggccaaaaaccaaatgttacacaaatgtgtgccaaaaatatcattttcattaatgaaatcctaattcagctgcgcgtaaaattaaccgcttacaaattaggagcactaaattaattttattaataaaaccgctgctcgtcaaaatgtttccaagctaaaaataattaaaatattctcctccaaaaaattaattaacttatgttaaaaatgaaatttatatttgccaataaaaaataaaaccgatggggaagatttgacaaattttattaacaaaaaaaaggaaacaaaagtaatgaaatgaacaattggaaaattttttcatggaaga

SEQ ID NO: 16376 - DNA, 2931 bp, Heterodera glycines
  misc_feature (6)..(6): n is a, c, g, or t
aataantttgttgaatttatatttataaaattgtcgttccctttttataaaataaaattgcgaaattctgaccagacaattctccacatattctattagcccatcaatttcaaacttttgttcatttagtacaataaaattggtaatgagaaggaattaaattttgaaataaatgagaagaacaattggtcccataaaaaaatacatgagggaattcaaattttaaaaggacaaacggacattgtaagaattcggaaagaatttgacgccattttcttaaaaaaattttgatttgtccacaaaatccgtgccctttcctgatcaaatcatttgctttgttcctgtttatttaagggcattccaatggcatagggagtaaagaaaaaacaaaaaaaaacagccaatttgttttgaaatgcaaattatgtctctaaaatattaggtcattaatactgatcgcgaatctgaaattctaatcgttgttgccctttcccacgtattattgatctgattgtgaaggaagaggtttgacagcaaccgagttttgctgtgtcatcgctgaggacggcctgcatttgtttattatctaggcgataataaacaactttttgttggacctgctaacagtttgacactgttagtagtgagaaattttgcgccgctgattttgtgtcttggcgacacatttcagttcatccacgcgcatccactctgtttagtagcttggcgctgctaacaattgagtggcgaacgacacgtcatttaaaacgagtactctcgagctgaagggaaagtccacgagctgtggttaagatgggcgacgcaatccaacaactcactgcggcaatccagcaattattggcaaatcaaaatggtgcgccagccgcaaatgcgcatgcttttgccaacgcttctgaccatcgactgttttgagccatcggacgatagaagcatttctgattggttggaacgcttcaactttgccatcgactgtgcggcaccgcagctggcagaccaggcgaaggtcaagctgctcatgacgaagctgagtgaagtggctttcagccagttcagcaaatcatgtctgccgaagaaagtcatcgattttgactacagccaaacagaggagcgcctaaagattgccttcagccggccacaatccatttggattgatcgctatgaatgtatgagggcctcgaaaagcgaagatgaaagctttcgtccttttatcaacagacatatgcgactcttgcgtgattctcagtttgaaaagctcaacgaagagcaattttcttgcctcatgcttttgacggcactgaaatcaccgaaggatgccgagctgagaaaacgaattctttcgaagcttgcagcgaatggtgacctggtcgagtatgatggagtcgtcgaatacctccaaatgtaccagtcaaccatcgctgaagcaaaggtcgtcgaacaacaaccgatgggctcacgaaaaacttgatggcgaacaaattgaaggcaaaaaagaaacgaacgaactcggatcattcgtcgaatgagagcagcatttcgacaggaacgcgcagcagcaatcgatcgcaacgcgtatgttggcgatgcggtttgagacattcgtcgagcaattgtcgacatgaaacaaccgtttgtcgaaagtgcaagaagagtggccacttggaaaggatgtgtgccaagcaccaggcatggttaaagaagaatggaggaaagaaggaaaaagcggtgaacaacgtccgcgttggaggagttttcctggttaaatctgagaacgagacgaagaaaggaataatcgatgttccgattgatgtgaatggaataaaagtggacttcattgctgatttcggcaccgagagaactgttctttgtgaggacacggtgcgccaaatcggaactttgaaattgagccgttgtcaagaacccgctcagtatggcaagaggtataagaacgccgaccgaggatgcggatgatggacggaggcctggcactttttaagggggggggggggagatgttagggttgggacccaatgactggtacccatttggccttttactttatttgtttctcccattttcccttcgtatgtcacgcccctttttccgcccataaatacccgcgttgttgacccttcctacgtatttcgtttatttcatttatttgttcccttcgttccccaatcaatatctgaccccgttcgccctgtctttcttttctttttgaataaatatttcttttattcctcttcggacttttgggcgtaatatgaattaacccccgaagtgcccagttttctttaagatatgcttctatcttctttttccattttacaatttctttttcgatttgatattatttttcatttctccgaacaatttcataaatacactatgttttagcacatatttcagcatgagcccaaggggcgaaatagtccctcttatcccttcctcctccccttcaaactcagtctaagaaatcgaaaaaaacgaaaaatgccgatggtttgtgaaaaaaatatattatccagtttgaaaatgtaaaaggattgactcccgaagatgaaactgtcaacgacgatttgttgagttttgagtcccctgcctttttaaattgattataattttatattaattccaactaattttatgtggaaatagtttttatgaattcaaatattgccaaaatattattttttgctgaattaactcaaacttgttcttttgtgaagtatgctcttaggattaagctttgcttgcaattatttatttgatttcatgttttgttttttattaacattgcttttatcgaccttaaatctaatttgaaatataatttattttaatgttcatttgaaattgtttttttcttactaaagtatcatttatctaattcaaggcgaaaataaattt

SEQ ID NO: 16377 - DNA, 3017 bp, Heterodera glycines
gtccaggtccaggccatttttcggcaacctggatttttcctggacctggattttcctggatttttgtccaggaaatccaggtccaggtctaattgaaaaaacccaggtttaggtccaggcaaaacacgaaaaaacctggattttcctgaacaaaattttagaatttgttattttaattgaccgatatttttttcaagttttcaaaaaatgattaaataacttagaaacacatcattattattatttagatatttttagaggtttataagcaattaattgattttttcaaacatttttttgatttttaaaatgagtttcaaaaaatccaggtccaggcctggatccaggtcccgaggagcctggatttttctggacctggattttcctggatttttgtccaggaaatacaggtccaggtccaacttggaatccaggtccaggcttttttcaaaatgtcgatctctacatatttggtctctgaacaaaaaaaaaattgtataaaaatgcaaaaatgaaaaattttgaaagatttcaccggagcaaaaaacttacaatttttcttcagagaatcgaaaaaataaataataaatttttattttttattttgcaaaatactgaattaaaatttattttttgacaaaaaattgttgtaatttatgataaaataattttttataaaatttttgaaaatctttttttttggttgatttattataaccaattagattatttagcaccaccaaaatcattattcgaataaattctgaagtccgaatttagccaaaaatgcctgaactaggattttggttgcaccctcggaatactgccaattgttctatattttttttgtgaaaatctctagaatcgtttgaaaatttggctactttaaatcaaaaattctcgcctttttgagtttctctccgttctcgcaaatatgggaggagcaaagttcctattttagtacacattttggcaaatcataagttaattaatatacaaaaaggaattatttttattcctcataaatttgttatattttattttgggtattttttagtaatattgtagaataaaatttactcttaattatgaaaatttgcacatttatcgcttctcatttaataatttacaaattacacacccaaatcaccaatcgtttgtacttcagtttcaatatatcctcaataacagcagcacatcggatccatttttaaagcattacaaatcccacacagaaaaggatgtagaaaacagcggccaaaaaaatggtcacccatccaattaaattgcctttttgaatggacaaataaacggccaatttcagcgcatgccaccaataaagcatgccaacaatgatgaagatgacgaggatgccggtggtcatcgacgcgccaatgttcagcttgccaagcatgatcgggtggccaatgtgcagccaatggaagtgcaggccgggcattggggaggtcaaactccagtccatcactttggcatcaacaagcagggcgctaacggtcgaagagccttgctttcctaaacaaaattaattaatgattaaatttacatgaaaaattaaccacaaaaatataattctgcataggttacagaattaaataaaatgttttataaaatattaatatatttgacggcaattcagtcaaatttaataatatgatatattttttaatgcaaataataataattttttaaagaaaattcaatatcagtcggatttgattgacaaagaaaaattaatttgaagggttttatgttttcgattttaatcataatattttttggatataatttttaattaatgaaaaagatgaataaaaaagggatataagcttttatccctgtataaacttgcaaatttgccattttcatgcctagaaatctcatcctttatgatgacaatggtctgactgattttaaacgaaatgttaagaaaacttcaagaaaatttggaaaacttttcataattcaatattttacccgcttcaatgtaagcatttatgccagctcccaactcaatgccgcgctttcggcgtctccgattgctcttttttgtgtttgtattttctccactctaaaataattcattttaaatttttttattttattttaaaaatgtttagtcaaaaataacacccacactgttctgggcatttccgacactcttttcaatttcgttctgtacctttttcaggccaaagttaatgaaaaggtccttcaacatttgtgccacctttttgaacgctttttcattactgttcgctttctttttttccacaatatttgacattttcttaattgttgtgcccaaattttcattcaatgattcctcaaaattcggcacattaattgatggctcaatttccgacaaatcagtgattggcacttttcctattataaaacacattaaaaatggttaattaaaatttattaaaaggttttgaataatttttattgcatttattagcaccatcgttcgctttttgcttcattttttcatcaccatcattcaagacaaaattcgctgtcgagaaaagtttcaatatccatgcgcggaaccaatctttgggctgcaccaaaatttttttgaacgcaaattttactccctttttcattggcaagtaaaatggaataacaagctgaaaaaataaataaaattctggataattcgtaactttgtaaaaaacaattaatcatcgataaaggtcaatccgtcagaatttattttttaaatgtatgttttgttgctttattaatttttacatttttgtttaaaatgtaagctaaaactgtccatttaaatattaataatttacggatgacggtttgacagtcaccaattatgaattttccttttatggcctttctgttgacagattatcatagtttttttatataatttatttttaaaaataatattttttaattaaataaatattcaattgtgtatatgcctcaaaatgtgaatgagttttaaaatttaaaacggaaaacttttttta

SEQ ID NO: 16378 - DNA, 1607 bp, Heterodera glycines
  misc_feature (1572)..(1572): n is a, c, g, or t
atcaagccaaaattttttgtttcaccagtattattttacaaaattttcagcaccgggcaaaaaagcaggaaatttttgcagttttcgccaaaaaaagagatcaaaatttaaaaaaataatgacacaatggggcagggcgctgctgataggcgcctgtctcggcaatcagtctcgagtcaaccggtatgtttttaaaataaataagcaatatttttttaattttacaaaaatatttgtaaggctaaatgcatttttttctccaaggctacctaatttagaaaaaggcacagtgaaaatttttgaaacgaaaaaatggtctgcatgtaaattctcttgaatttcagttaaggaactgatgattacagtacagccaacccatgcttaccatccgtttcattgatccaccaaagccgaagccgtactgtactcggtccttgtcactgctgatgtgttggatggggaagcgatgggcacatgtgcaccgggccgtctcgcgtgcaatttcctcgtggatacgttccgtctccgtcttgggctcgtaccgacgctaccgagggggggggggggattttgtgttactgtatttacttcatacactgtagcaatttaaatagtaagtaaaatgcgtggaattagagacggatgggaaatgaatatttaaaaaaaagaaaaacacaggctttcagaatatttcctttaaaaggggtaaggcaatggagaacagtatgaaagaattacagtagacataattacagtatgccagacagaatgtagtaatgtacgggtttttaaataagattaccatctttttggggtcgaatcggagtgcgttcatgaattctctggagacgatcaggccatcccccttatcaaactcgtccgccacccgggccatctccagcgcagaggtcggaaattctggaaaaaaacacatggaacagaacagagataaaattgaaaaattaaaaatgatagtaatttcataatactgtacttgaagcgaggattccgtcgatgaacaacttgcgcggcaccatgccggtgcccgacttgtcaatgcgccggaacagatcagacacgcgtgccttgccgtgatcgttccacgccaaataccgttcccgccaatcgtcaaaggtgaagcccttaaggcgttccaattcctggcaataaatcaagcaattagttaattaagaaaatcaaataattcattattcattaaatgatttagatgaaataaatgaacagcataatatctttctttttaaaatttttattatgacctcattaaatttaagaaattagaaacgttgatgaatttgatgagattttacaaaatattattgcctttaagccacctatttaattttgcattttagtcacctaatttttttaaaagataaaggaatcaaaaaattatgaatatgtattaaccatccctaatgaaatgaccacctgcaaatgagctttgcgctcgttcagcttctgttcatactgtaccaagtcggtccacaaccgtttccaattgtcgtgcagcgtgtcgctttttcgccgtgtacgtttcttgtcaatggncgtaccaagcgaagagcgcaagggtactgtaccag

SEQ ID NO: 16379 - DNA, 2343 bp, Heterodera glycines
cagctcgctttgtcggcgacaacggttgttgctgctgcaagtgactgtcgcgtctcttagcgctcgccttcgcggcaccgctcgctgtcatgccctcatcgccagcagcaaaagcggcagcgtcaacaattgccggatcctcggacgcttcgcggatcaacgacagtcgcttgttggccatcctcaacaggtcgtccagctccgtctgtcgctggtgcaggtccgccttgaacatctgctgttcgtccatcaaactgaagaatttgggcattacaatcaagtaaaaatagaaatattttttagagaaataaataaaattaattaaaagaaaaaataaattaaaattttaataaaatttcagaggcggagaagagagtgggtcaaatgcgcacaaattatttattgatgtttttttgttatttctctgataatttgaaactaccgtatccctaaaagggggaagggtctatattttataatccaaacgagggacgggagggatctccttttgtaaaatacgttatttagttgaaattaacaattttagaaaagaaaatccttttgcatccgaataataccgtaaattaattgggataaattccgtaaatcggctacattaatgaaagtaatacattttcttccgatcactcacgtgctcaatcggctcagctgtccctcatcactgcagtcgcgcatcagctccaactgtccctgcttttcttcaacaaaacccatcaattcgtccaacatttgctcatgttgtcgaatttcttccaaccgctaaaaataaaaaaataaaattattttgatcagtaaacaaaaaaaacttgtaacaaattcttcaaaaatttaagaaaaatgtaaacgaataaaaaatcaaaagtaaaaaattttgattggattttttaatgagaattctgaaaaaaagctataagataattcactattgagttaatttcacccgtagactctctgaaaaacaaaaattaaaatcctgatcagctaaacaacaaaaaattaaagcaatactgatcaattaatcaacaataaaaaattcgtccctcattccgatcaatcagaagcaatagtgcacttacatgtcgcaacttctccgcccggtcattgatcagctgatcaagcagttcccagcgagtgctcatgccacagatcagctcgcgcatcggagcctccgcgcgcggatgcgcgttgcgctgcaattccttggccaactccatcaccttctcgaactctggcaatttggccataaattcgtcccgcaaatggtccagctttgtctgttcggctagcaccgatttttcgtcccaagacagcgccggacggcgcagtcgcgcttcaatgtcttgcaatgatgtgcccaaatcgtgcctaaacagcatgacgattcgtaattaaaatgattaattatggcaattaagcattatggcactaattaaaattatttaattaaatgtaaaaataccaacattaattctgacaagtctacagccttcttcaatgagctggtgagcagcgtttccttaatattatgatattctcattgtaaaaaagagactggagcattaataaatttaaaaagtattaataaaaaaaagtctaattcataagtcagcaaaattttttaataaaaaaaacaagaaaaatttttaaataatttaaaatttaaaaaaaacataaaataaattgagtttataattcgaaaggagggggaggggggaaatggtttatgaactaaaggtaccaataaaaaaacccattaaatctttaattaatcttcaaaatttttcacgccaatttgaatgttaggcaaattttagtcccaagcatctgttgaaattgagcaccattacagtatgccgatttactcaccctttgcgtggtaccgtcgttcagccgatcccattgatcgttcagaatgatcaattttctttccaattcagccaattcatgggcatctccaacatttgtgtcgaggatctttcgtgcccgttcgcgcacctttaaaaacaaataatcaaaaaatacaaataattattttttgaaaaaaattttaatggtaattaatttactctttaattaattaattactctgatcattaatgatcattgatcactcaccttctcaacattttccctgcgcgtgttcgcctgctccatcagctcatgatgttccttcaccaaagtgtgcaatgtgtcaacatcgcctaattggaaaaaaagtattgtttctcgtgcataaatctgttagagagacgtgtgtgatcgaacggatatactacggtaaaaagaagagacatgtgtgatcaatagggaccggattttaat

SEQ ID NO: 16380 - DNA, 1653 bp, Heterodera glycines
ttttcgaaaaatcattaacaaaaatgcaataaaaacgaaaaatacacccctaagaaatgacacgaaattttttttttagaaaatagcatctaaaaattgaaaaaatttcccaaaaatttctccctaaatttttttttcttgatacaaattttttctttaaaaacttgtccttattcaaaaaaagctaaaatatttagtaatttcatttacaattgaagttttaaatttttacatattttactacctaaaaagggttaataaaatttttatttgcctatttgaggatttttgtgcctatttaatgcctattttgctatttttcggcctttttagtgcctatttcgcgatgcaaaaaacgaagcactaataattaactttgatgtaataccaaaagatacaggtgtatcactctctttttatgagaagcaaaattttattataatttgccggataatttcgaaaattttcagcgtccaaaagtcgttgccaattattttcctaatatgggaacaattggtgcgattcgacgggcccagtagtgcaaattttggccagcacgggaggaaaaacgcggtcaaaattcgggtccaatatatttgaaatgtaagtgagaaattggcgatgtttggcgcccgtgttgaacacacattcgatcagtcccatcagttccatgtaccgtagggcacccggcgcggcaccgtaatttaactgaaacggtaggaatagttctcagtgatcattacattttcgaatcatttttgtgacgtgctttggcacacaatccccaactgatcgaaagtaaatgtttaagtttccgaacaaaaacatttttcaaatgatcatctgttatatgtttttttggtcgaaaaatcgacaacttttttttaattggatagattataaatagctaaattcaatatttctatgaaacacttttgcaaaatttggaaattagaaaatttggtccaaaaaatggtaacattatagatggtacgccctttttttcggaaaatattttttatttttaaaagtcgtgaaagcatgtttccgagagttttcggggacactgatcacgaatccgacattcatttcgaccaatttctaatcccaaaccgaattcgaataaaagttcgaaaattcttgaattctcattttttgtttaaaatggtttaaaaaagaacggcacctgcaaaacactcattagcagtgaagaatatttctccgcttcggtgaacaacaatttctgtgcctggtcactaagccccggagaaactgaattaacttttttaatcaagtaattttggcatttcattaattagctgacccatatgagagaaaatgattgcccgaatgagtacaaattcttcggtgctcagttttaaacggctgaatggtttcacggctttacaaagcaatttgtcagccatttccatgacacttaaattccaatacatttattaaagtaaaattaaattatttttcttttttatttttgcatactttgtgttgtatttaaaattcgattttgtgaaggcataaatgagtggcatatcagctggagtacaaagaacgtcaaaactttgttggactgagtagaaactgttgcataacacatacaatggcatcgcaatattactgcacagggcaatcttt

SEQ ID NO: 16381 - DNA, 1817 bp, Heterodera glycines
  misc_feature (1717)..(1717): n is a, c, g, or t
aaaatgttcttatttttgaccctaaaatcttattttttggctttatccttattttgaaaattttgaaatagaaaccctggatttagacaaaaacacccataaaaattgactattctacataatttataatccttaaatttggtcatttttagacaatatctatgcaattataccaaaaaagaattgaatcgaggcgaacatcgaataaaggaatgtggagccaaacacatcattcaaaaaaaatttttgagattttttggagctaattaaaaacaaacccccgcccccgtccccgggggcgagaattttctacccccgcccccgcccccgcgactctgacccccgcaatcccccgcccccgcgaaaagccacccccggggtccgaaccctattttaatacattgtaataaaataaaattaattaattaaatatttttattcattgcaccttgtcactgatgttcaactgttcaaagaattgaaaggttttaccaatttcaaatacaaataaaaaatccatgaccatatgcgatggcctattgccaaaaggaccaattcgacgtattatttctaaaatctcttctgaagaatgaagcggtggttttgtctgagattcaaaaaaaaattattttatttaattaaattcttttaatttgcttacagaaaatttatcggccaattcgagcaaatttaatttccgcccaaaaattgactcaaatgaatcgcattgttcataaaataattctggaatcgttgtctgtgagtagcgaattcggcgtactttctgctcaatctccagcaaatggttcagcacaatgaaacccaaaaaatctttttttaccaattgctaaaatcagagcttttgcatttaatagaatttgctaaaaaatcctacaaataatattcacaagcttatgaagaaacagagtaagttattcatgccaattttcttagcaaccagttcaaaaaccagttttggatttctctctacctcaagaatatttttcttgttaaggcgtttggcattaaaaaatcagttacagagctaatcttcttaattttgtctttatctgtccatgattagtgataaccgagtttggtatgtgacatttcaatggtccattggtggcgctggtttctgtcgataattccatgccaatttctgccgaacttggtgctattgctgctgctgaatttgttgatgtcattagccgtttgattcgttgtatatatgccaatatttgctcattattgacattgttgacgcaaactcttcgaggattcattccgacagtaaagcatttcttcagacggcaccgcttacacgttgaatctttgtagaaaaaattcttagattttttaaatttattttaaattcttttcatttgccattttaaagactgatggataagtgtaattttaaatcacaaaaaaaggatcatttaaatttataattgcattttctgccttttttaacgtcgcactctccggcacttttgcaataatattccttcatcgacgaaattgagcgacgaaaaaaatgtttgcaagctgaattattaatatttaattaaagttaaaaatacaaatattattttattttaattatttcattatttttagagctttaacctttgttctttttttaatatttttataaaaacaccttcacaacatttgacgccagaatgaaatttgcatttttcactacaaacgnaacatttgaccgggacagattcggcagaatcaggctcaatcatgctcttaatacgggcaagaattttgaaaataattctccaaagtttttcacactaaaa

SEQ ID NO: 16382 - DNA, 3067 bp, Heterodera glycines
tttaatcccaattctttaatccattcataaattttccttcgatttgtcaccaatttcttcgctattttcgaattaattttatcccattcttttgctgaatattttcttccgttttgctttattttctcttttattttataatattttccaattatttctctttttttctgttcatttcgtttttcatcttctttttctcccattttctccaaatatttcttcaaatgacttttggttcaactttttgtttggcattatgttatctcgatgctcccttttgcgtaaatgaaagtttttttattatttctttggtactgaagtgattaattttactgggactaaattgttctgtttgacttaattcttaggtttttaggcgtaactcatcaagtgcttttgaatgaccccaaatttgtccatgtttgacctttttaaaatgttaggagggccctattttgcttattttcccgcatttttaaccggttcaaaaaccggtttaaacgcgttgccgcagactttttttgatcgttctatcgtattcagcacctaagaaaacctataagtgtttttgtgagtttttggctctgggccgtcaaatacatatttaccgatttgataaataaaattttttttaaactgtaaaatcaattaaagatgctttttctaatttgttaaaccttaatatcaatatgaaaaaaaatatttagaaaaatcatttacacgaaaatggttttcattaaaagcattttcattttccactttatattatttttatttattaaaagaataatttttaaaatataaaattgtaaaataaatttattcatattattctttttgaatgttatttaattttttatcagaaaaattgatcagatgaatcagctaatgaaaaattagaacagaaaacatttgacgaaatatttggagaaaaatgggaagaaaaagaagaagaaaaacgaaatgaactcaaaaaaaagagaaataattggaaaatattataaaataaaagaaaaaattaagcaaaaaggaaaaaataccaaaaaaatgaatggaagaaaattgaaagaaattagcgagaaaatcgaaaatgagtgacaaggaaattgcaaaaacattgaaaattagtcggaatagcatttttaattggaagaaactagggttgagcggtaccggtaccggtaccggtactggccggtaattaccggttttttttggtaccggtaccggtaccggtttttcaaaaatgaaattaccgttaccggtttgtctagtaccggtaccgccggtaaaaatttgctctggtaagaatgggggtctggtcgagaaaagagtaggaaattggtgaagaaggagaaatttttgagaaaaaattaaattttatttcgtttagtcatgggattacagacatgcacatgtggtgtagtggttaaactttctacctttcataatttttcgcctgggttcaaatccccacttggatagaatattcctcacattttctttaccattattttaattaaaattttaattttaaaaaatattccaacttttttctttcatgttaagcatcctaaaaacccaaaaattaatcaattggtcattttttttacaaattctgttaacaaatcgcattaaaaattacaaaatttttcccggcggcgcctatcgcaccgccggccctccttgtcccccaaaagtcttggaaaaaacgtgccgcgtaaaaagcggtgttgaaagcaaaaaaaggtcattgatttacattaatttacatggccggagaccccttcgcaaaattggaaaattggctgctgaccccttgttttgcaataatctgaattttgaggtctacatctgaattttagtgttctttatcctgaatttgaaaaaaaaaacttggtcaacctgaatatacatatacttctgaacaattctaatgctaaaaaacaggtactcgcgcgaaaactgaataaaaattttgtatttggaaaattttgtccaaaaatttttatgttctaaaattaccggtttttaccggtaccggtaccggtttaaaaagttggtaccggtaccggtaccggtttttgcagtaccggtcagtaccggtaccggtttttttgcaattaccgattaccgctcaactctagaagaaaccaatagagaaagcattgatttggcttgcgtgaaaatttgttcaaaagtccatgatgtccatgaaaaagaaaattcaagaattattgtttttgttttggaaatttgtgccaaattgactatcgtttttaatgcattttttaaatagcaaagaagcacctgctaaggatgatggcatggctcatctgttaaaagccttggataatcaactaatttgtaagggaccccggcggttcgacgacttcacttctcaccctttcttggctataaatttgacactcaaaattagctaacttaattatgtttttaattgtaaaaattgaatcagaaaagaataaactgcaacaaaagtcatttgacgaaatatttggagaaaattgggaagaaaaagaagaagaaaaacgaaatgaactcaaaaaaagagaaataattggaaaatattataaaataaaagaaaaaattaagcaaaaaggaagaaaatattcagcaaaagaatgggataaaattaattcgaaaatagcaaagaaattgggaacaaatgataattatattaaaaaatggattaaagaatttggtcatcaaaaacaaaaaatttgcgtcgtaattagaaaaaaaaatcaaatttagtaaatcattttaattacaaatttattcattttcgattttgtgtatttatatgtagataaaattgttaatttcaattaatcaaactgtaaatttttttacactaaaaatagtaaataattacatatctttttaatcgacaaatttatttaaacttataatttctattatcaaataccagtttctgcgtgatacctttgtttgtctaaaattaaattaatttgtaaagattattaaattacctaatctgatattgtgttaaattgaatattttgacctctctctgcttaat

SEQ ID NO: 16383 - DNA, 3442 bp, Heterodera glycines
atcgtcaagatacgcgaatacacctgggataccggcacatatttggtccatcagatgttgaaatattgccggtgccgatttgactccgaatggcaggcgttggcattggaagagtccgcgatgcgtgttgatggcgcacaattgcttggatttgtcatccatttccatttgcaaatatgcatcgcgcaaatccaaatttgagaaaaatttcgcgccattcagtgaagcgtagatgtcgtccggccttggcagtgggtgccggttcaattccaatgcattgttgaggccagttgagaagtcgatgcagactctcgtcttgccgtttttcttttttacggccaagatcggtgcggcccaatgactgaaatcgattggcttaattgcgccaatttgaagaagacggtccaattcggcattcacagcttccatggcgccatgtggaattgggcgagctcggcaaaatacaggctttgcatcagaccgcaaaatgagatgcgcctttgcctttgagcagtgtcccagtccttcttcaaagacttccgggaaatctttttggagtgccgcttttagcgttgacacatcattgatcgttttgtttggcggcttcactgccgaaaaattttcaatcattgtcgcctgatcagccgatttgctggacggaaataaaatttggcggggaatgatctccaaagcttcgatccacggcaatcccaataaattgtgtccgacttctccgctcacataagcgatcagagtttgcggtgttttgtcggaaaattggacggtgcagatgaatttgccaagcaaggcgaatggctggtcattgcagtttttggcatcgatgtcggatggagtcagttccggttctcccaactctcgccatgtttgcaatgaaataattgtggcctgagcgccggtgtcgccattcatggaagtttgccttccatttatcaaaatgatcaatttccaccatcggccttgagttgtgccaacatgtaggcaatgtgtgtccactttgactgtgtggaatgaccggtggctgttcggtggggcctttgtcttgttttgtcggcagactgtcgaaatgtgcccttttttgttgcacttaaggcaagtggcgtctttgaatgtgcagtcggagcgccagtggtcggatttgccacatgatccacaaggaagtgttggacgaccacgtgttggctttccacttgtattggcatttttatgttgccgttgatttgtgccgctttgtctttgtgctgggtcggtccattgccgcggccttgtgttaatggcgttggtgacaattggcgggttgaccagcgacagggcgctttccttcacaatttggattgcccgtaattcctcctcaattttcttgagcgaaatgttggtgccatttttctgagcgtcctccaacattttcaatgctttttgtcgcaaatcatgatgttcatcgctgagcgcgatgactaaaataatacacttgagttgttcctttgtcaggctcaaatctgcgttttcacatgacgcgttgatctgcgcaataagtgacgacacgtcctgtcctggttgctgtcgaattttgaagcattcgtagcggcggacgaacagcgaacgtgtctcggcaaaaagctgtttgaggtgcgaaatggtgtcattccaattcacttggtccggctgggttgggctgatcgtgtcacgatatttgctgtactcctcctctccgagtttgccgaggagaagtcgcacttttgaggtctccggcagtgtgcttccgtcgtcctcgatcaatttcccaaaccgtttgaaccaactttcaaatgtggtgccgacctccggattgtaatggaatgctgaaagccgagcatcaatagagcttgccaaattggcattgctcaaattttctggtgcggcgttttgcggtgcggcatttgtgaccatttgttgcagtgcattaagcaattgttgaagttgctgcgggtccatggccaattgaagaaaaactgcacacggcagactttaatttgccgaaatcggagaaatgatgtgccgtaaaattggcttgaaatagacgataaccgtgcctcgagatttggcaaaaatcggttcttgtcgaagatgaaaccgtgccttgagatacggcaaagattcggtttatgtcgcacaaattgttgataaaccgtgccgtaagatatggcaaagatgcggtttagttgcacagattgttgataaaccgtgccgtaaaatatggcaaagatcggtttatgatgaatcaccacaagcaatatcagcacgagataaagcttggaaaataaacgctgtcgttgagctgctgactgcgccaaaatttgttatgtccgaagataacaaattaaataagtttatttgccgaagaaaataaaataataaataaatgcagagaatataaattgggaggtcaaaatcggtgggcacaataacaactgaatgaggggaatgggagggggaagatggcgaagtggcgtggggtcatacacctaatcaataattacttccttctctaacaataaactaaaaatgaaaagcataaaaactaatttttatgcccaacattgtttcattggtggcgccaactcggggccgaaatgccgttgtcgctgcattcaccgtctgcgaccggtcgccacaatcgccgtcagtcgtggcgacggcgtcgatcgccgatgtgccattgtcgacgctgtgcgatgacagacgaatcgccgatgccgctgaacagtcaaacagcagcgatcggcgagcggtcgccgatggctgcttttgttgccgctgccgcggagatccgtcgatcagtgccgggaaagcggtgcgcggggagtccaatggcacagccgtgccgacgtacgcttcgtacatggacacaccggcgctgctggggacgtttgctgcaaaagcagggaatgagtggagctgtggaaggagttttaccgtatggctatcgtatcgacattaaaaatgcgttaccgtgtggtaccggtttctctctctaacagcaattttagtcctaccgtattctaccgtgtttccttaaccgttacttattagggaagaagagctaccgtacccgccaatttataccgtaactatcacgtcgtaaacgagaaattgcaaaaacaatcccttgaatagcaaatttaaaataatcaagattaaatttagtccaagaataatttcctgcaaccggagaaattttacgaaattgcaaaaaaaaaaaaaaactcaaaatttctcaaatatttatttttccaaatttcataaattttacgaaattacaaaaaaaaaattaaattaattttcacattacaaaaattggcacttttattaggttcatagggcacttttagaaattactatcataaactaaaaatgaaaagcataaaaactaattttttatattttt

SEQ ID NO: 16384 - DNA, 1048 bp, Heterodera glycines
tccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagat

SEQ ID NO: 16385 - DNA, 702 bp, Heterodera glycines
tcccatcgcaatgattggcaccaaaaacaatgcctgccttcgagctttggcaacacattcaatgtcctttcgcatggaatcaaattccctatcggaatatgagaaatcgcccgcgcggggtctgaccatggcgaacaccggcacagaaccgttgagagagcgagccaattcaattaggcctttaattagtcaattagagagaaaattacatatttttatttaatgcaattgatttggatttaatttatgttttacccggcgtcggtgtcaatccgccaacctcaagcgcagaacaaagttcgactcggtcggcaccgccccgaatcgctgccaaaagtccgtccgcgtcatcgacacaaacctccaacaaaatttcggtcattttcataagaaaaaaaaataagtggtgaaaaaaatcgtctgtttattctcttttgttggaacagaatgacaataattaattcaataaaaatttaaagaaacttttccgaaatattaattagcaaattaattaagtaaaatatttatttaaaaatgataaatttggtaggttaatcatctgtttattaaagaataaattcaataatttttttgcattgagaagtattgcagagaaatgtccaaaattggcattgccttaggcaaaaccggcatttccccattttaaaccgatttcattaatggtagaaaattgggtacttg

SEQ ID NO: 16386 - DNA, 3384 bp, Heterodera glycines
  misc_feature (759)..(759): n is a, c, g, or t
  misc_feature (916)..(916): n is a, c, g, or t
gattaatgacgacattctttcttctctctgttaaacctttcatacatgcatcattgaatacaatcacaatacacacattttatcagtggtttcctaaattaaaatttaattattgcaaaaataatttttaatttcaattaatttaatttttgtagcaaaaatttgagttttttttttaaattaaatgaaacaataaattgccaagaataattatatgtctgctgtttaatagtttatatttgtcattgttttaaacccaaaacaattttttgtccgttctcacgacaaaaaccaataaaaattaaaataatgacactcattagtgaattgggcacttcataaacatttggtacttaatatttgtctccgttttcatcgtcaacacattctttttccttgttccgtcatcgcattttatgtcgccatatgactgcgaattgctcagcaacaaaaaactttaaaattaatttgaaatattttaacggtaattaaaaatgagcggtaaaaagggcgccgattggtacgacgaatcggaccgtgacaaaatgaacatgttggacgcatgtgccagtggaatggtggcagaggtggagcggtaccttaatgggggcgtggacatggaggaggaggacgacgacggagtgacgggtgggcggggggaggacggggaacggcacaacacactcggcacacctgctgggggcgaatttcatttaaaaaaaatcaaaaatgaatttagcccttcaaattgctgccgcnaaaggacatcggagcctggtcagtggctttattacatattagtgtcctataattagcaacaattaatatttccaataggttgagttactgctgcggaagggtgcccaagtcgatcgagcaaattatgccggaatggttggcaatgccattcattacnttaataacaacagttaatttgatgttcatgctttgctttcctttatagactccttttctccacgcgtgccgcgaaggtcatcaggacgtgatcactgtgctggccaaccatggggcgaacactaatacgaccacgtattcatttggaaatttgtttatcatgggatgttgcattcaaaatttgttaattattattttttatttcaaatttctgtcactttatctcccagtggtctcggcgtgtcagcgatggcattggcatgcgccggtcggcacattggcgcagtgcggactctccgcggactgaactcgccggtaaattcggtgccttcaaatcggatggctcatcaggtggcgccaagcccatatatggtcgcttttttccaaatggacattgaaatttgcggctttttgaaaaaaaagtactgtggttatcaatttttttaaataattaactgaatttattgaataaaagcgacgcgaatgtttggcaccaaatccgctggatggatggaatggacgtgcacaaaatgggcgaaacgctcaaatttccgccaattttgatgagcctaaactacgcggagaacagcttaaaggcgccaaagagtgcaagtaaaaaaaaattgggttcaaaatgctgaaaaagttttgccaaaatggcagaagactttcgagcggtgatccaagcgggcgacgaggccgaactgtgccaatgggtgcgcgaggggcgagtgccaagcgcaattggagacggagtcactccgctgatgtacgccgcagtccacggccaacagcgcatcgtagggaaagcggaaaactgattcataattagcagcaattaatgaatgattaattgattccaatttcaatgaatcatcgattataatttgcttaggccgaacatttgttgagaaatgttgcgaattcggcgattgatgcccaagaaaacgttctcggactgagtgcgctaatgtttgccattgtcgccggggacaattcgatggtgcaactgatgctgcgccatggggccaacccgcgcctttcctccaccacaaaagagccattcactgcgattgaactgtcccattttgcgggtaattaaataaagcaaataaataaataaacgcatttcacattaaaatttaaaaaaagaaattgtttaggtctcagccatgacacgcttgtcaagctgtacaaacaatttttgatgagtggaaaaggcatggacaatctgaagaaggaattggctaacaaaagggagacgggcgaaattggcggcggaaaagcgccattgggcgagcggaaaagctcagcgggcattgccctggcaaaattagtcctaaacgatagcggaaacggaggcggcggaatgccatcgcccgcgtccgtcgccgggggcggcgtaagttttaccaaatggcaaattttaaaaagaaatgaagcgcaaatggtccaattgaattctcagagtcataagcgacttcgtcgagtgatcgaaagcatcggcagaaatatcatcggacttaccggcgacctaagcggacaaatcggtgccggcgcgtgcggcgcaagtgacgcgttcccaatggcgcatctgtcgcccagcggacgcgcgcgtttcgacgcgcttgtggacacggcacatttgaacggggcggacgcaccgcgatttgtgctggcggaacagattctacgcggcgacgcacgtgcgcccgcaacgacactcgcgcggacgaaaacaatgcaattggacgcacgcattttgttggcccgacagacggcgattgtaagtagagacagagaaacataaacacaagaatgcattgattacagtatcggccaatttgttactgtaatttggtctgacatggatttgggcgtttgcttcacttttttacctttgattttaaagatttttatataaaattagttaatcaattcgattaattagagattggaggggagggaggacgctggacgagtcttacgaggcttcttctggttttaaaatttgttctgtatagagttggatggtccgaggcgacactttgaggccaatgatattcggagacaatgtgccacattcgaaaagtgccgaagagtcagccgaagttaatggcctttacatggcagcccaatggaacgcagaaaaactgtttaaaaatgtataaataaaagtataattcgaattgtcaacaagaaattaaggccccaatgaaaaggcaccgccgcaaaacggacccatcccatgggaatggggcggaggcaattccgaacgtgcgagtgcccttaacaccgcaattaattgtcagaacggctaacagtcgcgggcacgaacaactgcaaaaatgttgaattaaaattcaaaaatatttcataatttattttttcaaatgcctttttcagcgccttcctcggtgtcgcgccataaaattttgccgagccatggcgagcggactactgtccgga

SEQ ID NO: 16387 - DNA, 2491 bp, Heterodera glycines
actagagttgagcgggaccgggaaatttgacaaaaaccgggaccgggacttgccgggactagaaaagtcgggaccgggacctcgattttcgtccgggaccgggaccgcgaaaaaacccgggaccgggaccaaccgggacttttcccaagtgaaaattttttttgaaaaaaattgaaaatttaagtgcactttgttacgaaaattgccaacattcaaaaatgtacccataaaattttgtatttacgttttgggggacgagttcgaggaaaatttttaaaaattttgttttcagggggggttcttggaattttctgagtcccaaaattctgtatttttttaaataaacttacaattttttaattttttgcttttaaatcgctgtttttgtggcaatgttttttcaaaaaactttcattcagcagccttacttcatcaattcgtctgtaaaatttcagaaaaataggcattaaatttcaaaaaaaaatggcaaaaatattccgaaattttttttaacctgaaaatttataattttctccatccttcaattggattttcggggggaagtggtacgaagtgcactcaacatgggtttgatatggttgtccattttatgcgggttttacataaaatcgctttcccctcccccgcaggaatatgttcggtttctgttcgacaaggtcgacaacgcgttcggcagctgcagcagttccgccgacgctggcgctgcccaaaatcccgtcgatgcgtttcgctttcggctggtcacgcgtttccgggacgaactttcgcaatgcgttcgctacaccccgcgcactgacaccattttgttgctgccaattcccatgcatttgtgcactgaggtggggggccttgggtcgaaaatccgaaaaattctttaacttacaaggaaaggaaggttgctaggatgcatttctcatttcccccgtgtcatttcccggccgaaattttaaattttgaaaagtttttcaattttttcttgaaattttcttttcaaaattttttgtttttaaaaaatagttggaaattttaaaagacaattcgactggcgggaaacgagctttttcaacctcctcgtagactggggtttattggagattgggggataaatagagcaaatacggtatcattgaataaaaatctaaacgatttgaagattttggcgcctcccacggtgccgtgccggtgaaatatttttgcgaacttttttagtactacatgggttgcttcaaaagtctcaaaaaaaaattttttttttttccaacgatatttacataaattaatgaatttttgtcatttttcaattagtccgacactgtggtgaatgggctgactgtgagccgaaagtgtgtgccgttggagcagtgtttggccgccgcatttggcgaggaaatcatcgacgattatttgtcgcccgttttgaagcgcaaaggccgggccacggagcagcaacggatggccactttccccgactttttgctgttgcaacttcgggtgaataataaatgtcaaagcgattcgcgaagggaaaaaaattaatttgaagtttttagcgatttttcaaaaaatcaaaaatttctaaaacaaaaacaatttttttttttgagtttttaagaaagacgcaattttttctgaataagcccaaaaaattttgatgatttttttttcaaattgtttaaaccaaagaatccttgaaaatctatcaaattttcaatttattggattttcaaactttcattttttttgcttattgatagattgaaaagtctaaattttctcgtgggaacgatttgctccggttttacaatttgtaagatttcaagaagatcgggcacagattattgaaaaaacccattaaactggatgggacttgagttttgcaggaccatgaatttttcaatttgaaaaatttttcaaaaaatattgcccctgccaattaatgtttaattaattgtttaatctctgctgcagaggtttacctttgacggtgttcgcggcatacacaaattggacgtggacgtgcacatcccggacgagttggacatgtgcgccttcttctcaaccggcgaattgcagccgggcgaacaggcacaaatttaaaaaaaaacaatgagggttgaattgacaaggatgggcacctttttatattgttcctccagtggggaccgaacccgcgacgttcccttgtgaggcataaaaaaaattttttaaatttgtatttggcggcgcctgtcattatcgccgaactgcaaatccaataatctcctttttattcaaaatttaaatcaaaaatactcaaaaaaacggtaatttttgggcactgctctgccaataataaatatgcgccactttttgtgaggcccctggtggatgggttggaccaacccaagtttgtttctccgtacgcaattaaaaaaaatggttaaatttgggagaattgttttttttttttttgtaccaaacaacatcacaa

SEQ ID NO: 16388 - DNA, 1219 bp, Heterodera glycines
ctgccaaaaatatgcacgaaaagtggccaaaatatgcgcataaatatgcaaataaaattgccaaatatgcatcaaatatgcacaaaaatcgcaaaatatgcaccaaatatgcacaaaaaaacttgaaaacgcgcaaaaaattacgccaattatcatatttggcattatgaacaattttgtctaacactgggcttagggttgggttcgttttcctatgaccatttccctatgaccgtttccctatggcccatttccctatgggccgtttccccatgaccgtttccctatggccagttccctattcacgtatttaggctattttcatatcaaactatgaatataaataaacacttaattaaaacaagcaagaaaattaacaaacattttatctgtttcaaatcacggtctcatttcataatttcgagaaattccgatcaaaaaggtaatgataaaatgatgattgaaaggctgatgaattgggaaaatgttagtgtctacgttgttaagtggcaaataattttgaaccatcgtgagaattcggcggtctgcttcgcgatatttctttgctgaaacgccaaatcgatggatgtgaacaggcaaatgagcactgcaggcgtctgttcgcggcttctgaatggttattcgtccggtcatcgccttgcattgttcgagtgtaaacgctccaatttgggtcaaatcgcgggcgtgttcggcttccatcatgcttaagacgacccgtgtagttcatgatgaacctaataaataaagaacagtaaatagtaaacaatttgtgagattgtcaatttaccagtcaaggacgggattaagttcgtcgggaagagccatgtccagagcaatgattccaggggtcaaatctccaattgggagaaacgcgagcgacgtgacacatcgtgcttggttcacattggtggctgccaacttcacgtaaagcgttgttgttgaggtcagtgtgaaggcgccctttgcaacggatgtcttttgcgtgatgatgttcacacgaccaaaagcgaacttcaccgtcagcactcaccttgtgaaacatgtatgaatgcccgttgtgttgaagcttggcacgcttcctctctgctagaattgtgtccattttcttatctgtaagattacaaaattaggtcagttttcttcctatttcatgcataagcatcctatccgctttaaattccccttatgtatattgcaa

SEQ ID NO: 16389 - DNA, 1995 bp, Heterodera glycines
gggttgggttcgtttccctatgaccgtttccctatggcccatttccctatgggccgtttccctatgaccgtttccctatgcccagttccctattcacgtatttaggctattttcatatcaaactatgaatataaataaacacttaattaaaacaagcaagaaaattaacaaacattttatctgtttcaaatcacggtctcatttcataatttcgagaaattccgatcaaaaaggtaatgataaaatgatgattgaaaggctgatgaattaggaaaatgttggtgtctccgttgttaagtggcaaataattttgaaccatcgtgagaattcggcggtctgcgtcgcgatatttctttgccttttgcggtgggtcttgtccagttgaacacttcgcgaagtcatcatctgataacttttgatcctttcgcagaaggtcaatgaaatgccaaatcgatggatgtgaacaggcaaatgagcactgcaggcgtctgttcgcggcttccgaatggttattcgtccggtcatcgacttgcattgttcgagtgtaaacgctccaagtgtttgggtcaaatcgcgggcgtgttcggcttccatcattcttaagacgacccgtgtagttcatgatgaacctaatatataattaaagaacaataaatagtaaacaatttgtgagattgtcaatttaccagtcaaggacgggagtaagttcgtcgggaagagccatgtccagagcaatgattccaggggtcaaatctccaattgggagaaacgcgagcgacgtgacacatcgtgccatttctgcgaatgtcgggtcattttgatagcgctaaaattttcgaaaattcgattttttttttgtcatgaattcaacctgtttcagcccaaattcagaaatttttttgtgaaaattttggacgaggtggaacagacatccgcgcacttcagtgaatgggaagactacattcagcgcagtaatcgccgctgtctcgaagtccatcgacacgctgtccgggttgaagtctggccacacagcaacgagcatacgaaacatacgctcgtatgtagtgtgcgttttgttggacagcatgcaatagcacactgggatgacccagcgattccgacttaaataataagttcaaaattgttaactgtttatttcgtaccgcgccaaaattgcgtacacttgttggaaaggcatcggtgtgatgctgaaggtgccgtcggcgaagcactctttcatttcatgcgcccaccgaccattcgattcacgtccaaatatcagtattctaaattgcgtttaaataattaaaaagtgggcatgtatattacctctgttccctcccgttttcttggtaaacacccgaatcggctaacaaaaattgctcgctttgttcgtccgtacgagaatacattttgtatgcgtctgggatgattaagtctgtgagcgtgttcggaaccggtggcggtgcgtcaatttcacgacgtacacgcctgattatctaaatatacaaatatttgaggaaacataaaaattatcacttgttttgtcgcctgtttggtagggagttgcgcaaggactggcgtgaccacattctgcagtgccaaagagcgaattgtcgctggtggttccatggtttgtaccgcccggcgtttgattccagtgatcactcgttgtgcttccattcgagctgcacttggttcacattggtggctgccaacttcacgtaaagcgttgttgttgaggtcagtgtgaaggcgccctttgcaacggatgtcttttgtgtgatggtgttcacacgaccaaaagcgaacttcaccgtcagcactcagcatgtgaaaaatgtatgaatagacgttgtgttgaagcttggcacggttcctttttgttagaattgtgtccattttcttatctgtaacattagaaattaagtcaattttcttctaattcatgataagcaccaaccgcttaaattccccattgatgtatattgcaat

SEQ ID NO: 16390 - DNA, 2082 bp, Heterodera glycines
ctttcttttttgtgtttgcgaataaaagttcgggccttttatttacatatttttatatatttcgagattttatacataattcacatattttagggattttatgcatatttggtacatattttggactttttaagcacttttcctgttcaggaaaattttattaaatgtcccataaaacccaaaatttcgcaattattcatacctatttatatttttctagaattttggagaatttaaaaaatttcttgtgaaaaatttaaaaaattttttaatgtacccccaaaaattttttgaaagcgctaaaagatgattctaagcctatttggtcattttttggcattttgtgcctattttacccgttacgaagaattattttccaaaaaacatattaaaaattttatttcatatttagtacatatttaattttttttatacatatttcggtattttgtttaaaatttatgtacatattttgaccattttttgtacatatttttcatccctaaaaattaaattttttcttttttgtgaaagcgagaaatcaaattgcatttgtctcctcgggataaaaaaacatatccatttacaaaagcaaaaataattcccataaattccattagaacaatgctttagagaggagttttaagcaaaattaatgattttcacaaatgctcgctctttagtttgaaatttttttataaattttgtacaattaataaaatttataataaaaaattctctgaattttaaatattaaaaagtaaaaattgtggaaaaaataattaaaagtgtgataacgtgttaattcataaatactaattaaatagatcagaataaatgcggtaattaaaggttcgcatcttggcactcaaagctggcattagttagcatgagtttcccacgcggttcgagaatcaaatctaggagatttgttgtatttttgagtgcagtccaatgctgatggttgtatagaatagaacaaatcgttgcgttagagttctcctttttcagctgcgcaataaccgtgttcagcgacctcgaaaactcctaaaaatatgttttccttttaatttatgaatttcgaatttttgttcgaattagggtttgggattaggaaaatttgaaaaacaaaagtcatattcgtgaacagcgccacaaattaccctagaaaaattatttcaaatgccttttgagtgctttttatagtgcggtcacttgagtcccagctgagtttggcactccatttccgccactttctcagcctgaaaaagggcaagcgcgcccctaattctttttttccaacccatttcaaacctttttacatcgattctgaccgtttttaagcatttttgagtttggggcctatgatcaatatttaccaagttctacattaagtcaagtcggaagcccgttttgggatcattaattcgcctgatcagcatcagaacggcaaagatcagtacaccggttgggttagatcactctataatacatttgttctactaagatgatcagaaaaatgatttggctgatcaaacccctctaagaattgatcggcattgtctgctgattagtcgggttcatccctcatcccatgagaagtgcctttcgatgtctctgctcagaaatggattctccccgatgatcggttcggctttcggtttggccgcgctgacatcgatgccgacattgaacactttgatgggcaattggaccaactgaaaacaattatgtaaggacaaaatttaaaaaaacagaagcactcgaaaatgcaacagaaaatacggacaaaaaggaacaaattgaagccgatcaatgctcgagagtcttgacgagcgattggttaagtttttcgggacataaatcctttttgggtatcaaccagaggaaactatgccaatttgtggtccattgtttctgcacacatttttaactcatcacaaccactaactttgatcggagcgtccacctgttgggtggccaccgaaacgtaccaatggtatttggcaaagtatccctgaaaaacaatgagaaaagagattcatgttgaagattggggaaaacgtcggtttcttgatacat

SEQ ID NO: 16391 - DNA, 687 bp, Heterodera glycines
aagaaatagtgtgtgtttggtgagagagacattttctcttctcaattcttcgcttataaagagaaataaatccccagcctccgccgagggtcgtggcgggcccttgtgacccagcgagtagggggcgaaggcgggcggggggcgggcgtgcgccgattgggtgtcgcgaccaagggccgcgtcgacaggggcggcccgggggagcccgggctgtgccggtcgcacaatgaggagagcaacggctcaggcccgcaagggagcaggcaaaatctcccgcgcggtcacagtggctccgaccgcacccgagagcatcgccatccaaacgcccaccgccaagctttttgccgcgctgcacaccaggggtgtgacttgtctcagaaaagacgagagcgagagtttggcgagaggcgagagtccccaaaaagacgagagcgagagtttggcgagaggcgagagtccccaaaaacacgagagttggcgagaggcgagaggacgagaggcgagagtttttcaattttttctgtagccttatttttaatttgaaaaacttcaaaatcgtatattaaattaggggtacgggcctgggtatttgggcaaataccgggtcagggtattgccgggtacagaaagccgggtcagagtcctaggaggaaaccgagtccaagtcatgaaaaatccaaacaaaaa

SEQ ID NO: 16392 - DNA, 1404 bp, Heterodera glycines
tgttttacataattcttaaagtgattttcagttaatttccccctacaaaaaaataaaaaattcaaaaaccaattaaaaacacttgagaattcttttaattggttttgctttataaatatatatttctaataatattaaaaataaaatattttaatgtcacaaaattctcgtgtttttcccgagtataaattccaatgttcgttctcataaaactgaatttgtttcactcatcattttaagcgaggcttttcccgctaaatttcatttggccaaatgacaaaaaatgtccattttaaaagtgactcgatttagaaaaaaaattgcgctaaattttattaccaaaaaagggaaaattgaatttaacaaagaacaatttaaattgggcataaaattttaaattaaaatttttttgaaaatccagtcttttaacagttcaacttttgcaacgcgttacagcaccggtggtcgctgtttttcaacgattccatcaacgacaagcaaattggcttaatggaaaggaaacaaaatttattaattatttttttaaaaattgaattaacttttaaataattgaattaaattataataattttccccaaatttctcttgagaattgttaaaaaaaagattttccaacattcgaagatttcttaagaaaattaagtatttgtcaatcaatttgatatgttttgtccgaaagaaaaatctgagaattttcgcaaaattttatggatttaaaaaaaattgaaattaaatattatatgttcatttaaatttctttagcttcaggtttttctaaagtttaaaatttacttttttcaaatttattccttgaatttattcaaaatttatatttttttagtcaatggaaattttcatttttacgaataattaggttttttaaattaggaaattataaatttctaaaaattttcgcacctttccacggcttccatactgttcaaaccatttgacatattgttgcacatagtctccacaccattgtgggtctgtgccaaaatcgcatttttctggcacataaaaattttgtgccgacgccggcggctccattaggggaggctttaaaaattgtaattttagaaaaaaacaaaattatttttaacttctccagccgatcctgacggcgatgatagcatcataacttcaccatgtccaatcatttgctattttcggaatttaggaatttgaaattctattttaatggccaataaaggtgaatccaagctcaatgttgtggaaaatttgataacatacatttcgtataatttttaggttttttttcatttaaaatcggaatgattttttcttgaaaaaaaaactaaaaaatttatgctaatttttcaaatttatttcaattaaaaaaatataattcgctttttaaaa

SEQ ID NO: 16393 - DNA, 2083 bp, Heterodera glycines
  misc_feature (77)..(77): n is a, c, g, or t
  misc_feature (79)..(79): n is a, c, g, or t
catacgcagtgcccttcagtgttgagcgtgtttcatgcgcgaaatcgtcaaacactgaattaattcacccgacatananattgaaattaaaaaaaataataatttaataaattacaaaaaaaaaattatttgtttccatcataatatttgtgaaaaggatcagaaatggcgtaccaaatttgaaaccgtatatgtatgcaaaataagaagctacaagaatttttaaaaattttttggaacattaattattattttttgaattttttttttcgctaactcttcaaaaagtgataaattttccctttttttaattaattaatgctcataaataattctatattttatttttatggcacactttgtccagtggcttgacgcttgaggcgattttctgtgaaatcctgtacagtagacgatggcttcgttaccgtacctaaaatgtattcattttacaactcgctaatttaatggcatattttttgcacattggaaccatatgacacatacaattcgttgttttaggcgctacagtaaccattggtgagttttccggttgattagtcgaattagccgattcaattttagatgaattttttgacaaattcactgctgcgatggcgaccacaaatagaagctgctgttgatttggaaatggttcttaatgaaatttggtgtactactgtattgactagccaattcctacagtaggttcaaggaaaagtttatttaaaaaaaattatctttaaattttaaatatttaattaatgaaggaagatatctttttaattatcgtaagcaaatgatggaacggaatttgaatagttaattaattgttaaagattaattattaatttccttgagttaattaaaatcaaattatatttttaaaaactaaaacatacattaaagtacaaaaacgatttattagtgattaatatttgtgatacaataacattacactaggaaaatgttatcattatgaagaatatcggtgtttgagggtctgtgtaaaatgttatggtaaggaatggtcaaaaatatacggtataaaattgccaatttcggtgaatttaaaagctttttggcaccaaaaattttcctaaattttcttaagtttattctaaaagcatccgcttcttcgttgttttggctttcaacgggctcagaaagccaccccaataggcggtggaataaggattctgtgacgcggagtactgtaattgtgccgcggctccgcccattgggtactgtagtgctggactctgtggccagtacgctgcgtacggtagcgatggtgctgcaccgtagccattgttatagtacattccgtaagggttgttgaatccgctgacgccaatgccggctgcccatcaatatgttacagtaatccgcagtaaacgagaattgttaaatttaaattaccgtaccatatcctctgttatacggcccgtaaccgtatcctccgccaccacctagtctgccggcgtccatcatcataagcggattagtgtagccaccgtaaccgagtgaaggcccaaatttgttaccgtaaccacccatcactgtgcaggtgggttttttgtaaattaaaattattaatttaatgaacttgttaaaagcaaaattaaattcaattcttagttaggtaggtggttattgtttgtaattaatagtttaattagtattttaaaaataaaattttaattaaaaattaaaaaaaagaaaatattaattaaattaatatttcattcattcgcttgatttgataagattaatagtattaaacaaaatttaataatttttatatatttaattttttgtaagaaatatttatataaatttcccatttttacttcctcgattcattgtgccaacatcgttcatcattgtcattggcaatgtcgggtcttgtggactgcccgtgccgatgaagtccatcagtcctacggggccgctaaatccgtcgccgactgtttttaaatttggaaaaaattaaaattaaaattttggcgcctaatcgcgctaatacatgcaacagagcgcttctgctgctttgtcaatgcttcttctttaccgggcgaac

SEQ ID NO: 16394 - DNA, 1295 bp, Heterodera glycines
  misc_feature (117)..(117): n is a, c, g, or t
gagtatatgtgaggtatggacggtccaaaaaaatggctatctcttttttggcatctgggtaatagaaatctcttgggaaacaatgacagtggctgtcatcagttgttatgctctaanaatgattttcgggccgtttgagtatatgtgaggtatggacggtccaaaaaaataattttggcatctggtaatagaatctctttggacaatgacagtggctgtcatcagttgtatgctctaaaaatgatttcgggccgtttgagtatatgtgaggtatggacggtcaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaatggctatctctttttttggcaatctggtaataaaatctctttggaaac

SEQ ID NO: 16395 - DNA, 2636 bp, Heterodera glycines
aagtaaaattcaaacaaaccttcagcatacaatcggaataaatattcatataaaatgtccaaatattttcgatatttttggcattcttcccgttcatattctttcaactcctctccaatttcggcacattgccaattttcacgcatcaaatacacaaggccaagaaaggcttcatatttatgcgtcatatgctcgtgcaatttttcgatttcaaatataccaaaatttgcgtattcttttaccatcttaaaaaaattctcaaattttgtcgtcagtcctttgacaaattctgaaactaaagcatcttcactctaaattttgaatttatttattaattttcattgggtgttaaatctccaggtggaatggtatgacgttagtcaataaaccattgaatcacaaacatttggttttttgtaaaaattaatcgctaaaatagggttgtacgggactggaaatttttgccaaaaccgggacctcggttttcgtccgggaacctagaccaaccgggaaatctccatgaatttattttaaattcaataaattttaatttaattattttataaggaaaaaaaatcaaataaaaaataaaaatcgtttgaatctttaatgaaaaaaaaagtaaaaaacggaacaaaatgtcagaataagaaatatcggaagtgaattttttttcaaaaattatttgttttcctgaaaagcatttaatttttggaagatctgctaaaaaaatttctaaaagtctgggacctgggcttttaaaatttccgggaccgggacctcggaacttcttattggaattcccgtaactctagtaaaacaaaaaaattaaaaaatctactggttttttggtgaacgtcccagcactagagcccggtgctggacggaatcccgcgcgtgatcttgctgggtcccagtccgtaatcccgcatttttgggaatttcaggatttgcgggattactccgtgggatcccggcctgcaaaaattttgagttccaatcccgcaacgggatctgcactaatttccgcgctctacccagcaccagggttgttccgggttacccgaaacccgaaacccggcctttttcccgacccgaaacccaacccgatgattttgggtcgggtttcgggtcgaaataagcactggtaagaagggggtctgggtgaaaattagataaggaaattgagaatttttttttgaaacgattgtgttcaaatggaatcgaaaattttgtatttgtttttgttcattattatcctttttctaaagatattttgtatgaatttcttgaatttaagcaaagcaaatggctgaaaaacctgattccatttggttttatttccatcgtcctataaatggcgcaattcgctgcaaatattgcagtgccatccgcacccatgcaccagggttgttccgggttacccgaaacccgatacccgaaacccggcctttttctcgacccgaaacccgacccgatgatttttcggccgacccgacccgaaacccgatatttttctcgacccggaacaaccctgcccagcaccatctctcacccatgcccatttatcatcgaatttcgaatccacaattattttatgtttgtcatcatttatttcatagattttccatgcgctaaacatttcctccaaattttcttcaaattttttgttcatttttggttggattattccatctaaactttcatttatttcccattcatttgctgtgtcaattgccaattgcaaaatgatttcattaattggcatttttggttgattttcaaattttactccataattcaatttctcctcattcaacaattttggctcaaattgaacaccgaaaaattcatttaatttatattccccaaaattaggccatggaataaaataaaatcgcgaaattctgacaagacaattcatcgcataaattattgggccttcaatttcaattccatatttaaatacaaattttggcctaactgtgggaattccggcgtattctctaaacaaatattcgtataaaatgtccaaatatttgcgatatttttggcattctgcccgttcatgctcttcaaattcattcgcaattttgtcacattgccaattcttccgcataaaatacacaatgccaaggtgtgcctcatatttttgctttgaatattcactgatttgcatttgccggtcatttctcacaaacgcaattagcatttggtcatctccctaattaaaaatgattagacaaatcaactaccttgattaattaactcactgatgggaatgcatttgaaatatgaattaaaaaatgatgaattataatataaacagggattggagataaagaaaaataacacattatgtttttcttcataataaattaattatcaaatgagaattaaaagcacattaattattattattatggtactagtcgggtttgggtcccccttttgggtcgaaatttttaaatattttttttttttgctttaaaagatcctagaaacaaatatccggggcttttcgagcttgctgatcacgactatgacaattattttggccaattccgaaccccgaatccaaattcgaaccaaaactcgaaaatttgaatttttgaaaatttgcttttatgttagaa

SEQ ID NO: 16396 - DNA, 1220 bp, Heterodera glycines
acaaaaaggggaagaaaatttcagaaaaagcgacatccgaaaatgaaacggaagaaaacggtagagattttatggatgattaaattttttgcaaaattttaataaaataccaaaattttaaatgataggatatgaaaagggatgttcttgcccaccatattatgggcccacatacaaagtcaaataggcaagaaagttgatcgcacaagaaatggtaagtcgtgcccaattttactggaataatatataataatttaattaattaattttatttaatttttttaatatattaattaatgcaaaattgataaatattaaactaataaaagggttcccatcggctaaaattgttttaagggaccaattaggtgacttcatggaggacataaaggaaaagttttgcgaatttatgtgatgatagacgtcgtggggaaatttttgaaattttaattgggttaaatgaacagatttaactcaaaaatggaaaatttacaagatttttaaggatattttttgaagatttttatagttagttagttcgccaaaggaaattttgaaaaaatttaatgagattttaacagactttgaccaaaactttttttgcaaatcgggaaataaattaaattttagggaaaaagaaaactctttttccattggattttttatatccgtgtgtaaaataccacagctttccaagaacatcaggaaaaagggatatctgcaattttcatggcgtaatgcccaaatccaaggatgttctttgaatccaaggacggatgggatcctgaaaaataataaataagaaatttttttattttgaaacagttgtttttttattagttcattaattttcaggtagcggcatcataaatagtagaaaatggtagaatgatcgtgcaaaaattatcttagattattggatttagattttttatatacctcttatattatataccttaaattttccgcgtataaatgggatttcgatgaaaattaatttaaattaaattaaattaacattttaagaggagatattcaggtatcagtattccaacaaactttttgatttattaactatatcgaaaagtagcggttttgagtctaaaaattcttttcaatttatttattaagattgtataatgtatgaagataaaaaatgtgtcctgaagcattgtgatgtatttacacgcccttaaaaccatgggtaatataatttaaaa

SEQ ID NO: 16397 - DNA, 981 bp, Heterodera glycines
aacacttagacctatctaatgatatcaagaattaaaaatttagatgcttttgaacaaagttataacaaaaaatattttcatttgatggtttttgactaacgtcatagcaccactattcacttcagtttcgcaaaaaggccgaattcgggttaaactgcagcattgcgacaaaaataacggaaaagtaaattcaaaaatccctctccctttacatttcgctcagataaatgaatatataatttttttttcttattccaaatttatgaggataaatttaaatttcatatgattatttaagcattttctactcatttcttaattgcttttaacaaattatatcctaatggaacaatttcaccgtttcttgaagataaatatttttcataaagggaatctaattaattaattaccaccaaattgcctaactatttttcaactccagttaaatcaaagacaatgtgcttgagacagaagaaagaaaagagggataaggattaaaagaatgttagaaagaaaggatttgcgaagtaaatgggaaagggagaaaggggatagagaaagaaagagcaactgggaagagtgagggagagagatttagagagagagagaggagaaaaaagagaaagaagttgaaatgaaataggtattgaatgagagagtgagagagagagagagagccagagagagcgaaagagagagagagaggagaaaaaagagaaagaagtggaaatgaaataggtattgaatgagagagtgagagagatttagagagagagagaggagaaaaaagagaaagaagttgaaatgaaataggtattgaataagagagtgagagagagagagagcgagaaagagcgagagagagagagagagcagaggataaaaaagagaaagaagttgaaatgaaataggtattgaatgagagagtgagagagagagagagagagagagtgagagagatttagagagagagagagagag

SEQ ID NO: 16398 - DNA, 2682 bp, Heterodera glycines
  misc_feature (2591)..(2592): n is a, c, g, or t
  misc_feature (2616)..(2616): n is a, c, g, or t
gagctatcgagcaaatccgagaatgttcttaatttcacgccggtttttctcacgcagtcaatcacagatgctgatcacggagaagaaggtggagctggtgttgaagcagctgaaccgggagaagtggaacaaactgtgctacgacgggggcgaggacggcgccatttgcgacggcggagacgacgacggcgcatttctgttggacccggcggacgaagcggcggaggacgacgaataggcgaagcggaacggacgggcgaagcgaagggcgaaagtgccatcattcgatgagaaatgccatattgttatcactagggcggcgaaaaaagaaattcgcgaaatacggacatagaaaatccatcctagaggcttccaaataagctaattgtaaggatattggttttcatataattagctgccctaagtgtcacacacacaaatacatacatctcttgttaatgttggaaaactttgtaaatttgatcagttaaaacatatttgttgttatgtgaatttccatcaaattttcagcccctccattttctgtgggttaggcccaaggccagaaaaaaaggcaaacaaattttttttttctattcgccacaaagcctttaaaagggcatgaattttgtaatttttgttgattggttttaactgattaacctctggccggccgatcattgaggccaatttttaaaaacggaaagagtttagaatactttaaaatttgttttgccatttccttaaatttgaagtaattaaatttgattttcggaaacccaattaattacctaatttgttttcgcttccatttaaaagccattgataaatttcctctcaaaattaaattgcgcaaaaaatcgaccgccctggcggtaaaagagtgagtgacctctaaattcacgaaatgcacttcttcgcccgattttacagcaaaaaccacggaaatgaaaccatttggaaggaaaggaattgacggacattgacccaaattcggcgaaattttcttacctttttgtttatatactcatttcgaaagaaaaagcctaaaattcaaccgaaaaaaaattaaaaattttgccaaaattaaaaaaaattggccatgggacattgatcatctgatcacgactgatcagtccaatgttttgactgctgctaaatccctaatacgataaaatgccaaaatccgttggtccgtcccataatttactaattttaatcaatttataaagctattagttgctaattatgtctttgtttgtgttgaccctaattttcgcaattattcactcccttttaaatccgccgccggtggcaattgcattggaaccagcggaaaatgagaataaaagtaaggaatgggcttctaaaaaaatcattggccttatcgtagtctaattgatcacaatgctcacaaaaataagcgagaaatttggggcactgggccctcggcttcctcgatcagctgggcctaatcacagagactgctggcctaggggtgctcgccggccggcacgatactgatcagaatgccaaacaaacaaagtggccgtaaaacaagccatgatcatgtaggcaaacccatgcaaactggataaaaatttggcaaaatgctttgatgactatggggcccagcagtcggccatggcacggatttgtgccatatgtcttatcattaagggcacatgacattgccaaacaacagtattactgtaaatagaaacacctgtttaaataattgcacaggaacgcggctcttccgtctgtacagtaaccgtgggacattggacagatgggcaaacggtggcacatttgtccaatttgacggaccaatgcgaatcggcagcgaaatcgcgcaggcaaattggagaacaaaatgccatgccaattaaaaaaattttaaatctgtggctctaacttaaatgcaatacggtggtaccgtaaacccaattgacagggaagtactgtatcggtgacgctggctgagccgttcttcctgcgcccattctttcgcgttgttcccattgccgcgtccaattctaccgtatccccaccgtcccctatcggcggttcgtcttccgcctctaccgtacttctccgaccgggccaggcattcaaagtatactgtaaaatattaattttttaaaaattcaatttgttttaagttggctctgacgcgtgacgcttctgaacttcctgtaaagcattgggacaatgatgggagcacaacactgaacatcacactcatggcacaagtgatgccgccatcaccggctgatgctgttaatgcgattagtgaaaatgtgcgcgaattttttcgcattttaaaatatttaaaaaatataatatttatgaaaaagggttttactgatcaccacttccttcctctgatcaacagttatctccatcattaagcttagatcattccggtcactgaaattgctctgatcactgaaaattgccaatacatacccaatttctgatcacttatatagttctgatctcagtaattccgagtatttacccaactcgtgatcattaatctgatcataataattcagattattttaacctgacaattaccctcactnntctcatttctgatcactttaatanatctagtttcgctaatcccgatcatttagctcacttttgatcattccctctgactgatcgatcatc

SEQ ID NO: 16399 - DNA, 1054 bp, Heterodera glycines
  misc_feature (19)..(19): n is a, c, g, or t
  misc_feature (64)..(64): n is a, c, g, or t
  misc_feature (599)..(599): n is a, c, g, or t
  misc_feature (610)..(610): n is a, c, g, or t
  misc_feature (621)..(621): n is a, c, g, or t
  misc_feature (654)..(654): n is a, c, g, or t
  misc_feature (660)..(660): n is a, c, g, or t
  misc_feature (662)..(662): n is a, c, g, or t
  misc_feature (665)..(665): n is a, c, g, or t
  misc_feature (670)..(670): n is a, c, g, or t
  misc_feature (672)..(672): n is a, c, g, or t
  misc_feature (714)..(714): n is a, c, g, or t
  misc_feature (724)..(724): n is a, c, g, or t
  misc_feature (728)..(728): n is a, c, g, or t
  misc_feature (730)..(730): n is a, c, g, or t
  misc_feature (733)..(733): n is a, c, g, or t
  misc_feature (753)..(753): n is a, c, g, or t
  misc_feature (774)..(774): n is a, c, g, or t
  misc_feature (785)..(785): n is a, c, g, or t
  misc_feature (803)..(803): n is a, c, g, or t
  misc_feature (806)..(806): n is a, c, g, or t
  misc_feature (809)..(809): n is a, c, g, or t
  misc_feature (812)..(812): n is a, c, g, or t
  misc_feature (826)..(826): n is a, c, g, or t
  misc_feature (848)..(848): n is a, c, g, or t
  misc_feature (850)..(850): n is a, c, g, or t
  misc_feature (857)..(857): n is a, c, g, or t
  misc_feature (859)..(860): n is a, c, g, or t
  misc_feature (863)..(863): n is a, c, g, or t
  misc_feature (869)..(869): n is a, c, g, or t
  misc_feature (913)..(913): n is a, c, g, or t
  misc_feature (919)..(920): n is a, c, g, or t
  misc_feature (929)..(929): n is a, c, g, or t
  misc_feature (939)..(939): n is a, c, g, or t
  misc_feature (941)..(941): n is a, c, g, or t
  misc_feature (945)..(945): n is a, c, g, or t
  misc_feature (953)..(953): n is a, c, g, or t
  misc_feature (960)..(961): n is a, c, g, or t
  misc_feature (994)..(994): n is a, c, g, or t
  misc_feature (999)..(999): n is a, c, g, or t
gatcattagctcaactttngatcattccctctgactgatcgatcatcaatattcaatgtttgtnttgttcagttttcgcatttctccgtgcatccaattgaagaacaacacattgttgtacaaatgatcagcagcaaaaagtcgtggctaaatgttcccggcgatcagtcgcgccaatttgtcaccgtttcgtcccaagcagtgcgcgacccgaacaattgctccattttaagagtgaaagtgagtcacaatcatttttataaatgattaaaaaatttagcgaaatttactttaaaatttttaaattggtatttatatatcaccggtctcgagattagagttgagaaaagtcttgggcttttttggggtcttcttcagtctcgggaagtttttagtctcgagcagcacttgtcaataatgtaattatttttaattaaattaaacatcaccaaattaaagcttttctagtgaatttatgaatataaatatttacaatttctttttttttcattttataattaattttctttggtgcatttgaatttggcaaaaatttttttactaattaattttaattccatgatttttgaattataaancaattttccantttaaaaattnaccacctaaattatttcctatccatttaattantacctncnctnaacantnaatttaaaaaaatataattaaaaattatacatttaatttaantttctctttnattntnccnccctcatttaacaataatanccacaataataataattcatncacaacaaaancttctacaactaatcatnatnatnatnatactaataatttnttaatttttcaccaaaactatncnacaaatntnnaanaaaaanaatactttttcaaacctaccatatcaccactatcattcctactntacatnnatttatctnaaatatactntnaatnactccatnattattnncactattaaataaggattaaaatcaattttctncatcntaattttttccctaggagaattttttaatttatttatttaagtataaaataatat

SEQ ID NO: 16400 - DNA, 2256 bp, Heterodera glycines
catcgatgggattgtgtacgttatcgatcctgcctctgtgaagcagtcttcctacgatgcgcgtggcggtattgaccatttgaatgtggtcaccatttcgaaggcgtctgccaaccaaagggccggaagagcgggtcggactggcccggggaagtgtttccgtttgtacacagcctgggcctaccaacacgaattggaggagcaaccgatacccgagattcagaggaccaatctgggcaatgttgtgcttatgctactcaggtctcaatttattctcaaattttctataattgtaaacttttgtcggattattcgttgtcattgtttagccttggcatcactgacctcgtccattttgactttttggatccgccaccttacgaagcactggctgccgcattagaacatttgtacgctctcggtgctttaaaccacaaagggatgttgactaaacttggacgacggatggccgaatttccttgtgatccggcaatgtccaaaatgataatttcctcagaaaagtccttaatttctgttttacccggtcatctactttttttaaagatacgaatgttctgaagagattatcactatttccgcgatgctttccgtaaatgcggcggtgttttaccgcccgaaagcgatggtaatccatgcggacacagcgcggaaaggattttggtcgtccagcggcgaccatctgactcttctgaatgtgtacaacaaatggagagaaaccaacttttcgatgcagtggtaaatccagtgtctaaaataactcaaaatatagaagtaattagttgaatttaatttttatttaggtgtatcgaaaattttgtccaacatcgtacaatgaaacgggcaagggatattcgggatcagttggaaggactgctcgaacgagtggagattgagccggttttcttttattttaagctggatttaatttaatattgcatctttccgactttctttccatttaattaattctttaagaaatcttcttccgacacaatggccattttaaagacaatcactgctggatatttccacaacttggccactttggacaagggcggtcaatacaaaactgtcaaacaccgccacactgtccaagtccacccaaattcttgtttgtttgaagaccgacttcgttgggtgatttactacgaattggtattcacttccaaagagttcatgcgagaagtaagtcataaacaaactctcattttttaactaaacaaatgtacctacagataattgaatgtgacccgaaatggatttcggaagtggcaccgcattactaccaacaaacccaattggaagattctgtcaacaaaaaaatgccgaaacaaatgggaaaagcaaaaagtgaactcgtcgggagttgattcacgaatttcagttctcttacagtgtaaattcgacttttgttttttttagtttgccaaattttaatttaaatggattttccgtgtttcttattttaaatgttatcacattttttaaaatatctttacataacttcatcaagctgatttttgactgttcttacaattagacggataaaataagtaaatggcttaccacgtcgacctttctgttcgcccaaatagggcttttatgcaatttggtggaattcaatttaagtgtttcaacccttcggaagtgccaaaaattagtgttttggaggtcactcagacgaacacttttgacgaagtacttgcaaatgttcagtctcgttccctgttcattttcctcgttcttaggccggtttccccgttagaggtgggttgtacgacccgcttctcggcacctccgaaaataaccattgtgagacgtgcgggatgcaggggacgcactgtcccggccatttcgggcacattcggctcactgtgccggtgttcaaccctcttttctactcattcactctcaatgtgtgttttggactcatttggttttttgtatgttctttccattaagatgatgaaagggacttgcatccattgccaccgtttcacctgcaactccaattcggttgcagccaaagtcgtcattgccaaactccgggcctttcgttttggggtgccggaagtcttggacagggtcgagagtgggttgaaggcgaaattcgagaaaagagacgaactgctcactgaacgcattgatttgatcggagagagtgtctttttacgggaaattaatgcgttcatcgcagagctgaaaggcgtgtccaacgctgaccaactgcagaaa

SEQ ID NO: 16401 - DNA, 2771 bp, Heterodera glycines
cttttcgtctgatcacttttagtgactcaaaaacaactcgcttgatttgatatgcgttatttacaagcaaattatctcaggtcaatttaatgcaaatgttgggaaaatgtgtcagtgattaatattaaaaagcggattttgtgaagttgcgttgggctcggacggcagcatcaaatatggcaacatttggatggacaaaaacaacccaagcgatggacgcgacgcggacgcactcgcggcgacacggcacgtgatcatcgtaagagggaaaagccgaaaatcaaaagacaaagcgcaaatgatcagatcgacttggaaaatcagtccagtggccaaattgacgaattcagcagaaatctgaccgccaaatttggcacttatccctttttctgcaatggcacttgcatgggcgacccatcggaacgatcggtgggcaaacccttcggcattttatcattggccttgttaagccttcgcaatatgcccgagcattgttcgacacaacttacgtgtattttcgtgcacttaaccaatcaatggaacaatcgaaggaagcttcaaaggatttgttccgaaacggaacaaatatgaacggagaaacggccggatcatttcagggtaggagagagaaagacaggggaggggagaggcggagggggaggagagacagacagacagagtgatggagaaagagaggggcatagagcagacagacgaagcgtgagagaaaaaaggaccagacagcagacaaacagagagaggagagagagagggggagacaaagagattagactgatctgtcgccaaaggtgagaccggactaatcactttcgactcggacggcaaccgccagccgacctttttcgtcactatgctaaacgcagcgaatgtgccgacagtgacaatgacagtgaacatcagcaaaggagtgcttgtaagcagaggaggaggagggcattttgccaatttttccaacattttgtgccaatgttcagaatttggaccgcctttacaccagcgaagcgtccctttgggtcaattggggcggcgttcggccgctgaccacgccgttgtgcggctacaacggcacgcaatgtggccaaaatgcgactgtgtacattctgatcggaagtgccgtcattttgatgctgctgattgtggccatgctcggcatcggatacgcactgaggtaggggggaaaaaccatgccaagcgtagtcattcagtttttgcttttcaacaaacagcctttgtgccgttttcagggagaaaatgcgcgagaaagagcggctgatgcgcgagtgtctgattccgtttggggagctgcgcaatttgaaggagctgcaaagcacggaagaactgaagaaggagacggagaaaagcatgcggagcatgcaaagcagtcattcgggtgagaaaaacggtcataccgtaaccaaatgtacggtaacgaaagtacggtaatcaactggactactgttgaggaagcacaaaacttacggtgggcagccacaaagtgttggagacggccaatttcgcactgtttgtgtacaaccgggagattgtgctcgccatcaaataccatgccagagtgcgcattttgggcgacgatttaaacttccttcgtaaggtgaaagacgaaaagtaaccggggaattgcctacggtacttttgaccggggaattggttacagtactttttctgggatacggtccaagcggaacttgaacaaagttctaagtgtaataaacgacgttatatttaaatacttgtctaattatcttattaagcatttgcttttggtcattcccaaaatcgcaatacagtaatctctcatcgtttctttacggtaacagctccgccagtttgaccacgacaatttgaacaaattttacggcgtttgcacagatgggcctcttttgtacggaatatggaaacactgccaacgcgggacattaaaagttggcaattaactaattggcggtaattacgctaattgatgaacaaattaggagctgatcgccaaggagcaatatgtgggcgacaatttcgtaatgttcgctttgatgcgcgacattgcaagtgtaaattttgaacattttacaaaataacaattgatcaatggataagtctgtttgatcatttcacgccttcttcactttaaatgtcccaatttctcagtctgatcattcaaatcccccagtctcttagatcaccactgataactcatgactcatcatctcatccatttcccttctccattaacttttcagggtctgatcgccattcaccaatcattcatcggtgcccacggccttttgtcctccgaaaattgtctgatcaacgaccgatggcaagtgaaaatcagcgactatggactgaacatgatcagagagagtcagccgatgccgaagaaaagttggcattttggcaccattttaattaacgccaattcaaaggccttttgtggacggcgcccgaacttttgcgagaaaacaatcggacgggcacaaaagagggcgatgtgttcagttttgcaattatttgtgtggagatggtgaacagagagacggtttggaatgggacggagagggacgacgacgtggacggtgggcaatggcattttagggacaattggggggggggacatgggtgattggcacttgagaggggattatgggggggacgacggtggatggtgggcaatggcattttagggacaattgggggggacatgggtgattgcacttgagaggggattatgggggggg

SEQ ID NO: 16402 - DNA, 1177 bp, Heterodera glycines
aaatttaagatataattaaaaagaaattaaagatttacctcacccccagatggaagcaaatctcaaattttgattttatttgcatttccgtcgtttttcagcctaaacgccatcccaattcccatccaattgatgcgtttgcttgcctcgttgaaggaccattcgaaggcgcacaaagaattgtattggagatcgttgaaggtgtgtgtgcaacttgttgtgtaaacaccatttaaataccattttttctgagggagtgggggttggaatatacggtaattatacaattttgccttggaaaaaataaaaaatttcggttgatccaacacccccccccccccaagacccccccgggtccaaaaatttcaaggaaaattttctgattattttttttttttgcttcctcattttaacaataatgactttataactgacgaacacgttgcaaaatatgtttttgaaaatcaaaacataacgccaaataatattttttattataatgaaatgttttcgtcttcatccatctcttccgctgatgcaaaaaataatttatgcaccttttatttttctctttcaactgtctgcgtacaaattttttgctggggaatagaaaaaaaaaaaaaaggtcgttcaagcgaaaaattctcaaaaatacacccctaagaattgacttttttgatttggtacaccaatatcctgggaacgtccctgccatagtccatgaaatttttattgtaaaatttaaaggaccatcgactgctcccattcatggcctacgcaattgcgcgcggcaacagcacaattgtctacgacgcgtttgtgctgttcacgcactgtgcccaattgcatgattttccattgaaaaagtgcgtaaaaataaacggctttctaaaaaagtgtgccctgccaaatttttgctatttccccaccctcctccattggcacagattgagcattctgaccgcaaaatgtgcttcgatgaaaaatggtggtgccgccatggcgagtcgaggcggcggcgccggcacatcagcagcgttcaatggccaacagtcgtcaaggtatgcatgttcaccagcaggggatgggtggagagttccgtggttctaaaaaaattttttttttttttggaagtcccaattatgagacaaaaaatgttttgagttttcgggaatcg

SEQ ID NO: 16403 - DNA, 2500 bp, Heterodera glycines
ttttaaatttttgtgctaacttttttttgattggaattctttttttttgagccatagaatttccgcattttcgtctgggattttttttgaaattacatttttgaccgcactgtttgtttgtgctgtttaacaattacttaataatcacaaaacagactccccccacccctcccatttattcacgcttgcataatttatttttgttccgccatttttgtttattgattagcggagcttttttgggttaaattcctattaataattttttttcattccgttttactttttttcaccgaaattgaccttttttatagtaggcacagtttttcaaaaaatttactgaatttaatttcgccattacaattttcattactcaaaccaattatcttttttttgaagaatttgtttaaaaatgtcaaaaattgagagtgtataggcaggcccgtaaccagttaggggccggagtaggacaaaacgtcgtcagccgaaacgtcgtcgaacgaatttttcgaccataacttttttctttctcaaccaaattaaacattcttggtattattcgaaagcattcgaaaaatgctattagcctgcaaattttcaaaaatttttatttatgcacaaaaaaatcagagcaaaaaaagttcgaattactgggtttttgagttcattctggccataacttttttgaaacttaacgaaaatttttgagattttgcaaattaataataaacacatagagctatcgaacaacaccaacaattcttaatttgattgacattgaacaaagttatggttcaaaaagtcttccgacgacgtttcggccgacgacgttttggggtgcaccggttaggggcaactaaacgccgctggatgccaattttccatatgttttcaaaaatcaggtctcaaaatggccaaaatttcctttttttttccagtcgccgccgaaaatttaggtcaaaattacactggaaaaatttttggaccgaagagccaaaaaaaagccacatcacaagctgttttgcaagaaaattgtatcaatttgaatgcttttttgcatggttttgctgtttttgggccccttttacattgctaaactgcagcagcaacgaaacatccggcgtttcgtcgccgagttggagcagcgcctggtggagagtgaggcggagattgcggcgctctgctccgagaagcgtgagttggccaaacgcgttggacacatggccaacaaattggacacggaacgcgtccaaaatgcgtcggcgatggaaagcgtgcggagggaccggcaattgttggtggaggaaaacgagcgggaacgcgcactgcacgcggtgatgcgcgacaaatttgacgagttgaagcgcaaatttgacacgtgagggagcggggagggcaagggaaagggcaccacggcctgttttttgaaaactagcagaaattttcaaaaaatgtagaaattttttaaaaaaaagtcaggaaaaaattaaaaattttttttagtgatttgcaaatttttttttgaaaaaacgtacttattcattaaaaattctgcgggaaatgcactgcattagcctttaaaaaatttcaaaaaattttatttctaaaaagttatggaaaaaactgtttctaaaactaacaataaacgaactttttggtttaagatttctatttgaatgagtatatacagaaaaggacggatagtatttttaatccgacgaatatttgttattttttgtttaaaaaaataccgaataaaaattttaatttaaaaataataattataaggctcttatccatccaaaaataccaaaacgtatactcaaaattttcagcattgccaaaacggtgttggacaaacagtccgagttggagcaaatgaccaaaatgaacacggagttgagccaacagcttcatgaacaagcggaagcattggaaaggcaccgtaccgagttggaaacggcaacaaaaatggtgatgtcaattaaaaaaaaataaaattaaacaaatttgtttaaaaattgtcacaggtcgccgaacgggacaccgaacttaaaggaagcgaatgcgagttggccaagtgcagggaggagaacaccaagttggacgagctcaggcaacaaatggtccatttgctggaagaatttggtgccaatttgggcaaataaatcatttttatgtgtggcggagaacagatgcaattacaatacaatgtataaaattattttttatttttatacaaataaaacgggtatttttagtgaaaaaactaattgtaagaaaatttagaaattttttctttttccaattaccggtagtcaattaattataaacaaaacaggataaaatttgtcaaatatgaaaacataaaaatgcatgaaattctcagtcaattttgcgttcaacagtatcctacaaaagcatcgacggccagcgtcaccgtgttcttccgttcaggggagaggttgcatcaaatcctcaaaacatgaaattcaatttt

SEQ ID NO: 16404 - DNA, 2378 bp, Heterodera glycines
ttaattcttaaccaagtaaaaggtattcacaaatgtttttatgtatattcgcttgaaaaaattattcaattattttatcaatctttttttgtcatttttcattattttagaacatttttgggaaaaggagtgactatttacacgttttttacagcgcgattttttcaaaaactttttgggaacttggaggagagtacggcggtgccgataggcgccgccggaaaaatttcacaaattttgaatgaaatttgcgatgaaaaatgtgttaactttacttaaatttattatttaaaaatattaggcattctgtcttagaaaaattttcaaaaaaatcaataaaatcccgcataatcccaattttttatatttataaaataagactttttaggtgtaaaaataatcaaaaaccatattttaatatttcgtaattcataattccaaaaatgcaactcatttcaactgacatcttcataaccctgtcgttagttgccgctttttctcattctgctccaataactcaagggaaacgtaagttttcggaaataattaataaaaataattgaatttcattaagcaaattcttccacgaatggaagaaagaccaaagagaatccaccaacttctgctggggttgtctcgtcggtcgcaaaagttgtcaccggtgtattggcagtgactgccgccggactgccgggtgccgactgtgcacgacgaccgattgggtatggcaaacaagcggagacggcggtgaattatgttgcttctgccgttgatcccccgttggctcaaccagcatcagcaccaactcaaagcttttcgacagatgattttaagacactggtcggtgccacttaaagtgataaaaagagccgggttttcacgcatttatttttaatgagtatttaatttcgattaattcgaattttattttctgctttaattatttaaatttaacaattaattgttttttcagcaaccatgtacaaaattgaaccttagctttctttttttagttttttggtttttaatggaaaattaataaatattttattagacgccacctggtcaacaaaaaatgcgtcgtagaatagaaatgaacaaacccatcactgctgttcagcatcgtggtggtggtggtggcggccatggtggcggtggtggccatggtggcggtggtggccgtgctggtggtggtggccgtgctggtggaggtggttaccgttcaggtcgtacgtacggtacttatggcgcaggcgcacatggttctagcaaaaactgcaaatcaaactcgaattgcaccgaaaaagatgtaaatcttttttaaattttatctttgattgattattttaaaatgttattttatgctggtttctgatgattcgggactttttacttgggttgaaactttccaaaaatctgtacaaaaatgcaaaaaattgaaaatgtaccctaataatgctactcatggagtggactttattattcaacattaatattttcaaaacccaacaataatgagaattaattgaaaactctatttaagcctgactgttgttcctgattgattggctgctcgagtttgattgttttttcgatgaatttggaagaatgggccagacgtggataaagaaagagattgctataaatttttggggtctatttaatcggtcgttttcctaaagtaacttcatcaacgtaaccttcctcacctttcctttttttaaaatttatttgtctgagtaaagcattactatgcaacttggtttttaattacaaattcaaagtactttaaattattttctggcttcattgtaaagcaaattttttgaaaaatttgaaaatttaaggggtgaaaattcttgataaattaaatgattaatgtggattattaaattgagggcaaattaagaaattgattaatattttgtaaaagcacgaattgcttttaaattaagtttttgttttatctcgttttgataaaacaaaattatgtcaacagaattaacgaatttgcaatcatagttattatgatagacttttagaacatttaagcaacaatagagattaaatatttttcatttttcattagctttcattttgattagagaaaatttgaaatttacaacaaatatttttactcgacttcaagcgttatttttgtgattctatttttaattttgtctctaattaatacgatttgaacaattgttctgcattttgaacattttaaattttaagatgggcccacattaaaacggacaatgagtgcgcttgaagttgcggctttgacacttggagcagtaccaagtgttgaagctggacgaccacttggaacaataatggtataaatcatggtcgaaaatatttcatttttaaaa

SEQ ID NO: 16405 - DNA, 864 bp, Heterodera glycines
gcgccgccaccgccggatggattagtgatcaccggttatccctctgctaatccggatgactattttggaaaaaatgctaatggacacgaggtaaatttagccggaaagggaaccgtttagtatcatttccatactctgctaattgtgaaccgatttttaaaaagcgccaaaatagctgcctttttcggaaattttagaaatatttaaataaatccatctatttttagcattgtcgtcgcgatgtttgtacttgccattgttgtgttgtcacttgtgcttggtgtcatgaaaattgttgcccaccagaaaactaattaggctgtttccagagaatcttatcgagagtgagtgaagcatacgaatgatgaggcgaaaaaaagaaaaatttaaacattttactatttataattcgaaaaagcaaatgacagcgggaaacggcgtcagccgagcggaccacgccaattgccctcagggcatctcattttatatacagcgaaatttatctccaaagttcgttgggttgaaaaagggggaaaggcaaaatgaaaataatgcccattatttcgcagtcactctcgtttcttttccggtctctcaatttgttaaaaatttcggctttttcggaggaacaactgacttctgctgatgagttgaaggattattcaattccaggttttaaaaattaattggttttataaaaaaaaatatatggaattttaaaagttcaaaatttatttaaaatggaggaaaattttgcataaaaacaacttcaaaatttgtttagtttgaaaaatgattgctgtcaaaaaattgggaaaatatccaaaatcactcagaaaattaacacaatagaatggatttacg

SEQ ID NO: 16406 - DNA, 1635 bp, Heterodera glycines
gagtgtccatttggcgggcagtgcggcagaaaagcccttccgagcgacgcgaaagcattcttcgccgattcgatggccaaagtgcaggcgatgaacatgctgaacatctcttccaacgaccttaacaatgcgttgtgttcgcttctctgcgacgggtaaaaccttttggcgtgtttcatcacattggacacttcgaaaaaagcaaaaagaaccaaataaaagcagcaccaagtgccaatgccggcgtaaagttggaaaaagtcgcagcccaacgaatgcgaaatgcgttcgacaactttcaaatcggtgagggaagtcgactcattcgctattcacctgtgatatagagggaaatgggcggactcgtcagcagcacgaggaaaagctgccctccgaacagcccaaacaccaaaccgccaatccattggcccaaaattgcctttgaaaccgcttaattggtgggaacgaaattgacaatgatcagagagagagagatcactcactgattttgccatgagtatgctcctcatttagcattcccaaagcaattgccatcggaagaacaataaaatagagaaaagcagcagagctaatagtcttttgaaaggcacgagtgtccgcaatgccatcgagaaagtccgatttataaaaaggaaggcgacgacggaaatcgccgattagtcccctcccggggtaccaattttgtgctgtctttcgaaaagttttcttttacatattagttaatcgagtaccttttccctttgcttctcattttcaacattttctacaacatttgtaagttcgtaagcccttaagcgaattttggccacaaattggcgttctgtggccgtggtggccaattcatggtaaagcagcggatcggccaacagagaagcgaaagtccgagcgatttctgcggcagatttagtctcttttatttggaggggggcgaccacgaggacaacgaagcgaacattagtcaatccgacgccaaagtttgtgggaatggcgagccgcgcgaaagagacacgggcacgggaaatatgctcgattgaacagcttaaaagccaaggaaaatggggagggcgatgggatggtctactgaaggacgagccaacgctggtcctccaccagcccacgatgctcatccgccaaaacgccttggaggtgttcacggagggcgaatgctatgcaaagggacgcatcgcatcagcgacaggcaaacggcatggcacaccttcacctacgctgctgaccgcacatgggacgaacagtttggtagcaatttgccgaaaggagacgtactcgagaggggttttgtccacttcaactgctgatggattgtccgttgctgtcccgtgataaagcggcttttcctcaaccattcttaagggaatgcaattcaaacaattgaacaacccactcactcacttcatcacaatgtcttccaaaagtgtctcagttacgttaaggagcactgtgcatcgttccaacaaatgctccgtgtccatcatccctcggacttcgcattgaaaattccgtggagtgaccagcgattgaatgcgggacaacaaaaagtggggggagggaaagtcgacggggaaattgccacggtcagaaaaggagggcattgct

SEQ ID NO: 16407 - DNA, 916 bp, Heterodera glycines
  misc_feature (57)..(57): n is a, c, g, or t
  misc_feature (893)..(893): n is a, c, g, or t
ggaaagggaaactgggcggggccaattaacgagccaaaagtgagttagaatctctcncaaatgagacggtaccagcagaggaaagtaaagtttctccacccaaaggaggtaagagtgtttatcaaatatgcaatgtttttggttactctggcttcaaaatattattgccattaggtaaaataaaatttttagagaggatattttttcgaaaatcagtacgaatcggacctgaaacaaatcgatcagtattgatcgtaaaactatgcaattgaaaggagtgatcagtaaaaaatatttaatcaatcggcgtcaacgattaccaaatcgaactcatacatatcataggaatgaatgattgaaaaattatcaatttgtccgtcccccaaagaattattatactccaagttcaagttccgttgttgtacagttgtgttgctgtactgctcgtcctcctcattctgttgttgttcagttgcattgttgaacacttcgtctttcttgaattgtggctgaacggtctttccccgggatgcttcttttgtgaattgttcgtggtggtatttgctgccattctttggctgattattctctttacgaatgtgcgtttcctccttaaattttggtttgaaagtaaattaaagtcacttaatttgatatgattaaatttgaaaacaaagagagtgaaattgtgaaattaataatgccctctcgcctgataaagcaaagcgtcttttggttgttcaaattgagtcgtgagttgatgcgaattggtgggacaatcactgccaaacaaaagtaagagagacacagcgaggagagcgagaagaaggaacacaatgatgcagcagaggcaatacttcaaacatgagaacattgtaattttaggctcccanattcaattatttaaagacctgca

SEQ ID NO: 16408 - DNA, 2783 bp, Heterodera glycines
tttacattagattaatttgaaccctcaaaagtttattggagatttcttgccaaaaattacattgaagaaatttattaatatattaattgattaatagaaaatattaattaataagtaaaaatctagatttgatattgttaatgaaaaaataattctaattcattaattatttcctaatcaataatttaaaatatgaaatcatcccaacttgaattttaataattcaaaatgaattttttttctgatattaacataaaaaataaaaattagacttattcaataaaaaaatgacgattaaggaaaatttattttttgatcccatattaaaaagttatttgaaaaattcacaatatttaaaaaatattctggactaatttggaaattttctataatgtgccaattcttaagaaaaaaattaaaatcataaaaattaaaatctttgaataataattattatatatatatatatatatatattaatatgtattaaataaggtttatcaaaattgaatacaaaatttaaatgaatgaagtaaagcgaaatattttaaaatactaacaaaaattttttgatcattcattttaaacacactttaaatttaatggataataaatggaacacataaataaatgtgaaatctaaatttgcttcatatataattaatatgcctacaacaaaaaatcgtcattatttattttaaacaattgaaactgataaaaatattattaagtaatgaatttaataaaacaaatgctgtaaaaaaaaatcaaatataaacacaaagatattaaaatttttaaaaaaatgtgatttaatgcaccaaacaaataaaatattataccaggataaaaaattcattttatctaattaggttcttttatatctttattattaattaaaactaaaatcaataaatacaaaatttttaataaaatatacccaaattttttaattttttccgggtggcgattgttgtctgcggagccggccccgaaaaaactcctttggctcaaaatatcaaaatttgatgagtttttggacagaatttgttaacaaatagtagttttacaaaaaatactttgaaatcgcataaaaaaattatcgatgttcaaaataaatgaagtcaaaaaataatgacaaaccaactatttattcatttaatattcaagttatcaattactaatttttgaatattttaaatatttaatttctattttagtaaatttttactcgcctttttaacatacagtaaaaaaaattatattctaaaaacatttataaataataaattaaaacatcaaataaaccatttttatcaatttatatggaaatgacattaaaccaaagcaaaattattataatcgtatcaacaatggacaaaaatgagaagagagaaagcctcagtccaaaatttcattttaaaatattataccaaatctaataaaataacattttggtcaaatttaaaacaaacaataaattaaatgattataataaaaaaataaaagatttacataattacaataatgaataaaaataaaaatgaattaatattttgcgtctatatacataacaaataatgtttttttgagaaagaatacatgtataaataaaaataatatatagaaaaggcaaaataaaaaaaatcacaagaaaaaattaatcaataaattaattagatggacagaatcaataataaatatttgaaccaagtcgagaataaatttaaaatttaacaaaagtaataattataaagagtaataataacgtaaaattattttatataaacaaaaaaaataaattacaaataaatatttaaatgcacagcgcaccaacctggaacacgaacagtgtacgaaaccatgaggtaaatataggtaattaaatattttataagatgtaatgaataaaaaataactcaagattaatttttcaattaaagaattaaataaattttctcataaaatttttattaattttggaatttttttaaatatcctattaaacattcaaaataataataataattttggcagaagagacattttcacacaatgaatattataattgcttaaaatgttgaattgtacatatttttagagctcgttaaaaaataatttacgggagcgggagccgggagcgtgagttcgaagtcttacgggagcggcaatcccgtaaactcccgctctcgtgaaaatcccgtcatttttaacgggagtcccgggcgggagtaattcgaaaatttaattaaaaactcacaaaaatatttttaatgcacaaatttgaaggacaatctttttattaaaggaaaaatatgtaagcagaaaactagaaaaatcagattttgggtcgaaaaccagaaaattttttcaaattagttcaaataaattttttttataattattctaacaaaaaaaaattttaactttatattttcgacttcctttcttaatgttaacaactttttacggcgtattttttgaaaaaaaaatttttgtgcatcaggtaggaggtgggagataatgaaattaaaatgataaaaaactaaattatccttaaatataaattgattttatatttcgcatagaaatttaaaattttttatttaaggcggaagaagcacatcaaaacaaaattttattaactaataaatcattgagaaaagcatcatcaacttacttcagtgaaggaaacaattttaaaaaataaaaataaattaatacctattattattataaattaatagagattttgaacaattttttaatcacatcacaaattg

SEQ ID NO: 16409 - DNA, 3747 bp, Heterodera glycines
  misc_feature (3739)..(3739): n is a, c, g, or t
ccccccccctcccccgtccgcccgcgctataacccaacccgattttggagcagtgcacccacaattataatcagcacatggtcgtgtaatggtaaaacggtaatattttctacgtatttttgtttttgtttgagtcgtaatggactaaatttcatgtacaaacatgacggcatggcacccacacttataatctgacgcgatggatcaacggatggaggacggcgggacaaatcgagggaagaggataaacaagagacgaattctgacgaggttttggggatgggtggatggcatgatcagtcttcccaacaaatttgcctagacaggtgatgaagcaaatagtcgggtgcagctcatccacgcccccccccccgagaattttttaacagttaaaaactgatgaaattgtcaaataggtaaatgaaataagaagctataaaaatgaaagctttttcaccgattttttttggggggggaaaattaaaaatttgcattttgaaaaatttctatttctaattttttgtcttctgcagaattccggccaaaaatgggtgccccgtgcgctgctcgtcgacttggagccgcgcgtgctcagcgacatttgcaaccacgaggccaactcgtactcggaactgttcgacatggacaacttttaccagggaccgaccggctgaggggcgggcaacaattgggcacgcggttactacccgggcggacacattgtggacgacatcatggagctgatggaggcggaaagcgaacgggcggatcatttggagggctttgccatgtgccactccattcttggcggtgggtgaacagagttttgtgtccatgggaatgtttgacaaaaatgtttttaagcggagcaattattgttagttacatccccatatcgtttgcctcatgaaaatagtttaaaaaaacaaacaaattttctaagtttattgcaattggatttttttcctgcattagtgaaaaagaaaaaacctttatttgaaacttcaaaataggtattttgttgtgaaagaattgaaaaattaaaaagaaattttttttttgctaaagaaacctctaacaaataagaatttgacgaatttgactactaaaaaaacttcaattaatttttatattaatttttattagatttaaatttttaataatttttccaactcgtcgtccttcagtacgtcgtatgggcctcgccctggcgcacgccttgttcacatatgccctcttccccttcgtacccgctttgcccctcccccccgccctcaatttagccaagtttttcgttttcagcaattccgccgttttctccgccacccatcgctgcgaattgtccacttccgcggccaaccattccgcgcccgactcttttttggctgctcccaaattcaaatacgcagaaaagatttgtttggacgcctctctctcccgcggggacgacaaacggcgcgttttttccgctgcgattggtcatattttggtcgggtgagagaacaaaagttggtctaacagcagcagaggaacacccttaagacatgtgcaagaagtgttcaatgccgggtcattgtccgaatgtatcaaagcgtgtctaatggccgagtcgagctacgggttcagatgcaaatcactgatgttctacccgacggatgctgatcaggcaaacaaaagcatctcgaaagccgagaggggtcaaaaattggttgttaaccccggcgggcgattagattattttgtgcgcctcattttatttttagcatttaaaaaaacaaatttctgtcggatttgtcggaacacccacccaattttatatgcttttatttcagaattgtctgatgaattctgagagcagattcacccaatccgatgtttttgtacaggaagtgggcacaatctgatcaaaaatgatcattccgttgtcctttggcaggaccaaaatgtgcacatgctttacgtggacatggaacagccgcggcttcccccctcgccgcagcctttgcccgacgacgaaaggcgccgtttcaaggcaaaacatagcaaagaaaaagcgcccaaatttgacgccccttttccaaattaataaaatccgtgccaattaattgatctttgacactttcaggacattcccatcggcgcgagtgtatcagaaaaggacggagatttgcaaaaatggaccctttggtcgaagtgtcctctcagctcatccgttccaatgcttgccgaaatgcggcatcgctatttgaagtgccgcgaggcgaaggacgtgagaaagtgcccaaaagagtcaatgccatgccgaaaaagtgagtggacaaattggatggacagaaaaggagcacaaaagggaggaagagaaagaaggagcaccaaaataatctgacaaaattggcattttcaagttaaaatgtaacgaatgaattaatttatattgaaaataaatccgaggaatgccaaaattggcgaattgaaaatttaaagagcatttgcagtgccaaaaccgctgagaatacaaccgatttggacgttgacagcaaatgcgacggcggcctaacactccgacgaccgacggatgccggtcgattgccttgcggtcagagacgccctcgggcgaaaaaagccaaacgaacgaacaaatgctgacacatatatttattctctcttcgtttttgtttttattttttttagaaatttgcaaaaaaaaaaaatacacaaagaaaaaggaaagggtagcggcgagatcaaagggaaaagggaggggcaaagagagacaatggcaaagccaaagagcacaacaaaagtcggccgaccgatattctccgccgttttctttccgttttatgcttttccccccgtcctccaccaccgttgccgttgtccatcctccgttttgtgtccagtgatttgtcgtcgattgcgtcgtcccattgccggagactgaagaaattgaatcgcatcagctgattgtgaacgtccccagccgatgagcagtcattcgaagaaacggaactcttcccgcacataaacgttttgcgttgtcttcgccgagctaattaagagattgtcattaattagcaaagaaaaaaaaccgattagccaaccgatgtcgctgaagggcatggaacgtaggtgccctttgaactttttgaactgctccgctcaatgatcggagaagggcaggcgaccaaacaggcggaaacggcctgaaggaaaaccaatgaaaaattcgaattgtagtgcttgattagagctgaccactttcgccaccattatgtgctgcttttcgcgcaacaatttgacacgcaaacgattggcgaaaaactcagtttttccaaaatacgccaaggaatttgtggccgaattgagtacaacgccaaagtcggatagacggacgaggatggagaggataatgccgaacgattcgatgccgtagaaagactcgtaaatgtcgaagaaaatgggaagcgacctgaggagagggggatggatgatcagaaaatccagcccaatgcacctaaaaatcaggaatttgatcgcgataaatatggccaccgtccgtgacactttctctctgagttcttccaatgcgaccaccgaacggcgccgactttgtgactcgaaaagccttaaggtcaaccaatttcgaacagagtctgaccaatcactttcactcacatgcgacgagctttcagcgatctgtgcactttgtattccgtgacaattgtcatcaaagtgnatcgtcag

SEQ ID NO: 16410 - DNA, 555 bp, Heterodera glycines
tcggattcccattggacatcacgttaggcatggtattatagtacaaggaaatggctaatttcttaaacaatcattttaccgaagaaattgtgaggagaataaattcgccgtgtccgattaattaaccgttaattagcaataatgattcaatccgtcaatcgctagcttccttatacgtgctaacgatccgcgatttgacgttcctgctcccggccgatgtttgttgttggtccactaattggggaatttgaagatgttcagagcgttcactgtgctgagcagtgataaggaagtacagaacaccgatcaaagggaaaaagacggaggaaatgatcattggtcaattggatgcttccaactgaaatacgtgctttcctgccttccccccccctaatgtcacttatttaaatcccctcacggccggtcttctttttttcgttatttccttttaccattgttgacataattgtcagctgatcgtttccattaatccatcgccaattccattctttgcacattttcttccatattcactgcgtgttaagtcatgtgcgg

SEQ ID NO: 16411 - DNA, 1523 bp, Heterodera glycines
gatttggttgacaaacaaaaatgttataaccaaaaatttgggctcgtagtacgaaaacgagcccaacccaagtgtttctgtttacctaatcttttattagcaaaaaatccggagataactcatattaaatttaacagtcaaaattatgagtttcgtcagtttcttatacttcacattaaaatttatatccaaaatgttttcccactgtcagcaattgaatggtcatcattcgaagtgacaaatgagtggtcaacaagtacgaattggtctcaatttgcttgccattctccaaatattcgtccattgtttttgcattgaaatgaccttccaaaaggccctggagagtgaaaaagtgccaacaatcaaaaactaattgctcaattaattaattaattaccctgatgaacaaaagaatgtccactgattgcgagccgaacacgagaaatggtcgatagataacacaaaagttgaccatcccatgggctgctccgtcgttgctagtcgacttcttcaacagactgaacttcttgccgagttcggcgtgcctttcccggtccccaaattgtgcccggccttggcccactttctcccccaattctctcagcagtttgatttcttccccatcattttgctcctcctcctcctccccctccccttttccgtcctcaattcccccctcattcgcctctctttggccatcctccgcatccatcgctgcgttcgccaaattttggtcaaaatgccaaagcatcgtttgccattccgtcgggtcatgcgggtcaatgttcggcctcattttggcagtgaacaccagcagtggtgccccgttgtgctgctgctgctggtcaattagcggactttgccgaaccgccaaatgccaaagcactaaaccgatgaagcgcaaccgcggcacaatgcccacggcattctgtaaatgtttttcgatttttttttgacttattacatccctttttcgcactttgtcatgctttttgatcgctttccacattactcttgcaatttcaaaaatgcgttcagtttcgtccaatttgtcttccgaatgttcggccatttctttggcttttcctaatgcttcatttaatgcacaaattgaataagcatcattttcctgtggaatttaatcagttttttaatttattattatttttgttttacgatactttttccttttcaaattctcccccgagggcagcaattgttgcgtttcgcactttttcaatttccgatttgtttgccagcataatcttcaactgattcatgtaatcaaagtgagttttatgcgtcaaatttggtcgcttattttccaatgattgaacaatttttagcctttttcctttggctaaataatttatattttataattttaatgcaatatttatccaaattattcgtttcaatgctcaccaattctttgagaattcagtgcattaaatgtttggaggtttgtggataaattgcaataatttttatcattttttgctaaattttaattttttaatttt

SEQ ID NO: 16412 - DNA, 3050 bp, Heterodera glycines
  misc_feature (32)..(32): n is a, c, g, or t
  misc_feature (3011)..(3011): n is a, c, g, or t
  misc_feature (3028)..(3028): n is a, c, g, or t
ttttgatcttttaaagtctgaatattatttancacactttcattttaagagaatttgacagatttaattaattttcaaaattccctgtacaactttgcatgcgagattttatttggccaaattttaatcttttaaagtctgaatatttacacactttgacattaaaagaatttgacagatttaattaattttcaaaattccatgtacaactttgcatgcgagattttatttggccaaattttaatcttttaaagtctgaatatttacacactttgacattaaaagaatttgacagatttaattaattttcagaattactatatttgaaaaaataatgttttttaaagtagttttttttcaacaatttaaagtggttattgacctccataattaatatataaaccaaaacattttaaaataaaatattaattatttaatttatcgaaaattagtaaaattacactttatcaagcgcatggggttatatttataaaaaagcccttttaaagaaaatatactaaatttggcaattttgatttattatcttaattaaacgtatagaaagagataatagctatatttactcatttgagtctattgtattcgttagattttatattctcattcgctttttcattattttttttataatgtttttatgtgcctccctactaaaaaaatatttttttaatgctaaatcactaaaattcaaaaaatgcgcagaaaaacgtgcttttcgtatctttctcttaaaatatatctgaacaaatatttagcataaaatgaattcatcctttttattcgttataatgctcgtgctgcgtatttgcggcgaacaaaatgtcgcaaatcgacgctatataacggcggtacatgagggtgctcatgtactcgcactctggaggtcgcgctatggagacaaagtcgaaagcgtgagtattaataaaactttaatttatggatatatttaaaattagagatttttttttttggctctaaaaccgtcaaaataggtagaccttggtcttaaagacacaaagataggctctaattaatacaaaacaggcactaaaaccctgatttttaggagtataaaatgattaaaatttattcaaaaaggtaacaaaattaagccaaatcagtattgagacaaataatttttaaaaacgcaaattcttatcaagaaaataaataaataaattttgtgcatgaatttttgagaaaatttcatttttaatggtgtgtttttgaaaattttagggtctattcttatgggtatattttccagaaatttgtggggtcgattcttaggggtatatttttcttaataattttgggcaaaatgccaaaatagtcaaaattgattttatggctttttatgatctaaaaataaaattggcactataattcgcaaagtaacttatcaacccaccataaaaacttgtttttcatgccatttggagctcaggaaaaaataggctaatacctaaaaaatacatccctatttaatacaggtaacggttgaacgaacggcgacaacatttggtcgaacaatgttttgggctaagcgttggtacactcctgaccagctgttttcgcgtctgattgcgtcaattggtgagaactttcttttttgtaataattgccgcgattttttgcgaaaaaacccttttttttgctcaatgttttgaagaaatgagctaaaaaacgcaattctttttaaaaatctcgattcttatgtcactatccgtcactagaaatcacttttttggcgtttcgtcactaaaatagtaaaaattcactatttgcatttttcactatacgattttttgaaaaaattttcaaataaaaaagcaataaaacgaaaaatagacccctaagaatcaaccccaataatttaaaaaaactcttctaagaaatgaaaaaattttcttaaatttcattttcttgccaagactttgtaattaaaaaaaattttatttaatttttggctgaaaattgtgtcactgttcgtcaccatttcgcactttttgccaatatttggtatttttagtcactgttttagttaacttttcgatatttttcgtcatctaaaagtcgcggccctagtaataactaaaatggtgatgaaactaattttattttttcatacagcaggggaagaggctgagatcatgtttttcaatcaaggccctcctcctgagggccttaaaaccgaccaaaccgaaatggacgacgttgctctaacatgggtatgtgaataaaaatttctaaaacagttatagattataaatcagagttcccaagttttttttcaaaataaggcaaaatggctcaaaaactaagattcggaccccaatttttgcatttttatttacaaactaagaataagcacaaaacaaggaggtcgtgccaaaaaaggataaatcttctaaataaggcatttttaatttctaagatcgggcacgcacctccaaacaatgacaaatcttacaaataaggacacttgggaactctgatatagatacatcacttctatgagaactcacatgacgtggcaccatttgtggttcctgtgcgataccgaacaactgcccaagggcgattaatgatggcccaactgatagcaaaagcacgaagaacatttcgggaagcgtttggtacagaggaaagccgccaatgtttaagaatggtaaacttcaataattaaaaataaattttatcttcttttcaatttttcaatattaaaattttttaattcgagtttgccgacgagctcgttcgcaaaggaacaatgaattatggtgaaatttttcggtaagcgctttattttatagcttattttgagaacttagaaaaattaattttagaattctcggcccaccaacaaaccccgacaatgtggttgatcactgaagggcaaaaaaaaaaacacatgcataaataattaaatggaacttatgataaaataataaatttttaataatatcttataaagttattttttcgantaaaaaattaaaataanattaaagtcgcaatcccttcat

SEQ ID NO: 16413 - DNA, 1190 bp, Heterodera glycines
agcgaccaataaaaaagtagtttcttgtaatgttttttacaaaaaatagcaaatgaaaatggtgagggagcaagtatcggatgaaaatcaaaaccaagtataaagttcaagcaattaaaaataatagaaaaaataatttttttttttaattgtaaataaatgcgtaccaatgacccatgaataatataataatgaaatttttatttattagtagtttgcatttaaataatttttaaggattgtatttatattccttcttcataattttgtttttataattgttcttattcgaaaaatatgataattattaatatttaatttggtttacaatggaaatatactaaaaattttttcttattttttcagacgagaaacttaatttaaaaaaatttatattcatattttttgccatttgaggatatttatgcctatttaatgccagttcgcaattttgctaatttttcttgaataaataaaagttttttaatttatttattgttattacaaaaagttcaataaaaaagttttgaagaaatattttttggtcaaatctccaaaaaatgtggtctcttcaatttttgcatttattttattattactattattattattgactaaaaatgtcgtaaaatgaaataagcacagaaattcgttttttgagttcatttctttaatgcatataagcaaaaaaattaaataaattaaagtcccagcctatttgttagtcattattttcattaaatttttaattttcatcacaattaaattttttatcaaaataaaaaaatctgggtatttatgagcagaaaaagtgcaaattcattgatcgatttgatgaatttcgagaattgtatagccaggaagaacagaaagaatttgcaaacgaattgggcaaactctgaaaatattaaaagaaatgttcaaccagttgatcagtgatttttgtttgatcatgatcttgatgacttctaaaagcatagtttgaaactttataaaagatttttgtagggaatttaaaaaacattttttatttatgcaaaaataaaattaaaaaactttcaataattttacatacctttttttgtcatggaaaaagattttttcgaatgactttatcaaatgctgattttttatgagcaactgatttgaaatcgaattaaagaaaaaatttttttaaaatttattttttt

SEQ ID NO: 16414 - DNA, 1855 bp, Heterodera glycines
tggaagctgggacagaagtgatatacggtatcagtatttttattcttctattcattctttcctgcatactctcctttttaaggtcaattgcaaaaactttacattgcatttttaattgtttctatttaccatttaaagtcatcaaaggatttataaaaagagacataaaatacgatgacgagttagaaatgaatctattaaataataaacgaaaaagaaatgatttaaatgaatcaataaagaaaaagagaaacagaagattaaaaaacttaagcctaaaagcaaccactagcatgactttcatttctataatagtattggcacttattaataaaataaattgcgctgccgaagttgcaatcattcaggcaacttcagaggattgcatccgaaaaacgaatgggtccatttgtcgaataaaaggtacagcggaaatgacaattcttccagctggtcagaaaatttctctggcactaaaaaatcaatacagccaaactattggcttattaaaaataaaattaaattcactcactctaaattgtgtgcaggaaacggtagcttggctacgagattacggtataaaagtaaaatcagcaagaagatgtcccactatgggtacatgtaagaaagggaaatgtgcaaatattagaacaagtaaaaatattgaagaattaaaagagtattgggattacccaggaaactcgtattgtatggagggagaaagagtttggggttcaaagtgtgccctaccatcattcgggattaatgagtgttttttttataaaataatagcaattccaataactccgacagtgtggaaacaagtaaggtgtttaaattgggattatgaaattaaagcggaaattgagctaaaaagtgaaaataaatcagtaaaaaaggaattaactctgtacccgggaattacagaagaatggaatgagttttcctttacgccccaaggagtaactccgcctatttctcctcttttaagtgattatttctttatttcacaaaaagacataatttatgccggaaaagaagtaaaaactaagttaatttgtaaaaatcaaataaatgcttcaaacttcgaatgtgatttacaaaaagatgtttgtcgtgaatgttggataaacagcaccaaagaggagcctttaatccaatgcgaatgtgaagactatttaattgaagatttggaacctaaactcccgtttactaatgataaattaaatttaagaagtgacggaagtaaaattttaagcgaaacgagttatacaccgatacaattattagtaagagtagaaaatttaaaaatagtggcggaaatagacggaaatatttgcaaagcaaaacaaattggccaattatctgggtgttatgagtgccaaacgggaggagtacttaattacacttgctggacaaattggggagaaagcattgccgagataagatgcccaggaggtttaatctttctagcaaagtgtaaaaaagaaggtgagaaccaagtggacattcttccatttaatcaagccaaaattaatatgaattgcaaaattatatgcccgggagggaaaaatgagttaaaaataaagggcaagcttatgtatataccagtaaatgaaagagtgtttaaaatccgcacttcagaaagattaaaaataaaagaaagcggcaaattgaaatgggacgatttatttgaattcgattttaaaaatttatttaatcctttgcaaattttaataatctgacctctctcattatttttgtatttctcacaattggagtcatttttattttatggaatttttacctctgttatgggataccgatttgtcatcggcatttttgatttttgaaa

SEQ ID NO: 16415 - DNA, 1657 bp, Heterodera glycines
atgcggaaaagggaatgaaaaaatttgggtgggaaagggatggaaaatgggaagaacaattgcgatatttcagaaatggtaatgagcacgggcttaccaaatgggtttcagttggatggcctgaattgggctcaggttcaccaatgtattccccctccctccctgttttatcccaacccaaagataatgagaacagcgattgtacaaccgcaattattggcacaacagcctcaaccattggcacagcaaccgcaaccattgacacaacagccgcaaccattgacacaacagcctcaaccattgacacaacagcctcagcaattgccgcaacagcaaagtcaacaactgcctcaacagcctcagcaattgccgcaacagcaaagtcagcaactaccacaacaacctcatcaattgcaattgcagccgcaacaatcggttcagcagccgcaacagttggttcagcagccgcaacagttggttcagcagccgcaacaattgccacaacaagaagtaccgcagttgttgcaacgagtgttgtattcggtacaaccacccctaccatcgcaacaacgtcatcatcgacctctctttggaagagaaaaccgattcacatctcgtagaattggtccaaaccgttcacatccgtacactattcgactgccagcaacagcacaacaaccattccgtgaagcacaggaagttcagccgtctttgatcaattggccctgggacaccccccctaatctcaatgtgccattcgagattcgccgtgtcctactccgtcgcttagcccaagaaagggaacatgcatttggcctagccggagcagttcatcaatggaacccacccatggcaattcttttgttggccctcgaatcattctacagcagccttctcgccatggcggtaaatgaagatggtggatcggtgtcggcacaacactgatcagtcgcggcgggagtgtcatcgccaatcgattaaagcgatgaggaaagaaggaaaaggatgactaatcgaccaaagatcgaacaaaggacaaatcatatttaaggagtgattgttttacattcgggatcattcaaattttgctattgggaaataaagcaaagagcattgagattgatcaataaagttatttgtgttaaatataataaagaaaagggttcccctagccttatttactagggaaggtcatcctgatcactctgatcatataaaaggaacgacaggggtattattttgtaaaaagtctttttttccccaataaacttttcataccccatttttcgcaccgtgaatgttatttttattgaattctgaaccggtttgagtagtagagtacaaaaaattgaaaatttcgaaatcatgtttcccactcccttctcccaggggtattattttgtaaagtctttttccccccaataaacttttcataccccatttttcgcaccgtgaatgttatttttattgaattctgaaccggtttgagtagattagagtacaaaaaattgaaaatttcgaaatcatgtttcccactcccttctcccaggggtattattttgtaaaaagtctttttttccccaataaacttttcataccccatttttcgcaccgtgaatgttatttttattgaattctgaacgcggtttgagtagat

SEQ ID NO: 16416 - DNA, 3299 bp, Heterodera glycines
cgcataattgtcgaacactgtcggcacatattcgttgggaaatttgttggttgtgtaggaaatgagcagacaagtctttcccaccgcgccgtcgcccaccacaacgcatttgatggtctgcatcatgcacagatgatttgctcaccaattttatgacagaaaaaaagactgtcctggtctgattaatgcttaaaaaagtaatgaatttgaagtcgaaaaaagttcataagaaataaagctcggcgggataggggctcccgcgagatttttttacgggattacggccccgatcacggaaaattttagactccaacttccgtaaattattttttacccggctctaataacaaattattttatgtaattttttttttgtaattaaaaagaatattttgtgatttatgattttgcctaaatttttaaataaaaaattagtgtattgatagaatgtctcttgaagaaaatgaacgttctttctttttatcaatcaatcaatgaatgtgtgtgttttgtttatgtagttctgcggaagattattgggagatagagacctttatacaattatgtatatgttctatacatatatatgtatttacactattggtttttgttttattgaaaattcatatgtatgtattatcctcccgggagtgcctcggctgtcagcactgactgttttttctaggaattggtggaagaaggcgggaatgactttaatttaactttatctatcctttaatttaactatctatccttcatttatagtaacaacaatgaaaagcttacaatagttctgctatatatataacttacctattctttcgcacatttttcacaaggatttattgaaaaacaaagaaatgaacgtgtcaggccccgcgattgatcaaagtgggaattcatgggattaaattaaacattcactgttatttcctgattaaggtgaaaaaaatcggaaactacttcaggatttgcaaaagaccaaacaacaaatgatgatgaggggtgccaggtaatttcggatgaagaaagggctattgtaaataatagggtttttttcgttgacggaccaaaacaaatgtggtatcaatcgtaagctctcgattagacaaatcgatttaaagctgaaagaaattgaagcgactaaaccggtctaaagctcaaaaatgtaaggaaaattgggcatttctaattttaaaacggtcaaacccgaacaaatttgatatcactcgaaaaattttatgagttaggtttaaaaatcagtggatgaagtcgaatcgacggcatctaagcaccgagacaactgagtcctagtgaaaatagacatttaatggcattttccatgttttagtgctgtgagtcgttccgcccaatcgccacttttgccttccgcttcatcgagcagtttgtcctccctacaacaagcatcgactgatagtacgcagggaacattcgccaccagtgggcaacaacagcacggcactttagcgaataaatccaacacaatgctcgccatggaaatgatccaaaaatccagtataatcttttacccgaccaactccaattatggcaaccaacttctgcccgggtttccccgttttttggctgactgataaaacattttacggagaaaaccgtattttaaaattaaaaaaagaaaggcaacatttaaatatacaaatcgtgttccctcctatgtgttaatagcacaatgcgtgttgggtactactaggtcgttgcataaaaaagggcgctttttcaaaatgactttttttaagacttgattaacgtttgttatgtcttttttgtgtgtaattcttttatctgaatgttctcgtcatgtttttgccaaaaattttgattttgtccttttatatctaaagttacagtccaaaaaattgggtaaggtcaacaaaatttggctaccattttacaccaacgtccataacttgagttaaaattgtcaaaacgacttaaaacttggtcagattatgaaatttgatgagcttaacaagaaaaagcctgaaagaaatttttctgaaaaagaaaaaacaaaattttttggccatgtttattttggccaagtttccaaatctattggccaaaccgaaagtcaaaaacaaaatccaaaataattccatcggggttttgaggctttttatgcccttaaataatataaaaaattacagaatcgcacaagtttccaaaattgtgttatgggcgattattcgaatttctgaaaacgaaggccaaggagaaaacacttgtctttggacaaaggatttttcttatatacgctatgtcattccaaaaacgaaagttgggccttaaagaaaaattccattcttttgaggatggaagggaagggaagtattagaatttgtccaaggtcattaaacgcatttatttaaatagtgatttttgatgggaaaagtttcgtgttaattaaattatgcaaattcacttcgtccggaagttcagtgatcgaattctccgacaagtcgatgacctccaaccgcagcagtcgcgtcacgacggagggaaatgtgctgaatttgttgttggacgcgttcatttgggtcagcgaattgcacgcggccaatgggtcgggcagttcagtgagctgattgccttcaattttaggaaaattaagtcgggaaaaaataaaaatacctaaataaattagttttgtaattcttattgttagaaatttactcaattgggaaacaaaaaaaaggcaaaccagaaacatcgagcaattccaatgtcttcaaacagccaatttcgtcgggcaaattggtcagacggttgttggcgatgtacaactgtttgagcatgctgaaagtgccgatggtcgaaggcaattcgcgcaatttgttcgacgacagctccaaaattctgagcaaagaatggacctgaaatttgaaaatttggaccttatttttcatgaaccccaaattatcgaccattttaagtaaaaaatgaagaattaattacctcctcgacaattcccgacggcactcttttgatgccggcccctttcagttgcaaacttcgacttttcttcgactgttccaaaaggcgtcgtaaggcactcgacgagagatcatttgagccgaattttagcgcggacggcagcgctttttgaaggcgagtcgccggactatccttttttgaggacgaagatgacggatgaccctttgagcgatttgagtgttcattgcccataatcagcagacaacaagaacgaaaataaaaggccaattaaatggatttaatatctgaaaaatgaaaatcgg

SEQ ID NO: 16417 - DNA, 1550 bp, Heterodera glycines
atagcatcacgttttctgctgttcgctgatcgcatggaccgtttttacgctaaaacactgacaaaaaatgaggcaattaacggagacggacggggcaaattccgcctcaactgttggagacaatgaaaataataatggcattgatcagcagcagaaacggtccgaagcgctgacgaaactgcgccaatggcggactcgaatttcgaccggcaaaatggaccaggtgaacggtcaatagtcaattgtgatcgccaattttctgatcaaatcgatcagttaattgggctgattttgacaactggtcaatctgacagaccagcacacagtgatcactcatcagtcggcgacacacatactttctattttactttttttagattctcccaggcctttttgttggaggactacggtatggttttacagtatttacagaaactgtattttgccccaagaaatttttttcttgcattatatctgtgccgtcttttctgaccaatgagagataaataatcagccaatgtccgagaatgaaaacaattatgcctaaattttaaaaaagtttaaaaattaattgcctatttcaaatttccattaattatgaactcattagtgaggcaatgaatgtgccattgttatccgataatggcatcagtgcggttgtctcagtgcgcggcctttcccccgagtgccattttgggcccggcattgcgctgcttcggttgacacttagcgactcgcctggcgaaaacattttccagcatttcccagccgttaattcatttgtgcatggccatcggctcgaaaatggttggcattatttagcaaatttatttatttttatttttttattaattttatttgccgtttaataaacttcctcgttatttggtcaatgtcattcgaaagcccagcactttaatagtctttttttctatatttaacattcctttgaatatttttttattttttatatttttgatcccctctttacgaattatgtatttatgaatgaatgtaaccaataaaactcacctatttgatcagaaaatgtgctgatccattgtttggccggtgtcagccgaagtgtgtgcctttgcctggcctatttgatgacggtgaccaatttggactatcccaatgctttggacttcgtttgtcgtcgccatttcggcgcgaagccaaattttggtttcaaaatgcaactgaccaagtttggccagcaggtgactaaccatttaattttatttattattattttattaaagtgttatttttcaacagtttgtccaaagggaacggcgccgacttttcgccgaattttctcatttcaccggccaattgcgtgaccaatttcaaagcgattgcatgtttaccaactcgctttatgttggaggttcttccgaagcaatttttgctgagaatggcactgacaaaggtcaaaaacggcacggagccgggaaagaagccgaaagtaagccaaggaaaagtcaattcgaaatttaattggcagaaaattttcattccattttttttggttttaatcaaaataa

SEQ ID NO: 16418 - DNA, 2136 bp, Heterodera glycines
ccagcatttcccagccgttaattcatttgtgcatggcttttctatcgaaaatggttggcattatttagcaaatttatttatttttatttttttattaattttatttgccgtttaataaacttcctcgttatttggtcaatgtcattcgaaagcccagcactttaatagtctttttttctatatttaacattcctttgaatatttttttatatttttgatcccctctttacgaattatgtatttatgaatgaatgtaaccaataaaactcacctatttgatcagaaaatgtgctgatccattgtttggccggtgtcagccgaagtgtgtgcctttgcctggcctatttgatgaccgtgaccaatttggactatcccaatgctttggacttcgtttgtcgtcgccatttcggtgcgaagccaaattttggtttcaaaatgcaactgaccaagttcggccagcaggtgactaaccatttattttatttattattattttattaaagtgttatttttcaacagtttgtccaaagggaacggcgccgacttttcgccgaattttctcatttcaccggccaattgcgtgaccaatttcaaagcgattgcatgtttaccaactcgctttatgttggaggttcttccgaagcaatttttgctgagaatggcactgacaaaggtcaaaaacggcacggagccgggaaagaagccgaaagtaagccaaggaaaagtcaattcgaaatttaattggcagaaaattttcattccattttttttggttttaatcaaaataatattttattgtatttttgtgtgtctgatgaatttgtttttttgtcgaaatatgagcatcatttgaggcgaacaccggccgcgtcattctgttgacgaggattatttgaaggcggagaagcggcatagaaaaagtgcaaatggcacagcaaaaaacagcaatggcaccggcacttgctcaccaacttcccctttggcattagcagaggaagaagcattgccatcagcagcggagggtggcaccaccgccacgcggcggcgaatgccctccggggaggaggagtggggcgtaagccaaagcggaccccaaagaatggcacatgaatgatgaagacaaggcgattgtaatttggcacaattaacaaagctactggcgcagaccttgccactaattatctcctcctttaattttgctttttcgcagggaaatattgccgacaaatgccaaagattggtttctttaggatagggcctaatgtaatgaaaggaacctccgactcattcagttacttaaatgggcatttttcatttggccataaacccaaaaagtatgacgtgccgtcgccatccatggcttaataagtgttattactcattttgtttgcgtataaattggtagtgccctgctgaaatttgacacagcttttaatctcttctcgcgtggacatttaacacttttaattaatttcctacggctgcggctttccacaaaaatgtcgcccatttcgaactgcaacagttcactaatgtgtcaaataaatttctgtttaaagtctttatttttcttctcttttgtttgtttctccgttaagtgttcattttgatttccttaattgattattccttttattttctcaataacaaaaatttaattattattatatttttcattaaaaaatgattaaaattgtctccgtaatttacttccctttttcccccttttgttaaatatgccattgttttcttctcttctcttctttctcttctgtctggcgctgtcttcgaattttacatttttccgaaagcaattaaataagcaatttcaaaaaattatacgttctttaacacgcaatttgaaatggaccacaaattatttttcaaattgtaaattattataattttaattatgagtacgtaaaacgtttcatagaacatttttacaaaattttagtaattttttcgacctgttacattttgtcaatgcaatcaatatgaaagagaagaattagctaattgtgtaatcaatagggttgtaaattatatggactaaaaaacgctaaatatggacataaaatatggactaaaaaagcccgaaatatggactaaaaagcccaaaaacggccaaatatg

SEQ ID NO: 16419 - DNA, 3152 bp, Heterodera glycines
  misc_feature (839)..(839): n is a, c, g, or t
aggtcctggggaggagaacacaaaataaaaatcacaaagtttaaaaatgctaataattttcaattcgtttcattgttgtaagaatggctcgaaattttgcaggtaaataacttactataagagctttatgtatgcaaaagttcaaaaagcttcgattacgtacaaatttttaaaaaatacgcaattttttttttataaaagttgaaaatttgttgtaaaaagataaaatgtgctagtttttctgcaaaatttcaggtcattctggcaactacgaaacgtacaaaatcaacattttaaaaaacttcataatttttttatttacctaaaaatggaagccctattttttataattttaattcttttcgcgagagagaaaactgctgccacttctgtgatgccaaaatgagatgaagagacaaaaaatccaaaagtgcggtacaattattgtcttctattacgtaattttgtgccaacaacattgacggcattgtgccattgccaaagagcgcccatacacttttaatccctcagcactcattatgccgtcagctcaaacccaaacgcacacagaaaaaaaatgatgaatttaattttgtatatgaacgacgtaaatgagacgattagaagaagaaggagaagcgggtgtgaagaaggaagagcttcttccattgacgaaatatttacataatgagctaggtctttggaaaaaaaattccattttttttattatttgtggttgccgaggaaatttccccgttaaaattcagcgacaaaaataacgaaaaaaaattcaggaaaatcgtcaccgattgtgaatgaatgatggtgttctttgatanacccaaataaatataattttttttttttgaaaaattaatttttattcttttttttacccaaaaagcgcaaagaaaatttaattcccatttcatttttaaattatttaattattgtatatacatactaaatgcatttttgtttctcagaatttaatttgtcaaagtgcgtgagttaattaatattgaatattgtctcaattgcttaaattaaattttttacatacaccaggtcaatggaatgaattaaaaatgaactaagtaatgtaattaaaaaggaaccaattgtcaggcttcaaaatcacatcatttttaattaaaaaaatttccttttattgtaatgatttaaatagaaaattaagtacatataaaagtgcttttattaaattataaatgccgaaaatagaaacagttcactcaaaaacgaaagtaacacgcccacggccttcttttaaatcaattagcattctaaaaatggattaattaaatttccaaaataagcctaaaattggcatgctgtcaatgtttttatagaattttcttttcgttcttttccaatatttaattattattatttttttgtatttaaattaaaaaaaaattgtctatttttttaaagtttcgaaattaattatttcggtttttaaaataaaatacaggttgcttgacttttacacatttatttatctaaatgctaacatattcatttaaatattttgccggatgcaatttttacctcttttttccggcacttttatttacattttctttaataattaatttacaataaaggtgaaatcggcggaaagacacctcacagacaaaatgagtgggtgcgaaacattcccacacaaatattttgccggaaatctctttacaaaaacaatgaaacccatttcccttaactaactaattatcgattgctcatttgactaattaatagcgatttaccggcttaattagacccattaggtcgattaataaggttttctttggtaaagtgccaattttttttacaacatccctttgatttataaatgcaattattatatagggaaaatggatatctttttatgcttttaaaaattaattttcctcagaaaatgtaattaatctcttgacaagccttatgccattaaaattccaaaattttaaaccatttacatgctaaatacggcaatattttgcgattcaaaagccacaaattcttagccgctttttaatgggcggagccgcccattcattgtaaaggattaatggaaatataaaagcggcattggtttagcgcattcgcacatataatctctgtttctgcactaatttaaaaataacttattaatagggacgtgaattttaggttttaactattttttttgctcaattgttttgaagaaaggagctcaaaaaacgcatttccgcataaaaatttttcgattctgatgtcattatcggtcactagaaatcactattttgggattttgtcactaaaatagtgaaaattcactattttggagttttgtcactattttttcactatttcgacattttttggaaaattctttaacaaaaatgcaataaaaccaaaaaatacacccctaagaatctacaaaaaaaaatcaaaaagcactcctaagaaatgaaaaaaattttctcaaaaaggtattttcgtggcaagaattttaattttaaaaattatttttttatgtacctattttgtttttttgcccttaaaaatcccagccctactcattcatttgcaactgcaatcagtgaataaaaattatttttgcttaatttttggctgaaaattatgtcactattcgtcactatttctgaatttttttcactattttgtcactattttggcatttttactcactatttaagttaactattccgggatttttcttcactaaaattcacgtccctacttattaaaaatgtaaaaatttatttttaaagttagaaaaaaacaaaatgcttcgacaaatattttcctcttcgaaaatttctttgatcttacgcatcttcacattgtttatattcttccttatctttcgccaaaaaatatgcgccgatgcgttccttctcagtcatcgaaatttggtaaggcattataaatcaaaataaaacaattaaatatataatatctaaaaaatatttttatttttgtttattttaatctcaagaagaattcgaagttttaaaattaatttaaaatgaaaagaaaaaaaattaaaattttgttttctttggtatgaaaaatttttctgttttttcaaatatcattttcttcatgcgccctgcgagcttaaa

SEQ ID NO: 16420 - DNA, 1890 bp, Heterodera glycines
  misc_feature (1814)..(1814): n is a, c, g, or t
  misc_feature (1881)..(1882): n is a, c, g, or t
aaaaatatttaaatctgatcaaaaagcctcacaatgatcaccaatgcaaccagggcgaatagcaaaatgcaccagaggatgacatttggcaccacggaattattgacataagcatccgagtttgccgatgacgaattcgatgatggcccatgcccattgagctgcttgaaaaattggcgcaagtgttcatagtcttcactttgggaatggttggccaaacaaaaatgaatgccgatgacggtgatcaaaagaatggtgatcagaacagtggtggtcattttgattagaaaatgtttaaaatttgtggaaaaaatacagactgaaatcagaacaacataaaatgagatgaagaaatgatcaaattattttttaaaaattttataaaatatatttataaaataatttctggtacataaatgatttttgataataataacaattagggcttctaattgcatacacccatataaattaaaaagtctaatattaaaacaaagaatttttttaaatccccatttttttgttaaaagtgaaaattttacgtaaatttttaacgcaaaattttcaagtttttaaaaaattgagggtttgtaataatgttttgattatacgaattttacatcagttttttttaaacttggtgaacatataattggaagccctaatcctaataataataaaatggtgttaaataatcatttgttgaatgattgattcttttctctcaattgaatattctgacagctctctctctctctctctccgatcattgggtaggcaatgaacggtgattaagcaaattggtgtaatcattttttgtaatgtccgattatgcacatttacccaactgattggaaatgaataaattattttattatttaaaaaaataaataaataatcaaaacaaatttacagatatggatggatatagtgaagaaaagcaatgaaaaggaaagaaataattatgtgtaatgttcggaaaatgtgatttttcagtatcaatatcattaattagtttaattagttaagtccatttatcgcgttttttaatcggtttttccgagaaagcggtcaaaagtcgagcttctctcaattaatgaccacatcaaatgcattttcgctttcgccattgcttctctttttgtcaatctgaaattgatcaatcagccatacccaaaatttcgctgtaattgatttgttatctataatgaattaataaaagaaattagcaaattcaaaactaaattaggtaaaaaaaattaataaattaacatcttatatattttcaaatttattgaagatttttttcctaaaatcattgacaaaaaataattaataaaataggtaatttcttttagactaattatttttaatgaaattttaagatggaatttactaaaaattttcattcttttttaacaaaattttataaactctttcttcccgcatttcaatcaaaatttaatttctgaaatattgtaattccttgccaaacatcgattaaacctttcataacatcaaatctataaaaaatagtttttatatattttatggtttttgctcgtaaaatttttgcgtccaatgaaacatttattttcgccaatttttcgtttttttttaattttttgattgtgcacattaatccgcccagcagaattagtaatggcgacagttcaagaggtttttgtttgtcaaacacagtcacatcctttgatattatttcgccattttttgtttttttaatcggttcagaattaattattattactaattgcatgggagtgagagaaatgccaaaacagcatataaaaggngcacagattggagcaacaaatcattcattaatttccgctcaaaagtgccgtcgatttcctccctacnnaaagcatc

SEQ ID NO: 16421 - DNA, 1555 bp, Heterodera glycines
cttcaaagccgagcaaaaaggctgaattcgccgaatcggtaccaaaaagtgcagttgacagagacggggacggaccaaccgcgggtcatcacaaaggtggacattcgcattggatttgagaaaccccccttctcaaaagtgggtgcaacagcaaagcaacgagcgaagtgccggcggacacgggggcactccggtgaagatacattcaccgcatcagttcagcccatgcggacggacgacggacccgcgggaatttcgagaaagacagcgacgtatgaaagagacgcggctgagcagcaccgtgtcgccaggcccacgctcgcaactgctgacagacggacggacacgggcggaggtgtaattgtacactagcaattagggatttgatctgccgacaaatagggccatacttgggaaagggtgggggcatctgtttttagctgtgtcctatttcggcatttatttttgatctttcaaaaccactctgatttatttgcacagacggggcttgctgatgggagcggagctttgtacattgggacggcatcgaaaggcataatcgacagaagtcaccagcacaatgcacaggtgggctttaacaatgatcacatttaattgatcattagcagtgaaggaatgccaaacggaaaggattgaaaagatactcaacaaagacaattttcgttgatttttatgacttaaattttgccaatcttttgccgcgctgattaaattctgatcaatcatttgtcatgtcaattgttctttgaaggtttatcggtgcctttacgcacaaaatccattcaatgaaatgaacggcgatttgattggttatctgaacgagatggagtcaatggaaagtccgcaagtgcgaaagtcaaaatcgagcccaacgattgcggaagttaatggaggaaaagcagtggaaaaaacgcagcaaactcaacaagggaaaggtgcacttaataagcttaatcatggccatgggaggcaaaggaattcgaactcggaaaaggggccgagtccatccgggcaaaattaaaacaaaatgaaaggtttaatttaacagagaaagtgatgagaatggtgaacggacacgaagggagaagcgcatccgaagaagcaaaaggaaacaatgggacggtggtggtaaacggaaggagtaaagatgagagaaacggcggaaggacagtgacaacgataggagagacagtgagagaaaagagagagagagaggggggggagtagggggaggggaagcgagacgaaggcaaagaaaggcataaatttcaccctgacattatgtgcaagattaggcactataaaaagtcaccagcagtgccgcaaaagttactgttacaaatcagttttcgggaaaaacggcatttttttcaaatttcaattaaacctataatttttctcaaaaaataagattttttttctcgaacttgaaaaaattagcaaaaaaattaaaagaaaaaattttgtgtacaagttccctagtgcacgcctggggaaataaaataataaaacactcatttttaagatggttagt

SEQ ID NO: 16422 - DNA, 1729 bp, Heterodera glycines
aaaaaaattaactaaaaaaattttgtgtacaagttgcctagtgcacgaactctgtataaaataataaaacactcatttttaagatggttagtgatgccaccgacggagaacagcagcaacagaaaaggaaaaagaaaaggaaacgcgggaggtcgtttttcgcttcgattgttcacagaaagaacaaatgaaacgattaattaggcatttaagtggtgatctcgaaagtgaacagatttattgaaaatgaaaaagataaattttagaaaatgacgcaagaaaacaataagtgaaagggggtaattgagtgttaattgggcaataagtgaattcttttgggcaagtgcgcttttggcttacaaatttgttagttttttgtttttttatcaattatctaatttttttttagtccgtccgttcatttgcttttctcagttgctcttaataagcaaccctaaatgtttttcatttctcaatcgtcgcacaaaagttgcgcttaattgcgggcaaaagtttgccccgacattcgccaaaaccaatgcgaatttcgcccgtcggactttcacattttcctgaagttcaaaatcagttgcttaccaccctttgtatttcaattgcaacacccgaaatgatcacttcgtcgccatccttcagaaatttacgcgtctccccactttcgcccaatttgaccgcatttgttcccttccaggagagttccaacagacagccaaaagagtcgggagtctcgaaacaatgaaatgccaaacaaacaacgcaaaaatgctaccggtccactcaaagtgccagagcccataaggtcgccgacccgaacgttgcaaccattggacgtgtgatgagccaattgttgtttcaaagtccaatagagatgctaaacaaaaataatgaggaaaagcgtgggcaaacaataaaactcgaaaattggttcgacaaatcggaactgagcgatcgcttccctccgctaaatgtccaattgaaaatggagggaaatggacgacaaacgtttaatttcaacggtcaaatcgatgttgaagctgtacggatcggaatgattcagatgggcaaacggagatggattttgggaaggattgtcgacgacgaacggacggagtgcttccattgtgacgacccacggggaaatggtggtggcgaaacttttgccgaggaatgggcccagcggaacatactcccatttttggatgtcccttgctgaaatgtctttcgcccattttgtcgtttgctcttttgcccaccactccaatcattcatcagaaccattccgaagatgtgttcctccgtcttctcaattggaattggcgtgcccaaagcgttttcgggccctcccacgaaaaatgccatttccaactcaaagtccattaaccgacttgtcacaaagttcggctgggtatctgaaaataataccaaaggataagggcatgggatggatgcgaaaacgagccatcttccgccttgacttggccccacgggcgattgactgccgtgccggagacaacaatgcttgacgccctgccatggtaagcaacgggcagccatttcctaatcgcatatatatgaaagagtgtgatttaaatgtggcaaaatgagcaaatatcagcaccaattctccataagtgcgttgtctttgccacgaaacattgtgccaacattcgtggcatgataaatagatgaataaaagtcagtgtaatcgcct

SEQ ID NO: 16423 - DNA, 430 bp, Heterodera glycines
gtgtactatagtcaaccccccgtaaaaaaacggcacaaatgatataccaatcgattcgtctctacgagttatgcacgaaaaagtgggtctccagttgcggaaatgccaaaaaaaccggtttttgaaccggtttaaaactcgaaaatttgagtgaaaaggggggctcctaaccttttaaaatggtcaaaatcacacaaatttggtatcattcgaaagctcttgatgagctaagtctaaaaaacaaggtataaattcgaactgatgccatttaggcactgggacaactgagtaccagtgaaaatggacacttcagtctcgaaaaataataaacgggaaataacaatttaaaagcaaaactcgcaaaagggagcatgcgaagacggagcaagtagtggggcgagacgaagggcggaggaaaaagtctgacgag

SEQ ID NO: 16424 - DNA, 1528 bp, Heterodera glycines
aacattgcaatttaggagaccactcaagggcgtgctgatgaagggaaagcgtgtgctgatttggtcgagctctgccgagacggaccctggcattgtaaatgactgaaaattgaaattcccattccaatctgcactttaggtcagttttgccgaaatttggactccgatcctgcaaaatttgggcgcaacattagtcggcattggtcctggtgaaccgtttgcctccaaatcgagcgctaaccttgaggaaaagatggaattctgttccaaaagtacacatttgagtgaattattgcaatttcttttggatttatttctacagttgagcctcacgtggatgtgctgctagcggagacggactgccaagccgaggtggctgttgtgtccaaagaacacaaatatttatcgacaataataaataataaaagtctgaggagagagagtgaatgaattaattgccgaaataaatttgccatttccgcttgacttgccatggtgatgatgtgaattgacagagatttcaaagagaaaaagatagaactttgtgtgaattgaatgaatgtgtgcaagtcagcggtgggcctttttggatgtttatttattgattgcacagtccgaggtcaatgatgatgaatgaatggagcgaatgatatggctttcaaccctcggcgaattttgaggaatgcgcagtggagtggctgcacgtattttggcttctcggtccacctcaacgcgttccaaaccactttaaactgtgcgggtgttcacagagctcgcagtgagatggaattccgcacagagtgttacgggaagggggccttgggttgtgccaaaaatggatgaaaatgaatgagaaaaatggcctaggactggcaaaatttagagcagaaatttaattgccttcgctgactgcgccaaaatgttgtgtccaaagaacacaaatatttatcgacaataataaataataaaagtctgaggagagagagtgaatgaagagaagagaaggcaaaaagcgaatgaatggggagagaacaaaatgtgtgtggaacagtcactatttatgcacttcgacgggcagagagaaaggaaaagacattgagggaaaagatagagaaaataaatgaatgcatgtctattttgtcttatcccaacagtggccaagctggtcgaggaacggggcggtttggccgtgtccagcgaatgggtcattcaggttggtctttccattttttttaagccatggttttcccggaaagacgtaaagccatcccattttaaaggccatcgtcactggttcgctgcccgacctgggcgagcccggaggcgagaagttccgctacgattttgtttagtgttggctgaatgaacatcaacagtttggtggtgaatgacggcggcaatggactttgactctacttgaacacacctaacaatatcataaaccattcgctttttccctttcttggaacgacacccggaaacttttctttttttgttcagaattatctgccctatttaattactattt

SEQ ID NO: 16425 - DNA, 3021 bp, Heterodera glycines
aaaagaaattcgccacacaagctcaattcaaataagatcaaggcaaaaaagggagaacaagcgagaggagcgacgaaccaaaatagacaaggcgacacacgtccgatgggccaagaaaggtgagtttttccattggtttttcgtaaaatctctaattttacaatttttagccgctccccagcccgacaccgatgccgaaaagccacaaccatctgaagaagggccgtcgacatcagaagcaacggcgcaggacaacgacggacaaccatcatcaactccaacaccggtgacaccgctggaaatggacgtgccatcggtggagatgatgggaatcggtgtgtcattcccttcaacgcctgcctacgaagaccaacaaattcaaccaatgccgtcaacatccacggcacgctgtgacgtggtggcgacaccatcgacttcaaagggcgacggtggctttggtctcgacgatggtgagtgagaaatttcaccaaaaatttagttttttaagtcgtttcattttcattacattgaaattttaattttaggttggccgctactctcatctcggcacacaagagaagatcgttgagaaactggtgaagcacacgacgatgttgaatgcactgcacgaccgtggcgttgagaacaacaaagaaaatgacatacccagatttttgaccaaattttcacctcacttttatttattttcacattaatatttcgaaaaatttgagtggtttgaaatgagttaaattgtttagctttcacttagaaaaattctccattttaaaatctttttttgtataccaaatttattcagtttagttgggtatgaagaaagttatcctatataataaagttgagtgtgtgtatgtgtccgtttttgaatttgtgtggcgatttgtttagtttttgcgttaaaaatgtatttgaaaatgaaatgtttgatttttgctttttttcatttttgttttgtcagtttttgcaaaaagcacagttaaaataaatttctctttttttcgtttttaatgacaaaatagtttttgtatgtttattaatgataatgaaatcgcaatgaatgctttctattgcatttcttaagagaaaaagtttttgtttttgttattatcaaaaagcgtttggaaatgaatgctcttaacacttttgtaaagaaaaagaattgtttttgtatatgcaaagtcaatggaaatgatcttacacttagttttgatattgtattgaaaaagttttggttcgagaaattgtttgaccttgaaatggagtttttttgtttttgtaattaaagcggatgtcaattatgcctcttttaatggatacggttttaattggatggatttatcgcacttattgtttgttttgacaaaaataagtttcttttaacgatataaggtcagtttatttgttctttttttgtacgtagatgtttatgtaaaagaaattattaaaatgtaagagaacaagtatttataatgaaaaggattttctacgcaaattgtatttcataatagaaatacgtttttaaaattccaaaattatgctgaacaggtctgaattaagtcccgtgattgacatgccgatgaatccgtaaaattgagttcattgtttggaatagtgaaggattgagtcctcggtgattggaatggcggagaactgagtcctcagttattacgatgccgaagaatccgtgaaaagtgaaggattgagtcccagtgattggaatgctggtgggattgagtcccgggaataggaatgatggagaattgagtcccagtgattggaatgctggttagttgagtcccagttattggaatgtcgcagaattgagtcccggtgattggaatatcgcagaattgagtctcgatgattgcgatgccgaaggaccaggtgaggttaggtcccagtgattggaatgcaagagaattgagtcccagtgattgaaatgcaggagaatgagtcacggcgattggaatgcataaaaactgagtccgggtgattgaaacgcaggagaatagagtcccagtgattgaagtcctggagatttgagtccctgtgattgaaatgcaagagaattgagtcccagtgattggaatgcagcagaattgagtctcgatgattgcgataccgaagaatcaggtgaggttcggtcccagcgattggaatgatggtgagttgagtcccggtgattggaatgctggagaattgagtcccagtgactggaatgtcggagagctgagtcccggtgattggaatgcaggagaacagagtcccagtgactggaatgctggtgggattgagtcccgggaattggaatgatggagaattgagtcccagtgattggaatgctggtgggattgagtcccgggaataggaatgatggagaattgagtcccagtgattggaatgctggttagttgagtcccagttattggaatgtcgcagaattgagtctcgatgattgcgatgccgaaggatcaggtgaggttaggtcccagtgattggaatgcaagagaattgaccagtgattgaaatgcaggagaatgagtcccggtgattggaatgcataaaaactgaatccgggtgattgaaacgcaggagaatagagtcccagtgattgaagtcctggagaattgagtcccggtgattgaaatgctggtgtcttgagtccctgtgattgaaatgcataaaaactgagtcccagtgattgaagtcctggagaattgagtcccggtgattgaaatgctggtgtgttgagtcccagtgattgaagtcctggagaattgagtcccggtgattgaaatgctggtgtgttgagtcccagtgactggaatgctggagggttgagtcccagtgattgaaatgctggagggttgagtcccagtgattgaaatgctggagggttgagtcccagtgattgaaatgctggagggttgagtcccagtgattgaaatgcaggagaatgatttacggtgatggaatcataaaaactgagtccgggtgatt

SEQ ID NO: 16426 - DNA, 1968 bp, Heterodera glycines
tatcaaaaacatttagagtgtgggattttatatttttgattgtccatgatcaatttaagcagcttttgttagaaatagcaatggcattttgtgaaattctgagcatgaaaaattgaagtttatttttttgtggcactttttcctaaaaacttttgcggaatagagggaccggcgttgccgataagcgccgccaggaaaaattttgcaatttttaatgcgattttttaacagatttgcccacaaatgaccaaatttgcgttgagcaataatttaataattttttggaaattttgggtaagattttcgttttaatgctcttttaaaaccccaaattattataagatcaaacattatgctaatttatcaaaattaatcataaatttaaaagaactgaagttttccccagcctcaaaaatcctcaaaatttctcaaaaagccacaaaatgaagataaatcctcagacctggcagccctgattttactggagaagtatgactaagttattccgcctcccgaagccgggggtcccgaccgggtcattttccaagtccctgccccggtcccgccatttgagcaggaaaaacgggactagtatgcttttattttttattttttgtacaaacaagatttcactgttatatctatttcggtatttaatacatctacttaatgctttttttcccaatttgaagccattccggttttattttaaacttgagaatttttcaacaaataaattcttcgattaaattatttactgtgaaaagctcagtttttattttaattttggtaatatagtttaaaagatttttggttctgcctcacttcattattattagggttataagttgtatgcactaaaaatccctcaaatatgcccaaaaaacccaaaaaatgccaaaatatgcactaaaatatgccttaaaaaactgccaaaaatggctttgaactctcaaaaaaaacgtcaaaaattgtgtataaattatgaactgactttgaaaacaccaaaacaagggctaaggagcattttttagacaattttaagttccaaatttttaaatttttattatatgcaaaacaaaattacgttttttatataaataaatttttttccaaaatttcttacaaaaagttaaaaaattttcggtttttaagcgtgtattttaaaaaaattcccaaaaagtcaatccttaggggtgtatttttctcttttttcgcattctttttatgaaaatttgccaaaaatgaccaaaatatgctctcaaaacccaaaaatggccaaatatgcatttattctcgaaaacccccaaaatatgcttttatatgcactaaaaaccttcaccaaatcaaaaaattttaatgtagaaatgctatttttgaacccctttcttcatagcatatgcgcagaaaaaatatgcaaaatcatacaacttataaccctaattattatacaaaaacaaacaccctcacaaaaaatcactaataaatttaaggcagccgcagagaatggggatgcactacctggcatgggcaagaacattgtgatgcagtaaacaaaatgtttggctcagaatgcgcatgccattacggtgaacaagacgaaagcttaccgtatttcccggattcacatttgcaagatgaagtttcggaaaaatttacctattcttagggatgtatttttttaaacttttatgtcgattcttaggggtgcatttttcgtttttattgcatttcttttaataaattttcaaaaaacaatcgtaagtgaaaaatacatagttaaaaaacgccaaatagtgatttctagtgaatgatagtgacataagaattggaaaatttcaacgcagaaatccgttttttgagctcctttcatcaaaacaattgaacaaaaaaaaaaaaactaatttcaataaatcgcggccttattcataagaagagttaaaattgatcgatcgtggtcatccgtcg

SEQ ID NO: 16427 - DNA, 1659 bp, Heterodera glycines
  misc_feature (101)..(101): n is a, c, g, or t
gacagctaagtatgggtacttcaatttcgatgttataatttttactttttcgctcgaactttgacggggcgtttggtcgccacacttgtttgaccaaatcncaaattatgattggttagtcattgaaagcaataaaaaaatgcccaaaaaattggtcggacgggcaaatttcatttccttaccttttttattttttagaaaatcttttttttgtcgcgttgtaggcgaaaaatcaaaaaaaaatgttgaaattgttataaggaaaaatacaaaaattaatgtagcttttaaaaaattaatataaaatttaacctaataatttattaacatttaaatataaataaaatttaatttagtgtttatttttcattttgccaactaaattttccatcccaaatacctacagtcatggtcatatgtttagactcaaagagtgaatattgattaaatgcgtaataaagctgaagttgcaggcaaaacgggaaacacatttcacggtttttgtagtattttttatgggctttcaaatggtaccattcattatcaaatttgttaagttcacaaataaatacaaaacaaaatccaaatgcagccccaattctgtttagactcactcattagttcttcaataaaatcaatattttgtaggccaaaaattctgaaaaaattcctgctaagctagcttttgatgctgatcaaaaaagtctcttacagcaacttgatcagatcactccttcatagtgatcggcacaccacaaaatacagtgaaaatcggggaaattttcgaaaaaaattcctagggggttgtgaaattttttttggaaaattttatcaagcccattagaaaggggacaaaattttggcaaattgtgcggtttttgcaattttttgctagaaaaattgggagatttacctgattaattgatgttagcagagtgctgtccccgtttaaaatgagaagccgagtatttattgaatttaagattttgtcaagaaattttggcaaattgtgcggtttttgcaattttttgctagaaaaattgtgagatttacctgattaattgatgttagcagagtgccgtccccgtttaaaatgagaagccgattatttatagaacttaagattttgtcaagaaattttggcaaattgtgcggtttttgcaattttttgctagaaaaattgtgagatttacctgattaattgatgttagcagagtgccgtccccgtttaaaatgagaagccgagtatttattgaatttaagattttgtcaagaaattttggcaaattgtgcggtttttgcaattttttgctagaaaaattgggagatttacctgattaattgatgttagtagagtgccgtccccgtttaaaatgagaagccgattatttatagaacttaagattttgtcaagaaattttggcaaattgtgcggtttttgcaattttttgctagaaaaattgtgagatttacctgattaattgatgttagcagagtgccgtccccgtttaaaatgagaagccgagtatttattgaatttaagattttgtcaagaaattttggcaaattgtgcggtttttgcaattttttgctagaaaaattgggagatttacctgattaaatgatgttagcagagtgccgtccccgttaaaagagaag

SEQ ID NO: 16428 - DNA, 1078 bp, Heterodera glycines
aaaataaaaacaaaacaaaacgggaatccttacttttatggcattttggcaataattctttttttcattttataaatactctttcagaaatgacgcattccttcacaaattctttctgtttgcctttatataaatttgtaaattcattgattcgttcaatgaattctttctttttctcctcataaaaactctttttgttgaaatttaattcttttttccatttgtatattttatggcgattttcgactaataattttccaattttcgtctcaatttgttgtttgattttaccattggtattttcctttttgcttcaacttttctttaattgcttcaaatttttgaattatttctctcttttgttggtcatttggctctgctttcttattttgatcacttttggtattattttcattgtaatattcgctcatttgatcatttgggttcgttcccatttcttcatcatccatttgttgaactgcccaattttcattttgatcaatttttggttgttttatattcatcaaattttcttcagttttattgtcccatccgttgccgaaaatttcatcaaaatttggtgggattttgacggatttaattttataaataatgaaaattaaaacaaaaataaaataataaaaattcatttttacaatttttgaaaaatatttgctatgtatatggcaattacacatattccatttcattttttcttaatagggagggaaaaaaactgtctgaaaatttaatttttactgattttcaatttaatccaaaagtactaatgtaaaatctttttttctattcctaagtatttaaaacatcaaaatcgtccaaaaagaagcattttagtaaaacctaattttagccctaggacgaaaaaaatcattgtgccgaaaaatcgtcgatttattcgctcattttatcactgagtatgttcggatgcttaaaccgttcatttgatcagatgctaacttttaatttttcttgatttttggttttttccccttcattttccatcattttaatttttgacacaattcttagtcaatattttcataaaatttggtccaat

SEQ ID NO: 16429 - DNA, 1333 bp, Heterodera glycines
gtaacaattttggtaaaaataaataattttatccttacaaaagtgggttcttccgtactttcacggaattaccgataattttgggcgaaatgcgcggaaagcgaacccatcgaatgtatttgccattcttgatcgtttttgtatgttttatgttttcaaagaacaattcttatttttataatttatacggctaataatttgtataattatttaattaattttttaaaataatatataattcatttttaaaaatatttaaattgaataaaatggtttatttagggaatcggccttgttttcatgatattttatggaggagctgatatatttgtgaaaatgaatgaaaatggttaaaaaattattaaaaaaaaatattgttaaaaatttcccgcacaaaattcagtaccgaacaactcaaccaacgcatcagcagttgaacataatcgcaccataaaaaaagctgacaccgaactgagcaaaaccacacttcacacaattagtgaaaattttctatttgttttaatttgttttcagattaaattaaatgttatagtaaagtttttatcattttggcattttttcgaagaaaaatagtcattgaattctttgaaattttttcttataaaaaaaatttattgagattttgaaattttttatttaaggctggctactcaatgacacttagtagctttaattaattcattatggcaaaaatttttgtcaaaaattatcaatatggcggaatttttattaaatggccaatattatacaatcaaagatttttttttcttattttatattttatttatatttttcaatttaaataaatttgaaatttttgtttaataattgttttagaaattggttcctatttcttttcttggtttctcacattggctctgaatgtttggctttattcaattgttcttcgtgcctacttttttatgaagcgccaaaatcaaaatatgaatggcgcagaacgaaaccaaaaatttgaaaacattgcactttgattactcaaaatgtgattcattgacaaatttaattgatattaattttctaattaaaacatttgaatgttgacatttaaataaataatataaaacttttatctttattgaatggtatttggtatttaaataaataatatattcctattaaaaaatgaaaataatttttttcaattgtcgaagattgtttgcaataaaattatcaaaagccttctcatttatggtgagaaaaagaatcatttcaaaatttatttattaaaaacctaatgaaaatggcaaatttaatttttttttattattttttttttattattatcaatgaa

SEQ ID NO: 16430 - DNA, 2410 bp, Heterodera glycines
agtgataaaaaactaaaataaaatttataaaatagagcacatattgcggattttttgagtttattatttttataaaatactttttcagaacagagttctgaatttttttctgaaaaatcgaatttttccagaaattctggaataacttatttattttggaagatagaaattccaaatgaatctcataaaattctcctaattttttgctatttttcaaactttattccactaaatttgatcaaaaacgaagagagttatgaattttcgaaatttcactggattttccggggctcaaattttgacgatttttcaaaatttgtaaacaccttccaaaaagtctgaaaccacaaataaagtatatattcgtcttcagcaccataaattaggccataaaaatgcattttggctaatttaggagcaaaaaaatttttcatgaaatgcaaaaccatggggtcccccctatggttttgaatttcaaaatcacaattaattttataactttttttagactcgtgataatgagatgatataaagcacattatatagggcttaaaattccctacaaaaattgtctaagaagattttttgctaaaatcaactcctgccaagttatagacccaaaactgaaataagccctcatttccggaaaattttctatttccaaaaaaattttgaaaaatttttctgaaaatgccaccaatcgatagagcgtgaaaaacggttgcttgaaagtggtcttggttttgccgagaaaaatctgcaaaaaataataaaattcaaaaacggaaaattttcgagggggcctagctcgaaaatttctgaaaattttcaaaatccgaaaacatggatggatagagctttttgagctgcacaaaaaagtaattatcaccatcccgctcagatcaaaacacagcgagttatttgcgaaattcaaaaaatgccaaaattggttttcaaaattcgccgaagtgtacaggccaggcctttgatcctagggcttcggccaagaagaaaaaaattttccaaacatttcaacttagtcgcctcccagcagaagttttttgctccgggttcccagaaaaaagttttggcccaaaaaccgcatgcatttttcataaaaaggccatttcagcgccgctggcgctcagttggcctccggaccggaatgccattatttttcctggatgcgcctcaaaaagttgcttaagtaatgccacattcccgagcccctcccgccagccgttcccgagattttagttttagcaatgaaactcgatgttgctttagttatatctaaactagcgggtgcgtgaaccgtcggctatttagctgggaaaaagcgcttcgcgctttcggagcttcgctacctaggctgttacgggggaagaggtacaaccacgggtgggaaggtacaattctgatcagaagaggtacaactacggttttttcagggatttttaggccgcttcgcggcctcgaacgggcgattcgcgcccgttacaacggtgattagaagaggtataaaagtgataaatagaggtacatctgtgataaaaagaagtaacgggcgcgaatcgcccgttagtgcctgcgccgcggctaaaacctgtctgcaagactcgagcctccgccggtcctcagagcatgttcaccaccgaattgaacagatacaccttgccctgactccccttgaatttggacctcatttcttcccacttttttctaccctttcatttctcctcacttgtaaatacttgtatatcagctcattgtgatggaccaaattgtcacgtcaatgggcgcaactgtaactgcgttcaccgaagggaaaataatcctggaaggaaccggatttgataaattggaaaaaataattataattatttgcaactgctcagagttaacaatgctcacaatccctccccacgccaatccctccactcccggtctatcccaaaatcctctcccctcacataatatatgcaccaaatgtcaaaatatgcacaaatatgcacataaatcgcgaaatagtgacggatgagcagagcaaaaaggcaaagtttaggaagaaaaaatgtgcgaagttaaaagccattttataaatcataaatttttatgaatcgtaaaagtaaatatattttttcgattacgcgaaatgacaaaatcatatgctaataaagcatcgattgccaaacgatggcattggcattggcatcatgggaaggcatttccaagcaaagtgctttattgacggaagctattcatttttaaaaaacacatgtaaaatgatgaattaataatgaaatgttggtgattttatatcaaatggcattggaatgatgtcattgaatagcccaaattaaaaaatattattcacgcaatttatgcgtagaaatgaacaaagaaacgc

SEQ ID NO: 16431 - DNA, 1841 bp, Heterodera glycines
ttagaagaggtacaaaagtgattggaagaggtacaaaagtgattagaagaggtacaacagtgaaaaagggatacaaaagtgattagaagaggtacaactgtgattaaaagaggtacaacagtgatcagaagaggtacaaatttgatgaagaggtacaaaagtgataaaagaggtacaaaagtgattagaagaggtgcaacagagattgaagaggtacaactgtgatcagaagaggtacaactgtgattagaagaggtacaacagtgattagaagaggtacaaatttgataagaggtacaaaagtgataaaagaggtacaaaagtgattagaagaggtgcaacagtgatcagaagaggtacaactgtgattaaaagaggtacaacagagattagaagaggtacaaatttgataagaggtacaaaagtgataaaagaggtacaaaagtgattagaagaggtgcaacagtgatcagaagaggtacaactgtgattaaaagaggtacaactgtgattgaagaggtacaacatgagaatgtaataaacagatggcatataaaaaaaatacaaattatggacaataaaattaattaatttgaaacaaaaaatttattcatcaaaaataatttaatttaaatttaaaattatttattaatttttaataaaacaaaaaggttcaaattaattaaaaacggtgaaaataacttaaaatgcatagaaaaataatatacgccgtccggattcgaacttgcccccccccctcaaaatgatgccccagaatccccaatcacacagggattctgaggtcttaacgatgtcaaaagtaaaatctgatcacgtattcgtgatcagcgtcataaaatagccctaatgacatgttttttgaagatttttagtgaaaaaatttttcaactcaaaaatcctatgctcacccctttggtctggaatcccaaaatcacttttatttttataacatttttcaaaaaagtgataaaaatgtgaaataaaatttataaaatagagctaaaaattgcggatttttgtagcaatctacttttcctgaatatcttttctgaagcgagttataaatttttttctgaaaatccgaatttttccagaatttctggaataacttttttatttttgaagacagaaaattcaaataaataacataaaattctcctgatttttctctatttttagagcttaagttcacttaaattgaccaatccttcactgtgttatgaattttccaatattcgcccaaatttcagagggtcgaaaaattgccaaatatttttgaatttttaaaaaattctaaaattttctaaactgaaaatgaacatcagattcgtgctcagcaccttaaaaatacccagaaaaaaatttttcaccctatttttcaaccaaaaaaaaatttccgaaaatttctagggggcctagctcgaaaatttttgaaaatttccggccatataatacactattcgatagcattttaaaagctctacaattttgcactaaggcgttttttcgataaaaccaacccctaacgagttatggactcgggactcaaatgtcccgcttaggccaaaaaaattttctatttccgggaaaaaaccgaaatttttccgaaaaaaataccagtcgatagagctcgaaaaatggttgcttgaaagtggtctccgttttgccaggaaaattcgttaaaaaatcctaaaattcaaaaacccgaaaaccgttttttaggcctaactcgaaaatttttgaaaattttcgaaatttttaaatttggaaaaatcgaactcattagactctacaataagtctgctggccaccctgcgctc

SEQ ID NO: 16432 - DNA, 2255 bp, Heterodera glycines
  misc_feature (2133)..(2133): n is a, c, g, or t
  misc_feature (2139)..(2139): n is a, c, g, or t
  misc_feature (2162)..(2162): n is a, c, g, or t
gaaattgccaattatttcatttaggacaaggcaaagcgacaacgggagactcagcagatagaaccgggaaatcagaattgggaattcctcgccatgattcgcgactaccaatcccagctgatctaccggcctttgtcactggaggacgaagtaatggacaatcgtatttgcgtctgtgtgcgaaaacgaccgttaggtaaaagggaattggcgagcagagaagtggaagtgatcaccgtgccgaaccgagaccatgtcattgtgcatcaggtgggacaccataccaagatgtccatgtgtttttttaatatgtcacataaatttagcctcaagtgaaggtggacttgaccaagtatttggtcaaccacaaattccgctttgactacgtcttcaacgaagcggcgacaaatgaaatggtttacaggtctgtttagctcgacaaaataatcagattatcgaaatgggtgttttagattcagtgcccagccgcttgtccgaacaatttttcaacgaggattcgccacctgttttgcctatggccagaccggttctgggaagacgtacacaatgggagggatcatcgaaggacgacgccaggcaataaaaaaacatttatttggcaaacaattatcattaatttcaggattgctcaaacggaatttacgccatgacagcacatgatgtgtttgcgatgcttcattctcctgagtatgccaatcagaaactgaccctctcgtgcagtttttttgaaatttatggttctaaggtgaaaagggttaaaaacatatttgaaaaatacattttaaggtgtttgatctcttgaataaaaaatcggtacttcgcattttggaggacggaaagcatttggtacaggtggtcgggctgagggagacaaaagtgcacagtgttgacgaagttcgtcataatttctgattaataaatgtactatgaattgaattgtccgtttttaggttttgaaactgatcaagcttgggtcggaccagaggacggcaggtcaaacatcggcaaattccaattcatctcggtcacacgccgtcttccaaataattttaaggaaatggtaagtctattatttttagtggcgttttctttaacatttttttgcagggaaaaggagcgtgacaacctttacggaaagatctctctaatcgatttggctggcaatgaacgaggcgcggacaccatcagttcggaccgacagacgcggctggagggagcggagatcaacaagtcactgctggcgctgaaggagtgcattcgtgcgatgggccaggacgaagggcagcacattcccttccggggctcaaaactgacgctgatccttcgcgattcattcattggccaaaatgccaagacatgcatggtgagaagaaatgcacaaaagttgggcattggtctttcattcatatacattcttcaacagattgcgatggtcagtccgggcattagcagtgtggagaacagcatgaacacgttgcgctacgctgataggtaaccataaaggctgatacaaagtgtaagtttacgataagcacactaccggaacatttctgctaattgtgaccctaaattcgcgttttaagagtcaaagaactggacggtagggatgaccaacagccgatggaaaacgacgaccagcgccaatgattattgacagtttatcccaatcaaagatgaacgactttcttccgactttcccaaatcgctccaaaaattctcaaaaaagaactgtgcattctttcttcaaacgatccgaataatattcccaagcattccgtttgtctgtttatcttgacccaaatatttttcctatttcaatctttttcttctcccccattctcggctcattgtgattgatgacgatgctttgacccacaacaaattgaatcgtatttttttgtataggaagacagaattttttttataaattattcagtgcataattcattaaagtttttggatgttagacaacacccatttaaattgcagccctatgaacattaatcccttttgtttttcgtcattcctctctttctcttctgtctgattcgttctttcagatgtcttcttcggttcagcgttctcttcgtccgtacatcgcctcctctcatncattanattaccactctgaggacaacggnggtgcttctgctgtgaatgtttgcgcggaactctgcgcttttctctgtgctaatggattcgcacgcgcagccaaacggagaaaaaacgcgccg

SEQ ID NO: 16433 - DNA, 1340 bp, Heterodera glycines
agcttggacttcgctcgttgctgcgttttcacaacaaacgttacactgcgccaaagtcggaggagaaaacgcagcggagtctcctcgtggtgctgctggacgccgacttcgcgaagcccatagcactgcgtcatgtgttcgctttgcttgcactcgggtccttttactcaccctaccacattcttaagtggtaattactctaattgcagtcccaactcgccctccttcttccttctccccggtctctctacgtctctctccgtccctttgaatttgccacgcatttccaccgtttctttcacttccgacgggcctccagaattagtctgtctgacagcgaagatacgaaaactgttaaggccgattgaattgacgcgacgatcggacggcaccagattgatcaagacgtcgaacagtgcattcgaaacgcctaaattcgtcagaccggcgggaaaagcggcagcaaaacgaaaagcaagacgaaaataaatgaagaactatgaagctctttgaccatacatacagtatctcacaatcagtacatttgtttattttcaattaaataaaaagcgacttaaagttaaaattgcatagcaggtcgttttcgcgccgccgtttccgcgccaggttcgttttcgcgccgtcgttttcgcgccaggttcgttttcgcgcgggggtcgttttcgcgcccgcgcttttttagcactagaattgcgaatatactttaaaaaaatacttagaaaatttactaatagtctattaagtttaaaaatacctaaaaaaccaaataattttttactccgcgggtggatccgaacctgacctcaccccagccggcttcagaatctcagatacgcagggattctgaggtcatagcgatgtcctaatggaaatctgattagagattggttatcaacggcataaattttctaaaaaaaaacttttttttgaaaaattctgagtgaaaattatctactcaaaaacaacgtgcctccccccgtggtcgaaattcgaaaaatcgttttattttatttcgtacataggctaggcataagctttagacctaggcttaggcctagctaggcttgtttgggcctacataagattaggcatttagtaaaaaaaaacacgaatacacatatttattttacatatatgcaaccgcgcaaaaacgacccccgcgcgaaaacgacagcgcgaaaacgaacctggcgcgaaaacgtcagcgcgaaaacgacggcgcgaaaacgtcagcgcgaaaacgacggcgcgaaaacgtcaacgcgaaaacgacggcgcgaaaacgacggcgcgaaaacgtcaacgcgaaaacgacggcg

SEQ ID NO: 16434 - DNA, 2885 bp, Heterodera glycines
tttttacggggagtcccggggcgggagcggggagtaattcgaaaaatttaattaaaaactcaccaaaaatatttttaatgcacaaatttaaaggacatcaatttattaaattaaaaatatatagaaaaatttataaaggagaaatttgaaataaaaaaatcttatttttgagtcaaaaatcagaaaattttttcaaattgcttaaataaattattttttataattaattcgaacaaaacatttattaactttatatttttgactccctttattaattttaacaattttttgcggcttattttttgaaaaaactttttggtggtgaccagagtggaagagggaggccggcggtgccgataggcgccgcagggaaaaaaaaattgaatatttaaatacaatacattgtcagattatgtccaaaaatagccaatttttgaaaatttgaggcattttttaaagaaaattaaggattttaaggttccggcggtgccgataggcgccgccgggaaaaattttttttgaaattttggctatatatttaacagattttcaataaaaaatcattatttttaccaaaaaactcaattcttaccagtgcatttttactcccgtttttgggtaaaaatttccgggagcgggagcgggatcgtgagttcaaaattttccgggacgggagtcccgaacgggaatcccgtaaaaattccgctcccgttaaaaatcccgttcaccgaaaaaagcgggagtcgggagtgggactcccgtaaaatcccacgggagtcccgatcccgccggactctattgttaagctattaattcaatttttcgcgcacaatagctgatcacttttccaatcacccggtgcgctgggaattgtttcaagaaatggccgccgaagaaaatgtgataatttttggcattgaaacgtaaaatccccggtaatttaaggttattgttcacatttttcccgcctatactgcgatacgatggatgtctttgggaaggacattcaaacggattcgcgaaatgtggactgtacttgaaaagtacttccgatcactgagagaccgagattgtcccaaatttcttcgtcaaatttttgatgatgaattgacgccacgatcagaagaatggaaagtggttgtgtgtgttatgtgttttgccttcgatcagttcaatcaattgaatgttattagccaggtagtactaagtacttagaaaattactaggttaatttttataaattcagaaaccgacacttccgtttcccattttggccaaacaaattaaaacattaaaggcgaagctggaactttcattgaatgaggaattttatggggaagagaccagtgaacttttgaaacaattggaaaatgatggcgcgatttatcaaaaaaaacaaattaaaagccgcctttaaggtgttttttcattaaatatttgtttagctttgatttttcagcaattttacgaggacgcatatgcatatttgtgcaaatggtcacggcaattttctgagatggatgaagtgattggagattgggtcatttttgagtctgagccaacatctgaaaaagttcggaaggcgtataggcatttttgtggggcgtcaactgctgatgaaatgaatgatttgtttgctgagatcgctgagttgaaacagacactgaaggagctcgagggcgagcggttcaacaggaaaaacgtggatgaaaaatggccggctattttcaaaaatcctaattttgtcctgctcaaatcactagtctctgcaattctatcaattttcccttccaatgccttttgtgaatctgtcttttctgttctcaagaacatcaaaacggacgagaggaatagtattggcatacctttgttgaattctcttatttcaatcaaattcaattcaaaaatttcgtgcctaaatgttcacaattattttctttcattgccaaacttgctcaaacaggtgaaaagtggtgataaatatgttgtttaaatgtttttacgttgttatacattgaattattggctaaaaaaatatgccgggtttttgaaaatttttgccgggtttttcaactcgcgcgcccggtttttgggttttggcgatcgcacccctggcgcccaaacgagctggcgcccaaacgagcgcgcccaaacgtgagcgcccaaacgcagtggacccgcgacttttagtgaccgaaaatcccaaaataattaactaaaatagtgagtaaaaaggccaaaataatgacataattttcagccaaaaattgagaaaaaataatttttattcactgattgcagttacaaatgaggtaaatttcctttctaataatttcttggcaaatattgacattttaaatcaaaaattttcaccattaccaattcggagactgcaaagaaattcaaatgattcacaaagacaccgatagatcgcattgagccaaaataaaaaattaaatcaaataaaaaaatatggcgaaaagtaatataatttgagaatttgaaagataatgacctaaaatttttttcaaaaaatcacaaatggaatgtaatttgtacaagaaacattaattaggctccattatcgacaattcttaagtcctgctgatagtttccagcagttttatggataagctgatcatgaatagaacatttccagacaccacgctttataaatcaccccccccctcacctccttacatctgtccctttatttgttgcttttatatattttattaattcgcaagggcgggattttgagtgacctacctaaatctgcggtcgctgatcgaattccagtcaattcttagcccagaattcggataaaaacacagaaaatgacagttcgggcggcaaaaataattaggtatgtatgtatgtatgta

SEQ ID NO: 16435 - DNA, 3135 bp, Heterodera glycines
tatatgtacatgcaaacgttgacttcgcccggtgagtgccccccccccccccaatttgtcaatttgtccccccccccttcgccttcgcagtgttttacgtgtgccttttgtctttgatcgtcgtcggtgcgttgtgccatgccgtactcattcattgtattacgacggcaaacacgcgttagtgacaaattgccatggtttgcccgaatagccaattcaattttcaacttcagtaaacaccgccattgtccacaattttactgctgccattcaggtgctgtgccattgccaactcagctccctccttctctttttgccctttttcttctcccttcgcttttccttttcttcttccgtcgttcttttattttttgtctctcttttatcttttgtcactctttttctttttctcttttacccctcccactatttcgttatttccccttctcttttcaggtgctcgttgcctacgctctttccattgaggtggcggcgtttcttcttctccatttcaaattaaagtgttactgatttttgaaaaggttttctacgacactgagcccgactggaacaacattttcggcgtcattctcgcgatggccgccacggcattttattttatttctgaaagggaccgcgaattgaaaccgcaagggcattcggaagttcagggggccaaataccaccgaattttggcacaataggcaaagattggccgatggaaatgaatgaatgaataacttatgatcaatttattaacaattcaattaaattaaaaacaatgaaagtaaatccctgagaatgttctggtcaatggaaggaattgtgttgtaacgcgggaattgctttgttaaggcgaatcattggcgaggagaaaaagcattgaaagttaatcatggcgaagtgccggtcagaaaatgccgcagtcgtgccaaatacgagacgagatccttggggtgaagcagatattgggagccaattgaccattgatcattccattggcacaaccgatcactgcgatcagtcacaaaccttggaatggatcatctgattgaccaacgtttgcagcaaaaggtccgcttcctgcggagaaaagcaaataattgaaaatacttttcattcatttatccgacaatatcagccggtgttttgtccattgatcagactaatcaatcagtcctccccaattcagtcccatttcccaatcagtctccaattgttcctctccaatcagtccctcccctcccccctcactttgataatttccgcccttccaatcattgcattttccgctgccatttgttgctgctgctccctcctctgttgttcacctccgatttgcatttgttgtgcgatgtaagctgttgagccattcaaagtttgctgagtttgtggcggggaaaggcattgtccgccgttggcaccgtacggctggccaattgagctgatcaaatgcgcttgttggagaagaccgatcagaggagagacagtgggcggatggaagagagtagaagaggaagagggggacgagggagaagggggaggttgatgattggaagagaaaaagccgaccgaagacggaatcggcacggggggcggggcgggggcattctgaacggaaagcgactgaaaaagcgaacgcaaacgaacagacaattgaacggagagcggagagaagcgcagtggcggaagagccgagggccgaagcggcgacggaaggcggcggagaggcggcacgctttgcattgtgctcacgttggagcgattgggagatgagagcgaaaagagtttggtgatttgggcccccattttgcgggtgattaatgccattggcgttggtctgcgaattttgttgctgttcgagccgaagaagttccttttgaagcaatttcattgagacaccgaaggatcaatcaattgggagcagttcatttcccccgaaaaaataaacaaaaaactgaaagttttttagtcttctaataaattaaaaagtcggcgtttaaaaccccccccccttcgcgtattttcattctcccccattctgacattgtatgtgctttcttacaaatagtatctctctccctctctctttctttctctctctccctctctctttctttctctccctccctctttctttctttctctccctccctctctctttctttctctctctccctctctctttctttctctccctccctctctctttctttctctctctccctctctctttctttctctctctccctctctttctttctctctctccctctttctttctttctctccctccctctctctttctttctcttcctccctctctctttctttctctctctccctctctctttctttctctccctccctctctctttctttctctctctccctctctctttctttctctctctccctctctttctttctctccctccctctctctttctttctctccctccctctctctttctttctctccctccctctctctttctttctctccctccctctctctttctttctctccctccctctctctttctttctctccctccctctctctccctccttccaaattcccccattttttctcttccacctgaatgatcggcataatgtgccaatgctgctgttgcatttgccgttgatccatctgtctctgatcagctgtccgttgcttttgctgctgcagaaatagcaattccccggccaactttttggcatttccaatccctcccccaatttgagctccatctttgctgccgccggtaccatttgccatcaaagccgctttaagcgtagtcaaaagcagcgaatgattctgttgatttggcgtaaattggggaggatgggacgcagcagcgaacagcgaatgttttaaaggcacagaaagtgactgacaatgggaaaaaatgtaaagcgaccccccggggggggggtaattagtaagcaaaagttaccggtgggggattattgcctaaatcggcactgtccacgaacatcgccgaagaagctttccccgctgtcattgtttggcgttggcttttgcctccaatggtcgctcccgacaacggcgaccgcggcattgacctcattagcagtgccgcaactgccgctgtttcgccaccggac

SEQ ID NO: 16436 - DNA, 2471 bp, Heterodera glycines
aactaattttttaaagtatgcttttgagtgtggcgtgctcttatgctgttgtcgttcgtttttattacatatttattgtctttgctgttttgtgctgttccggttccatttcaattttttccattaaatttgtgtctgctgagcctccgattatccgtgcaaaaaaaaaaagagaaaattctttttgaaacacaattttgtatacatataatatttttaaatatattctataattaatttagtcttttaaaaactataattttctcatttttatcatattttttaatttttcggttatttttccataaaatttttaattcgttttaaccccctgaatttttgacaccattgattttttcccggaaatatttttgcttaattattttaatggatttactgaaattaaagatgcttttatttttcaagattggaacaatgaattccaagtacagaatccttaccatttaaggataaaaccctcctttttaaattaaaaaggcacaattagaatattttaattgaagtaaaaagtaaaattgataatttgactaaatcttttctaaacaaatttaaaattgattaatttaaattgtaatattaaatttttaattaaatttcattttttttcctttttgtaaaataattgtgaaaaaaaaagaaaatttcaaaatttttaccctttgcgctcactaatctcttttgacgatctttacacatttgacctttctcccgctgtccccagcaatttttgttcttattgttcacattttcttctgctaaaattgaaacgaatcgattttgttttcgtaattttttggtttttaaaatttttgtaaataaatacctaattaatgaattttatttattttaaaaaataataagataaaaacatttttaaaatttatttacttattatttttttactttcttttcatttttgtttatttttccaaattttccaaagcctctgaacaaacatttggaacttttttgttaagccaacccccaaaaaaccacagctgctaatctgttgaataaggaaggcaatggtgcagtttttgtggtttctgcggaaaacttttttttaatttaagaaccactttttctagggtagaaaaatacattgctcatgaactagcattgctttttgtctttaacaagatggttgaatagtctttttttaaattaaacacatttgagaatgtgttgaaaaattgaatacttgataaaaaaaactataaaaccaaaatgatatatatatatatatatatatatatatatataatatatatatatatatatgtataaaacccgagctaagattcactattagcgcatttttctaccctagaaaaagtgctgcttcttacagtaaattttattttttcgcaaaaaccaaaccacaaaactgcaccattgccgtgaattgtatatgttttttttcagataaaatttttgagcatttaaattcggtaacccctcacaaatgccaatttaatacgagaggcaacaaccaagcaacaatagaatattatgaatagttaaatttttatctggatttttaattaataaaattgtatatgaaaattgcttttttgatccctgccctaggataaatttcaaaacatttttttcaaatgaattaattgcccaatttttcggctataaaatttttctttttcttttttctttcctcctccaatcacttttgcttcttcttcttcttctttttctgctgatgcttatgtgcacacctcacctcattcacaaccaaacacataatcaaattatgcgcggcgtattattcgcaggaaaaatgcgcaacaaaaaaattattgggcgtggcggaggaggggagaaaagatgcgcgcaaatccgtcgatgaatgagaaactccattaatggggcctcaagtgggacggataaagcggattaaatagggccgggggataaagcggataaagcaaattaagaaaaaattaacacacaaaaccataaaaaatcaagggccaaaagggtgctagggagatgaagcatgcttaatgtatatttggcctttcagcactttttgggagctaaaacgggtagcggattttggggatagaggaaatttatagaaaatgcccaaataaaaatgggttaataattaatttttaaagtaattcctttgtctgggaaaaaatttttaaatttttctaaaaattttcattagaatttttaaattttatttttggctttttggaaataaaagctaaaaaataagcaattaaataacaaaaaagggaccttctttttgttatttttttcttatccaaattaaaattgctaaaattttgtaatttcgaaaaacaaatttttatatttttatttatttttttattttttactcaaaatggatgttccaatttccaaccccaaaagtgaacatcgattaaagcaaatcctcagcatttatccgttgtattaatccc

SEQ ID NO: 16437 - DNA, 1602 bp, Heterodera glycines
caaaaaccctccctcctgatacccaaaaatctaatgtccctcaaattttacctacttctattgacaaagaacaagcggttttccctcagcgggatctcttgcataaaagtaaatacaatctccgctctcgcccaaggtctaacagttttaaacaataacaaatgcacttttctccttacccattttcatactcacaattaatttttaacttctcacaccactttttttacaacatttttcccctttttgttttcattccttcacaccgccttgcacccaaaatttttatgattaattctcgtttccttcccttctccaacagaatgatccccttcctgtccaacatccccgaacacaaatacctctccaacttctaccccgcccccttcttctaccctccctcctcctgtcacttcctttcgtcagagcaatgttaccaatccacaaaagcaacattcttccaaagatacgacatagacaccgaaatcctgaaaaccacctccccagtcgtagcaaaacgactcggggctcgtgcccaaaatgaagctgaccccgcatcagtaaaagtgtggcacagcacgaagcagtcaaagatggaagagattctcttccacaagttcgaccagaaccccgccctggcagagtgcctcatttcaactggggagaaatttttggttgaagcgagtcacgctgaccgattctggggcgctggtgccaccattgacgacattcgtcaatggaactttactgggcgaaacaccatgggccaactgctaatggaacttcgtgaaaaattaaaaggttttaggattcctcattccccagtgtcccttctcaaataaacatcataagtctcacacctttattccccccccccatcttcctctttcccttccaaaattatcgacccctcctttgcactccaagttctccttaaatgctttgttttgcttgtgttactaacaatgctttaccatacttccacattgctgtgttgttttctaatctcgttttgtcctctcctcgaatatctcttcactgccacattaagtatgccgaaacgacaatcgaaacactggattccaaagacgaaatgccccagactccttccgacaacgcctcttgaagaatcgctccaagctctgacaactaatgctgattcgaccatcactccggcagcatcttctactgaacctgctgactcttttgatcctctctcacattctgttgtcccttcatctcctctatcctctatggagactctgttggcccttatctcggtctcttctccttctgaaaatcagaatttgtccaacaatagtccggctccttccccaccacgaactgaaaatcaacccatgtcttcttcctcggacccggatataatctttttggagaaatctcaccccccaaaatccaagaaatgctccccttgccaaagtcaaatttgaaaatgttaaatcccttaattgggatgaaagtatggaagctgccaacaccatatctgattctcccatccctagccccaaatataaatgttctcatgccccatttcccattgcccaatctcagcagtctcaggaaactggtgaccaaatcccc

SEQ ID NO: 16438 - DNA, 2588 bp, Heterodera glycines
  misc_feature (47)..(47): n is a, c, g, or t
gcatcaatccccaactttatggctgtcaatatccccttcatctcgtncaaggaattgccgttggggcataaaattttcaaaacatctcagggtaaaaacataattttcaccctggtgaccggagaaggacttattacccccaatttcattccgacaccccatctcaatcatcccctcataaaaggtgtgagacttaatatttatgtcaaacaaattgccctggggacccaaatttctgagttttacacctttccccaaaacttcccagcaaacaaccttccagcatcgtcaggtgacaacaacttcgccatttcgatggactccacatcaccgcccaggtacatctttcctttcaatccctccctcacaaaaaatgataatattaactcttttaaagccatttccgtagccttaaaagcgcaggcccactttttgtcctcctcccaccaaaccacctctgtttatacaaaattaaaattggtcccccataatccaaaaaatgaagagatctgctcatccgtcaatccctcaaacccttcctgttcctcttctaatgcctcccaagcgatacgaatccagaaagtatttccatattttttcacccactctctctcttcattatctgaattcataaagttcaacaatacctggaaacccgactccctcctgattggctccgtcaacaaaaagatttgtgctcaaggcaccgttaaaaacgttaaacttactgatcctcatatcttttctgttgaaatcacagttaatttatcagagacagaaggtcacagctttgatttggaggacctaatcctcttggagatccctatgtcccagactcaattgaaaaataggtctgccttcttttcctcctccattcccctcgctactgcttccaatgaaagccctcaaggacaaattctctcccaaatccttggtttctccactctcccaaaaattctcccctcctctgatctgtcattttcctcattctcccaaaaactctttccaagacccaatcagggacaacttgaaaccctggacctccttttcaacccctcccccagtgcaatcatcaccgaagccggaccaggcactggaaaatccaaaattatcattatgtccatccaaaaattcttagaattagggaaaaacatccttatcaccacccacagcaatgtagccctctgtcgtttagctagcgatattctcccaaatttagaccataattcaaaagcccttctcatcctctctgcctccgcaaaagaaaaatatttttccctttttgagccttttatgaaaaatcttttaataaaaactttagctgactttaatttgcaaaaattaacccgaaaagaagccaaaatcattaataaatataaaatgaatgctctaaaaaaaccacaaaaagcagatgaacgttcttctgcagaaatctttatcagagacgttgggactgaaattcccatcatctttatcaccctcagtatgttagaagatattccctctatgttaagtcttataaatatcatattcattgacgaggcaggtcaggcacctaccaatcagattcttcacattctctccctggccccaaatttagaaaaaatccttgctgctggtgatccaaaacagctacaatttcgctcctctgagcttcctgaggaattgctccaatacggatttaattcctttctttctcatttaatttccattcctaacattcccaacacaaaactcacaatttcctaccgaggacacccaattctcacccagtgtcttgctgattctctttatcatggagatattgttgccggagtaacggctgaacaacgctccatgattacctcttccaattttcccctacccaatcaaaatgcccctcttcttctcgttgatcttccaaatcctgattatagagaattaacctctttttcacgtttaaactctgcccaaacccacattgcccattcaactctttctcttctctctctcattttacctccatctgcctcaattacttgtctttgtctgtattcggcacaggcaaaagctatcaaaactcttccccccttaaaaaacgtcactattttgacggttgattccttccaagcccaagaatcagatgccattgtccttatcaccacccgatccctccccatcactcccgacgagatgagcagatccctatattttttaaaagaccccaacagagtttcggtcgctgtttcccgggccagacattttttttgtttaattggaaattttggtactctaaaagcatgtaaatcctggtctaactatttaaactcggcctcttctttctcccctataatcggtcagcattatatttttaataaaattgaccccctaattgccacttttagttcgcactttgccactaacgatcaatttctcacttttagaatgccaaaccgcgccatgccgactcgccctccctctcttttttcagttagttttaattcccccccacttaacccaaacccttcctcctcctcttcttctgccccccgtcccatcccctccctcttccaaaacatcatttccactcccccccaaaatttctcctc

SEQ ID NO: 16439 - DNA, 2883 bp, Heterodera glycines
  misc_feature (103)..(103): n is a, c, g, or t
gaaaatgtgaaaattaaatgaattgatgaaatttatattaatgtatttaaaataaaaaatatatttgaaatttgatttttttttaaatttgaattgaatatgntaaataaaaatatttaaaagttaattgattagtttagttatgtaaattaattaatggatgtgtaaaaaaatttaattaaaaaaaagctaaaaaatttttttataaaatttcaagaaaaaaattaaagaaaaatcagaaagaatttgattttacttgtttaagctccatttttttcgctgcttcattccagtgggataaataatcagctcgttgcagtccaaccatcagcggctgtcggatgccctccttttggatgactttggccaactcaatcagtttggcatggaacgggtcgccctatcaaattataaaaataaattatttaaattagctataaaaagatttaaagcgttttattagaccggtcagttatttttgacgaagattttgatgatcataccttgccattaatgcaaaggattggttaaattcaagaaaaatatttttcattttcccaaaagaattttttattttgtttaattttgctactaataaattttaaaaatatttataagctttctcatttatttttttttaccaagtttttggaaaatttgatttttgccaaaaaatgcaaatttaaggtttatttaatgaaaaaaatcagttttcatttgacgaaagtgatttttagttttatatttcaatgaaattgaaaatttctcatgctttttcgagtaaattaactcaaacattttttagaattctccaccaaacatactgaaaaaatttaaaaatttgatgagttttcttttctgtgcccgaaaattaaaattaatttaattttttttaatcagaaaattcatttcccaccttgatcacgtccttgtacgcctccatcaggaagtcgtggtcgcatgcgatgcggaagtacagttcgttcagcgactgttgcgcgtcagtcgcctgctcgtacaactcgcgggggaacggcgacggcaacagggcgattggaggcgccactgacacatcgttggagtgtttgtacttgtcatccccactgcgtccaacgaggcctgaaaattttaaaaaaatacgcttctttaattaaaattattagcaaaatgtcataaaattttaattttaaaatataaaaattggaagccaattaatattaaattgtgtgaaatatttggtatagtttaattgtagattcattaattattggaatttacatttaattgtccccttttatgaacttgctaatgttcaatttgatcaaattaaaccaaagaattatccgagttttttggaaaattaatataaaaaataatcaaatactcatttgccacggcttttttgatcattaattcttgtaaaattaaagtaattatcaaaatagtaaaaattgtagtaaaaggccaagaaagttataagtgccatagtgtagtagaattttgacaatttaggcatttttaactcgtaatgaaattgagcaatgtttgtctggccaaactgtgttggtcaaaattcattttggcacttaatgtggtgacagtaattccgtttaaatttcagtttttcagttaattgtatgtcagcatcgcacttaaccaattggcacaaaaattctattttttgccatacaattgggcattattggccaaaaaaaccaaattgtcaaactgccaaaaatcggtgccgctttaccaattgaatgcgcgtagtcaaccgcgtactcggccaacaatttcagctcggcatcattgcgcactgcggccaacgcgtagtcattggccttgagcgggagttgtgccatgttcgtcccctgtgcctgttgcagcaactttttttgctgaatgccattggcagcgccaaccgcggcatgaccattgttgattgaagccatttttgatgcacaaattgtaggaaatgagcagcaaattaatctgaaaattacgaattaaggaaaaaaatgacaaacaaattaatttaaacaacaatcatcctaactaatataagccactgacaaatgagcaacaatttgtcctaatttctaaaaatggcattatttcaaatagcaaaatttttattttatttttaattatttcttcatttttgatttaaaaacacgaaattagcaaattttgcatacccgccaaaatgcaattgttgtatttaatttaatgaatttaattagcttaattaatgaatgaaaaggtggagaagttaatatttttattttagcttaaaacattttcatttggaatttttgttttatttttcggatttttaatgccctataagatgtggcaatttggaaaacaaatttatttacaaacttcttgactgtttttgattacatatagcagtgaaaaaatgataaaatgggagggagactttttggtgtcggggagggaaatattcattaattagttgatttgtgagctaatgtttgctgtggacaaaaggatgagccaataaataccattcccgataaaactgataagaagcaacaatttgctcttaaattgtgctgatagcccccccggggtgtattttgtatggtgaaaaacattcattcatttatcgtcgaaaaaagaccatcatttttagcacaataaaaaaatttgtgggcggattacgataataaaacgtacagtacgccaacataattaattagcccattaaactgattacgaaggcggaaaatttgatctcattatcgtcattataatgagtccattttttggccagtggtctttcgtttttgtacaaaatcagctgatcaacaattttaactttttgagtggaatttagcaaaaggaaagtgtaatgaa

SEQ ID NO: 16440 - DNA, 2020 bp, Heterodera glycines
attcaccgcactcggtataaacggtcaaggagttttttttaaagtatgggaaaaaggcatcagtgtccctactcaagtttatttaccagacatgaatttaaaaccgccgggggcttgggaaataaaattaacgaggcattcacacatcattacaaaatcaaaaaacaacgtggaaagagagaagccaaggctgaagataccaaagattcaaaaattgatgtcgcaaagagggccgcagaacgcgccgggagagatgtagaaagacatctcaatcatatcaacaatgtctcgagttccatccaaaccaaactaagcacactaagagaagtaaatcctcaaattttagaagagcctgatataaaagtgtggtttgacaaaatggtagagaaggggaccgaaattcaaacataccgaaatgaacttaaatcttttcaagaagaagtagataaagccaaaaacacaacattagagcatgtggaaaagaatgacttgaaagaagcaaagaaatcagccgacgtcgcaaagggaatagccaaacaggcaaaaagcaaatattcatcaactctcgaggaatataatgataaatcggaaaagggttatatcggaatagtgaataggcttaatgaggctttgggtgagcatattaaacgtaaagatattgaaaatagacaagtatcggaagctgagaaaggaccacaaaaaagagagagactagccaatgaggatgttcaatttcaatatgacagcattgatcaaaaatttattgtctatctttctgctgctgtctcccacatagatttgtcaaaacacctcgcctatgtgcttggttttaagaacacaaggctatttcacgcggaagaggcgaattatatgccagatttgacgggaggcgtaaggcagctatacatttatgcaccaaatttaatagaaaacacaattatcgggaaccaaatggctccactcttaagaatagttaacgtcgtcaatgacccagggtcgattagtgaagttatatatagcaccgagtactttcatcgtctacagtcgaaacgaatttcagaaattacaattgaaattcacacaccgtttggcgaattcgttaaatttcactggggaagttgtattctcacattacattttaagaaaagtatattttaaaaaatgacacatgtgtttttcgatcccgagtcggtcgattggtcatcttttttcacttcacaacatgggaggggacagaagcaatactttgtcgggagcaagtatcaacggggattcggtttcctcggtaatgtggcacgtttcttgacccctattgcgaggaatattgcctcgagtgcaggacatgaggggctcgccgcggggcagagagttctgagtgacatcgctcagggccgtgatttaagggatgccgtcagggaacattcaagacaggggctgactaaccttaccgataagttacaacaatgtggtaaaggaaaaagggccctgatcactaataagaaccggaaacgtgtatatgatcagttaagtttcatctaaaggtataaatagaataaaatacacaaaaagttaaaaatgacaactctcaagaaaatcgacaagacgagtgaggacggtctcgaggggggcctttcgctgttcgacatccccccgacgaacgttgcaattaataaatccagtattagggaattactcccgctttcagcaataaatcaatctggaccatatatctttagacttttttcagataatcagttttgtgatctcaataaaacttttctttatttgtcaacttcaattgagagaaaagacaaaagtaattggattccgattactaaagatagtgaagctgaccaacacgtcggtgtcattcaaaattttgggcacagctttgtcaaaacattaaaggtgtcaatttcaggtgtcgaatcttatgattccggcatttactatgcgtttagggcatatatgatgaatgaattgggattttcagaagatgccaaaaagggtctctgtgaag

SEQ ID NO: 16441 - DNA, 1885 bp, Heterodera glycines
ataattcagaaaataaataattttaagacaaaaaaattattcagaaccatttttatactggtcttaatggaataaaattaaagactataaatgttcaaattaaatatttgtagtatatttatttaattatcattctaatgatgttcaaaaaaacaataatggttccgcagatttatcagaacgaaattttgttttccgaggcgagagaaaataatttggattggtggctaatataatatacaaaataattaaacactctaaaactgacataaaagaataaatttaaacctttataacgaataaattattagttaatgatatcaattgtaagcgaaaagaaatatattgttataaaaacgcaccggcgacgctggcgatgacacctgcgacgcatccgtgaaccagtcgcgccaaagttaagccggtgatgaaactggtgtatccggagacgatgttgtttgcggcgccgcccgtgcgaaacgattcattggcttctgaaaaattggattttgtcctgaaatcgtttgcgagaagctattttttgacactgttggttataagcattaaattgtgaaaatgtaaacgtggtaatataaatgtatttcatacagacaaattggtaaatcgcggtttatttttatataatttattaaaaaaacggtaaatgatatttatgaatgagtaaaggttaaaaacggtaaatgatttatatgaagtgaataaaggatcacccccgcttatcgaccatattgcaattatgtccagccattgattgcgcccctgccttatgcatgtggcctctcctcacgcggcggtttgccctggaagctggtcggcttgtatcgcggctcggggaatgcattcaaccgatgactttcatggcagcagttccaacaccgcaatttgcggacaatttcgggaaaaaattttaaaaaataataaaaaaaatttctgaaaatatggaatgaaagatttggaaaagttagtaagtttcttctatttttcagataaaaataaacaattttaaatttttagctattcttagtcgctaacaaaacgtcagtaactaatccataagcaaatttattttttaaaacgcccatttatttaaaatcatgtgaaaattaatttttgtcaacactgatggattgtccggaccccattttaatcacttaagagaccaacatcacattttgaccagtgaaattaattcttagaagttaaaaataaaatattgactttgtaatataaaaacaaaattttttttattagttttgaattgataatactgattaagaaagaaaaatattaggaaattgattttcactgtctaatttcaatataatataaaaatttaaaaaatgaaaaaaatataagataaaaactaataaatatttattataaaaataaaaaaataaaaatatcttgaatacaaaaatcaaatttatattgtgtttactaattttaaaaaatttcagcttgcaacaaaatataatgatacaaaattaatattaaataaaatatttattatttaaaataaataaacttagtgaaaattacataaaataaagtacacctatccaatttttaattacgtcgtttgaatgcgaaaaattttaattgcagaaacgaataagctatgtaaaaacatttattgcttcatcaaaattataaataaaaaataggtaatataaatttttattttaacaaatcttctgcagaaatagttattcggtgttgcatagcactgacttgaaatttcccgcttttgaagcgcttttccagttaaaaacgaatactttttaaaataaatccaatttctttagtccaagtaaatcgatgacttgaagacacagtaaatcaccaatcattttttcataatgaa

SEQ ID NO: 16442 - DNA, 995 bp, Heterodera glycines
catttaagaagtaaattaataatatgaatagaaattaaaagtaaaagattacaaaatgtttaattaagttttaatttttatttaatatcacctgtgattttaaaagaataaataatttctaaataaatgtcaaaaatatttattatttaaatttataatacgaaaaaaatatcttacaattaattattaattataataagcaccaaaaaactagctttgtggaacctttataaatcaaattttataattaataatcaagaatagaataattaatacataataattaggacttccaaaaatatggatataaaatcgcgaatatggccataaaatatggacataaaatgtcaaaaaaatggacataaatttttttgaaaatttctgatgttaattaaaattgcattatctttttcatgtttaaaaatacttacgcaacacaaataactaaatttaaacttttaattatttcttaaaaaaattaaagaaataaaaattatgattttgattttatggattataagaaaatatattaaaatatcttaaaaagtttaatagactcaatatgcatttaaaataacaattccgaacgcaacagagatccagaaatctgtgacttatgcaagaaatcttaattctaattgacgcagaatacaatattggaaagcttaatataacaaaaattgaaaaacagtaaagagaattcaccgaataaaatatttgattagagatttcagaaaaattcatcaattaaaaagtataccaaagtagattaagtgtcagctttggggcgacttttacgataaaataaaagcatccaatcaaattaagaattaaacaattacacaaaatttttaaaaaatgaacattggaacattagtaattaaatgggtataagcccaaaaaacatcatttcatcataaaaaatacatgtaacaatggccatatgtttgggggcgccggacttttcgaccagtggacttttcgacagaaatatt

SEQ ID NO: 16443 - DNA, 691 bp, Heterodera glycines
cgaaaagtccactgtcgaaaagtccgggagccatgtttggttggtatcaaaaaataattgttcaaatttcacattctttaatatgcaaaatggtattctttttaaatctgttcaaaaatcaatttaatttattttaaaaaataccaaatcaggtcaactgatatttttaataagctatttttgtcagcaaaaagcttttagattgtctaattaatgataaatttataagaacattgttatcgattcaaatttccgagtcacgaaaggcaagaaatattacttaaatgaattttataattatatttaacaatttttttgataaaacaacttcaattgaaaagataattacgaaaaatagaagtaaaataaaatgccaaaaacatttaaaatgtaataattgtataataaattattaaaaaaaacacgaaataatgaaatctaacattaaagttgtctcccaacaacacgctaatccagagggtgaatgcgtgaagaagaaattaagaaacaaatattaatcaagtaaaatgtttttaacaaataaaatttatcgacataacttattttatactatcgtgcttaatattttttcagctggccttaaaacttgactatttttaacataaaaattaaaagataaaaactaatatagggcaaataaaacaattaaataaaaagctgatagtaaaaa

SEQ ID NO: 16444 - DNA, 1183 bp, Heterodera glycines
ggttttgtgaatggctgcttgatgcggcttaaatttctcggactttaacccaagaataaagaaacggatcgagccagaaacttatttttgtcaaccattcgtcgcgcaacacttcgaacggtgggtagttaattaattcgtggtactaattagtaaaacgcgaatttacatcggaaaattttttaataacaggaaaaaaagtttttaattttattagtaaattttaaaaaaatattttttttttctttgacagttttgttggctatgaacacccggagacatttttcacccgagctgatcgggcccgtatggtccacgatttgttgatcagagcgcggtatgaccgtggtgaaagcatcaacaaattgcgatttggcatcgacaaactgctcaggaacaggacttacacagctgcattcccacttcatgatgtgaaatttggattttcttatacaatttttagtattaaaaattatattttaaattttaaattaattcatataatttttgtttacaaataattttttctgtttgttaccatttaacggttttaatttttttataaaatccatatgaatattttaattgataatatagaaattcttatttaattttggatttttaagaatgagttgagaattttcaaaaaaatttttagaacggaaatgttaaaatcaaaacacattctaggaatgggatttcttaaatgaacatatttgtttaaaacggaataattaaaatatttaaatcatatttttaatttactccaattatcattaaaatatgattaaaatttttaaaccaattaaacttttaatgcaacataattaaggaattgaataaaaaagcgaaatgcgtcgattttgaacggtgcaatgatcgacaattgttgtatgagtcatgggtgaaaatgaaaaatgttttcaaatatcagccgcttgatttgatccgtacatattttggcaccaaaattggcttctattttgcctggttgggctattacacgcgatgcctgtggccagtgtcagtgcttggcattttgtttgtgctttacggactgttcacaataccaagcgatacacccaggcaagtgcttgcttgagggtcttaggttgtattacagaaaattagagtactatcgagactgaaaattttgccgtaccgagacttggatccgggattt

SEQ ID NO: 16445 - DNA, 1301 bp, Heterodera glycines
cgataattatcgtccaattacttctagtgactatgattgcgcctcagatgtttgcctcccattaattttgcttttaagaaaattttaaataatcacgacggtaaaaaacgcattctaaaaaatatcaattaaaaatattgtgccattataacagtttagaaatggaacaaagaatgataaactgacaaagggattgtgaatgttgtggcgaaaattaggtcccaaatgtcatggcgtaattgttggggcgcctaagttttaaattaggggcgcaattttttttttttttgtggcgcaattgtcagggcctattatcgggctcaaagtcggggggttctaagttttgggcgcaaatattagggcgtaattgtcggcgctcaaatgtaatacttttggcaagcggttagcgataggtcctaatttagcttggcgcccagttagcagcgcccacctgtcccagccaatatttagcagaaatatttgtaaaaattaaataatttttaaatcgtttcagtggtcaacaattctttttgctgccatcatgtccatttggataacactgtttctcgaagggtggaagcgttaccatgccgagctggcatacaagtggaatgtgctgggttttgaaccggaagaagtgcgtgaaatagtgccaaatttttcaaataattaacaaaaaacaatttggccactaattaggaaatgatgcgtcccgaattccaattccgtcgcaaaaggatgagcaaattgaacccggtcacaaagcaggaggtgaaaacaaaataaattcaataaaaatctatgaaaatttgcatcatatgcaggcccatacccaaaaaaatatcaggagcgaaaatttagtccaacgatgtcgattagtgatcatcgagaatttccagtctcgggcatcattagtgccgacagatgtcgtctggaaaaaattttcaatttttgaggagggattcatagaatttataaaataaaacttgtacaactattttctaacccattctcctgcttctgaaattttttgagtctatggtcccaactgttttgacgtatattttttattacaaatatttttaataactcaaatttatttttaaataattcaaaaatttaaactctaaaaattttactgtattttcaggagccgtacattcctttcatggagaaagcatgccgtctctgtggctcggctgtcactgtgttgtttttcatctttttagtcattgctttactgttcggcatcattgtgtaccgagtgattgtgcttcgagttttttatgccagcacatttt

SEQ ID NO: 16446 - DNA, 1051 bp, Heterodera glycines
gacccttgaatcgaaatgacctagcaccattgcttttaatttcatttccattccagggtcacttccggcactgctgcaatgattaatctgattttcattctcatcatgaattttgtaatgttattgttttttttaatatttaattatgtcatttaaatgatttatttaaataatttttgactccttattttttttgtttacagttttacagtaaattggcactcaaattaacggaatgggaatgtccgaggactcaaagcgaatttgataataggtaaaaacgatactaaaatattatattattattacaattaatgttggtaggctccaacttttagactaggttgtttttaagctttctcaaaaacaaaaagtcgaaaattccaacatttaaaaattctaaatttattgcttaaatgccatttcatgattaagccactcaaatttattaattaaatgccaaattaatatttcccttaactttcagttacacatttaaagtgtttctgttccaatttgtcaacttttactcgagtttgttctacatcgctttcataaagggcaaatttacgagtccgtctcatgtgaatcgtgggatcaacgccgatcgaactgagctcagatttgggtatataagaaaattattgcttaacattattatacagatttttatgtttagaaaatcagttttttgaagttttctggcgccataatttttatgaatcttaacaaaaattttttgatagagaacacttagggctattgaataatatctcgacaatgttggatttggttggcaaaaaaaaagttatagccaaaacaacgcgctggggcccaatcctagactagattgtttaacatgtgaagtttttaaaaattaatttggtataaaaaagctatggtcaaaaaggtgtgaaaattgtgtaaattccattttttcatatataattttggtaataaatttttcatatcgcaaacgaaatttttctgaaattatacagactgctaataggacttttaatcactgtggaattatgcaatttttattaaa

SEQ ID NO: 16447 - DNA, 1311 bp, Heterodera glycines
aatgtacaaatctcgttgaacaaatggccaaaatacggtgaaaacggcggagaaatgcgatgacattttgatcgatgtaactgaaaagcagaaaattagacgaaaaattccaatttaatcaaatttttacatgatatgaatgcgtctgaatccgatgactttgttgggcaacggattttgcgggattggcaatggatttccatcggaattgacaatttgcatttgcttagtgccattctctccaatttcgtggcaaatttgcattttgcccaatttccatttgcgtgttttgaagtgttcgttgacgatgcagtcaaagcgacggctaatcagtgcaatttcgaggccgagttgagaaggcgcaagaaaatcgaacaccaaaagcccacaatcgctgcagataaagctgaaaaatgaagaaattttcaaaattttctgtttaattttttacatttcgttatctgaagacatttgcagcatcaaaatgaccgaaaaatatagggagaatggaagaatgatcggtatgagaaggaggagaagaaaataggcatttttatactaaaatattagcgtagcgctccgacccttcgagggtgggaaaagtcagtcggctatacataaagagaaaggtggtgattcatgcttcaaatgtattccccaaaccgtgggattactggtgtttggtatgaaagaatcaacaataagcatttgtgatgagaggaaataagcatctaaatccgtttccaattgtatgagatcgatcatttctcaaatataattaaatcaggacaaatctgataaatcaggatcgatggaagccctgcttaaattctcagtggcttatttaggtaaattatccaggctattattatttgtattaagatttattttctgggtttgaccgttctaaaaggttaggaatccacgttttgtgcatttttccgcattttgaatcagttcaaaaataaattctattggcctaaacttttcaattgatattaaaagtatgggaacgggtcgttttggcgccgccgttttggcgccagccttagtttttttattataactttttttcttgttgaccaaatctaacaattttggtatcattcgaaagcccttcacaagctctattagccttacaaaaaacaaacaaaaattttagcttctaaaaaagttattaggaaaaaacctcaaaattttcgacttttttgcaatttcatgttataacttttttggtaattgtctaatcgcgaagcaatagcttagaaatatcttctaaacatgttaagctttcgaataataccaagatta

SEQ ID NO: 16448 - DNA, 2173 bp, Heterodera glycines
ttttcccttaaacgccgggttcatttgcgggcaaataacatcacacaattattgtcgtaagtgtgattacgacaaatgatgttaattaaactaaaaaatctttatttatgttatgaaaaaaagacaaaaatgatcaaatattttttatttgtccttttgatcgctataaaatataaattttaagcaggaaaaaccgtagaccgatgtggtgatattttgattggtgtaaagggaaaaaaaattcattctgaaaatgctgtgatggcacccccacaaagtgtccaagccacgaaatgtccaaaagagtaaaaacccacgaaatgtccaaaatttttcaaaatttataaaaacaaaatgagtctaatttaggatttttagggttttcggggtcgctgaatacgaatatatcctttatattaccccttgcctaaccttaggcccatctgaataataaaaaactcaaattcgagacttggacatttcgtgggctggacattttgtgggtcagcggctgtgatatttcgtcaaaatgtcgcctaaaaaagtgagcattatgccataacatttataaaatgcaaatacagatttcttttgtaacaaaattaagccaaatcagtaaattttttgtcatcaaaataaatgaataggtaaattttgaagatgaattttgagaaattttttcttttttatgcatcaatttttgggtcgattcttaggtgtgtatttctcgtttttattgccatttttgttaaaaaattcatcaaaatagggtaccgtattttctctaattatcaccccgggggcattatttttcaatctcctcagaaaggggaggataattagagacgggggcattaatggagacggggcgataattagagaaaatatggtaaatatttttttcaaaattttctggctctaaaaataaaaatctagaaaataggcactaataactcgaaaagtagcctaacaacatactattccccaaacgaaaaacaaaacaattgaataaattacccttacatttacgatttaccaaaattctgcgaaactgaaaatgttaaaattaaactatttgccgatgatcttaaggcctatcatgttctttcaatatttccttttctccactccaaaattttattaacaaatttaatcgatactgtaaattaaacggccttaaaatcgcttcaaataaatgtttaactttacatttaggacacaaaaaccaaaaaataaattattttattgatgactttccaattcctaaaaatcccggaaacgaaccagtcagagaccttggcatttattttactaatgatttgaaatgggcacaacaaattgaaattatctcgaaaaagcattacgatctgcttttgctatattaaagtcaatcaaaactggtgatagtttctaagggttttctgggtcgctgaacactaatctgacactcaccattttgtccatttttccgcatttttaaccgggccaaaaacaattttataggcttaaacttttcaattgttattaaaagtatattgtattcaaacgaaagaaacacaaatcaaatgagagcatcagaccaacgaccatttctcaaatataattatttttcgttgctttcatccgcttcttcattctcttcttccgttggtggcgataatggcctaaaattaaatattttttttcgacaaaatcaaaaattgctgttgctgcgctgcgctcacccaatggatttattgatgtcagcccacaaaaaaattgtgactttgttcaaattggcatcccaattttcccattgaaccgccgtcgccttttcactaattgggcatcgcttcaacagcaatctttcagtgaattcacagccatcttcatcagcagcaccgtaacgtggcattttctcaaatgtcagcttttccttggttcggtcgttcaccaattcaaatggctcaattgatgtattccacactgtaaatttaattttgtagctgaccgaagcggtggcacggagaaatgccttaacaaaaaggaagcgaaaatcaaagactatcaatcaattagtcggtcatttaacgaaaatatggcagcaaccatcagggccacctctttcaattgttgaccctccgactaaaaattttgaaaaatttatcaaaaaaattgaatggtaccagcggta

SEQ ID NO: 16449 - DNA, 2292 bp, Heterodera glycines
ccgaattggcaatttgctgctgcggcggcggctgagcggacatcgcattggcaacaacgccggcggcggtgccgaagtccaacggcattgccgagtggtgatggtggttgtgctgcagctggtcggccagcagcatcgcctggtgcaacgcggacactccgccggcaccgccgcgctgggctccaccggaaacggcggccgcggaaagccaagcggcggcagcgagtgcctaagaagcattgtcaaagtttacactttagtaattttcaataattataccgggttttgtgcaaattgcccagcaaatgggtggtccatcaaagatttggccggaggggacgacccattggcgggggcggcggagaaaagcatcgcggggatggcaccggcggtgacgggggactaaaaggataactgttatgccaaagcaatgcatttcaatttgcacttgtctagctattaattgttcggcattgtttcacctcattgctttcctcggacaccgccgtcggactgagcggcgccgcgtccgaagtgccgccaccggcgctcgtcgcctccgccggcgttgaactcgtggacaaactttgccgcttttgcggcgcgtccttcgccaccgttgtcccgttgttcggtccgcctttcagcatgtttttgtattccgtaattcgaaccttaattaacggtaattatttaatttctgtaattaatttcttttgaatttttgtccgtttcgtttttgccaattctatgcccacctttttcccatcaacaatgcatgtccgtttcggtcgcggtctaaatgaattttgtttttgttttttaattgatatttatttggctaatatttattcgctattcttccaaattttaaaatgcttctctcccacctgtatctgtagtccggatgttgctccatgtgctgcttggacagtcgcgactgttcttcataatacggttgcttttcgcaattactcatcgccttaaaaattattaaataaaaataattaattccatttttttgatcaccttccaacgtgagccgagtatcttggaaatgttgctgttgtgcatgtccggacattccttcaagattttccgccgttcatcccgagcccaaaccttcaaaatgttttttttgcattatttaaaatgcattcatttctaaatgcccaccataaaagcgttcatcggtcgctttatgtgattcggcgacttcgcccccgccctttgctgctgattccctccgtttgactgaatcgtaaattatttaattacctattatttcttttatctgttttttttaccttttttccattatttgcatttttcgcctcggatttgtcgccatttgacttttccgagtttgccgaattattatggaaattattcggcgaatttttgcccgaagaagaacaggaattttgtgtgtctaaaattacccaatttatgaagtaaaaaaataaaataaaaagtgcctgaatttgttggatgaatcaaatgttgctgattttgtgttcggttgttggacaaatcgaaatggctaaacaaaaaaaataaatttttaaaataaaataaattgaatttttttttattttaattaattgaattcttttatttaagtgatgtttccccaattggtcaattcgcttaccttccttcaccgttttccactttgaatctgctcaaattgagcggtgaatctgcggatgattgcatcaaattttgcggagtctgtcgatgatttctttctgttcctgttaaataaaataattttaaaatatatttttaattgttaatttttatgtatttatttgcctccgttttgtgtcgccggacttgtcgacgattggcgccgttttcgcccctttggcgttgtcggcgtcctttgatgattgtgaatttgatgttgctgatgttggagttgtgccgattcagccgacaaatggggcgaagcatctgttgaacagttcaaatgcatcggatggaattggcgcggaaatgggcctaaatttgtacaattttaaattattttttaaactattttttcttggaattggcattgtgccttactttgtgatgcgtttgcgctaaaaaattgctggacgggcggaaattctgccgccgcctggtgaatcattgcggcagcggtcgcttgcggctgcggaaagccaagcatgaccgcggtggcagccatttgacgcgcgagtgccgcctgctgctgattcgacgggtgcgcacccgcggcacagagggcggccaacaaatcaaaagacggagaggcatctgtta

SEQ ID NO: 16450 - DNA, 2955 bp, Heterodera glycines
cactttcgtcaaattcgagtccccgcaccaatacgttgtccttaaagcaaaaaaacaaaagttgaatggcaggaaacaaaaaaggcacgaaaagcgacttgcgaatggggtggcttttcgccctttccctcctcctccgcgtcgtcgttcccctcaatgacctcctccaatatgtttcgggcccttaaaacagacagtcatttgccttacaattagcgcgggtttaaatgccttcggacgggcgctttgatccgttccgccgtccgatgcgccaacaaacgactgctcagcgcggaaaagtctttgtaccgtttgattgtcctccatttgtagcgaccgtgctcaagttcgatggtgtatctaatcgaagggtgattttggccgtttttcgacggaattttagcacatgaatgggttcagaatgtggtaactcgacgaaacatcgcgctccacatgcacaattgttgcctccacttgcaatcccggcacccaatagccgcccttttgccgttcgtaaatggtcgagtacggaatgtacccgcgacgacgcctcggcgtggatttgttggccaattcatcgccaccggcgctgtaatcgaatgaggcgtcgtccaccgcgactgaggaaggcgcttccatcgcccaacttaatctgctgaaatggaaagtgaacgaattaataaacgcattttgattggccattcgcaacaaaagtaattaatcaaaatgacactttttaatcgaaatggaagggacaagaagagtttgtttaaacgtgtgaagagggggaaagagatttaactgttttttactacactcataaaatttgactgtgaaaatgaaaagaaatggaaaagggaaggacccctcaccctcccaatgtgtacatatgatcggtgcatgggatgattcacccaaaacaacacctccgatgatttcaatagcaaaagaaaatcaaaaccgctaatcgcaagcatacaattagtaaaaacagaaagtatcaaaacttaaaaaagcatttaggtactatttccaattctgtatttggcaaaattccttgtatgttattatgatttattcatcgtcttttgtatattacagtagtatcaatgatgcaatagaaaggcaatatttggcatgggtatctgtgctgggcgataattaataatattttgaacacagtaataggcgatgcaatgtacaataaacaatcaagtgggagtaaatgcacatgaaggcggaagagatcattttaaatactaaaaagatgtcccgttgatcttgaacagggtggccgggtcaggcaatttgctcttgaactgttcgacgcagtgactgagggaaatctaaaaaagaaattttgcaatattatatatttttgagttgttttctattaaaatcttaatcctctctaaattttcacctctttgatgttgagtttggcagaggcgccgattttgcggtgtccaaagtgcaattgggcagacttagggtccactccgcagtttgctggcaactccacgcccttcacgtaaatcagtggctcaatgccgcgctttacagccggccatacatcgtccttgatcatatctgcaattgcataccaatcaagatttcattattatagtaattgtttcgccattagcctcaccctgcagcagttcctccaccaccggcttcatctgtttcggaaatgctgtcttgtttttcatgtcaattttgcgctccttcaggttcagctgcgtgtggaaaataccgtcccgcacttgtgggatcagttgcacggccagagaaagtgtcagatcgatggccgttttcttctgtccgctctctccaattgttggattctcaacttcggcagcaattcggttgtgtctagaaatcagccaaaagacaaatttaacgtagtagaaaacgatgcgttgtacattttgatcaggatggagtcgtcttcgatggtcatactgggaagtccgtcagccgacacgttgaaaataaaaatgcactggggacagaggttggcaaaactgtaaacaaaattaattttttcgagcagaacacaggcttggagaaaaattagctatttatgccaaatactcacaagtcccgcgtttcctccggcaatctcgagctgttcagtgggatcttctaaaataatattggatgtaagtggaagcatctgacaataaaaccactcacctcttcgataattttgaagtcccatctaaactggtgcagcaattggttgagcactgtctcgttgattgacagcatcagtcgttcggacacaacgccaccatcagtaccgacactgtcaacggaaagcacaacaatacattatttactcacaatggcagaactaacccattcgggagttctggcagttcagtcgccggaggtgtcgaccattcgttagtcacaggccaactgccaatagcaccaagttgggtgatgccatcattgtcttcgtcgtcgacattgtttgcttcagttgatgaaagcattgccggctgatggcgcaaggaattatcaccggaccattcaatttgaacctaaagcaaaagggaatcgccacttccaaattggcagttcaaagaggaaccgaagggattaaatctatttttaaaaattcaaccatttagtagaaaatgaaaaacaaaccgtcacagcaagttggtctctgtctgcaatgactgattcaagtcgtgagcgaagtcgaatggatggcgagcgcaaatagggcacaaattcttgcggaattagctgtgcaaatggaaaatcgctaaaagcaaaataaaataagttgacatgaaaatttaaaaaaataataattacaataggaatttctccgcgaggttcagaacagtgccgtacagcatagaacacacacactcgcgcaccatcgacgcggacattgtgccacgcactgcgccccaatgcccatgttgacctgca

SEQ ID NO: 16451 - DNA, 1693 bp, Heterodera glycines
ttaaacccagaaaaatgcaacaacaaaaaaaatcccccaatttttttgtctaagattttatgcctcacctacctcctccctcgctcccatttttcccatgccaaaaacacccttgccataaaagccaccactgctggtatatttatatccttcgaaatccaaattagattctttttctacaaaaaatgtgtgccccaagccgaaattaatatttttccatggattgcccaagccaaaaaaaaaaccttcgaaaatctttggattttatttcaattttttattcaactaaaatggaacaaaaaatttaaattatttacagcagcaaagctcattaaccgtccaattcattcacatttttcttctctatacgctatttttgaatttgtttgtgccaacatcgtggcaattctttacccctttaacaaatgcaaaaaaaaaaaaaataaatggtgaatttaaaaagcgaaaaataaaaaattccaaaattttatgggtttataaagcgacaaataaaaattccaacatttcgagtaatttctttcattttatagcggtaattttgcacaaaaaaacatttatacaaaatattaaattttttctaccaaacatatttttaaaaaccaagctaccttttgaggggcctcttcttgaaattcaaaaaacgattattatagttttttgatgcagaatatttctggaaacaaaaaaaaattaacaaatttctaacgaaaataaaaatgctgaaacactttttaccatttgcctacagtattccccgtgccaaaccacaacagtaccgtagtgacggcatttggcgcccaaattatcaacaaatcaaatcaaagcgcaatccacaaaaacatttaattgcgcaattaacattttttccaagaaaattgggcattttttttgcctttatttatttattttccgacaacacaaagagcaattattattattattattatttatgtgttcgcctcctcattctttgatgggctcaacatcatcacacaacaaaaaacaaataaataataattcatttcgccaccgaaattatttcttattacaacgaattccctgccgatgatcagtgctttgcttgctttgcccattactgtagcatttgatcacacattttgggccaggcccatccattattcaattatgatcaattgcccacaagctaattatcgcatcatcattcattaattgctgctgatgtgcgacagatttgtttaaaaagtgctcgtgccgtgccggtccgtggcattcatttcttttatcatcgatgaatcaacaaattttcttccggcagaattttaaatatttcgcttattagtcatccaaaaaaattatttgccacccaaacaaaaaattcgacgaaaatttttcgcttaatatacctaataaaattgaagccagtccatttaactcacggaatccgaaaatttgcttatttttattccattccaaacggcacaaaaaaaaaatgattttgccatactgtgtcgtgccaaaatgtacgataccgtaccatcaaaccaaattattgctgctcttggctcacttattgtattttattttgatttcgccgctggcggcgggcgccgactttcgcctccaatggcaccaaatgaattcacggcttgttcagatgcgcgcccggcccccgtgccgtgccgtaccgcgc

SEQ ID NO: 16452 - DNA, 1583 bp, Heterodera glycines
aaacttcgggcttcacaaatgactgcctttcaagcaatttttcacgatggactgttgctgctggggacagaaaaagagggaggaaatgaatgatgctctgatcagatcagtgatcaattaattgatcgcattatttgtaaattgctcaacattttcaatgatttattttcatttttcttcaattttaattttcctaatgatcaaataataaatgttacaagttacttatgtaataattcaatttaatttactcattctttagaaatcatttttaaaacttttaaaatgctatgtcattttgatcaatgacagcctacagtgagaaagaagccccagtttttttcgatttccaaattcggacaatgaattataaaggggggaccaccagcgtggtaataaaacagtcccattggacgctgctgggtacacgaatcttcgagaaataacaaaaaacaaaatctcgacaaattttcaaagtcctttgaggaggcgcgtgctgccgccctcctcgcaacggatgagtgtgcccatatcacttttttgtttgtagtcaaattctgatttaaaaaaaatggtaaaatttgtgggttataatttatttatttaaaaaaaaataaatgaaaattgtcaggcagaattgtgaagaatcaatcccctggcatttgcattgcttcacccaatgcttttgctcttttgatctcccccgcgggggagatgcgccgctcccggaggtaagtgcaataccgggccgacgcgcggtcgagagggggcaagccccctactgcgacctttttccaaaaattggttaatctctttgaccccggtaggggtcgttacggagattaagccgtaaagaacagatttaagtttatttagcaaatgcttgaaatgacaataaaattgtgaaaatacaaggaaatgtaaatggtgtgatcgggggtcacaaacattaaatgatgggacaaaatgatcaggaagtgaatcaaaagtgcttcgggtggtccctccgcacacatccatcaatccatcagattaggccggattatcctgggatcattcgggctgggtcgggcaatgtcaatcgctctggtgccctggtcaattcggtgcctcgccgcggactccttcgacatcatcatctcggaactgtgcaacaccggtcaaatgttcgacataaatgtcacgactccaacgaatggcatcggagaccattagccggcgcattaattggcgataatgctggccaattttcattttattgaggacaaattcgttgtgcgggtcccaaccgccgagtggtccgacaatgaacgcttcgagaagaacatcaaagccaatcgcgcggtaatgttcggcaaggtcttcgtatttctgccgtttcccctgccggcacctttcaaacgcttggtagcggttttcgaatggcattgccacgtcaatgatcagcgccgttttgttttgttcgtcaacggccaggagatcaggccgaacggctgcacccaacccgggcactgtttggttgactctaaccacggttgttggtggtggcctgaaagcctttacaaggcggtcaaggatggcat

SEQ ID NO: 16453 - DNA, 2568 bp, Heterodera glycines
  misc_feature (9)..(9): n is a, c, g, or t
gcaccgccnggccccccaaaaaacctattttttcttaaaaaattagccaaaaatctctaaaatttggtaattctttagacaaaatctgtgtaatttatgccaaaaggaattgaattgaggcgatacattgactaaaggaatgtggagccatcacatcattcataaaaaattaattttttgtaaaattttttggagttaattcaaatcaaacctccgcccccgcccccgcgggggcggaattatcgtgcccccgtccccgcgactctgacccccgccatcccccgcccccgtgaaaagccacccccgcccacggggtccgaaccctacaaaaaaccatcaaacgaaaagtttagatagaaaattgttcgtaacttcgcctaaaatgaatcaaattttaaattgatatcattcgatggccctaagtgttttctattatcctgcaaaatttcaaaaaacttttgctatcgaataatatcaaaatttaaaaatttggttgactttgagcaaatatataaaaaaatttattttgacatttttttgagtaacgtcatagcaccaaaaaaagtggcgaaaaattaacgtgtaaatgctgagggcgcaaaaatggagggtgtaaatgttgacttacccattttaagtggtaaaaaataacctttccacttttggcattttttttttgatttagattaatcatttttgagaaattaattttatttaaaaaggttttcaataatttaattccaatttatttcattattattttttattaattaaataaaattgtgttattattccttgtttttacgggttcaattctctgctgataactcactgttagccgacatcaccaacgcttggtgtattaattggcacaaaaaagcggggtgattcatagtcaaaaattgacatcatcagagttcggcacagatattgacgggaaaaagcttaaacggaaatgccaatgcttaaacggactctctcaaattatatttcgacaatttattggaaaatttaataaggtgaatatattttttaaaattaacactcaaagaaatttaaaatatgcttttattttcccaatgttaattgacaaataatttaatattattccgttccttttttccatcatttgtttctttccatccattccctttttcgtccttctttaatccgatcagaacccgttgaccaatgctggtggaaaatgaaattcaaatatttttaatttcttttgattaattttatttttcattttcgacaatacggacagagatttaagatagtcatgtcccttttcaaatgtattttttgccgaaaaagcattggaaaagctgaattaaccaattctgtacatttgtcttttgacaattaagcaccgccttatacggaactatgcatagtaaaagatgttgacaacgtctcatttttatgaatactgtcaccattaacgcttttcttttaaattgctccaaatttatttttgtttcaccggaaagaatggcagcaattaacacggcaaaaacgatgcagccgatgccaaacgacgtgtgcaagccgatcactccgcttctccagtcagggcgcctaatttagcgatatcgatgatttgaatttcaaaaaacgcattttcaaccaaagataaatattatagaaaatcatcagcctttttcctgtgtttggcctgagaaaatccagaaaaacccagaccttggcacaagcccaaggtcgccccctattcttttgaccaaggccgtagcaagacccttggcttcggggggggggggggcagaagtcaaaaacacgatttttagggatgttttttttttcgtttttttgaaaattcgtgaattcattaatttttctacaaaatttcaaatgaaccgcaaagtcggttctaaatggggaaaatatttttttaaatgaaaattttgaaaatatgccttaaaattgttgagaaaatagtgatcgatcaacaacaaaaaaacagccgatcaatgggatttacgcgcaattgatcagacaacttgagcggaatgagcatattttgtgctatgttggaaatttaaaaaataaatatcttcttttttaatgggttttattatttattgacctaaatttttccaaataattgtatccgaaggttttaaatgatacctaatacccattcagccatttctagcgatcggaatttgagtcaaatgaccgtaaaataagttaaaagcgttctttacaaatagcattttatttgacttctttgcacttttatgacgtttttacctttttaagcaaaaatatttaatgtctattaaaaataaaaattttcagagtcccaatttggtttgtaagaataggtgaaagacaaatcaattaataataactttacctcaataatgaatttcttaaaagggccagccaaccatcgacagtatcaacagcgggggtggcacggaattccgattacggcatttttggggtcagaattccgatttttggctgttgttttagagtaaataaattttctaagttgtagaacaaaatttcaaattgaaaattttatatacacaaatc

SEQ ID NO: 16454 - DNA, 863 bp, Heterodera glycines
  misc_feature (5)..(6): n is a, c, g, or t
  misc_feature (835)..(835): n is a, c, g, or t
aattnntggacaatttgcgtcgccacactttgccaacaattctcaccgatctcaaccaattgaattcaatcaacacctgccattgttaccatgacctggtggctgatgatgggccaaatgcaagtggtggccaagcattggccaaatggttgcgcatcccatgaaaagatgggcatccgaagcgattgcgttgccgtgctcataaattaggaaccattgcatgggtcaacaaattcagagaggtcgttccaatttttttacggcattaatcacttcagtgactctcattttaagagagaccaaccaactgggtttcgttgatttcttacaattatacaacaacaacaaaaaattcgcggttcacaaaaaatggtggcctaaaacctcaaaaactgacttttttggcttttcggcaccgagtgccataacttttttatttttgaatgattccttttttgacatataaattcaatttattcactcgtcgattggaaaaaagttttttgttaacacaacaaaaatttattccaacaaacaaaaaggtcttcctttccatcagcaggtcacagagctgaattaggagcatcattaattagcattaatttttttttgtatttttttggcacttacccgcaaaacattcggccaatcggcctccaactcctcctcggccgttctcatggcccatcgctctaaccgccggacctcccgccggacgaacgccctcttctcctcctccccttcaatctcggcccatcttgtggacgttacggccagcttaaattatttatttgaatttttttgtatttgagctaaaattaaacggcaataatgngttttactggtcccaaacattttttttt

SEQ ID NO: 16455 - DNA, 1127 bp, Heterodera glycines
tttttaaaacattattaaaattggaccttcttttgcatcgcacaataagtaaaatcccaaatatttcttctcatcaatgcctttcgtaatttctgcttcaattttccattcgaatccatttatctccacggcatcactgaatctgcttctcccgacagactctcccgcaaattccgacactttttcaatttccaacgcaagtgtcctccttcggttgcttttggctttgttccaatcagaaattcgtccatggcttgggaaatccagcgagtacagcccgggcactccacgaagatacagaaacggatgggaattgaactgataaacgccgagcaattctttttctgttaacacatctgatggaaatctaaaaaaaaaaaattcaaaattgttaaaattccgtgactatgcccgtaggcatcgatggatttgtgaaaggtttataccgatgcatttggcaaaatcctcctcttggatatttggaaaacgaattttgaacaatgccgaaccaagcatttcgcgtcgtttttcatcgtaacattcgatgcccttttggcggcatttttcatcggcccaatgaattgcctaaatttaaaaaaaaactaacttaaaatacaaatgaaaaatttatcgaatttacagcgttccaaatttcaaattcatcggtgagcaacaaacggtcatggtcgagaagtacacataatatttcctgatcaatttgcaaaaagatctgatttgaacaattgggccacattttgacaaatgaaacgcaaagatttgcggggaaaatccttaaaaaatgcataaaattaccgaaaattaaacaaaaatggataatgaaaaaataattaaaaataaattcatccttctcacctccaatttgaaaaggagagcttgggcataagccaagaaaactttgcgcaatttggagattggaatttgcaaagaccggtcaacaggccagggatgttatactttttggctaattaaataatttaattgttttttttttgtcaattaaattaatttcaccggcgaaaaccactgccattgcattgaatccgttcaattaactcaaatcttccgtgtaaatgaagctcagcatcactttgaacgctgctgcttca

SEQ ID NO: 16456 - DNA, 707 bp, Heterodera glycines
  misc_feature (38)..(38): n is a, c, g, or t
  misc_feature (65)..(65): n is a, c, g, or t
  misc_feature (120)..(120): n is a, c, g, or t
tcaaattaataatgcaatactgagggctataaattaanttagtgcaattaactgaggctatcgtnaacatcgggtcataagggtgcaaactcaaattgctcaaaaacggtcggaatcatntagttcggctcaaaacgaggaaagaatgtaagttaggggtgcatttgccacttttcgtttaaaaaaatcgggtactgaaatattcactttcaaaaggtgcatgtattagtaaattctaaaaaaaaaatttcgatgaaaaatcttttctatgagtttcctttccgacattttttggagcctcggaatgtcatccctggtgtggagtctgttttcgtgcttatttttgggccgttttaaatcgattccgatcgttttagagcaattttgtgtttggccctatgaccgatacttgccaatttgggctaattgtagaattaaatcaaaatggcattttttaccattctccgctttttctttcttggcgtcagaattgaacattgcctcaaaaacatcggaagcgttcttcaaaatgagttgatgtgctggcaagatctttaaaaaattgggaaattaattgaaatttaaaattgaaatttaaaatcaaacttgcatcttttgcgtctccgtcccccaccaaaaagtgcacatccgaatgctcacccgtgctcaataaatgtttcatccgttccatcgaatttcacaacgat

SEQ ID NO: 16457 - DNA, 2655 bp, Heterodera glycines
ttttgcattttgctaagaacttcattttaacaaaagctattaaattgaatctctcgactcgaacgcactctcgagcatcgctaattgtctcaattaattggcgtcatttgctagttttacccacttcatattgttgtgtttcggtcagcgtatggtggtcaacatgtggcgctttgttctgttcatcagtagtatcggaaccgagccaaaaagtgctagaggtgcagcacagtgcaaacagaatggcggccaagcagttcagacgccaaaacatagcgctgattaattataaaatttaaatttttttaatttaacttaaaaattcttaaatgcgccaagtggaagaaaatgaaaaaataaaattacattttcggcaaaaataaaacaatttcaattttttgtatttgctcaaaagcgtaagttttctaatttaataataaaataactgaaataaaaaaataatttcttgttataattttttttaactttgcaaaaaaaaattaaatattacagctaatatagaagatttctcgttagatcatgaatgatttggtgaatgataatttagtcactgtaaacatttcatgaaaaaatttttccttaaaaatttcaaaaatttgtatcaattaaaaaactaaagcttcaaacacaaatttattaaattcaaatatttgctaaattttttattttaaataaaaatgtatttttgtttttctattcccatgcaaatctaagaaactcggctgaacgatcattgacgtaatacaattaacaaataaaggagaaaaataagcatttcccaagaaaaaattcaatttatttattaatatcattcgaaagctttgaatggaaataaaaaataaaaaagacgacccaaaattgaaactattaaaaactaatttggttacaactttattatcgatttaatttttttaattatgtagaccaacaaaaacacttagagctaccaatgacatttaaatttttgttaccagtgatagtaaaatttgtattttcaatatgaaattttattttttcaagaaaaattggactctgggatttttgaaaaccagcaaagcagaaaatacatccaaaatccgtgattacggaccggaaaagttatccagagccactccgatttagaacactaatgacaaaatcaatttaaattattttgccaccactgtgctgggttgggcaggtagcagagtacccctattattgtgctaatccttcctttgttggtcgagactgagagtcgaaaccaacaatttccgtagaaggaattatgctgagaaagagtgggcacaaggtcgtctcgagtggatgtgagaacaaatccatccgatcaaaacaggtcagccatcaacattaatcggtgtcattcgtccgtcaattatttaaatcaaatctatcatgtgagagctgcgcatatctccttatccaagcaatacctgttcaaaaatcttagtcccaattgattgatcacagggttttttttttaaatctgatcatgaattcatttggaaaagaatgcgaggttagggagtttcggtaagacgagcccttttacccattgttaattttcttttttggtaaataaatttaaaattggttaaattaaaatcaaattggatactcaccaattcatgttgtagaggtagaattttgcggatttttagctaattttaaaaataggaagccaaaagattggatcggagaaatgcgcaacacccaaaacgggacgggacgacttttgctcaatgtttgcataacataaatccacttaaagagcaattataggacgagaattgggcacattttcttggttaaatgtaccagatttggaaaaaaattatttgtagtagacaaatttactcaaaagcaaccgaatctttcaaatcattcgttggctttaagtgttatttattagcatgtataattttaaaaatggataagtttcaaataaaataagttgtaaccacaaaggctcacaaaatagctgttctttatcgaacagaattaagaatggaaaatttatttgcttattagaaaaaaactcccacggtaatttgatgaaaaacgaccaattagcaaaaaataatgttcgatttaaaaaataaataaatattatcaaaaaaatgtaatttatttatatatattaatttttcaatgactgtcaatttatgaaatatatttattgaagaaaatttcatttatcccgaggaataatggtcggaggctctaatgaatgaatagccttagggaatgaatggccatcatatttatttatttgtaaaaatgggtagtgaaaagaaaaaatgtgtcggctgttgtggtgacaccactgccgccatttgtccgtcccccgaggggccatcgatcgacgagcgccgtctccggcgccaatgctcctccgcctcctcaagttttgctgtgtgtgctttgctgaccttcacataattcagtcccaatcaattggtgctgaaatggcgtcgcggcgaaggaaaagcgacggtggagaattttcaagaaaactttttttggctaattatatcaataataaatagggatagtgttatatgttcctaaatattccaaatatgcaatacgcactaaaattgctagaatatacattaaaaacccaaaaaaatg

SEQ ID NO: 16458 - DNA, 1060 bp, Heterodera glycines
attcaaaatgccaccaatgcgatgcccattgcgcttcccctttcggcatcgtccgggtacgcctgggccaacatccctaaaagggaaaggagcacacatacataaatgaaatggttacagcaatttaaataaatgaccgtacccattcctgaagtgctggtacaggcggaaccgacgccttgcaaagaacgggcgagccaaagagtgaagaaggaagtgccaaaggcgaacagcagcgtggacagaaacatgattacgaagcctgaacatggaaaaaactataaaaggccagaaaaaagagagagagaaaagagagaaagggagagagagagaaaggaggaagaaagagagagagggacagggagagggagagggaaaagagagaaaaaaaggtatcgaaagaggaggagagggagccaaaagagaggcaaaatagagcgaaaagagaagcgatttgccatttgtccgctcaccggcaaacattggcaaagtgtagccgattctggcaaaatttaatcagaattacttatcaagaagtgaatgtaaatgtgtatatgtactgacttgttggtaagtggtccaatgctgaaaagggaatgaaaagtgttcctccgtttggcatataatttgacaatttagccaatcacccgcccttttttggccaccaattccccccccccccctccgtccctcttacagagggttggccaacagttggaccaatgcctttgagccgaacataaggccaacgtgcacattctcttccgttagtgcttgatgcctttccaattgtttctgtacacgaaacgctgccatcgctttttgttggcgatctgtcattggcaaagaaatttgattttttaaaaatgaattaagtgcctgctgccaatgctttgctgctaacattcggccgtttcgacgcctttggccgacccatgggtaagtgcaattcgtccaagggactctgaggagggcaagtcagcatacagatcaccataaaaatagcgaaccccgatgctgaactcatccggcaacgcctcgtactcgtcgtccgtgtcgt

SEQ ID NO: 16459 - DNA, 1826 bp, Heterodera glycines
atgtccagctcgctgtaccggttgttcagcaacatatccgttgagtttgggtgctgaatgcgcagcaaatattcgggaatgatcggcacctaaacgaatcggaaagagtgagcaaatgatggggacggatggcctttgcttttgcactttaccactgtggtcaacaacatgttgtccaggaaaagcgcaacgtacacaatgcatagcaacacacgacgattggaacggtacttttgcacgaaggcatccaaccaagcagccattttgaaggggaggggtcgaaagggtaattaagagtaattaagggtaattggggaatgccttaatgtacaaaattctcaatcaggtgtccactcaattctttgcctgttttctgcccattcccaaaatggcattttattttacagcgaaaggaaaaagcgccaaaaaccgacgaatggaaagggaccgatgctggccgaagatttagaacttccgacgtattttgctgcacgaataattcctttaggttgtcaaattctgtgcccgacaaatgctgaactgtgccgcccccggggcgggggaaagaatgcgccgccggaggaatgccgccgcgttccttcccccccaatttttgtttctgcctaagggttttgtgtgccggcggagtccgtccgagaaaatcctacaaaggcgacgagtgcatgagaataatgcgaaagaggcgtgtaaatgatgggaatgggcgcagaatggggcaaattaccactcgtttggagaggttgcggccgggggatggaatattaaatctgacgggggaggggaaatggggagggcaaaaagggagtgggaagggccatggcacaaattggcccggacgccgagccgtatccaatttcagcagcaccgctttttgagagtgttggcatagaaatgcccgattcggacggcacaaatcagaaacaaaaacaaaaacatttgaagtattgctgaagaattgctggattctgataaaatctgtggcgccgttttcagcttttctacttcaattgcttaaccaatttcatgccaattttgactccgattttatctgttaaatgccaaaattgacacttttaatttttgccatttctcaaaagcttttcggagtcactcgcatgctattctgccagaagcacggagctcaatgaatgaatttttgagtccaaccatttttgcgtgggaaatttttttggttggagaaaatggcgtggcggagggggaaagggggggaggggaggagtgatggcacaagtgccaatgccatgccaatactaatgccaaggtacgctccaaccgcacctttgctcatgccaaattcctcccccaaagatttcccctccgtcccgacttttttaaattcgttgacaaaattaacgcatggatggacaaggagcgcaagaagaacagaagaaggaaaatgagaagaagcgaactgatgaagaagtgatgagaaggcatttaaagaaaaatgaaaatgaaaatgaaaatgccaaaaaaggagagaaattaaatgaaagagggaaaagcggtgaatgaaagggcaaagagcggagatgaatcatcaaaaagagagaagaattcaattaattttatatacggatgaaaaacaattggcaaatgtttctctttttgataaatttgccattttcatgagaaattctgtaacaattaccaaattttacattttcacacaaaatacccatttattttgcccatttctgagcttccgacggaacgccgccgccgtcccaaaattcttccaatttcaatttcattgtcggcatttctctttcaattttctgaca

SEQ ID NO: 16460 - DNA, 2800 bp, Heterodera glycines
ggatgccggatttgtttttcataaaactgattttgacccaaaaaacttttttttgggggccaataattcctgaaatttatattttttaattgggcccatcttcaatttacaatccgctgaataaccgttggtacttattgttcatctgtccctgtgctttttttcgtgcttttttcccgggactgatcgaccggaacaagcaagggtaaattgatcggggggatgtgggaaacaaaattgattacattatgttgaaaatgaaagaacgtgattcaaaatagtgctgcactgaaaactagcgggaaaatccctgtttttgttagattctgtttctgtaattttctcaaaaatgcagaaactgaactatttcggcaaaaattttgcacgggtcctgtttctgtcctgaaactcatcgcttatatgaatgcatttttggaaacaaaaaaaaactgatggcttttcctatattgctttgtatgagattataagctgaaattagcctgacaaaccaatttccagaatttccggcgtgttttggaagtgcgcgcggattggcgagcgtctctctttgtgggtttctgccggctgtttttgcatggcaatttatctgctcttctgaacccaaatggaaaagggtgcaaacattttttaaatgtcttttgtgtttggattttgaaatacttttctaggacttgattttggtgctcgtagtggacgattggacccggtcgaatggaaaatttgtcggcaaattcccccgcgttttcttccggaaaagaacgatgtttatattacaaagtaaggaagtttttcatttagggtcaaatatagagagttttacacctttaataaaagcaaaaaaatgaattcccattttccataaggaagacaaaagtggccgctcagttctttcgctgcaaaaaattattggacacgaaatttgatgaggtacgaatccatgcgcttggccatgccatcggtcgtgcgctgagtttggcactttcgctgcgcgacgccatggccggctcagtcaaattggacgttcaaaccagcactgtacaggtgagccaaatgacaaatttaccactaataaaagttttataggaatggagtagtaaaaaataaaaataacagccatcaaataaaagggcctaattattttttcaattttttgttttccttcgttcaggtctctgatgaagttcagtctctgtctgattgtgatttggccgatgttcgccttcgtatggtttcttccgtccatattttgctttctcgcgtttgactgtttccaatttccccgtttattccattggtcattgtgtgtgtgtatttgtttctcatttgttccaataaattgttggtttttgaaatgtatttcatggagagttaattttgccattattttcctcaatttaaattcatattccaattttgaccctttgtagtttattaaagtaatgttctcgcggcgaaatcttttgctttggcctggtcaacggtgagaggttttctcgagacatttctcttcttgtacttttaaattcatttagtctgctccaccttaatcggccttgttcttcatctgtgattaaaggtataaaaaagggacacataccgaactaagagggcaaatttccatgtcccaccacccgataatcactgaacaggaacctgactcattccgcacccaattccgaacctcgagctaaatttcaaattccttttgtttttgcttaatttttcggtcccaatattgctgtgattggttcgggcccgtctgggttgtatgtgtgtgctcgactgcttcagcggttgccacgttgcagaatcgatgtgtttgacaaggcacaggcgccctacggactgattttctacggggtaattcggctttttcgagaaatccataatatacttccgttaattatcaggtggcccccgaccattttgacatgaagaaaagcatgaacaactttgagcgaatgttcaacgacaaccgggatcggattgagctgttctgcaacgtggacatcggtcgtgatttttcttatggagtgagtgagaatgtgaataaagtttgaccaattcttacgttaaatgtttataataattggttttgtatcattacaaccataaaataaataactccctcccacaaaattatcgctgcattttaataaagtttgtcttaatcataaaatgagatttacaggaactttgtgacagttacgaagctgttgtgctggcgtatggggccaaccgcgcgcgtcgaatgtccattccgaatgaaaatgccgccaattgtttgtcggggagcgcttttgtctcgtggtgggaaataaaaaaaggaacatcaaaacattccacttgtgggcaatcagttcaaaactggatgactttcttataaatctctaaaatacttttttcaggatcttttaccccattttatgtgattttgagacaaaaatgttttcaggtacaacggcgcgctgttgagcagctccgagccgctgttggacactgaagatgcggtaaaagacaacctctaattgaatttgtaattaaaatagtttttattttgtcatttttcttaaaaatcccaaggtgattattggcaatggcaacgtggccatcgactgcgctcgcattttgctctccgacccggacgtgcgcttggccggcaccgacatcacagagaaggcgcttcgtgcactgcgacagtcgcgcgttcgacgcgtgcgcgtgttgggccgacgcgggccacaaaacgtttgtactgaaccaggcccgggttaagggt

SEQ ID NO: 16461 - DNA, 3900 bp, Heterodera glycines
atttatatggtgttttataaaaattattattttgcagcttctaccaagcaaccgaaaaatgatgatgctaattatgctgtagaaagtcaaaaacaaaaagttcgagcatcatcatcaatagaaatttcagattcatcttcttctggtgtccagaactctgatgaaaagcggtacttaaaacaatacttattcctaaattttgtgactaaacgtctcaaaataattaatcaaatagtgaagaaaaaggtacgacggcattcgtgactactggacatttcgcctactggaaattttgcctactaaagcaaaatcacgctttttctgtaataaaaaattttattttctaaatgctgctttttctctgattccgattttggattagttggtgagatattcaatggtcgaaattcttaccagtgcttatgttcaatcctgatcctgtcggggttgaaaagtcgcgatcgggatttgatttttttaaaaccaggaccgggattgggttctgaaagccgggattacgggaccaattacagtcgggaccttgatcgcgtgcaaccctaatttaaatccgctttttgtttaatattcaactttacctgtcctactttactaatttacaatcaacttgctttcagattcaatgtggcaacattaaattgcgggttttttcttttataaaattatcaatacaataaattttgaatggcaggcttttacctcttccttggccaatcggaaggaacgacatacaattccgtttgttaaaattgatcaatgagctcaaacattcacggcatgacgtcattgccttgcaagaggtcggttggggcagttctgtaaggaagaagctggctgggcggttaaagcgcggaaagcgggggttgataacatccgtaaaagaaagtgcggatgtgcctcggtagctcaatggtagagctgcccacggaaagggtgcacgaatgggttcgattccaacccgaggcctaacatttttcccattcttattgttcctttaaaatgttttttcttaggtatggagtgaaagaatgttccttcaagttgctcacgaaattaacgaaattttctcccattcgcactatttccacagtggctttacgggtagtggcacttgcgtgcttagcaggttagcagtgaatcagggcttggcgtaactggattttcaaatacggaaatccgtaattacgcccagctctgcaatgactggattcttcagcacttggtttttcatttgatttaaggcatcctatagtgtccactttgctccacaaatactccctcaatggctttcctcatcacgtccaccggtaaaatatttccgaataaaattctcaaccaattatcttatattcttaagcggtgattggttcggtggtaaaattgttggaatggttgagatcatggtggagcagtaccgagttgcattttatacgacacatcttcacgccgaatataacccagagaacggtttgtgtaatattcaaaatgaagcggctgtggtacaaatttcactccgtcttctattgaactatgattttttgatgtcacaattcatccgtcatacctcgcgggggtttgtttgtactgtttatttttaaattgtttttttatactctctaattagacatcttgcttttaggtgctgatttctagttgcggtaggcgacttcatggccagaggctcgattatgtaatgtacaggagtggaaaaagtgagttttgtgaggcaatcgtaaagaatgcgacacctatttcttctttgtttagtattttgtaagagagatggcgcacggaagatgcgtcagtggaaattttaataacttccaatagcaagatgatttaattagattaaatttaagctaaatgatgatttattatagagcaaataaattgaaataataattaaattcaaatatttcaattcattgatacttctgccacttcggctcaccacggacgtttagattaatttgatttgtttattttgccttttctagcggaacttaatctcgttgagtgtgtcaattgcttcaacaaaattcccgggtctgaattgaatttttctgatcacattggcgtttctgccactttttcgtttgtcaaaggtattaaactctgactgacaatgaatctttttttcaaactttagaaaaagtttcagaaaccctttctgagcgaatgcggcaaattgtgccggagaaggaagttttgactaaatcgctcaaaataatagaggagggcgaagttcgcgtgctgggggaccgtcggctttttcttagcctctgtgtggctctaattgctttaactgtcgctacagctaacatccatttgaaagtgccatacttttaccctgccgtttgtatctttcaaaaaaggacgaaattgaaagtttttctttgtttatgtcgcattgttacggtttatgctccctttgttcataggcttctgccttttgtacggtttcattggtgcgtttttttaattttttgcttctatacttgggaaaaccatcgattattattttgtaaatttaggtttgacaattgaaatgaaagcactgaaagaaacgaaaaattctatcaagaagcttttgcgttccttgtgaatttttatagacttataaatttttaaaggtctcattcggtgctaggtcgtaatataaaaactgtcaacatgggcgtttcgtaacattgcttacagatttttcgagaaaaatccgtcataatttttcttaaacaacaccaaaataaataatcttggtattatactatagctcttgctcttggattgctctattatcatcaaaatcccagaaaatttaattaagtttacagagctctgattaaaaatgtttaaaaaaaatagacctaactttctgacaacttaatgaaatattctgaactgtttcatgctaatagagcactctaaaaggttgatatcgactatttaattacgttgtgtttaagaaacttatgacggattaatatgcgcataaaatatgcactaaaaatccaccaaatatgccttaaaaacccgaaaaatgtacaaatatgcactaaaatatgccttaaaaactagaaaaatgacttcgaatcatcaaaaaaaatgccaaaaattatgtaaaaaattcaaaattgactttgaaaaaaccaaaacaatgactacggatcgtttttagacaatttcgaatttttttttaaatgaacaaatttttttcaaaactttcacaaaaagttcaattttctatcattgatacttttgtaatttcgtttcaccacaataaatttgcaataaatttataaattttttgtaaaatataaatagttttataaatgtattaatgatcctcaataaaatttttacccgtttgattttttaatatttaaaagagaaaatttattaaaaatcctcaattagtgacaattttaatgctataccaaatcaacaaaaaacagagggggaaaaacacgcttttccaaaaattcaaaatttttaaaacaaggtcgctgtggaaaatttagaatccaataaattaagaatttacatgcatgtatttattaataagcattttttatacctgagtttttattcatctttaattaaataataaattttcttaacacattaatttaaatgcaaaattatgaaaaaaaacatttttaaggaattattaaaaatgaatcgcttaatcatcgttgatcaatcctccggcttctaagtcgcgcacattccgttattaggctataaaaaagaaatgaaaatattatcgcaaaattttggtgtatttgaaagtttttccaagatcatcaaatttttaaaatccaaaccttataattcttttatatatatttgtttttttttgttttaaatttttattttttt

SEQ ID NO: 16462 - DNA, 1781 bp, Heterodera glycines
cggttcattaaattgctcggaagtgtcggcgtagccctttgcacttggcatcgtaataaagtggccaagcatttgttcaatcttggccagacgtctgtcaatgctgctgcttgacaaatttgagccttctaaagaggacaattggcaaagcaattaccgtaaaattggtcaattaaaacggtatgataatgtaagaattaagccaacttttttatactatatccccttcacatggccgtggaaaaaatggcaattaattttatggcgccaattttgtggcatttgtaccaaattttgtaaaaaaaaaaaattgctgaaatttaatatagcaaaatctgtacctgtacttgtatatatgaaaaatgccaggcatgttagacaagtacaggactaacacccgatcttttgaaattttacccgtttttcttaggggtgattcctcctcattcagacgtgtgtcagccgacgtggatgccatgccaacattccccgctgggccagtgccaatgtcagaaacattgccatgttcggcattggcacggttccgtggtgtatgtacagtttcttcttcttcggcagttgatgactgttgcttcttctttttcttgattttattaagcgaaattgaggaagcacaaccaccggccaatgtttgatgaacataaagcagcacaaaaaggaggaggaaaagggcggagagaaaattgcgctgcatttttacctaatttaagcaaatttatttaagaaagtgccaaaaagtttgtgggaaaaatgccaaaaaattaaatatgttgaagaattaatgaaattttaaattattaatttcaattcaattagttaaaatctaattcaattttatgtgtcatatttaatattaaaaataattttaagctaatctaattataattgtaaaacatttaattatgatttttttataaaaataatataatattaatttattttaattgtaaaaaataactgagaaaatattttttttgcttgtaatatgtgcattgaatggtttttgccacgttaaattagtgacaatgccaatttatttattaagaaagtcaatgttttcaaataaaaatttcagttaaattattttttttagtattttgccaaggttcggaagttaaaaatgaagacataaattatttaattgatttaattaatttgttttattttgagttttgacgaaaaaattttacatcaaaatgaaaaaaaatttggattgaatgctaaattgttaaattttcggcaaacttttgaaaatttttgggaaaattgttgggaacaaattgaatttataagatcgttagaaaaacttatataattttttattataaatgtgaaacatgacaatggccaagtaagagaataaactttcatagaaaaatatgaaagcattgaaaataatcactgagttgtgccattgttttatgccattttccgtcccctccgtccgccactgatcgctttgttcaccgccccattggccactcggccaccgattgtgctgatcactccgtccaacagggaagtgccaatgccggacaacactgctgtgccaccaccaccgccaccattgctgtttgctgctgttgttggctgtgattcttttttagtgtcagtcgcttcatccccatcggcttgcgcgtcatgacggccatagtcgttgttgtttttcgtgccatcatcgccggtttctttgttcccagtttggcccgcgctgctgcctccattttggtcctctccgtttccgaattgactactttggc

SEQ ID NO: 16463 - DNA, 1254 bp, Heterodera glycines
  misc_feature (96)..(96): n is a, c, g, or t
ttaattactgtgcagaaaaacatgccaaaacagcagtaatcataatgaaacgatgaataaatgaaggaggcagcattattattatttgcttaattnaaaatatgaattaaaaaatataataattttaaatatagaagatatttaaatgattattaattaacattactcaactgaaataaataaattaaataaaataaaataaattgaattgaattaaataataaaacaaagaatgttaaaaaatgaaatttcaaataaaattattcgtttatataaccgaatttgagcgttaatattttaaatttttcaatcgacgaacaaacgaagaaaaagagtttacaaattagtaagtaattggaaattggccaaactaatcaaccaaattaagaaggggaatacctaagacaataaaagaaagtaaataatttaacagttaacggaactaattgacgtaattaaaacacggctttggcggctgccaaataaattttaagcgaacaaataccaatttatgacataacatattttaatattagaaggcgctatgaatgaaaatgataaaattagttgttatttcttaaaaatttcttactattttttttgtttgttttttactttacatcaaatataaagcagaattcgatgactaattaacacttaaatatttagcgcaaatttgttaaaatagtaaaaaaaaattttgcataaaaggtaactcgcccggtgggactcgaacctatggcccttccgaaatgctttaaccgtctgctgagctacaggaatacacaacacaaacaaagtaaggtccccagcaggaatgaaaatcatccgcttctaagatcaaattcatttatcagactcatacaaataaaaataataattaaacgaaatggaaaatatttaaatgcgtaatttgttaataatcatcattaattaatcgttcatttgatgctcttctattcgctccatttgcgcaggtccaactgggccaatctggcacatggcactgtgccgatcgctgatggaagcagaagcgcgtcgaacggcactttgctgatctgatcgccgttgtcacaaagcagacgggccaaactgtgagccgggagataattattggattaatcagggctcgcagatctgaggctttagcctcattttgtggttttttgataggtcaatgaggctaaattttcaaaatgaggctttgaggctttttgtggttttttgagaaaaaccgcaaaataaagaattttt

SEQ ID NO: 16464 - DNA, 2310 bp, Heterodera glycines
atgattataagattttttttttgcaaaaaacgataattctttgtaatttatagaaaaattggagcaattgagtcgcaatgacagccgtggtcccgatttttctccgagattagcgcattagccgacccaaaatggaaaattaaaacgctgataagaagtataagaggtgtaaagccttcatgtttggtcggttggttggttaatcaagtaaatatacatattacgcaagcattgcgaaattttggcaaagtgtttggtatttttaaatcgggtgaggtgagaaacttgggcgatttcccatgggaagacgacgtcacatgggcaaaagcataattttgtaaagtttaattaataaaatttaaatatggcacaccaaatacctatttatataatgagaaatgtgggaatataccaacaaattaagggacattttattaatctgtcaagttgcttattaagcatgaaaactatttggcgagaataaggtgccgtaaatttatggggaaaataggcaaaaaaatttcaagaaaattgtaccgaatacggtataattggcataaatgcattaaaacaaaaacacctaagaaaaattgaaaaccataaaaaataggcaagaattttaatttaagtattttatttaaaatcaaattttatctaaactcaagacacaaaacctaaaattatctttcattaaaactttttagcattgattaaaaatgaattatattaataattaatttaatttaatttctgtttgacaaatttctcgcatttttcaaatttttagtataagcgaaacaataaaaaggaaatgattttgacacataaattttatggtgaaaaatgcaaacaatgtttttcatggattggtgttgtagttaaaaatgcattgtgatgctacgctttttcctgctgatacaccaaataaaaagtgataaaattgtttgtacgacagataaaaaacgtaaatgatatgcaacttttatgggccattaaacattgaaaatgaaattttgagacgaaaaatagaaattaaaaaatgagatataaataattttattatttgaatattttctgaattctgagtaggaaaagtgccgaattaatgaggttactccatttttttaatttgaatttttgcacggcaaattttttgtgtcagtaaactaatgaatgaatgaatgatctgttggatttttcgatactaatagcgtattttgcaattcaattttttccatcattataattgtgttaaattctcaattccaaattaatttttcgtttttttccatgccaagaaaatattcaaaaattttaaatgagattcaaatgaacaaatttaaaaaaaggtgtgggcgcgtaaatgaaacaacaaaagacacaaattaatgaaataaatttttgggtgtccctttttcacccttttatcaaataaataataaataacccataaaattcgttgatttgcccatttatttttacttttatttttggtcggcgggcgaaaaaagaattttctgttgatgattataaggaagaaatgaatagatgagtaaagagatgataagaaaaatgggaataatatgaagcgaaaagcaaattgacggaaaggaaataaaaatagtttaatagttcaaatgaatcaaaattctcgaaaaaatggagcgtagccaaattagataaaatttaaaaaacatttaataaattacattaatgacaaaagtgggtaatttgaaaaattggcgttatgaagttactcaaaaaccatcaaaataaaaaaatttgcctttaactttgttcagaatcaagcaaattttttaattgttggtatcattcgattatccctaacaaataagtgtatctattagcccacaaaatttcaaaaaatttcattttgtttaaaaacttatgatcaataatgttcgttaattttccttgagtaattcggtttatggaaatgttaaattaattaataaatccaaaaaatttttaaaaaagcaaacatttaaaaattaatattttgaaaaaaaaattcaaaaattttggcacatttaatttcttaaaatttgtttttgtttaaagttaaaatataaaagttggactaaattatataaaaacaaaaaaaaattaggcgaattaaattaggtggataagttaagacaaaagaaaaaaagctttctgtgctgaatatttattcaatttatttttgctatttgtttgcggatttgcaacaaaaatataaagtcaatgggcaaacaaaaaaaatatttttgttttcgcctcgtcagtggcacaccgccgcgccgcaca

SEQ ID NO: 16465 - DNA, 964 bp, Heterodera glycines
tttatttgttttggcacactcaaaatctctcgcttttttctgttgatttggtgtgaaaatttgtggtagcaaagtcattttagtaagtgcttgatacaaaagtgtacaaaattttcaatttgtgtgagaaaatgtggaagggttttaattaattaattaattaattaattaattactcactcgctttgatgatccaaattgtccaacaaaaaggaaaataatgttcaaaaagggaaattaaattaaaaaaaaaatttgtaaaaatctaagtgaatatcaaaaaagggtattttttattaattatgtgtgaattgaaaacataataaatttgctagttggttggttctaaggatgcaaaatttccaaagagtttttcttttttagaggccaattctttgggctcgtttgcatcatcaaaacggcgctgttatatatagcatgtcaaatttcaaaaaaatttaaagccaaaatgctcgaaaaccgtgggtttttgagttcctttagccataacttttttgaaacttaacaaaactttttgaaatttttgcagacggttagaaaacatttagggctgtcgaagtttatgaagaatttaaattttggttgtttttgaacaaagttatatcaaaaaattttcatttgatggtttttgtcataaccgggcaataaaattcgaattagcttggcattaaagcgattgatttaaggatttttttgtttgttttgtatacaattctgtacataacgtcaattttcgtataaattaaatgccaataaagtaaattggaacttttgcttgcgcgtcaattaggataagtgggggagaaagaagtttggaaattgatttgtgcttgcgcgtcttttaaaattggcatatgccgtttgctaactcaaagtataaaaataggcacctgacaaattgaggtttttggggagtgttcctatttttttaaaccaatttaca

SEQ ID NO: 16466 - DNA, 4444 bp, Heterodera glycines
  misc_feature (1022)..(1022): n is a, c, g, or t
  misc_feature (1052)..(1052): n is a, c, g, or t
  misc_feature (1147)..(1147): n is a, c, g, or t
  misc_feature (1149)..(1149): n is a, c, g, or t
taattttttatgataacaaatttagcgtaaataaaagaagtgatttggcattgatattcatatttatttatccattgttttaaattatatttatttgaattatgctttgttttaaatgcttaaatatatttgaattattttttaacccctcgtcttgtaagttatttatttttttgttgattggttgttggattctaatgattttacaatttacttatttgtcttatgaaatagtaatcaacttgtattatttttattgtgttttttcacgttttaaaaataaggaattaattttaaaaaattcttattttggcatcgtttttaattaaaaatgcatttttctatttaatttcaatagcttgtttgtatgtgataaaatttttaaatttgttttggaacattatttaaggctaacaatacaaattattattatttacattatgaatttcattaaaataagcgatttttttgcgcagcactgtgccaaaattttcattttattttagtaatagtcctacggacactccgccgccgggaaaaattttgaactttttagtgcactttgtgaacaaaaaaaagtccaaaaatgacatattttacgattctaattgttaaaattgtgattgaattcccatcgaaaaaacattaattttgaaaaatgagaagaaaaaataaatacttgggggggcggggaactgatccaacgcaataacaagaaaccgaaccaagaaaacaacccactggaccacggaaatgttccggaatttactaaaaaaggacctaaaatttataaaaatataagtttaccaagagccaatcattaggggtgtaaaaagtctcggtctcaaaagctcaaagaccgagagactgaaaacctctcaaacagcactatcttataaatgatatttttagtctttgaactaattttaaattatttaaaactatctttatgctgtctgagagttttggaagtttattttcatctccttttttaataatttatgtaattttatattattttntgaatttgatggattaataaattactattnttttaatgttaggattttgtcatgataaaggctgaaattatttagataatcaataaaatatattttttcacaatcagtgaattctatcaaaattngnaaattttttttaaaatatatgcagtttcgcttttcaaccaattttaaattatttattcttaagatctttgacaattgatgctgtgataatagtaaaggcttacctttttcttataattttaggtattatcaaatggattaatctattggtttttcaatttttctgcttttttttttattatttgttttattaatctattccacaaattgtcattttttaaaaatttatttcattacaataatgacaatttaatttatagtatttatttaattttcatggtgacttagctcgttgattagccttcttttgctcactttattgtgttaaattattttaaataaaacttaaaattcgcatttaatttttttatcaataaatatttaaagtatgatattaattttattttaatttttaatttggattttttgtctcttggaatgatttaaaataacattttgtaattttttacatttctttattgttcttttaaggattattcacactttattaatatattcatattttaaatattgttcatttttttctaatttggaatttcgctattttttatttttcttaaactcttgtcactgtccgcttgcttcttacgatttttcggtcctcgactctaatatgttttttatttgctaattattttaaaaatttataattattaatgattattcaaagttaatttatttttcatcaatttataaatgaatgttcagctgttcacagtttatttgattttttatatgataatctctttttgtatcattaataattttgattggatgaatatttgctaaatccgcccctctgcttattctgcaatccattcaaatacttcaatagtaagtaagattaatagtaaattaaattttaaaatattgataatttatttaatttattctgtattttactattcacaaaattagaggagaataaataactcaatctaaaaaatatttattggcaattacaaactgatttttgtatcacaaaaaaaacaacagaattttgagtacaattattcccgccaaaaaaaaacaattaataattatttttgatgtagaaatgcaatataatgggattttttgaaaaagttgaaggattgcaagaggaagcaatttcaactaattaataaaagtaagtgaataaataagggccaaaatcaatattttttaattgaatttaattaattttatttccatttaatgtcaaaattgaaaaacatttgtttaaatcttctttggttaaataatattatatttacaagtaatttgctttgtttctgctcatgtcctattaataattcgaattattgttaataacataatttattttataataaatgtattttttggcttgacattgaaaggaatgtttcatttttacctttgttaaaaatttcccagagtaattagtctcactttattaaaatatttttattcaaatattgttcatttattttttataatttggaatatcggtatgttttattcatattactcttgatcttcacctcgacttctccgaagcttttgaattaaatgtttcttaaattgtgtggtgtttataatttttctattaaaattatttcttatttatgggtttttgtgggttttgtggtgtctaaaattcattaaaaaacttttaatctaattttctataattatgtacaatatggcactttgtttattaataaaatcatcatttattttttgaattgtctcaattgttctgcattttgtcattttttcttatgatcttctacagcttttaaattacccttcttgtcaaggtaatgagaaaaagaatttttaatagaataaatattttcttaatttttgctctttaatttgtcattttttttcttttttttctgttattgtatgaaatatttaaagaattaaatatattttattttattggttaaataactaattaatgaagtgaatttacttttcttttttcgtcctgctacgccgggaacaattttgtaatttttaatgcgaattgttaacagattttaacaaaaaaggcaaatttttagccacttttatatcattcgaaagcccttcaagggttgctaatattgccgtttgtaccccatctttttgaaaaaatatttttgttttcaaaaatcacgaaaaattgtttcctagtgttttctattccgctcgctgatcatgactaaaaaattgaagttttacgcatttattcgaattcggttgcaaaaatttttggaatttttaatgaattttgttaagaaaaacggttaaaaattttaatttttttcctttttttcccttcgcggtcaacccccactccccgcaatagttatccataacagtgaaaagatgaaaaactgaaaactcgatcagtttttctaaagaaggttgcaaaaaaaaaaaacagagacaaaatcagggtgatctgaaaaccaaaaaatgacttcaaattgggaaaattttcgaaaaaatcctagggggctggcaaaaaattttcgtggaagataaatgtcacggatagaaagagcacaaaatttgccacagcacatgtctctataaactttttaatttattaattattgcgttttattttatattgcaattttgtttttcattttttcgaatctgattaattaattattgcgtttcttttgcttttaatttgttttaataataaaattgtgttataatatatggttttttcaaatataaaatataattttttttttctttattactttaaaattgcaaaatataaataatttttgtctctaattagtgtaattttcatttacagattttttaaaaaccggtcaagtaaattttgttaattagcatatatatttttcaaaaagaaaactttgagcctcttagcaagccttattttagatttttattttaaatttttcggattataaaagaaaaaacataacaattcaattacatggaaatgctaacactttagaaaaaacattttaaattaaatatatttaattaaaatggaaatttttaattaaaaatattattatgtcaataaaaagaattttttttgcaaaaattctaaatatttgccttttttatttttcaattttgtttaattcctgttgtcttatcgaattttagaaataataattatgaatattattattttttatagttttaaatttttaattgttttatgtatataatatttttttaaaaattattcattctctattagtatgctcaatcatactttgttttatgaatatcaattttaaaatgcgcaaattaataatttt

SEQ ID NO: 16467 - DNA, 1238 bp, Heterodera glycines
agtagagaccgagccggaccggatccggtaccgatttttaccgggcccggaaaccggtccggcggttttagggaaaattccggtttgaccggtttttcagagatcgggcccggaaaccggtcattttgaaaatgccaaaccggtccggaaaccggcattttggaccggtttttatgtggcattagtgactctttgaccctttatttgattgtttgaatttgtttggcataatgattggaattcgaaccaaatattttggttttcttcaagagtgggtggatttttggttatcgtcggtgataatccaaattttttgaaaacttaaaggcaaataaggacacttagggctatcaaataataccaataatgcttaattcggatggttctctaaaaagttatagtgtattaaagtttcaaaaaattattttatggtcgtgtctttttttatggtagtgtaaactgcaatagaaccgaaatgtgtcccaaaaatccacacaattccggtaaaagatttaatcaaaaaactaaaaagcatttttttttttgtcaaaatctgataaaattcacctcaaataaaaattttccccggtggtgctatctgacgcaattcatttatctcttctgttatttccctcgaaattttttttaaatttcaaacagaaatttaaaaaattttaagcgatttttcaattttatgatgaattatcgcaaagtttttcaaaaaaattaacatttggcacgatttttgtcgattttggggtttaaatacatgtgagaatttaaatttttaccaaaccggaaaccggttccgggcccggcaatttgaaaatccggtttcaccggtttttgagaggccgggcccggaaaccggttgcttctgaaaatatcagaccggtccggtccggcacttttggaaatctcggtctctagttaaaagccaatcatattagcgattttttgtctaaaaacagtacgagtcggggcagtaagagttgggtttcgtccaaatcctatatacatagatactttggttgacataaactttgatttaattaaatgttgccaaatgcaaataacatttttcataataaatgatttgtgagagtgatttaacattgttctgattgttattttctgttcaatatccgtcttcggtcctcggtggtgtgcaatggtctatttagattgggaagtgcaaatgattttcggcttctcatttctaccacatcccgcctccg

SEQ ID NO: 16468 - DNA, 2029 bp, Heterodera glycines
agcaattgctctcgttggtcaatctcccttttgaaaatattggtgcggtcccaacagaaggcgagcttttccttaagcaattggatgcttaaagcaagtccggtcttttccccttttcacttggctttcgtattgcactttctgtgattggaggaacaaaaagggaaccaacagaatggcaaatgccaatgaaattgtgcccagcgcaatcgcaccaatggccaactgaccgacaaaaatgcctgtttaggaattacatttgattaccactcacagaacgggttttctccgcttccgagaacaaatagtcgtgaaatggcataatgtgattttgggatatgcttttgggattagccattgttggcgaggaatgaggcggacaatgaatgggccgtttcttttacaatgcaccaacaaccatcagccaactctgctgcatgcttaagacgggccgaacaggtttttgggaatgggcagatgaatcggaggataatagggagggcgagaacatccagtcggtgcaaaaccataatattgtaaatgacgaatggtttggtggccttgcccaatgagtgatcgatcgattggttaaaatgatcagaattcgccagtgatttgaatagaattttaatggcatttgaaattcatttttgaaataacaaagagcagacagggatcagcagcttacaatggatggacaatatctcttcccctcatttcgcttctcacaaaataacaacgacgtttcacttttctcgaaaaacgggggccgctttcgacagcggcggacggtcacgcgccccctcccctccccccccccccccctttcgcacgctctgtccatgtcaatgtcttttcccgtctttcttcattccgtcgtcacttttctcgatttaacataatcgtccccataaaatgtgatagtcgtaatcatgccaattcacccctccccctctttttttatctttttcattcttttcgcttcataaaacgtataaacggaaaggcaaactgaaaacactgtgtttttattgctattaaatgaggtgacttggattctcaattctgttaattgaaaccggcacaaatcttttccaattgctttcgtccgtcgcttggccttccctttcctctgcttctgttcattcactgtctttacactgctcccctaatgcattcacacctctctctcttcctttccttgggcgacagcgcaaagcgtatccaacgaaagcccacacttatttctgtccctctttcctttccctctttctcctctctcctcttttttcttgcccttttcctttccttttcttcactctctttttgccctcctttctctttgctgtacatcccttttgtaaaacttaacatttcgtttttcctactgctctgtcacttaaaaaactaaatgaaagtagtgatgtgattaaatatggaaaaacaatgaaattgctcaattcctttcacccctgcattgcctttattaattaaattaaaataaaacctaaacctttttttactaattttcattgtagaacataatctccttccaatttctccaaccataaatactaatatgtaattttacatatgtgcattagttagtactttcaaacaatgtgggattatttttgtggtgtcactaagcctatgaaaattggtctttcctttttagcggtctttccgctccgtctaaccatcgcattaaattgagcaaaaggaaactttaaatatccttcatttttattttctgtggtgggatttttttttacttcatgttaaatttttaagccaattggattttcctttttaatccacaatttatgaaccacaaagaaaagttatatttgtattattcgagctgtccgaattgaaatgcccttcaaactaatcgcataattcgaacgggacgatgacagagaacgaagacaaaaaagcaggaacagggtaaagaaaccagggtttcagttttgttgcatcatctatggcatttgcgcctttctggtgttcgtgctctgttttttta

SEQ ID NO: 16469 - DNA, 1119 bp, Heterodera glycines
  misc_feature (28)..(28): n is a, c, g, or t
  misc_feature (1072)..(1073): n is a, c, g, or t
aaagcgttagtagaaaataaaaaataantcggagcccatattttcgtcataaattgagtcccgaaagataaatagcatggcaaaaattgaaaatatttgtcgatttattgcatattttccatctatgtttgggatgaggaaatatataaaaggataaactttgtataagtatttattatcatggaagtcgtcagaataatatcaaaagacttcgtctaaacaatattgcaataatttaagttggttttatttttcagtcaacaacacggccgagagagattttgatacatcaaagacacacctaaaatacaccgcggtgtgagccctagcgaaggctggacaataaaattgcacaactaatatacctactgttcgaattatgttttatacgagtcagatatgagtttttcctatggcaaggttgtgaaattcctcccaaaaactttcttacggaaaataagcagcaaattttaataaaaataaatacttttcaattcatgcaaggaatttcctgaatctataaactgatccactagaaaagcgtcagtcgaaaataaaaaataattggagcccatattttcgtcataaactgagtcccgaaagataaatagcatggcaaaaattgaaaatatttgtcgatttattgcctattttccatccatgtttgggatgaggaaatatataaaaggataaactttgtataagtatttattatcatggaagtcgtcagtataatatcaaaagacttcgtctaaacaatattgcaataatttaagttcgttttatttttcagtcaacaacacggccgagagaaattttgatacatcaaagacacaccaaaaatacaccgcggtgtgagccctagcgaaggctggacaataaaattgcacaacaaatatacctactgttcgagttatgttttatacgagtcagatatgagtttttcctatggcaaggttgtgaaattcctcccaaaaactttcttacggaaaataagcagcaaattttaataaatataaatacttttcaattcatgcaatgaatttccctgatctataaattgatccactanngaaagtggtagtagaaaataaaaataattggagcccatattttcgt

SEQ ID NO: 16470 - DNA, 1884 bp, Heterodera glycines
ttgaaaatatttgtcgatttattgctattttccatccatgtttggaatgaggaaatatataaaaggataaactttgtataagtatttattatcatggaagtcgtcagtataatatcaaaagacttcgtctaaacaatattgcaataatttaagttggttttatttttcagtcaacaacacggccgagagaaattttgatacatcaaagacacaccaaaaatacaccgcggtgtgagccctagcgaaggctggacaataaaattgcacaacaaatatacctactgttcgagttatgttttatacgagtcagatatgagtttttcctatggcaaggttgtgaaattcctcccaaaaactttcttacggaaaataagcagcaaattttaataaaaataaatacttttcaattcatgcaaggaatttcctgaatctataaattgatccactagaaaagcgttggtagaaaataaaaaataattggaacccatattttcgtcataaattgagtcccgaaagataaatagcatggcaaaacttttaaatatttgtcgatttattgcatattttccatctatgtttgggatgaggaaatatataaaaggataaactttgtataaatatttattatcatggaagtcgtcagaataatatcaaaagacttcgtctaaacaatattgcaataatttaagttggttttatttttcagtcaacaacacggccgagagagaatttgatacatcaaagacacacctaaaatacaccgcggtgtgagccctagcgaaggctggacaataaaattgcacaacaaatatacctactgttcgagttatgttttatacgagtcagatatgacaggtgaatgtcctatggcaaggtggtgggaagagctcaaaaaacaatttctgacaggtgaaataacctgtggtaggtggtgaaaagaagtgaaaaccaatattcgacaggtgaaaatgtcctgtgttaagtggtgaaaagaggtgaaaaacaattggcaacaggtgatttgaaagatgtgaaaagtctaagaacattgatgaaattctagagaagtgatgaaaagaggtgaaactaaaatagaagctattttaaagtggtaaaaaggcaaaggaggggtgcgtgccaaccgaaacctatgtgaggggttgtttctttgaatctgccgccttgtggtttttaattttccccaaaattttgcgattttaaagctttttgttttactaaaatattaattgtggtttttacatgagtaatcaatatcttaatatcgtcccgatctttttcaatgccttaagcttggagattttaaaaggtttaagttgggaagtgttttcaattatctagacattttcaaaagctgtataccatcttatgtcacaaaaatagcattttcaaggaaagaaaattaatattataatttaaacattcaaaaatgtagaacggttaaaatatatattcaaaagaaaaggttcgggaactcaaaaggattgtcttttcatattaaattatttattgaaatatttcaaatttttaaatgcaaaacaataataaattacgttaaagagttaaaagggaatcttttaccagagcattttttgtatataaattagctcagcgggaaaactttagatgaaaatcccctaccattgagtttgggaattcaattaaatttgaaatagaaagaagaacaacgagattacgtggcaaagacataagagtaattattttcaacttccctaaatccaaaatctaaaaataatgatgaataacagaaaaaacatggggaaggggtgaagggagcaaaaaaaaattttcaagaaaaactaagaagaaaattgctacgaatgactttaaacaacatacattcag

SEQ ID NO: 16471 - DNA, 2483 bp, Heterodera glycines
tactttgttaaatatcttacaacaatgactgaagaattaaaaataatgccaaatatggcgatgatttcataagtcagtgcgaatccaattagtgaccagctcgtatggacatctttgaagtagggatgatatttttaggtttttacctatttttttcctgagctccccgtagcctgaaatgcacgaaaaacatgtttttttggctgttgttaagctacttttcgagttattagcacctatttactaggtttttatttttagcacctaaaaaacctaaaaaaattttaaaaaacttattttcacctattttggtgttttgcccaaaatttgttaacaaaaatgcaataaaaaagaaaaatacactcctaagaaccgacccaaaattttttttcaaaaaatacatccctaagaatcgaccagaaaattttcaaaaatgcgcccctaagaaatgaaaaatttctcaaaaatttatctccaaaatttatttattttattttcttgtcgatagtttttgattttgaaaattatgtatatccttaatgacttgacaaaatatttttgcttttaaaagaaaattttcgattttagacccctaaattcggaactttttgtcacctattttcccatttttagcacctattttgcgggttttttagaacctaaaacctacctattttgccagtttttagcacctaaaaatatcatccctactttgaaggccaaataaaactgtaaaataataaccaaaattgttagtaaaaaaaatctaaaatttcaatctttaaaatatccagtggaaaaaaaacttttacttaacaaataccaagtaataaacaatgtaacataattttatgaaaaaaaaactttaaaaaattattaaactaagcaacaaaaaataaacaaggaaaactgacgagaaaaattaaaagaattgtgtatcttttttaatgaggcagcgtgagataaatattttcgttaatgagaccaattaattactattttattgtaatataaaggactaaaattgaattcagtctcgtattttatttgttcaagcatcaattagaaaagatcccgctaataagaccaatttgtaaggctaacttaattttctataggcacataagtgtcataatgcttagaggtgcgccgtgactgaaaaaagccgtgaaacgtgaccaaaaagcccgtcaattttttgagtttaatttttccatgtcggcgaatttttcgatttttacactgtcttttttatggtataattttccaaaaaaacattttgggaaaaagggggtccatcacaggtttcgtccaaaaaatggcaaaatttctctttgaaaacaatatgtacttcgtaaattttcaattttattcagtgtaaatttttcacggaataaccgtgaattttcgcatattccccccccccgcggatgaacacttcacttcgcataaacacacaacaattttaattatattcctgctctccctgccttttattggtcccctttttccccaagcgtcagaaataaagtgaaaaagcattcgattggcaatttggttggacttaattattccgattcgttaatttgggtaaaattaatttacgaatcgcgacaaaagtgttaggccttgggtgggaatcgaacccactcgtgcaccctttctgttggcagctctaccattgagctaccgggcagggatgggccgaggtttcgctttacgcatttcgccttattcgcatttttaggcgtttcgcatttcgctttttggcgcaaaatgcgaaagttccacaccgaagaatgaagaatatatttgaaaatttaaattttaaaacgaatgcatcaatttattattattttgggctgcaagattaacaattacctaaattttttgttgacttgctacgggctaatacgaacgaaaacgagtttttattgggttgatgcttctatcttgaactttttgatgtattttttttttgcctcttgcgattttgatgccttatgccggccacgtaattttggtacctttttcctgcatttttcggtatttttttgaaaattttgcaacttttcctatcatattttattaatttccaaaaaattttccggcgcgcctgtcggcaccgccggaccctcattttaccttgatttttgaaactttaatccaaaatgggtagatttgtcattttttgtgatctgagaaaaaattgaaccgggaaatgcagagattttgttgtttttgcatcacaacctcaaaatctatgtttgaccattggtaaacttttttaaaaaatttcgcatttcgcctttcgctttttcgcatattttggcttttcgcatttcgctttttttcatttcgcatttttcagtttcgaaaatttcgcttttcgcatttcgctttttatttttcaatttggcccatccctgctaccgaggcaaaaccgcccttgcttttatgggtgttatcaagcccgctttccg

SEQ ID NO: 16472 - DNA, 2603 bp, Heterodera glycines
ttttacgatattaaataaatgatgaaaagaataattattcttctttcttaaaatatgctaaaaatcatttaaaagggtgacctttaggaaaatgacaacaatttacacgcattatccctgctaaaataaaaataaagttaattttgattgtttttaaaattcccttaatgaaaatttttcaacaaaacattttaaaaagacataaagcctcttctgttgcggtggtcggaattatgtctttacgtcacaatttttggcaggacaaacaaatcagagattattatttttaaattaattgctattattattattatcaaaaaacactttcacatttaaaagactaaacaatttttttaatttttattaacaaagaggaggtgccggcagatcccttgtgataaattttctaaattttctacaatattaacaagattagaaaccgcagaggtggtcattatgggagacaactgcactgggcgatggacaaataggcgacagccaaatttaggggcataatccaagccgagataaaaaaaatgaaaaaaggttaattatgttgaataaaattgatgattaatttataattaaaattcattataatttgttaattaaagcccaaaagctattaacttataacactaatgttagttttaacaaaaatatttccaattttaattcaattcgaatcactaacctaaatttaagcgaaaaatcgaaatagcttaaattttcggttcggatatgagatttgtcaaaattggtgtccgattcgtgactagcacaaccttgaaagcaccaagaacatttttttacgtttggttaagttttttcatctcaaattttcttttgcagtttcccacctctttcccacgatttttgcccatctttttggatcacaatttgcccacaataaaaggcaaattatgaataaataaaagaaaatgagggaagaaattatgagtgttcaaataataataattagtattttttgccaatggcaatcttcaactttaggtcgtcgttttaattcgttaaaaaatcaaaatttaaatacttttaattagtcgtattgtatttttcacaattaaacaatttatttttttaatccttaatatgctgcccaaacttcactcgcttttcctttgtcgagaatggccccctagacctaaagttacaccagggttgttccgggttacccgaaacccgatacccgaaacccgaaacccggcctttttctcgacccgaaacccgaaacccgacccgatgattttgggtcgggtttcgggtcgaaataagcactggtaagaaaggggtctgggtgaaaattaggtggataaggaaattgagaattttttttgaaacgattgtgttcaatggaatcgaaaattttgtatttgtttttgttcattattagggatgtcaattttatgtaaatgcatatttttttcctggtttctccatgctctaaatagtaggaaaaacactttcttttttatgtttgcaaacaaaagttgggacttttatttacatatttttacatattttcggattttctacatattacatatgtacatatttttatacatatttcttacatatttagttattttttttacatatttatatgtacatatttttatacatatttcttacatatttagttattttttttacatatttatatgtacatattttgaccaatttttgtacatatttttgacatccctattcattattatcctttttctaaagatattttgtatgaatttcttgaatttaagcaaagcaaatggctgaaaaacctgattccatttggttttatttccatcgtcctataaatggcgcaattcgctgcaaatattgcagtgccatttgatttttaaacaaattaaaaatttgtcaattgacccgaaacccgatacccgaaacccggcctttttctcgacccgaaacccgaaacccgacccgatgatttttcggccgacccgacccgaaacccgacccgatatttttctcgacccggaacaaccctggtgctgagtaatttgagtctttttattacttttcctagaaacaaccaaattaaagacattcagcataatttgatagccctaattgccctctattagcatgcaaaaattcaaaaaaaaatttattcagttttggaaaagctataattaaaaaacaacaacttaaatacatgtttttcctaaaatttttggccattactttttgtaattttgcaggcaaaaatgaccaatttttgcgattttgagccaatttttgtgggtttttggaaaaaatagcgaaatttgtttggaaacttgggtgagggaggttttggaggggataacaaccaatgccaagaatgttttatttggttattgtaaagctaaaagtgccacgcactaaaattgcccggaaaagaaaagaaaatgagtgaaataattaattttgcaaaaaaaaaaaattatttgcggagtgaatagaaaaagaaataagaaaaacttcctctttgccctctaatgttctgctgactgccgttgtgtgaaatttgtgccaacggcacacggcacgggacgacggcatttccatccaaaatt

SEQ ID NO: 16473 - DNA, 1662 bp, Heterodera glycines
  misc_feature (53)..(53): n is a, c, g, or t
  misc_feature (1643)..(1643): n is a, c, g, or t
gaaatcgggattcagaggcccatgatttttcgtaaatcaaattcctctccatnccctggcttggtacaggtcaactgactacgaaattcaagtcctcaaaattttcggaccgaattcgagcctaaaattttttgggaaatcggattacgagacccaggaatttttcgtaaaccgaaatccatttccatccctggctttaaaaatgtgccacttgttccggtgccgttcctccttttgccagccagcatagctgcgattgttcaacacaattgtgtcctccaagaatttgaagcgcgggttcacatgcagcacaacatcatcaccacgaccgttcaggttgacaacaaattgcttctgttggccattgtatgtggcacccgtcatgatcagttcggcaccagtttgcatgccgtactcaattggccatcggaatggcattggctgtcaaagcacagtaaagaattaaattatattgatgtactgtatgatcgatcatcactgtatagatctgcccgggcctctggtctaccctaatacagacctaaaaaacaaacccaatctgaatacagacagactactgagtttaaaccaaggttgccaactgaaaatattcaaaatcagcagttggggtcaaaaagcaacattttagaaaaaaatttccgaatgaaaaaagcgggttttccaaaaaaaaaactttttgggaacaaaggggccggcggctcagggaaaattttttttaatttgagcattttaaacaaattccactgaaaattggcaatttttaggttaattttgcactttgaaaatcagcatctcagaaaaaaaaaatcatcactgaccccttcttgaaatcagcaaaatgatggtaaatcagcagaattggctactctggtttaaacagattttttgatctacacaatccgaatctcggtacaaatcccggtttatccaacgaatcaggaaattccaaggcatgtttacataccgggttttccacagtgtgtaccgcagacattgctgttttcggcaattttaaataatattaattaatattaatgtgatgaaataaattagtaattttaagaaattacacaagtacctataagagaattacattacacaatataattgtaaatgataagaataaaattgaaatggaatggacgactgaaaagaaataaaatgattaaaagcaatcttttatatttttatttaacaaaaaaattatttattttgcaatataataattgaaaataaataaatgtatttatgagtgaatattaagtatgaattatgtataagataatgaaaaatttttgggaaaaaagaagagaagaattgttgagaatgtttgctcagatgtttatttctccccgattaatcatcaaagaccgatggaatcgatgaatggggaatggactcatcaaaacgataaataattgctttcattttatttaaataaattttttttaatttaatatataaaatgggattaggaaaaatgagaattcgttggaaaaaaatttattcaatccaaagcaaattcaaaaatggttttttttcatcgtcttcgtgtgccatcctcgaagaaaacgcccccatcatgggcacaatattttgggacaatgccctttctctccggntagtccgggagcgccagga

SEQ ID NO: 16474 - DNA, 2520 bp, Heterodera glycines
aggtggtcctggcaaaccggggtcgcctgaaattcattaccatttaaaaatttaaattttccaaaaatttgacctggcggtccaggttcgcctggcagaagtggctcactgaatgccggcactcccgggtctataaaaatgccaagaatgtgcttcttctccaattccccgtcaatttataccgccggggggtccaggaagtccaggctctccgggaggacctaaatttatgaaaaatgaaaacatgaaatatggaaatttttttgcaagatttcaccaggtggtccttttggccctggctcgccaggctgtgcatcacgtcctgggctgccaggcatgccgggtgttccggggtcgcctggaggtccggaaggcccctggggcccaggcggaccctgcgggcacggcttgcaggggggctgaaaaatgttttaaggatgttagtcgcgactactttcggtgtgtcatttcaatctccatatagtcttggctttaccggtgttatgggctcgcaagcctgcataggcggacgccctggatttcctgacaatttaatgggttttaaagtaataatcatatatacacacaggaccacttgccattctgataaaaaaaaataatctttcataaaatttttcatagttctttgatttaatatttttgcaacctttttggtggatttccaatggttattgcctaaattatatttgactgtgtgtaccacaccccaattttcgtatggtcatatggtgatgaaaagtttttgaatctcgaatttgagcattgaaaaatctgtaagaaaattttatgaatgcgtttttatcggaatagcaagtggccctaaacatatatgctatgattgtacaatataaaaaataattctgatcagggaggaacactaatcattaattaccacaaaaaccattaattattaaaaacttttagtctagcaaaagataaaaattaaaaaattaaattttcatatgaaaatgactataaatcagataaaaaccatttttacctgggaggccaggcgcaccaggttttccaggccgtccaggtcttcccggtgctcctgtgagtaaaaattgagttattcaaacaatatagaacagaatgccagatttttttcataaaaatcatttcaacccggaggcccttgcggtcccggtaaacagcaagaatcgcagctggtgccgtaagcgtctacggcaacgttggtcgcggcaccgctgcctccaccggcctcatagccggcctggcgttttgtccgtcgtgctgctgtcacattggttggcgttgagttcatcaacgacactttccgcagctgactgacttcttgccagatgtcacgggccgagccctaatcgattttttttttaatactttaccgttttaaacgacgaaatgcaaacccgacatttaaaaaaagagacggataaataatttttttgaaaaaaatacgaaaaaaaaattctaacagctttgaaggtattcaaattttatgcggatttaggctccccgatgatacgggacgagcttctacctcgtagaggagctatgtagaacggtcgatcaaaataattaattatatattccgaaaaaaattttttggattttaaaattcgaattttttttttgctccccaactttgcaatagttgagctcgttttgcgtctgatgccgaacattccgcacataagtgtaaaccatgggcagcgtaacacaaacggacagaacagcgacaacggaaaatgttacggccgaataagccacgatccgatacgctttgatccgattctccaactccattaaatttttcatcacataaatctttatgaacacaaaaaaagtgcgaacgaaatgagtgtgacatttgtaggtatttttaaaatattctcagtaattttggagcccctaacatacagtattctgtacaggattttcctaatatccgccaggatttcctagggtccgcgttccggaacttgtatgttttttgaaagaatgataggactcggagtcctgttaaaacaggactcttttcgtccctgaatcagtccgggtccatcttaacccggattttctggtccgggtaaattggaaccgacatcaatgttctagatccggggttttccaaaattccgggctattcttgttttaatacagccttggaattttttaaaatcaacttaaaaatttttaatggtcgatgttcccgcttcacaaattaaatttattattaaaatgataatttttatttaatttaatccatttcaaaaaatgtccaaattaaatctaaaatatttcttggtcgaaaattttcagagcagatcagtccgattccgatttgttttcagcggaactttaggggtattgaaaatggcttaaaaatgcaggaagccaaaaaatgacaatttgagagatttggcaaccgcccggggcgaagggtggggggaaggcgtctaattacatggctggaggcaatgatttgtgtcgacgacgtaatgcttcatggat

SEQ ID NO: 16475 - DNA, 1266 bp, Heterodera glycines
  misc_feature (1218)..(1218): n is a, c, g, or t
tgatcaaatgaaaaaaccagtaaaaattcttaatttaatgaattttttcctcttacattttaatgaccaatttgtcatgggttcgaatccgctagacagatggtgaataattttgattttttctttaaaatatttttgcatctaattcttttaattcacttattttttgctgatcaccttaaaaaagtttagtgactctagaagtatttttaattttattatgatttttttaaaaatgaccagttttattgattatccgaaactttgatcaagtttttctgattatttttggcgcccgtagccaaaaaagaaattacataactaaattgaattcgacagatctaaaatatatttccaattttgtaacttttttttattattagattttttcattattttttggcaatttttttaaatattagcattaatatgtatgttcatttttacatatattattttcacataattatttttttacttcatttttacaatgagaagaaggccttttccaataaattcgtggattgattgacgtttccaaagaaattttaataataaaattattagaattcttcttttttaaattaaaaatattataatgtaaatgtgaatagactaaattaaatattatttttcttcttttatattattaaaacatatttagggtcttttaacaaaatcccaaaaatgctaaatttttttcggtcattccgcaaaaattttgcaatcgaaatttaatctctaagaattcacttattttaaaataaggaccaaatcatggcttttttctcactaaatgcactaattattgataatgaatagtgaaaaatagtgtctttttctttcttttttttagtaaataaaattctgggttttattcttgcatttttaccatcaatttatacaaaactcatacaaaagttaaattttctctaaattaatagaaaaaagtaatattagtaataatactacataggttcctaaatacaccacaaaatggccacctctttctcgtttcttggcctttattttgccattatttggctttgcttctttaatgaacgcgcaaatggcaccggtggaggcaataaattaaaaacaattggcgaatcctcttcagatatgggtaattatataaacaaatattttgactaatttattctattaagtctctgtcgatcaaatcaaaaacatgcaagaacaaataaatgcattggnagtagaagtgaaggaattaaagaaagcaatgctatggaaaacgaaaaa

SEQ ID NO: 16476 - DNA, 2785 bp, Heterodera glycines
  misc_feature (2687)..(2687): n is a, c, g, or t
  misc_feature (2746)..(2746): n is a, c, g, or t
agttttttatttttaattaattataatttaaatttaaaattaaaaaatttttaaagttataaaattaagttaattttttttaaattttctttttattttgggttgaattttttagtttaatttttcggtgagactatctatgctaatgaatgaatgaatgaattaattaattaattaaatgagtgtttttaatgaattcattatttactcacttttcagcgtttgcaacagcaagtcgagttgatccaaaaccagaacaagtgagcttacttacagtaacagcgataaaatattaatgagggcataaattacttttctccaatccactacccgaggaattttgccgtccagatccaagtcccgagattttctcatccctaatcgtgaacctaaagattttggccaccccggtctgaatcccggcatttttctcgtctctgcgatagtcattttacatgcccatttacagtattttggcggcactttgcaatggcattgattataacccgcaaaatcagcaacaacacaattggacatatgaagggagtcagtcgccatcgccagtgggccctttcgccgatggttccacggatttttcgttattcgccaacatgtcgcagccgtggcacagccaaagcgatagccaaaccgaaccgccgaagccaacggattcatatgccgaagtcgccgctaagccgccgacagtggcaaacactcggtacaactcaataatttatatggatatgagatttacaagatgataaatcatttttttctcaagttctgctcgtgatcgaaactttctcgatattcgagaaagactttttcaaaatattttccatattctttcaaaatcaaataaaaataattataaattatggaagcagccttagaattttttccttgcaaattttgattatttttttcctaatttgtttaaattattcaactataaattctttaaaaaaatttgtgggtaatacgtagggtattcttcaaaacatcagcagagaaataacctattttttacagtcaaattaatgtgccaatgccattggcttcagtggagccaaaaaagaaatctccgactgtcggagacgaagatgagaaagccgcaacggataaccttcaaaagagccaaatttgtcatttttgggaggcccataaaagtggaaaaagtcggaccaaatgtcagaacggcgccaattgtaaatttgcgcatggggagaaggaattgaagaagattgtcccaccctacttcaagaaccatctttgcaaggtcagtgctccgttcgggattatcaacaatgtccgggttcagcactggagctcgggcaaatgtctgaacggcgaaggatgccatttcgcacatggacccgaacagttgcgtaaagttggacttactaaaggtgggtgattggcaccgtttgcattctttcttttcccaaatggactcctttcgacccatcaaaattaagagtcgtcaaatgtgcctccgtcaccctccaaaagtcatcaaagtcgtcgtaagacgtgaacacgcacaaaactcacacaattcagccccaccgatgattttggcctctgttcaatgccccgatgatttgttacgatttaaaaacttttctttaaattctttctgttattttcttcccaaaagatcagtgtaaaatctgattttcttaaaaatttctttactaggattattttaagccctaacacgaatctgacgtttatttgaggctatcacgtattttacgcgacttatgtgaaaatttacatgtgaattttaaactttttttaaaattagcttttttcgttgatccacaaacgggggcacacacaaaaagttcgtcgatatttttgccattttttggctcagtttaaaaaaaataatatttcatgacatcattcaatagctctagatgttctctaccataatattaatttagaagttttttaacaaaattataaaaaagttatggtcataaaatttcaacaagtcttgagtcaaaattttttggccagatctttcgaccaatttcgaacgacgtgaatttgaacaaaagttcgaaaattcaaaaaatacgcgagatcaaaatcaactcattaatacttcaataaaaggttaaaccattttggatcaaaaatctgaagcaaacaaatggcgatttattattatattatctataaatataaagttggcaaacaactgacataaaaatttaattaaacaaaaaatttttttttgaaatttttgcagttttaaaaaacacctattgtggcggtttttagaaaaacgagctagcaccgtttgaaaagactgatattttaatagtatacatttaatgtatttaaagcacatttctttgttttatttcagtgacgaaaagtttagtgacgaaacgttcggccatttttttaaatagattctttttttaaataaaaaataattccaatttaaaagtaaaatcaagcccagaatatatttatatggcatttgcatattttgagatgtgtgcctagaaattctacagaatatgtcaaggtcaaccggccaaaccagggataaaggagagaaaatcattttcatatagaaaatttaatttataatttatcttttattgttttttctaccttttcaaaatttgagtcaaaatgaacaaagttatggtaaatttccttanagatcatgcacaatcttgtgaaattgtcttttctcttccgacaaaagcgttagcataanagcgatcattcagttttatatttcttactatgcactgaa

SEQ ID NO: 16477 - DNA, 2962 bp, Heterodera glycines
  misc_feature (142)..(142): n is a, c, g, or t
tccttcgcttctccggtagtttctcataattcaaaccaatcttcccgtttgccaaaaacaaaggtcccaaagtttcatttgcctcggccttgaccaactgaattcacaaacagagacattaggtctctgaacaactctcaanaattgacaatggcaaattgttcattttagagcgatattctcgcatcgcttcttctaaacgtaagctgtccgattcaaaaagagctcccgctctcaggaccaaaggattttgtatgtttctgtatttcggtttaatgtttcccaaattttcagttaatctttgaacaatttccttttgtgtcgcattgttcatattattggttttttccatttctgtacactccattcttttgcctataatgctcaattctctggtacccggccgaataaaaaatgttgtattttctgcgaaaattggtatccattcgtaacaatcgttccccatttttctgtcccagaatattttttctggtgtaaccggtgcacaaaaaccaacttccaaattatctcctttccatcgtgccactaaatcgtctcgattaaatatttttctgactccctcatttggattaatttgtaaaaccgctttggccaattgtagctgaaatttagtattttcgcacgcttgtttataaatatgatcgtattgccttcttttctcctcatttagtcgatacaatgcataattgactcgcgtattcaaattcttattttcctgtcctgctttatttcgcactttgcttttctcaacttttttaatccaccgggcgtcaggtgttgtaactgtcgttctttttcttcgatccatgtcgaagatttcaatctcatcggataattccacactaacttcctcatcgctttcatcctcgaatgaattttcaaattcttccatttcattgccatcattagctaagctctcaatgacctcagcttcaacttcctgactgtattcttcctcactctttttattctttactgtcttttccgacacttctcttactttttcgtcctcaattttcttcacaaccgtaattgccgtggatggaattaataacttttcatttttcttttcagctttaatgctgtctgatttgttttccactttctctttcggcaattccaccttttccacaattttttgagtggttggaggaattggagtcataagtgctggaatctcagtcacattcattgttggttctgtgtgtttaattgtctttggaaatagacttgctgttgtggcctttttcagttcaacctccggttttttacccagcacatgcttagaaaaatttttggaattatttgcgctttttactgccaaaattgtactcggagttgtaactgactttggaaaaagctcattgaccactttattagtgcttggtctaactgtgctaagaaccttctgcgttgtgctcttcaaacccacaatttttggttttggtgttgcctttttcagtgtgttttcaattttcgattttttagtcgttgtaaaaggagctttagttgtcgtagctaccaattgttccacctttttcccaactgccttgtatactgactgagttttttgctcattttttatctgaattttctcgaaaattggttttttgacttctgtcttaggccttatagtcgttggaaccgtgcttgtaataattttggtcggaattgccatggttacttttgtcgtactccccactgtgcttgtggactggggaaccggggtactcaaaattattagctccgttgtgttccttttaggactcaaagttgttcgtgtccaattgcttttgggtctggacgctgggtccaaattttcaaattttgaattttgacccggcctgattttcagaaacacttcctgtttcgctggtcgctcttttctctgaggttcacttttctgctttgtttcccttttttctctcgctttttgtggactcggagtgtgtatcagaatgaaaacgtcatttgacattttatacgcctcgtctggtacgccaacaataccctctctttcatcgcccttttctttttcaaaataaaacacgctttgttcgctttctaacacaattgcgttctccgttacttctgccacaaaatcaccgacagggaaatgagttgcccaataagcctcacttggttccggaatttcccaaataaatgtccatttttgtccttcttcccatccgttgtacggattaaagttatgtccaaacgatgttaccaaataaaaatccagaattccgccttgtcctttctcaatgaaatcattcactgttgtctcacatctttcaccaatccatgcatattcaacttttgaaggcctctcagttgtccataaattctctgtcaatctcttcattgtatgtcccatgttatttttaaatccatgacaagctcggtgacttactcccttcacgtacgaatcctgactttttatgtctttccagaaaaaaaaaaatttcccgtacaaattttcatcattttctgatagcagttataaactgggaattgctttggcattcgaacaggtaaaaaaagtgtaacttttctctcgtcagctttttggtactccggtactgaacattctgttacgtttggtaaccaaatgggtgtggtgggaacccgatcagaacataattggtattgaccagaaatagtcccgaaaaatgagcacagaatcattgaaattgtcaaaaatgtcattgtcggggtcagggaccttcgggagttggatgccgaaggctgagctgcctcatccgaaatcgcatttattttgtatttttgcctttcacttcctcttcctcttgaattccctcggaaattcccaaaatttcccctctttggtcggaaattctcaaatctccacgtattatttccaaaattcccattccaagtccgattttgtcccaatggaataaaatttggatttctttgc

SEQ ID NO: 16478 - DNA, 3204 bp, Heterodera glycines
  misc_feature (48)..(48): n is a, c, g, or t
  misc_feature (78)..(78): n is a, c, g, or t
  misc_feature (179)..(179): n is a, c, g, or t
tttgagttataaaatattctttttaatattattttccctaaatataanacaaaccattttttcagtgaatttctaacnccatttatttttgcccatttttccaaagcctcaattgctttatccaactgattcgaatggtcatcattttcgtgggcataatataatttaacatcatcggncatacatttttatgccaactgatgccgcttcaattgtaataaaggacggcagatcatttataaaaattaaaaagagtaatggccctaagacacttccctggggcactcctgaaaatattctgaaactttctgacaattcttcgccaattttaaccttaaaactccgatttttttaaaaagttagttaaaaaattatgaatttttccttcaattccaatctttttgattttttgaagtaataaatcaattagaacagaatcaaacgccttgacaaaatcaatatagataatgtcaatttgttgatccttttgtagagaattatatatatcgtccatcatttttaatatttgggttgtagtcgatctattttttaaaaacccaaattgttctttatcaaagaatcttgtactgttcagaaattctaaaattttgctactcaaaattcgttcaaaaactctacagacagtgctggttaatgaaaccggcctgtaatttaatggatcagttttttcgccttttttgaaaattggtacaaataatgatgttcgccatatttccggaatttgaccggaatccaaaattgcctaaatatatctgctaatatttttgtaattggttatgcacaattttttaataaaatgtaaggaacattatccggtgaagtggaattacgccggggaagtcttcttaatatattccaaattattcccgcattcaattcaatgtcagaaagtttaatcttattctgtgttgattgagtttgtggaccattaacaattgattttcttaaaaaagacttttgaaatatttctgctaatatcttacatttttgaacattgctggaaaacatatttccagcattatcaattagagtaggaatctcaaaaaattttgataacttatttcggataaatttgttaactgaattttgcccctgggaaataatttttgactcttgttcatttcttaatttgtacaattgttttttcatttccctagaaataattttgtaatttaaaatgagatcacttttttcaggaaatttttttacaagcttatgcaaacgtaatttctctgaaaataagtctcttattttttgaggatacgattgttttattatcgattttagaggcctattgggtataaaaatatcatataatttcagaactttatttaaaaattctttatatttctgttcaacggtgaacactgagtttattgataaatcaattcgattttcaagtaacgcctgacttaatttcgaaaaattaatatttttaaaatctcttctgtaaattttaggatttttatgactgaattttacttttattttaaatccaaccattttgtgatcggaagttgaaaaattttctagaactgtcaattcattaattaattctaattcactagtaattactaaatctaaaattgctttttctctggttggttccttaacatgctgtatcaattgtctttggtgcataaactcaaatagagaattagacgccggatcttttattttttttaccttattttcatcccacaatatatttgggatattaaaatcaccacagaatatggtattttcagaatcgctctggtcagaaatgaatttgagtagttttttagtattctgaatgtacaatttggtggacgatatatatttataatttgaataggttttttaaaaagtaattttatgtgaataatttcgctttggaattttgtcccagagaaaagtgtctgataagggatgtttgattttaataaaattgccgatcctccgccctttttatcatttcggcttgcaaagattatttgatattgattatttactgtaaattctgattctactgtgtttctgaagtttaaccaggtctcatttattataattataaaaggatcgtatttttgggttataagttctatgtcaactattttatttgttatcgatcggacgtttattaataggcaagaaatccaaggatttttctttcccatattcccaatatttttgtttgatttgctcgcgtatccctagcgagttctgagcgggcgggggtctttcagagatctgatctccaagtcaaccacaaaatacttatactcacctgcggcaatattggcctgataggcttgttgccgaagggagtataagattttgagctcactttgggtcatatccctttggactttgatatgttggggcacattgggcaattttttcacagcattacggaaattaaagagaaatttgtcacgtgaaaatttgtccaaaaaacggcacttttaaaatccgatccctttttacccctccttcaggccgtgtccttgggtggcggtgaatgtcgggcgacaatttgtctttgacaccgcattgttctgcaaattgctccaccactgcctgttggtccatcgcctccggcaatttttcgatgaccgcacgagtggacttctctttcagttgttcggagttgatgattgcctcggtaatcatctgcgaaacggcgccagtgccagcaaaaggcggcggttgaccccattgaacattgccgttgttgttggtggagaaaaatttattaaatatcattagaaaaaagaaaagacgcgattggaaattttgctcaaaatttaaacaaagcaatttaacgtatttatttaattataatagacccagacaatttaatattaataaaccatccattaagggaggaatttgttaaggtaaattttcgtcggcttttgtaaaaaaagctatttcaataaaggcataaatactcttttatttttaaggtaacaaaccaactttttgatgatttagacttgattattccaaacgaggatgaaaattttaatttgacaaaatgccaaaggacaaattgtcttttcgaattgtgttcaattaatctttgatttggacaaaattcctgtcaaacaattccccggggtgcttattaaatcagctgaaaacataattattatgtgttcacgtcaacattggcattcgaatgtgaattaaacaata

SEQ ID NO: 16479 - DNA, 2919 bp, Heterodera glycines
  misc_feature (586)..(586): n is a, c, g, or t
caagcagacgcaggggacgaaggcactccgccagggacaaatggcacgggtgccgaacgatgttcaacccctgcacttggacatggactgctcggactcgtcgggccgcatcccttaggatttatttccatgcctaagaaatggcaatacgaaactgactttgttcactgctggggatatgtcccgattaatcactcgttcattttgcgattggaccaaatttgttgtcgttttaataaaatccccaaaaactgtgggagaacgttgaaaggggggaagcagagccgaggaaggcgaaggcgacgaagaaacagcggcgaattgggcacccgccgaccgcgcggcattgggcccattgttcgactgaattcgccgttgtttctcatcccaacggcgcatttgttgtctattttaaatatttttgatttcataaagacattttctaatgcttaatcatatagttttaagcaatttgatacaatttccatgaacagagaaagaaatgcttcacgaattaagacaagcgaaaaatgggtggaaggacaagcagaagaagccaagcgcaaaaagccattgtctcaccggngcagggggggactccccggggttttcactcccccggctccccccccccaacaagattgcagagagtgtttaaagtggtttcttgataaattcaagaaaattgaaaaaagttgaagataatttatatttaagattttcaatgttttatttataaaaaaaaaaactgaacaaaagggccaatcagtgccaaagataagcaggcgtttgtagtgaatttttttatatgaaaaatttcgactttttagtcttcaatcttattgttagcttttttgggaattgcttagttgtttaaatcttaattaattcctttaaatcgctgagttaaatgtcaggcggtaacaggggtgggacgcgaccgcgattcgcggcgttttttcagcgatccgcgaccgcgggatttttttttgcgcggcgcgtcgcggattttttgggacaaattttttataagaaaattttttgaatcgattgtaaataaaaattatttgaaaatggattatttttctcaaaaaattcgtttcaaaattacaattttccacgtcggagctgacaaaaatctattatttttctttaaaaaatggctctaaatcaaaaataggtaatttttttacaaaatcttttatcaaattgcattcaaatttcaaaaattttctcgacgacgcctagcggcaccgccggacccaccccatctgttccccaaaagttttttagaaagagcgggccgaaaataaaacaaacggtgcaacaaattaaggcccctcgctcaacaaattttaagctgaatccttcctttgtacgtggaattaatcgtcaaaaaggggagacagttcaaaagtgattggaaattcgtactcgggttttcagtgacgagaaatcttacaaatgacaaaagtgcgacatagtgaagaaatagtgacagaagattgtcaaccaataagcagtcaaaaattcgaattacagagaaataataaatttaaaaaatagcaaacaaatttattcactcatttcaattgcaaaaaattaatttattattcgaaaatgcaaaaaatgagaaattctctttcaccgaaaaagcgattttttttattctatgctatggcatttttttaaaaatttttgtcaaaaatcattgaatttcagaaaaatctaataaatttctcaccgaaaagaagcgcagaaacaaacgaattaaatcactaaatttgccttctctgttgatgagctatttgtttttttgtcaggaaagatgcgtacgactttcgcttcttccaaccgatgcattctctgctcattctcggcctgctccaaggtcatcccaaagtgaaaaatgaacaattttggtacactcattgaatgggggggggagcagcagagaacggcagacaacaaatgccaaaatcgaagggaaagccaaggggagggggggggggagggggaggaatcggataggacgaatcgataaacccccgggggagggggaattggacggatcccaaagggaagacgggacggaaaggaggcgcagtttaaatatagactaataataagataaaaccaatcaataaaaaagtgctcgatcattcctccccgacaccacagatggaggaaggtaaagggaagcgatgggaagtgatgtccgcgaacgatcagcgagaatattttatagtggagagagagggagagagagagagttcgtctgcactcattcgccttggaatggggaataaacatcaaaaacgggaaccgcccactttggcgcggccattttggcgccctatataaaatggctttttttggcgccagagttgaaaaatctccaaaaattttcagaaaatttttagtttgtctttttttatggataattataagccattttctttaaaagaaccatgttaatacaattgctagcaatggtgcagaattgtggtgcctaatttaacttttatattttggtccaaaattactattcggtgggtttcgagggtgttgatcataatctgaccatagatttgactaattacgaaccccggactcaaattagaatatgtatactggatggactcgaaaattcgtaacacaacccaatagtcgatggtacacaacacttcaaataaaaattttatttttaagcaaaggaaaaaattgattttgacagggttagttctaaattttgaaaattttttaaaaattcttttacggcgccaaaaaagccattttatatagggcgtcaaaacggccgcgccaaaatggcccgggccaaaaaagctcgcgccaaaaaaacctcgcgccaaaatacccgcgccaaagtggccgcgccaaaatggccgccccaaagtg

SEQ ID NO: 16480 - DNA, 1647 bp, Heterodera glycines
ttttcatcagaaccgagcagataaagcaatttgatggatctcttcacttccgaatttaattcattgaagggacggaagccaaggtcaaacgcagccacgtggccagcgaactcatgaagcaaattgagcactttcggctgtccgttgcctgaatgtttgtagtaaatacggcgttgcccatggcttcacctccccccaaacccttggtgttttgtttcgtctgtgaagttgaacggagtttttcggccaattgatgaagtttttgaaggagggacgaggagttttcgccttgaaatgcttgtgctccgacgacaatcatcggatgtttcgcattttccaatttcttatttgacactgaccgtgaaaataatgggggaagaaaaaaacctttgaaaatgacgactttccatttaaaagatcgtccaaaacggaagaattgggccccaaataagtgtagtcataagtgaggtcgacattcgcaccgataaggccaatttcaatgtccgaatacaaatatctgaaagagaggaaggaaaggaaaaatacatattttcaaagcaattaaaaaaaaattatattagggcaagtactcgaatttacattttttcccatggtacgaagtctcccaatgagtttgtaaaacatcctcgcatatgtaaacaggcaaacatagtttaagaaattgtctaacaaaattaacttataagaaaatatgcgtctgcaaacattggacaagagttttaaattaatttaatccgttttttaccagtcttatattttgaggcattttccacacttacgttttgcgaattcgggcgttgagcacaggtgcttcgtaacgagggttagtaccaaccaataaaagtgcatcacatttctcaatgtttgcaattttgtcattgaacagataattggacctaaagtgaaactgtgaccatagctgtgcaagggggcgggtcagggggggggtcgtgaaaaaagggagaaaggaaaaaagggaaagaaaaaaaaagagagaaaagggaaagaaaaaagggagaaagagagaaaagggagcggcgagatcaaggaaagggtcgtgcattgcgttcgactaaccctgacatgagggcgatttgtcgaacgcaaaagtggagacttgaaaattgactatttccctaagaaatttggccaaaattttccaatttttctgcgttcgacatctgaataattcctaaaatcttgcctatttttttaaatctcaataaaaattcctaagttctcttaaaagttgacccaaaatcgcaaaaatgttgtcattttttggtgaaaatctgttaacaaagcacaatcaaaatttcaaaaattttctcggcggtgcctatcggcaccgcctgacccaaccgcccgttccccaaaagtttttcgaaaaaagtgcaacgcaaaaaaactgacatgaaaaatgcaaaaaatggtcgcgcaaaaaattggccggccgctgacaaaaggcctccgcaaaaaaaagtattgaaaagcaaaaaaaaaagaggtcttcaacggggcaaaaatggtcggccgcaaaaaatttgacgctgacccccactagggggggtcatcgccgaacgcacgacccttttcctgaccccccccccccttgcacacgtatga

SEQ ID NO: 16481 - DNA, 1338 bp, Heterodera glycines
  misc_feature (22)..(22): n is a, c, g, or t
aaaagcaaaaaaaggtcttcancggggtaaaaatggtcaccccgcaaaaatctttgacgctgacccccccctaggggggggggggcatcgccgaacgcacgacccttttcctgaccccccccccttgcacacgtatgactgtgactgcaattttcgactaaaatgacaacctcaagtcagtccccccgctaagaattggcaattccccttcactgaaaacattttccgagttgatttgattcagcagatccttcaatgcgattagagattcttaaaaatccacatatgattgcgttttggcgattagaaggacctgcatcgacgaggccgccggccaacccggcaattgcatttggagtgatctgacgaagtttttgtgccgctgtgaagagggcttcttcccaattgcagggactgaatttacaggagcatgggcaatgaatggcaaactatggaccaacctcagaacttccgactcatttttgagcatcggctgtaacagtcgctgccgcttcagcccgtcgcaaatgaaccgggctttgtccgacaaccattcttcgttcacttcctgtcaaaatggcaatggtcgactgattcacttatgccttggtcacttatacatcgttcattcgtggaattatcctcaaaatctctcctgttctgtgtgcaattacaatgtttgagcccaatgcatccataacgtcaacactttccgttttccgagtttcccatggccgggcaacgaaacttatggaggaattgttgcgcattattatcaataagggatcatataaagggggtgctcacaagcaccaagggccattagactaaagattgaggcagggggtattttggatcgatttttcaaacgaaggtccaaatttttctcagtggcgaccttttttaattttcgcactttttttgttttgcatttcgcctttttcaaaaaatttttgaggaatagggggggggggggaagcgtcgccgggaaaaactactagtttcaagggattacccctttcccccagtcgacctttttgttgctcatggtgatagaaaaaatatgtgccgccttttgtcaaaatgagtccccggcggtgacatttgccacctcattgtcagactaacaatgagtctgttttgaggctcggctattgtacagactgaaagtaatgggtgtacctgtactgtttgctggtcagtgcacccacggggcacaagtcgatgacatttccggaaagctcagaggcgaacagcttctcaacgtacgtcccgatttgcatgtcggaccctctgccggtcgagcccaagtcgggcaccccggcaatttcgttggcg

SEQ ID NO: 16482 - DNA, 1034 bp, Heterodera glycines
cagaatatgctctgaaacgcaccaaattttccttaccaggtagtttaggcactctgatgctttttctatcaaaaagggagatgaataaatttttaaaaatttttaattcctttttaaacaggccaaaaagtttaggcttatcttttttttcagaaacttatcagaagcgccccaaactttgcagggatactgaaaggaaaagaattaacctgttttatcacattagcttgtcatcagtttttataaaaaattttcaaaattctgagtctcctattattttatttttttttcaaaattttgaagggcggagggggggcgaaggcccaccacgaggccgcgaagcggccgagtgagtacctcggtgcatgaaaattattaaggaagagagttcattatttgtttattttttgcataattaattcataaatattttttccagaaaatgctctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatagatt

SEQ ID NO: 16483 - DNA, 1032 bp, Heterodera glycines
agaaaaatgtttgattattattgtttacttaataaagcacttagaaattgaaaaactcaccatagaagagataatctgttatagaagaaaattgagaaattattagtgaaattaagatttctcttaacagggtaggcgaaaagggcggcaatttgttaaaaatattaatacagtttagttccccgtttttagcatagtcgtttagatgtgaattaagaaagtaggtatgaatgcttgggaaaattttgttgtttaaaacagagcaaatagagcggtgtgcgaggaaatgcttatcgtttaaagtgggtcttgaagaaaaatcgacaaaaaatttaatgcgctccaattgcatgggcgcctgtaaattcgaaaccagcacaaaaaataagcctcatggcaaaattccagcgcaattggtcgggctataagcatggaattaccacaaatttcgacgacattcaagactgctttttgttaaaatatgaacacatatttaaccggaaataatgaaaggtgtgtgcttgatcagactttatcttctctatttgttacactatcgattgcttatagaaaattgcataagatttatacaattaataaaattacaaaaaaaaattgtttatttaattgaccttttccaaaacataatgaaaataaaaaagcctatgattttttaaatgctttgcaatcatagaaaaatgtttgattattattgtttacttaataaagtacatagaaattgaaaaactcaccatagaagagataatctgttatagaagaaaattgagaaattattagtgaaattaagatttctcttaacagggtaggcgaaaagggcggcaatttgttaaaaatattaatacagtttagttccccgtttttagcatagtcgtttagatgtgatcccagtgtaattaagaaagtaggtatgaatgcttgggaaaattttgttgtttaaaacagagcaaatagagcggggtgcgaggaaatgcttatcgtttaaagtgggaattgaagaaaatcgaccaaaaa

SEQ ID NO: 16484 - DNA, 1144 bp, Heterodera glycines
  misc_feature (113)..(113): n is a, c, g, or t
  misc_feature (118)..(118): n is a, c, g, or t
aaataatgaaagtgtgtgttgatcagcacttatcttctctatttgtacactatcgattgcttatagaaaattgcataagatttatacaattaataaaattacaaaaaaaaaanttgtntatttaattgaccttttccaaaacataatgaaaataaaaaagcctatgattttttaaatgctttgcaatcatagaaaaatgtttgattattattgtttacttaataaagtacatagaaattgaaaaactcaccatagaagagttaatctgttatagaagaaaattgagaaattattagtgaaattaagatttctcttaacagggtaggcgaaaagggctgcaatttgttaaaaatattaatacagtttagttccccgtttttagcatagtcgtttagatgtgatcccagtgcaattaagaaagtaggtatgaatgcttgggaaaattttgttgtttaaaacagagcaaatagagcggtgtgcgaggaaatgcttatcgtttaaagtgggtattgaagaaaaatcgacaaaaaatttaatgcgctccaattgcatgggcgcctgtaaattcgaaaccagcacaaaaaataagcctcatggcaaaattccagcgcaattggtcgggctataagcatggaattaccacaaatttcgacgacattcaagactgctttttgttaaaatatgaacacatatttaaccggaaataatgaaaggtgtgtgcttgatcagactttatcttctctatttgttacactatcgattgcttatagaaaattgcataagatttatacaattaataaaattacaaaaaaaaattgtttatttaattgaccttttccaaaacataatgaaaataaaaaagcctatgattttttaaatgctttgcaatcatagaaaaatgtttgattattattgtttacttaataaagtacatagaaattgaaaaactcaccatagaagagataatctgttatagaagaaaattgagaaattattagtgaaattaagatttctcttaacagggtaggcgaaaagggcggcaatttgttaaaaatattaatacagtttagttccccgtttttagcatagtcgtttagatgtgatccccagtgtaattaagaaagtaggtatgaatgcttgggaa

SEQ ID NO: 16485 - DNA, 1525 bp, Heterodera glycines
taaaacttttttgtagagcattttaaatgctatcgaatggtatactatatgaagggaaatttttaaaaaattttcgagctagtccccctagaaattttcggaaatttttctaggctcgaaaagggtggtgaaaaatttttttctggggtattttgaggtgctgagctcgaatctgacctttgttttttgtttcggaatttttggaattttttaaaaattcgaaaatatttttcaattttttgcccctctggaatattgtataatattgaaaaattcataactcagtgatggtttcatcgatttaactataataatgctttaaaaatagagaaaattcaggagaattttataggatttatttggaatttctatctctaaaaataaaaaagatattccagaatttctggaaaaattcgaattttcagaaaaaaattcagaactcggttctgaaaagtcactggtgaaaagtaaaatactacaaaaatccgcaatttttttctctataagataaattttatttcaagtttttatcatctttctgaacattgttataaaaataaaactaattttgggattcgggaccaaaggggtgagcataggatttttgagtggaaaattttttttcacaaaattcttccaaaaatatgtctttaggggttatttgggccgctgatcacgaatacgtgatcagattttacttttgacataatcaagacctcagaatccctgtgtgattggggattctgggcatcattttgaggggggggtgggaagttcggatccgggcggtgtcaattattttctttgcattttatcattattttctatgctttaaataatttaaatgtttttgtttaactaatatgaaataaattaattatttacattaaatttaatttagcgaaaccgtcagtccgctaccatttttttcgaaagctagcgtagcaaatgcacgagcgtagagtatccagtgtaggatatctacactactcccacagataagtctataaaagggcagcgaaaccgtcagtccgctaccatttttttcgaaagctagcgtagcaaatgcattagcgtagagtaatcgcttcctcagatcatttttgaaaaacctagcgtaggattcctacgctgactaatgacatagcgtaggattcctacactagcctttcatacactaggctaatgtagttatcctactcgagctcaaagtctataaaagggagtggaaaatcgcttcttcgtatcatttttgaaaaacctagcgtaggattcctacgctgactaatgacatagcgtaggattcctacactagcctttcatacactaggctaatgtagttatcctactcgagctcaaagtcgtcaaaaaccggaacttgctcggacccaacccacgggtgggtcgtttctgtccctaaacatccattagtcgtctaacgactcacacggggtgggattctcccttttgggggtgggtcgcttataggaggaactagctccggcccaccccacggggtgggtca

SEQ ID NO: 16486 - DNA, 903 bp, Heterodera glycines
ttaatcttactttttaataaacgatttccttaattatttaattttaataccatgattgtaccctttttaaccattgttgtaccattccaacaatttttgtcctctcctaatcactgttgtacctcttctaatcactgttgcacctcttctaatcactgttgcacctcttctaatcactgttgcatctcttataatttttttggccttcgggattttgggttaattttcgaaaattcataacaaatcgaagggtggataaattttcatgcaattatattataaaaatagagaaaaatcaggagaattttatgggatttatttgggatttctatcttaaaaagaaaaaaagttattccagaatttctgaaaattttcgatttttcagaaaaaaattcataacccccttctgaaaagaaatttttgaaaattaaaatactacaaaaatccgcaatttttttctttataatataaattttatttaacatttttatcactttcttacgaattgttacaaaaataaaaccgattttgggattcgggaccaaaggggtgagcataggattttttagttgaaaaattttttcaccaaaaatcttcaaaaaacccggacggtgtacattatttttatatgcatttttgggttattttcactgtttttaattaatttgaagatttgttttaaattatttaaatttattttttttaaattaaagaaattattttttgttttattattaataacaaaataattttaattaaatttaatttttcttttgatgaatagatttatttttaagcaaaattagatttaaaaatttggatgcataataattcatttcaaaataaagtaaaataaattattccgtttattaataaaaataaacttttacattttttattatt

SEQ ID NO: 16487 - DNA, 2505 bp, Heterodera glycines
gagcagggcatcctcctgacgggtcatttcctccactcggtcggcatttgcgacgatgtcggccttaaaaataaatatttaaaaaatataacattttttgagattttagaaatgcattttactgcaatagttgatgctttttcaacaaattctcaatgctggccaagtcccgaccgtagtcttcagaggcgagcagtgtttcgacctgaaaaaatgaaaattgtataaaaaatgtttaatacattggtaatatcaaaaaacaatttaagagatagaaaaattagtaataaaaaagtaaaaaaaattaactaattaaaaaataaaataaaaaagtttttatcatttttatcaaaaatgattttaaaaaaaaatcgcatcattcaaattgatgtttttaaatagtcaaaaaatatcactaaatctcggaattcagtttaaaaaaatattcaaaatccttaaattcttaaatttaattgatttatttgcggcaaaaactaatttgaccgctagtttcttaaaattcttcagaaaatttgtaattttatggcgtagtgtcacttagattttcataatttttttttgaacttttgcagttaatagagaacatttagggctatcgaataataccaagaaattaaaaatttggctgctttagagcaaagttataagtagggataacatttatagttgctaaaaactgccaaaataattaatttttagtttctaaaaaaccccaaaatagttgctaaaaatgggtaaatagttgctaaaaacttcaaatttatgggggtgtaaaatcgtaaaattttaccaaaaaaggcaacaaaattaattcgaaccagtattgagataaataatttttaaaatcacaaattcatgtcaaaaaataaataaataatttggagatgaatttttgagaaatttttcatttcataggggtgcatttttgaaaaaaaatttgagtccattcttaagcgtttatttttgaaaattttcaaaaagttgatccttaggggtgtattttttctttttattgcatttttgttaacaaattttgggcataacgccaaaatagttgaaaatagtttttttcaaaaattttatagtttttttagttgctaaaaataaaactgcgactgcgaagtttaattttattatatttttaacatttttgaaagggattttgaaaaacttgacagctgtgaaagtgattacagataaaaaatgtacagcgataccagtgaacagtattgagaacacaggctaaaaaatatcaaattttcagtatacaaactgcaaagacgaagccaaaggaaattaaagcgattgataaaataattgctaataactcgaaaagtagcttaacgacagccgaaaaaaacatgtttttcgtgcatttcaggctacggggagctcaggaaaaaaatagtgaaaaaattataaatgttatccctagttataagcaaaatttttataaattttgtgaattattataaaaatcaaggcattttcgtttttaacattaatgtcaacaaaacgagaaaaaattgaataatatttaataaaattttttttataatattacagaatattttattcaaaaattttccatatgtaaaaatgcatttgtgttatttattatatttttttaattttttttttgtaaatgactccggcaaaatccgaccgaattttgatgaaatatttggcgatttataggacaaaaaaagaaagaatatgccaaaatgtggtaattaatacgaaaaatttgtcagtaaaaaagtttttttggaaaaagcgccacaaagggtcggggtcacttcaccgcggccaactcgccgcggacaattcgcagcgagtttctcgccgcggcgctttctcgcccccgtccaactcgcctcgccttgttttttggctattcgccgccgtgtacgtgacgtagagtgcatgtggctccctttccggttcgcgccaatgggttttggttaacatttcttaccaagtgccaatgggtcagcataggggaaagcccgggggggaggggggggggagggtcactgccgccgccgcattcattcgctggtcgcgcgatagttggagacagaggcgaaagaaatggtgccacaaacaaaaattgtcagcggcggagggaaagcccatcaacagcagcaacagaaatggcacaaaacaaaaagcaaattgtggggaaggagcaaatgactgtacgggggaggggcaatgagaggaagaagaggagagagtgcagaagacgagaggaacgaagagagaggagggcacaaagagagggcaattggatgagaatgagggaagagagaatgtgtgagaaagaatgcagaagacgagaggaaggaagagggggagagaaagagaaaaagagagagagaggaagaaggaaagagagggggggggggagactggatgaggaagagggggagaggaagaagtggagaaagagagagaggagtggagactggatgaggaaga

SEQ ID NO: 16488 - DNA, 1706 bp, Heterodera glycines
tcctggtgtgcctaattaatatttaattaatggaccctcccacctgattgctcctatttatagataatataaaacaaatactcaatatggaacgcacattcatctgtttgaggcccacaaatccgtcgccggttggacgagtgattgcccgctttgagtctaatggactcaaattgatcgccatgaaaatggttaaaaatttaggattttttaaaaatataaattatattttttttcagtatttaaattaattaaatctttttaactttttttaaattatttaaattaaatttttagattaacgctacacgaaatcaagcgactgagcattacaaagagtacagagacagaccgtttttcaacaaactgatcaactacatcacgtcagggccagttgtggccatggtctgggaaggtgattaaattggaattttttttttaaatttaacctattgggtcaaacaattttattaaatctaattcaaatggaaaaaatatcataaaaaaataaaattattaaaaaaacaaaacaatattttcataaatctaatggttgccaaataaaaatttgtcagcatataatttttcgtgttaattaaaaagtaatttaaaaaattagtaggacacatcatttcaaaatttaattcaaatggcaaaaattaaaaattaaatcacaaaaacaattagaataaacttgcattaaaaatttaatataatggttgcaaaataaacaattttcattatttatttctcatattaattaggaattaatttaaaaattaaggaattgactcagtcaagaaaagtctgcatctgctggagtcggcatgtttctacaatttgagggtgaatttgatttaaaaaattagaaaaatttttttattttattattttagaatatggatgagtgccgtgacattgtgcgccatggttcgtgcaatgtgcaggacgcacaacgcaaaatcaacatttggttctcaccaaatgagttgcgcattaattccacaagcagataatcccaagcgaaattattatttttttcatttttattttaatttatattaaattgaataaaatcatcatttagatttttattcaaaaattaaaattcttttaaaatcattttggctttttttcttttacttttcaattttttttaaatcgatgtgatatatatatatatatatatatatatatatatatatatatatatatatatatatatatatatatatatatcatttttattagcgttctacatgcaataatattttagcactaataaaatttttaaagaaattatcattaaacatttagacaaagcaaaaataaaaactgacaaaatgttttttcgatggtcaattgcgaagaacttgctggttcggcagacaaggcaattttcttagccccagaattttcaggattcgacgacgcaaacattcttttcaaaaaaaaaatacaaaatgccaattgaaaataagaaaatttaaaattttttttcgtcctttttcgtccaaattccgtctgacgaaaacgaaaacgaaacgaaaatttcttgaaggacgaaaacgaaactcaaaaagagacgaaaaaggggggcgacacgaaaacgacacgaaatttcgcacacccctgaacggcaccgaagagggggaaaaagtcaaacgcgagtatgccaatcgtgccccccaatcaaccaaacgaaa

SEQ ID NO: 16489 - DNA, 1090 bp, Heterodera glycines
agcaatacaaaattttttatgaaaaagaattttttttattttatgtaataaaaatagtcctaaaaatgtttggcccttcaaaaataccgttaattatcattgccttctctattatttgtgctcattttggccaaattttgtcaaatcctgatgataacgatgctgatggatgccttttatcattcaatcaaatcggcgaatttattaaggctgttaaagagccatttttaaacaaatcatcatttttggacgcccaataaataacggcaccgaagaggggaagaagagtattggacagacaaattgggtaggaccaattcacaggactgatgagtggtatcatagccacctgtgcttttactacggcccccggcggcggatggttaaaacgctttaaagaggaggcataaagagccataaaatggaaggattaatggaatgggctggtagctaagattgtaagagtggtttggttttagagaagccgatcgccgtaccgaagtttgagtgtagtgatgctcgaaagtctgtccccagtctcgactcgtgtaaagtctcgagtttttttggtctcagtcgcttggtgcgggaaccttcagtctcaagcatcactagttgaggtttcggttccatcaatctcgagtttttgaccatagttttttatttaatgttgaggcataatgccacatcattggttaaagcatttttagcgctggctttttaggcaacaaaatgatttacatcggtgtccgactcgggacaatcgagctaattcggtcaatcaattcaagaatttatggagtacaacaaatgatcgttgactgtgtgagtaaccaatgcgctgatcagcctgacaattgccaagagatggtcaaggtggcaaaagcacagctgagtgtccgtctgctgatcacaatggccaaatactttgtcgaaaatagaattttgtaccaaatttacaacaatccgttacaaaaagcccggctttgccaatggtggcaccgattcaggtagtggagcatttagccaaagaatccttggcttatgcccgtgctgagccgaacctcaaaaatatcattacggattacgg

SEQ ID NO: 16490 - DNA, 2602 bp, Heterodera glycines
tgaaattttttttttaatttatgaaagaaaaaaatttccctcacaaggtcatatactcgaaacaattttgaatttctaccctttgacaattagaaaaacaagttatggcctatgaaactttgaacgcgtaaactggaaaaaagccaatgaactttaagtaaaaaaattttcaataaaatattttaagtgacaaaaaaaggaaattttaatcaattaaatgaaaatcaacgaattactagtttttttttaaatggatctgtataattaaaaatttaatttattaaaatacatattaagtcatacctccgcaatgactcaccattctcttttactttttttattcggtcaaattttgcaaattttgttcggccaagcaaatgccaatgccatcgccagtgttgggccacgttttgggccaacccaattgcaatgtgtggcgggttcgaccaaaaaattgacacaacactggaacattcagaattgttccgcaggacaaagttgtgtggcatacgtttgtgcccatggtatgaaaaattgtgtcatttcaaatcatgattagcaattataaaatgcctaaatgatttttatcattttaatgctaattatattacacgtctcatgcttttattaatagttttatttcaaatattccctcgatttaaacaaaatttatataccgaatttcctagatagagccagccccctggggctttatttttcaacctcctcaaaaggggctttattttaggagggcattaattatggggggggggcgctctatttaggaggaactattttaggaattacggtaaattacttcactaattggtcttttacaatagaggaggctatatttagattatgccggagagccggttgaggtcgtcacaatgggatgtatggaaatgcacttttgtcgcgttgactcgcacattgaatgcctgtacaacggcggtgcaatccttcggatgtgcgacgaatgcaatggcgagcagttgtgcaacgcgaaggagggggccaagcttgcgcaccattccccctcgcttgccgcctttttgcgtgaccgattgcagcccgtagttggacaacaacaatggctgcagcagcagcaagctgctcatggcatacatcaggctgctgcgaatgcgatgcaataccaacgcgtacacccggcgcccaaggctgcagcggcagttgctgcattttttccacctcatgcaggctcagttcagcagttgcaaccacctgcagctggtggttcagtgcttacgcagcaacctgcagcagcgcatgccttaagccaagcacaagcagtgcagaagcagcagcatgcaaatggtggtgcaaaaggattgcaacatcctgcacatggttcaaacattttgctgcattctgcaagtggctcaaagcatttgcggccgcgtctaagatgcttcgtgggcagtgaaggtcaattgcaattggtcacatgcagccaaagcgagctgtgcacgagcagtttatgcgatactggtaggaaaaaatttttttattaaaaaaatgaataaaaatcccaattattatgcaattttatcatgaaattttttatttttgcaatataaataataatttttttattttaaaaataaaataatttaaaagttaaaaaaaactattttaaaaattaacaaatattttttcagttacatgcaaaactaccttcaaaaaatgtgcaatttttttacatttatatttgcatattctttgacattgttcggttgccaaaaatttggcacttttacattagcataattttttatttacaaaattagtagatggcgaattgacggaggtgaagttctgtggcgtgccacagttttgcacaatgacaaacgatttgtgcaaacgatttaaccgtggcatttcgttgaactgttcgcagtgcgacaccgattcgtgcaatgggaacagcgcgttcgcactggcatcattggtcaaccacacttttcgggatatcatggccgcaaaaatcaacactttgacagcactgaatggcacaaaagtgtcaaagaagacggaggacgataagaaaagcaacgacacaacgccaaatgtttgtgtttaactagagccagaactttgagaatatccggaacagggcccaggtttgcgagtcagaatccggacagaatttcggttaaaaaaagttattttaacaggacttcgggtcatgttgcatttttgaaaaaaaaaataccggacccggtctagggcccaaaatcttgtacaaaattctttccttccatataaaaaaaattaaaagaaaatttaggaaaccaagatgaatgccagacagaaaaaaaaggaggaggaagaaataaaaaagaaatttgaagagatcaagaagagagaggaggaagagttaaaaaagaggaaggcagagaaagagaggaaggcaaaagagaaagaagaagcggagaagaaggagaaagaggaaaagaaggaagagaaaaagaacagagagaaagtgaaaggaaatgaaaaggacaaaaaggagggagagaaaagagcagaagaaccttgtagagaatcggtgttacaagtgataggaagaaggaagaag

SEQ ID NO: 16491 - DNA, 665 bp, Heterodera glycines
gatgcacgaaaatgtgccacattttcatgtgcacttgctggtaatgcctaaagtcttggggttggtctcgctcgatgagtcaagaaaagtctcgttttttaaaaagacaaaaaacgaatcggcgtaaaaacgaattggccccaaaaacaaattgggggtcgtctgtttttttttggtattgatgtcagtcttgggcttttaattctcgattcggcaattagtcaaatactattttcatgtctgtaaatgtacctctaatcattctgatcatcatatccatgatcagaaaagaaggaattggtgatcaaatcatgcgcgccgaccgacccgaacaatgcgtactggagagagggcggaatggcgtcacgggaatgtgccaaattcaacggcactctgatcacgaaacatggcatcaccatgtgcaatgagtcattgtgcaacaaccgggcaatgcctaacactggtgtacagtttcaacagctcgtgttcatcacctgtttcactgttgtttacggtaacgatgaaaaatacggtggataatatatgataaaaatttttagcattcgtagcgctaatcatccatcattaatcataatacgaacaatgaaatgaagagttgatgacagtaaaaaaaatttaatttacaatatgaataatgctttttg

SEQ ID NO: 16492 - DNA, 3502 bp, Heterodera glycines
ttttaagttgaaatattttttattaattaatttaaataaagtaaaaaaaatataaaaaatgttctatcacggtggggaattgaacccaagagacaagtaatgaaggacataaggtatagccactacaccacataatgatataaaatcctttaaatgaaataaataattaaattttttctctcaaaatttacttttccctccaatttctttctcttttctcatcagacccccattcttaccaatgcttatttagtcccgccgggaccgggactagcaaaaccgggaccgggattcctgtttttccaaaaaccgggaccgggacctgaaaaacccgggaaatcccggctcggtcccggtcccggtcccgctcaacttacttctcacccatccccattttttttgtttcaaatcttggtgggggggggcacttgcctcctccgaaactaacaacaaaactttttttttattttgaatcggaataattcccttcgtaaattcgtaacttataaaccgcgacaatcttttcttccgtgctggctcctcacgaagttaaattctttcttttttcccttttaaattgttaattcttattattgcaactcgtacccaaatttttttaaataaattttcaaaataaaagctagaatttttttgatcggggtccccgagccccttgaagcgtgcgtgcgctctccgaccccaatcccgctgacttgtccttcccgccgatgttccacgctccccgagaattccttctccgagggttcgttgagcaacctaataatcaaattacttcttattaattaaatccataaattaagcaattaaattcaacccattttatcattgaaattttaatttttatcattgagcaaattcacatatattatataaaaatacctaaataaattattcatattttaactcataaattcaacagatatgctataattatagaaagtaatgttacaaatcgagtattaaattatataaatttggtgaaatacatatttaaaaaaattaaacagtgtctagatcgaaaaaaacggacaaaaataccgagcacattatgcaagacaaacaaaaacaaaacagcgaaaaggatttatttatttaaaacaaaaaccaattttaaaagaataaaattaggcatttaaaaatgattatttgaatatcaaatttatatttaaattgacaaatttgcaacttttatacggaataatgataatttaaaaataaatcattctaaaatacatcaatattataacatgaagaataaaatattgaaaatatttacgctacgatttagaaatttattatttttcctaaaaattaagcaatatttagcgaatgaccaacgaaaattgaggaaatcaaatagcgagagtaaaaaataaatacataaaaaggcaaacaaataaagtttaacatacatatatcaataaaaaaaagcaaaaaatgagaattgaagaacaaataaaacaataaataatacaaaaaataatttatataatttttacaatttgtctaaccaaaagaatttgtttataacttttttaataaatggcaaaacaaaacctttaataatttttttattttcaaataaatttttggcttttcaatattgggttcctagttagaaagtattcatataaatggtcatattgaattcataaatcatataccacacttaagaactttaatagataaattagaatattttaataatggtgattataaaaatcattttcattattaaatttaaaaattacattgcaaaattaaatgaagattaagtttgaaattgggtaagaatatttaataggtaaattatgtaattttataatttactccgaaatttcaactattatttgtctcccgtttttaagaaagtgtagaaatgtcgctagggctcgtctaattgtgggatttactttacccttttacaaaatatagctgtccacggtcggctgatttcggctcttctcttgccaggaatttgttttccttttttccactgcttgtcgagggatttacttttccctttttttcaattcgaggccagtccaatttgtatttgtccactgctgattcaccagtgccaggagcgccaagtcgtacaaaacagaaaagggatagttctcgggggctttaataaatgttgttgtacagcacacagcaaaacacaacaacccaaagcaaacacaacaaaacaggccaatgccgaagacaattatttatttcaattaaaataagcgaggacaaatcaatagggaaactgccgaatgcataaactaacaactaacaaaatcacaaacaaaaatgacacaaataaaaataacaaaacaccaatatatatttaaatctcaatattatcacacaacaaaattaagcaagatctttaatgagttacataattttttaaatttaaaatcgttgtcaagaaataaatttaaaaaatttaaatacgaatttttgataaaattttcatttcttaggggtgtattttctgaaatttttggttagattcttttggatgttatttttctgtaatttttgaggtcgattcttagggatgtatgaaaaaaaatttttttttctgagttttagggtattgtgaattttaaaacgtatccctaatgataacagagcaagtaattcattcttataatacagaaatataaagaatttcatccttcaaccaaaaaaaggtccaaatcaccaagaaattaatatcattgttttgtttggcataacaaatgattaaagattaaaagaaaatattctaaagaaaaataaagaaaaaagaaatacatttaaaaataaaatattcatttaagaaatcagaatttaattattttaataacattgaaaaacaaactagttattatttaaataagtaatgataccactaaataaaagcttaaaacaagaccaaattatcaattatgaatttgttaaagaaaaaagctattaaaataacaacaagcgaataaataaaagtgaactaaagcataaatttagctcctttcaaaaaaatattattttatgtaacaatgaaattttttatgtgaagtaaaaaaaaaactttacaaataattacatttatggacaagtcaaacacgtaaacaaacaagcataaaagcgagataaatttaaatggtaatgttaaacttattaaattttctatttaccatatttaaaatgacaggaaataaataaatgaataaaattttgaaaaaaatattcaggcaattaattataaaacaattaattcaagataattcaactcttgtattccagaaacaacgcctcaataaacttttagtttagattcattttaggataagtaataaaaacagagccacaataaacttagatatcgaaacaaaatgttcttaataattacaattaaacaaaaaataaaacataatgaaaatttactaattataattctatcggggagttcatctgctcgttttgcgaaagatatatatcttcc

SEQ ID NO: 16493 - DNA, 1811 bp, Heterodera glycines
  misc_feature (29)..(29): n is a, c, g, or t
  misc_feature (81)..(81): n is a, c, g, or t
tgacttgaaaaattttcagaaaatacatncctaaagattgaaaaaattttagaaaatacacccctaaagaactgaaaaatnttctcaaaaattgatcgccaaaattcattttttttcttgataaaaaattctcggtttaaaaattttccttattcgaaaaacattataaaatatttaataaccatttaaatgaccaaaattaagtttttggttaagttttacgtgttttgctccctaaaaaaccttagaaaaatttttttaaatgcctttattcatacctttttcgggattttcgtgccttttcatgcctttttttcaattttttcgtgcctattttagtgcctttttcgcgatttttggtgccttttttgcggtctagtcattacacaggtcaaaaatgaatgaaaaatataaagaatatttcgaatttcaattactaaaaaaaaagtttgccaaaacaaaatttattttaggggtttagaaaatttaaaaattaaattatttttcatgtgctttgttttgtgttttggggcttaacatgaattgcttcaaatggattttgttgtccttgcctatccaactctgctgataatttggtgccgttttggcattaatttgccatcattccttgttctcttcccatttgttgtcttttcccattgccttttgtcttctaatttatggccattgtgccaccaccattttctgaattgtccaacaaccaaaaagtttccattacaccttttccccaaataaaaataaataaataaaagtatttcaaaaaaaaataaaaaagaatttcattaatcaatacaaaatttaattttggctcaatcgccaggacgaacaatctctctcttacttttttgttgaaaaatagagcaatttttataaaagttttttcattttggtcgcctcgcgaaataaaagatgaaaaaaaccttggaactctttataaagcccttaattcatatcaaaggcttctaaaaatccattcattaccatgccaattaaattaatgaccaaaacaaatgttttttcttcggctggttctcaccttaatgatcatttctcctctgctttcaattatataaccgcaattagaattttcgagcaacaaattgcgcgtttccttggaactgtgaattttgttagctgaaattaaaaaagaatttatttaaaaaaaattcttatttttgaaacagaccggaagaagaagtttccatccgagacgcggtgttcaccgagtcgccgaacaaacagaagcgaggcatggccaaacctgtaatcggataataattttataaaaaacagaaaaaacatatatacgattaaagggattaataataactttcatgtaaatattaaaaattaatttttaaaaggtttccctacaaatttaccgacaactcccgccacaaatggcccactgtgcagcccaattctgtctgtctcatttattattatttttctgtgctaaaattatatctgttttgctcctcccaattttcaccttcttttatttgttttaatttatttcatttctctttcacaataaatttaatttctgttgttcctttgggacacaacaaaatcaagcttttttccttttttatgggaccacaataatgttcactattaataattttctttcttccacattcatccacaaaaaatggagttgaacagcataatttggccataattgacgagaaaagcggcaaagggacggttggccacaaatttgggcggtgccaattcactgcaagcgctgcactgcacgggacgaatgattgtgacagccgcggcca

SEQ ID NO: 16494 - DNA, 2323 bp, Heterodera glycines
acagtgttcgtttaagtgccaatttgggccaaataaaatgaaagtgattggcctacaaaaaacactcgctaatgtcattttgtttttcattgtttttgaaaacagaataaattctgaaatttttctgctagtaaagcaatccaagagctgctatattacaaagatttaagttggttgtttttatgcaaaattctgatgagttttttggcaaatctataaaattgggacaacccttcacagaattaagggattaatcagaaaaaataatatggtattgtctaatacacaagagggatagtgggtcaatcaccggctttaattcaagacattttttaatttttttttcaaatttagaatgataaatgacttatttggggtgtggggggtaaatatagaatatctcgtgaaatttgaatgaaagtgaacaaaaaaaaaaattattaataaaagacgataaagaagatttaaatgcaaaaacatacgacttaacattcctccatgctttattaaaatattgtagtgatcttgacaaattatccatggaaaattgtgccaaaaagggcaagggcatcactgttaacgacaacggcgaagaaaggacgatccgcaatgaaacgagccgggctatttttggcatttattaatggcaccaatcgaatgcccgtggcggcggtcgcttcagttccctgctcattgacctaacaaatgaatgaatggacagagtaattactaaatgacactgatagtgctataaatatgattaacagcagaggcattgcagggaaaaaattcagtaaaaggaagagaaggcaaggcaatagcaaagcgaagacagaaattagtggataaactaagcaaaatttagcacagagagacaaaaggaaaagcattggaaatgcagggaaatttaaggacaaattaagcagtaaacataaataaagttataaaagcaagtgaaaagaagcaaagaaaagatgaaagtttgaataatgttttaacagaaaagccaaaatggaaaaaattttaattaataaaaaatttataaaccatcatttttccaaataattattccactgacggatggattgtccgcggtttcaacccccgctgaacaccggcggatgtgttgccgcacgtaccctcccctcgtaaacaggggtatgtgccaaattcgtttcatttcggatttaaaaattaattctaaatttatatttcgtttcgtgttagtgaaagataataataatattttagtttcatcagctcggaaatagagcagctccccccaccgggcatgacctcatttttgggcattcacttcacctcaatgaatgctttctgcacaacgtcgctgatcttcaacgaatcgccctcggcaatgccgtcaaaatcggcactgtcggagaaagcgttcgccattcccatgctggccaacgattgttccaattggagcgtggactccaacttgaactttggcaacacaacctgaaaagacggggggatgaatggcataaaatgatagatttttgcgaaataaatgatcaaacataacgccaagcacacatttggcgcataattttacctgcactttcattttgtcccgctttttggtcaattccagcagccttttcccgtccaaattggccaacagtttagccaacccaaagcgatccttcggcaacagcacaaacatgaacacttcaccacctttgtagggcatgccgagcagttggagctgttcaaattaaggaagggacacaatttaaagaaaaggggacaatggaaaacggcaaacaccaccaacatggccatcctcaaaataaatgaaatcagctgtcttgtgcatcatttccaactgaaaaaaaataaaataattcattttttaatccatttgagtgtttacaaattttacggttttatgtgttcaagtttcaaaaaatttttggtttcgttttaattcatttaaagcatttggagtttgccgagccgccgccgtgcaaattttctctgaatttttggtgaattcgctgtacaaaattgtcaaatttttaagccaaattttgtaaaattttgaaagacttaatttctaagattgggatgagtctttccaatcgtttttttgcgccacctcttttttgttctgttggtccacaaaaaatgtcttcttcttggtatattttgcgttgaatcgctccgcccaattgcccttgaaatagacagcgttgaccaacaccaagctgaaattaaacaaaacatttcatataattaaggcattttgaattttttaaatttcctcgtaaattggtccagagaggttgggcgagaa

SEQ ID NO: 16495 - DNA, 2599 bp, Heterodera glycines
gttttggcgaattgactgcatcaaaatttaaaaatttactccatttcacttaaaaaacgccaaaaaaaaaaatccgtaatccgtatccataatttatactgatcaggatcaggactacggactagacacctatacggattacggactaaaaatccggaaaacccgtactccgtaaaaatccgtatacggatccggtccgtacccgctctctacttttaatggtataaaaaattttttggaagggggggggctttattttaggggggttctaatttagggggagggctgtatattaggaaatacggtatattatttttatttggtagaaaaaagacataaatgaaagtggattaaacaatagcagagctcacaatcacaaaatagcactttagcgaattttctacgatttccccatttttcatcgaattttttcccagtaaaattctggcggtgcccaaggcgtcgtcggggaaatttttgcaaaattataaagatttaaatcaacttttaaaaaaatcacagactacccggttcggctccctccggcatcccttcgtacattgccaatctgcccgatcatgctgtgcatcgtgccgatgattttttcgccgacttttcattgttcgccggcactttggtcatgccgttgcccaacacgcttcaggtgccacttcttcacaattttcaaaataggtatttaatttttagttttttcacttttcaaacaaaaacaaatttttttgatgaaaataaaatctcaaaaagactagaaattaaaaattttcattttaaaatttttttgtcgtgctgtggaggagggaacacaacctaaagcgttaacgttcgccgcgacatatcgtggccgcaaaattttttatgaaaatttccagggaaaaaattagaaaaatttattgatttcaaaatttttagcctcccccccccgcctcctcccgctccttccaaatgagagcagctcatcccctggtcggttcccccgcatcatttccaccccttaaacttaattcaaatttttttcacaggacgccgtcactattctgatggacagcgaacggcatggtcctgttagtgccgcggctttggcaccaaatttttgggggcggctcttacttcgtgtcagccacccaactgatgcagcaaccgcagcagcaggtcgggaaaacagttcatatattgttttgtttgggaggttcgccccaaaattttggcgcccgaaatttcgtcgacgaaatttcaaataagcgttggcctaaaaaatccattcgcttttctttcgtcggattttcttacatattttcttattggaataaatgttttttttttttttttgctttttcataattttttattttctgccactttttacacagatgcccttctcccggtgcaacactgttcttcattctcaccattcgactgacaacgccctggggacattgacgcagcgttggaaaaaaccgtcgcctttcatccgagtgatttgtgatgatcacttacgatcacgatcaaccttccgattgatcaacctttcgttcaccccaaaaaaattgttgtttttcccaatctattttattaattgtttttttgccaaatttagactttgcaaaattagagtcaaataaaattttcatctcaaattttttcgcgttcgacaacttttgcccctgtgaagacttttttatttttattttttttttgcttttcacatccttttttcgcggcgccctttttgatggacgaacaggcttcagcggcacccggtggcgagagaagcggcagaccaatggaccggacgagcgaggccaaaaaaaggtagggctctttcgccctaaaagaggttgaaaggattagacttacagttcggaatgttctctcgtaaaaatgacattttttgtaattttcaaaaaaaaaattagcgcgccacaaaaaattcatttttaagctgctttttgaacgtcaggttcaaattcttagaatttgttcgcaatttttttaatgcttttttagctgatttttacggtcggaatcagggatggcacggcacggaattccgacttccgaaatttttgataaaaagtcggaatcttgtacaatttctgttaataaattgcatagaaattttcaattttttccggtggcgcctgtcggcaccgccggactcaagaaaatacttaattttcttgaaaaatttgctcaaaatcgctaaatttggccttttttgacaaaatttgttaacaatttgcattaaaaattacaaaatttttcccggcggcgcctattggcaccgccggacccttccccacagtttcccaaattctctttggataaagcgcgccgcaaaaaaaaggggtataacggtccccaaaaaattccaaaataatgtaaaattacttaaaatattttgaaaatcattaaaaaattttcaaataaatatagaaataaactaaattaccttttacatggttaaaaatttaaaaaattagcctattaaatattttaaaaaaattttatattttatttttttgaaaaattccgacttccgacatttttggagtcggaattccgacttccgaaaattttt

SEQ ID NO: 16496 - DNA, 2675 bp, Heterodera glycines
tttttttcattcttaggggtttattttctgaattttcccccgtcgattcttaggggtgtatttttcacttttattaaggatttttccgaaaatcctgaaaaagtcgtcaaaaatggcgaaataggcacaaaaataggcaaataggcattaagcacaaaaagtccaaaataggcaaagttaggcattataaaagtcattgtatacaccccaaaccaagcggaaaatgcgtttttcgtgcttatctaagcgtattaagtgcgcaaaaattttaggcatttgcctaaaaatagcatccctattgattaaattccgatggattgactcattgtacaaatttgtatgtatgtcatggtgttgtgtatatgtatatattgctgtattgtattgcattgtatagtctgtataaataaatgtgttggaattttacgcctggtacataatttttcaaacgctaaaaagttgtgatttttccgataagtttcaaatttaggggtataattttttaaataacttttatatgaaaataatttcaaattaaggcaagcaattttatttactgattacagttacaaatgaagtacatttcgggattaaagtcgattcttagggatgtatttttgttttgattgcattcttgttaataaatttaccaaaaatcgcgaaataagggcgaaaataaggtcaaaacgccaaaatatgggcaaacaagggcgtaggcagggggaagggctgaggggactaaagcccccccccccgaaaaaatgtacaacaaaattgactgttgccactgaaaatatccgaactttggagcccgtttggctcaagtacagtttatgcgtgcgtacaatcaaatttttcatccggcggccatgtttcgttaattttaaaagtgagcggaaaatttagtttttttttttttcgttcttctctcgtaaaatgtaacccgcagaaaaaataattacaaaaaacgattattaccatacataattaattgacagatttggagctgaatgagaattaaatttatgcaaaaatatattttttaattattttgggattttttatcactaaaaatcccatccctacttataaattatatggattaacatattttttctgcgcctatgctacgaagaaaggggctcaaaaatagcatttctacgttaaaattttttggttaagtcccaaaaatgaattgaaaattcaatgttaaaaggtcaaagtgtgtttttcgaggttaccaaaatccgtaaaaaaataaacatactgtaattgttattattattattatttttactttgcattaaatctcaaattttggcttaattttgttgctttttggataaaattttacgattttacacccctaaatttgtaacttttttgcaactattttcccatttttagcatctatttaaacggtattccttttcactgcatccgacccacaagcatatccggacatagttaaagcagtaatgggttctctgattggtgtccaatgggcctgcgtaattttttcaacaattccgagaacatcaaaacatatttcttccgcagatttgactaaacccaaagaataaaattttgccattaattgcaatttgcccaatcggacattagccagaaaagcagtgtttaatgatgccagccaggactttagctccaccatttaatacaggctctttgatttttttatatatatttttttaacaaatttcattaaaaatttaatttgacatgcgcaaaagattatgggaagaattggatgaacaagcaaaccacggattttccttcatcaaatgccttttcaatttctgaatttgtagtcgctcccctgttatagcaaagtttacaccaagaatggcatttttttgatttagagcggaatttcaaaaattaattctatggagtcgggcggtgccgtgccaacgattgaaggggaaaattttacaattaacaaaaaggtaaatttttggatatatttttttcttgttacataattatgcttaattttgttgaaaaaattattgtattttttgattgaataagaaaatctacatttaaatgaaatggcgcgctgtcatttcgtcccgcgtcgtttcgtcccgcgtcgtttcgtcctgcatcgtttcgtcccgcgtcgtttcgtcctgcatcgtttcgtcccgcgtcgtttcgtcctgcatcgtttcgtcccgcgtcgtttcgtcctgcatcgtttcgtcccgcgtcgtttcgtcctgcatcgtttcgtcccgcgtcgtttcgtcctgcatcgtttcgtcccgcgtcgtttcgtcctgcatcgtttcgtcccgcgtcgtttcgtcccgcgtcgtttcgtcccccaagccaaaattagtcgtttcgtccccaaatttgttttataaaatatttagattttaagtgttaccactaaaaatttgtctgggtttagttaaacaaatcataaatttacgaatttagacgtatgatgaatcgtaaaaaattgaaaatcttcaaaaatgtcgtaagcgcaagtttttggataacaatgacagtgaaaacgaaacgctatctgctgatcaccgtgaacaaaatgagaacaacaacgaccgcgacgatgattttgaagaacacgcaatcgtaaacaaaggacttggagaaacgaaaagaggaggtgtctgcatttg

SEQ ID NO: 16497 - DNA, 1158 bp, Heterodera glycines
  misc_feature (274)..(274): n is a, c, g, or t
aaatcagaaattttaaatgttcaaccatctttaaaccttgtttaaagagtttctgatgtattacttgttcttaataaaaaaaaattttttcggattctggacacgtttcctcatcaagtatcttggggagtattggacatgtaatgcgcaaatgtatatataccatatttcactatatcttaaatatttccattataaaaaattctttaaaattccaaaaaaattttcacccccaaaattattaaattttttattattccaacattatttcaanaataatacattatttcttcatcatttcttcattaattcttcattatttcttcaaaatttcattattttacataccaaaattcacatccaatatctttataataacttaaattaaatcacaaatttaaacatcaaacatctttttacactattttaatactttctcatatattacttttattacttaacctaattttcaaaattcaattttttccaattctatacacaatttcccatcaactatcttgggtcagtattggacatgtaatgcccaaatgcacgtagggcgtctttacacattattttaagtatttccagtgtaaaaaattcatcataattacccatcaacccctctgaatccctgcgtatcccccctaacaaaaaaagtaggcaaaaaaaattgtcaatcagatccctttttagggtatttcccgaacccggaccaaaacctgccttataccatctgaaagagcaaagtatgtagaagtgacatcaactcttcttttttcgattgaaccgattttaaggcaggatatgagccatcaaacacaaaaagccaaaaatttttgaaaaaattttcaaaaattttctgaagaaacttttttttacgtgaaaatttcaaaaaacgctttacaccattcgatccgcaatcgaaaagtgccggaaggatgcgcaaaccgcatcccgctatgagcaaccgctcgcttatttttttagcaaacgtcatttcaggctacatttttctcttatagagggaaccagggccccaaggggccctgtgaaagcgccggagccgctttcaacaccggggccagccggggccattgggttttccccgcgcttaaggtactcgctcggccgcttcgcggcctcgtagggggcttt

SEQ ID NO: 16498 - DNA, 1064 bp, Heterodera glycines
ttgtgtcagaggaccacgaatcaacggcaattgtaatgttatcggtgctttcaattcgccttttaacattttgcaacatcaaggaatagctgtactgtaaaacatcatttgtcaaatattttctgcccctgaaaaaagttgatcatcgaaagttttatttatcaaattaatacctagttttatagtgaggaaccaatattcttaataaattttttagcccaggttcttccacaaaagagaacggcaatccagcagtacataccaaatcgttaattgccttgtcaattttcttagtcatttctccgtcgggtgtccattgagctgaaaatgttatgtaaattcatttaaaattaaattcctacaaaaggttttttcgatggttaattgcgacgaggtagcagattcagccctcgctatttttttaatcactggacttgaagtcgcaaaaattcgttttaacgtcggttgtctcgggttcgcttcattatttttgaggctttctgcagccttatctttttcttccaattctttcaattttggttgatggtgattttttaagtgagaacgaagtgaagccattggatacctagacaatttctttgattcaaatttgtagctgcaattttcagaacggcaacaccataaattgccgcttggaattgtgtcgcaattaaaatactggagatatttgcttttggaagacattaataggcctaaaaaagactttgatgtgtagtaaaacggaaattataacacggaaaaaaaaggactaagaaaaatggtaattctgtagtttgcccccccccctttatttggaaaaaacggaatgccaatgaaaaatctaccaacggggcctattcttaccagtgctttttcgtacttttttcgtccaattttgctctgacgaaaacgaaacacgaaacgaaaaacaaaattttgaaaaccgaaaccgaaaacgaaacgaaaaaactttggtagacgaaaacgaaacacgaaaacgaaactcaaaaagtgccgaaaatgtaggacgaaacgaaaacgaaacgaaatttcgtccatccctg

SEQ ID NO: 16499 - DNA, 1443 bp, Heterodera glycines
  misc_feature (93)..(93): n is a, c, g, or t
tgcacgttccaataatccaccagaaaacgcggacgtctcacacgtgctatttggcaaaggaacaccggtgtagttgatgacttaccggagaanaagcaaaggattggcaaattcccagaaaacttaccatcccaaaattccctcgagggcttgtcccacgacatcgttcagcgcagtaattgcagcagtcaaatgctgaattggcacaaatgcgagcgcggtgatcatacgagcagtttctgcgaaagcggggtcacttcgatagcgctaaatgggatggaatttctttcttttaaaaacagaaatttaaattttggagtccttcggaaatgaggcgcttgggcagattgggcactaggtgaaaaagacatcctcaaatctgcgcaaattcagagtaagtaataattatttattttttaatttttaaaaataaataaaacttatttttgctataaaaaaattttaaaggaaaattaattcatcacaacattattattgttattattaacaaaggcttcatagatggcatactgcaaatttttaagcacttttagtcgtttttttattattaacaaaattttcatattttttttattttctatgggttttttaaaaaaaaatcagaccaaaatcccaaaaatttcccaggcggtcctgtcttcactgaagggatatataattcatatttagtatattttaaaaacgcttaaaaaacgagcttattttagacaaacctacaaacatttgcatcaaaattaaaaagatttgttaaaaactttttggttaacaatttttttttattttcgttctgatctatctttttgactgcttattgaccgagcatttaattattattttggctttttttcttaattcttaattaattattaatttggataacttgttattgttagtcattaaaaattgtctgcccaaattattattacactatagttgatcagccaatcgtctagctaattcggcatccgcttgctcctgccacgctttacccatggcttccgcaatttgtgcgtcatttaccgttgaatcatcataatgcgataggctaagagcaatttgccgatcttaaatttataaatttttccagttaaatttgtaaaaaatttttttttcaacatttgtgtagtgagtacttgttttttatatttgatttttaatgtttattttgctattttttttttttgcattattcgattttaattgttgcttattatgaaatcttgggttcaatattctaattagtaattaggtaaattaattaatattctgacttttttgttgattaatttatttattaattaggtaaattaataaacatttattcagcttaaaaattggttccctagatataaccgtatttcgtctgttctctttttgaatttgatgggcctgcctttaaaataaataataataataaaaata

SEQ ID NO: 16500 - DNA, 842 bp, Heterodera glycines
aattatttagtcttgggtggttgatttttgaaaaatggagatcaaaatggcaaaaaatagtaagtttctgcgaaaacggctaaacattttgtaaaatacaccccccataattcgggatttaaaaaaatgaaaaatacacccttaaaaattgactgataaccaaaaatacacacctaaaaatcgaatttttaacttcagcccccaccccccccccccccccccccgaagcaagggcctggctaatgtgctttaatttgttattggcatttttttttgaatttatttatgtattaatttgctttaatttgttattggcatttttttttgaatttatttatgtattaatataacttcgcaatttggcaatttttcagcaggaattgatgcttgtccttgttttatttcatctaaacagattgggcattcatcatttgttgctgttttatgtttcgttggagcggtgacaacggcattttttaattttttccatatctttggagccgtgccagcggtatgaataaatattattatgatgcatagaataattaatgaatggcaaatagacatcgtgaacaaattgttaaatataattaaaatgacaattttgggcaaaaaaatggttcaaaaaatgcaaattgaaaaatggacaaatcgaagctctataataaattatattaattcaaacttattaggtaggattaaatctggggagccacttggtcgcatttaggtgacttgaaaccgggcctgcaaatctaagaaaatccaattttggcccagttctaaaattttatgaaaatatccagggggagtgtctgtttagtcccaggcttttagttgtc

SEQ ID NO: 16501 - DNA, 2476 bp, Heterodera glycines
ttttgaatttttttcactttttttttggtcaatttttttttgtttatttttacacataataatgaatattaaacattaacagaacaattatggcgaatgaaattataaattatggcgaataaaagtacattcacgattttttatgtcaaaagaattttgcgaaacaaaagggttcccccctttggtttttgataaattcaaaatctttcactttttaactatcgccaaattttcttttcaaaattattttcaattattaaatagcgtgaaatacgtaccatcggcgcccccacaaaatgtccaagccacgaaatgtccaaaagagtaaaaacccacgaagtgtccaaaactcgaaaaagctattaaaaagccggaaaatgggtctaaattaaggtattcggggtcgctgaatacgaatacgacatttatataacccatttcctaaccttcgatccacccgaataagaaaaatctcaaattcggttaaaatatatgctgttttttgtcttcagattttgttattcattgatcgaacaaaatgggtgggccgagtattatccacctggcattctggctacacccggccaccagttagagaggaatcttttgttgcaagttcatgccatgattcagcttccgcttcaatatggctgccattgctgcccataaaaagccgtggagaaagcttgttgcgactgccctgcacgagggaatccattgtggtgcagtttacctgggtggttgttccaagcgagataatatctgccgagcgatggccaaggcctacgggaaaaaagtgacgccacaatttgacgctctgagaaagattgtggagaaggcgtttccttttgtcaagccccatctggacgtatacgaatgtaaaagaaaaatactaaataccatttacaaagagattgtttatagaggagctcctccggcgacaacggcagttgtgtggtggtggtaggtgttggttgtgaaatgggggtaggtgttggttgtggaaattttaagagaacaacaacaaaataaaaaaaatattttgttttcgttactctaacaaaaccaaactattaaaaaacacaaaaaataattttcaaatgtgttgaccagttccgtgttttcctcgtaaaataatgtcgtattcatgggatggtggcacgtttgctcccgagtcaaggaaaaactacaattattttattttttaattaaaaaatatttttacctgtgcgaccagcttactgcctgcgacagtttcgacattaattcgaccaggatgaatttcggaaatttgtcgttcttgtgagcaaagttgatcatcattttggcaattggtcttgacacatcgttcctcgccctttttgttcgtgtcaacaaccaacattttgaaattcactttttcatcctcattgagtgctttaaatgtttgcgcagctgtcaaataaatcttcctgtaaggatgatgctcacgcaaaacagcatgcagatagttaagcaggttttcctaaaagcctttttcattgtcgtattttttaataagtttacatcaagatgcttttcttttgcaatttcatccaagcgtagacgtgcatgttctggcggaattgtaaaaagttgaccgtgcaattgaggtagatcgtcctttggcgcattgaagtcccagagaacgtaacgaatcatgttgttgcactttacgatccggaaggaattttgcagttttggatctcgctgaatccgcacacaaccaaatgcaaggctgtcgttgtatgccattgaatgttgcgtgagatgggaatgccaacgaatgtttgttgtgtcgttgttgttaaaaagtgccataatgcttgaaggccttttttgcagatcgttgaagcgctccatgagagacacacgtccttttgcacaacactttgagaatgcagttggccctttggcttctgacggtaacaatagcgcattacactttggacaactgatttgttcctaaattatttttttaacaaaattaaatatatttaaatacatttttcaaggaatcgtaatattctggaagatgtcttgcacttttggccccgcaaccatatccaaaatgtgaagaatgccgtgatgcacattgggacgttattggaagaaaggatggtctcgaagagacgggcgttgaaaatagagatggtgtatggctgagacggcttgatgttcttcgtggcgcaagtgacggtggaggcattaacattgagtcaattgtttgttgtgtattggtcagtcattcgtctctattactattgtacctttaaaagggaatattttcgattcattaatttatttctaccagcagtcacggtggtaatatgaattgcaacatcccaaaaagactccgtagcggtccaactcctgacaagacaaacagctgtttacatagaatgcaaaagctaagagggctgagatgaacagttatggcattttcccatttgtgatg

SEQ ID NO: 16502 - DNA, 3243 bp, Heterodera glycines
  misc_feature (6)..(7): n is a, c, g, or t
  misc_feature (3138)..(3138): n is a, c, g, or t
  misc_feature (3182)..(3182): n is a, c, g, or t
  misc_feature (3184)..(3184): n is a, c, g, or t
  misc_feature (3189)..(3189): n is a, c, g, or t
tcaaannctctttttgggaccatattaaatcatcaatttctgatcactagtaaaactttttttagcaaatctgaatgtgccattagactaacaataattagtactaaaaatttacatcggaattaattttttttcatttatgaattttgaaattaaattaattcatgaatttagaataattttcattttcgagtgttgaattaaaatcttaaaacaaacaaaaagatttgaaataaattaaaattaatggcttaaaaactgacaaaattgactttggtttaattaatatctcatggtttttattacacatttcataattctattcattttataaaattttcttaaatttattatatttgttttcccaaattacagatataaatgcaaggaattggaaagtgaaactgtcccagtttgggcgccgatattcaaatcaaaactgtcggaaaagcatttagtgtaccttggtagaaagctgtcgttggactcgtcccaaatgggccaagtcggcctttggtttggcaacgatcgaatggccaatgaaagcgaattgtcgcatagactgcgcattctgagcacaaacagcgaatttgacaagttgaaagcggtcaaaacattcatggaactctttttgatgcaaaactcacacattggcattttggtggtgcgtcatccgctgacattttcggcaggtgaatgaatggatgggtagtggacggatgccgatttgcgatttggaacttttttaaggcattggaattccaattttttggggaaggggggggggggttcggattacgggtgaaggggtgctattgcgttgattaaaaaccataattgcttataccttttgaagcttaatgaaatattttaaaagttataggctaatagagaatatttagtgctattgaatgatattaaaataaaataagttactttagatcaaagttagcaaaatttttatgtgataattttttaaaatacgccctttataatatgttggacccgcccccccccccccattctctttgtcagtggttaccgtaattactgagaccaaggagtaacaaattcatgagggagtagtaaaccgataagtacggtatttggttccatctcctaagggattaaaagattaactggaattttgtttttttaaattcggctcatgcgaccctattaaaaataatattgtaaaattcattataatccacagaagtaatgcgtgaaaatgaattgtttatatcggtcagcaatctgttggaagcaaatatgaacacttcttcaaatgccgttcgatggctcgaattttattttattttcggaaaaactttctcttatttcaaacaaatttataatgatgaagttttaaagacgaaaattcaaaatctgtgggaatttttcaccaaagttttgaaaaaagtgcaggaggaacagcaaacattatcagtgaacgaaatgacaaattcaatctttcaaattttatcgcaattagaaaacaattttggcacaagaaaattggggcaaaagagtgaagatttgttcaaaaaatatgcacaacatttgtcggcattttacaaagaaaatgaatcatttcgcaaaaaatttgacagaaataaattgggaagagaaaacataaaaaagatttttcaacttattgaccaaagtcaacgaataatgccacgcaaattttgggaacttttcgataatgcaaagaacgaattccacgctaaaagctcgtcctatttggcatgtccaagtggatcagaaatttgggagaagcctacaaattcatcagaagattcttccgagtgtaattataactagggatagtatttttaggttttagcctattttttccctgagctccctatgatctgaaaggcacgaaaaaaaacctttttttggttgttgttaacctacttttcaagttattagcaactattttatttttataatttttagaacctaaaaaactaaaaatatttggacctattttgaggtttgcccaaaaatttattaccaaaaatgcaacaaaaacgaaaaataacacccctaagaatcgaccacaaaaatttcagaaaaatacacccttaagaaatgaaaaattttctcaaaaattcatctccaaaatttattattcctttttaggaatttttcgtttaaaaattatgtatctcaatacggggttggcttaatttgttgctattgaataaaattttgtcattttataccctaaatctgaggttttttggtaactattttcccatttttagcacttattttaggttttttagaacctaaaaactatttaatataaaaatattcgcctattttaaaattcatgcacaaacaaaatatatttaagctgctgattatgggctaatgagttcatatgttgaagttatttacaaaatagaaaacagtgccgaaatatttgagtgcaaagccaaagattatgggcacattttggagatgaaagccgttttggagatgaaagccgttttagagatgaaagccgctttatgggtgtataaggaagtgatcgagaacgaactgatcggatttgccgactcactaaatctattggacacaaattttgattatttgctcgaaaatgaattggacaaaatgacgacaaacgacggacaaaacgacagcgacatccattactcccgattatgcttccttcacaaaatcgcattagcatttgtgaaagatgaagcgctgagaagaaacaagcagtgggacaagcatttgaagcggctgttgacggacacagcggtacttcaaatgaatgatccggtgaatgggaaaggggttaagggcttggcgattttaattaaaaatatgattttttatttaaattttaaaaaagatttttgaaattttttaattcaaaaaatagaaattcaaaaatcaatttaagtatttaaaaaaattcttatatgtttttgttttacatatgaatacatattggcattttaaaatgtatctatgcaattttaaattaattaaaattaagaaattaattctgttgttgaatcatgaagatggcatcaattgggccagtgccgactgcgccgacccaaaattcacaaccaaatttatataaaacatcataaaaattccaaattnttcttaccaacttcatttctactcactaaagaaattaatcccanantttcntatttcaagcttcaggagaacggaacgcccactgctgattcaatcacataaagg

SEQ ID NO: 16503 - DNA, 1002 bp, Heterodera glycines
aaagggaattaaaaagggattaaaaaataaaggaaattaaaaagtgattaaaaaataaaggaaattaaaaagggattaaaaaataaaggaaattaaaaagtgattaaaaaataaaggaaattaaaaagggatttaaaaataaaggaaatttaaaagggatttaaaaataaaggaaatttaaaagggatttaaaaattaataaagggaattaaaaagggattaaaaaataaaggaaattaaaaagtgattaaaaaataaaggaaattaaaaagggatttaaaaataaaggaaatttaaaagggatttaaaaattaataaagggaattaaaaaggaattaaaaaataaaggaaattaaaaagtgattaaaaaataaaggaaattaaaaagggattaaaaaataaaggaaattaaaaagtgattaaaaaataaaggaaattaaaaagggatttaaaaataaaggaaatttaaaagggatttaaaaataaaggaaatttaaaagggatttaaaaattaataaagggaattaaaaagggattaaaaaataaaggaaattaaaaagtgattaaaaaataaaggaaattaaaaagtgattaaaaaataaaggaaattaaaaagggatttaaaaataaaggaaatttaaaagggatttaaaaattaataaagggaattaaaaaggaatttaggatgccaaactgaacaagaattgatagatgcattttattaccaacgcaattttataaaagaatgcaattacacggcaataaataagctaatgcaataccacagcgaccaaatattagccaaaccggcggcaaaaatgaaattgtggaaaatgctcaccgaattagggccagagcaaataataatttacgatggcacatgggagtcggaagtgatgagaaagaggagaaaacaaggtcattaaggggaacaaatttaaaataaataaaaaaatttgcttttaaatgaatattaattaatagggtttcttttttaggtac

SEQ ID NO: 16504 - DNA, 4222 bp, Heterodera glycines
  misc_feature (129)..(129): n is a, c, g, or t
  misc_feature (143)..(143): n is a, c, g, or t
  misc_feature (2032)..(2032): n is a, c, g, or t
attaatttttaaatcaattttgtagtactttcttgaggagcctgcgcggggggtgaggatcacttcgcttcttcttcgccctgcggagcatgcgccggatggtcttgttttggcttttagacaacgtcncaatggccgcgacnccagcaaactgcaaaaaaataaatggaattaaattgttttttttcaattaaagaacttttttggcaatccgggtggcatccgggatgttcgcgccccggtgaccgacgcttcctttgcaaaacatttcgctcccgcaccctgcccgccgagaaaggccacccatttcgccccaattcccccccccccttcccttaccaaaatccccccccctgaaaaattccggcccaaatttggtcccaagatccccccaccctccctttcatcggaccccccccccctaccgcgattcgctccccacatattttgatcggataagattattcaattgcgttttttaattttcgtttgttgcgaaatttttgtgcggggcgcaccaaaaatggtgccatccgcgctccaaggtcaaaatagtttttatgttcacaatctgtcaatcaaagttcttgggcgagaaaatttaaagcgctgcggagatgcaaaagtatttgcggccactttaccgcagtttttatacacgggaactgtcaatcatataaagaagggaacgccgaagcgacttcatttcaattccatttcgcttaaggcggggggtcgggggccattcttgcccctcggggcgcttgcccacatattcaaattttttccatcgatcatctggatctgtcaccgcggcacggcagaacgggatggcagtgggaggagtcagcagcggcaccatccgcaagtttacttcatttgccactttcgcccactttttcaatttgtcagcagcggagccacatcccaaattcacttttcgccatttgccattttcatccgctttcatcatgtcttttattacccccggcactttcacgtttctttcaaaagagtatggggaattttcggctgggcattttgacccaaacagagcatacgacccaaattcacttgcagaactttcgtaatggcatttattttgcttccattatctttcattttttctttgtagtcaatggcgaaaagagtttctggacggccgatacggatccaaacaaccaacccctccttccaccccgcgtgccccatcgcccagattcccaatcccggtcattgttggtaattttaatttgttttttggattttgcaaatattccgtttacaggaaatcgtccacaggatgaaaattgtttggttttccacaaatatcttgtctgattttttccattttagggcggcagatgttccccgatgacgatggctacgaatcggaagatgatgaaattctcttgccacctccgccgatccccccgcaacttggccaccctccgccaaatgtgccggtaatttcggtttcgcttttcgttgctttttctcaaatttccgagtgcttttttcaggcagttcgtgttcagccaatgcatgttgggcagcagcggctgccgctgagagacttgccacaattcgaggaccatccgcaaaatgtgccagtaattttgggtcgattttcgctgcgtttttctcaaatttctgcgtgctttttttcaggtaattcgtgtccaaccgatgcctcaaccattgccgctgagagacctgccgcaaattttccaccctccaccaaatgtgccggtaattctgggtctttctttcgattgctttttctcaattcccgagtgcatttttcaggcaattcgtgttcaaccaatgcagcaacccgtagcaatgagagccgtgccacaattcttccaccctccgccaaatgcgccggtaatcttgagtctcgttttcggttgctttttcataatcccgagtgcattgtttttcaggaaattggtgtgggaccaattcatgatgggcaacaaccactaccactaagagcgttgccacaattcgcccaacctccaccaanatgtgccggtaattttggctcgtttttttgttactttttttaattcccgaatgctttttttcaggccgttcgggtccaaccagttcaacaaccgataccactgaaagacgtgccgctatttgtcaacccaccaccaaatgtgccggtaattttggctcgcttttgttacttttttttcaagatcccgaatgcattttttcaggtaattcgtgtccaaccgatgcctcaaccgttgccgctgagagacatgccgcaaattcaccatccaccgcgaaatgtgacttcaatttggatcaaattgtggttgctttttctcagtctctgggtgtttcttcagggaattcatgttcgacaaattcaacgggaatacgccgtaccgcaatttgcccatccgccgccaaacttaccgtatcatccaccagaaaacgttccggtagttgggtcttgtttttcgtgcgtttctcatattttcggatgcttattcaggtaatccaaccacggcaacgaccgcgccagctgagagatgtgccactattcgaccacccactgccaaacggacaggtaatttcagaccctgtcttttacctaacaccgaaacatcttttcttaagcaaatgtatgccaaccccccgagagtgctggaagtgatccgacggctgggcgagtggagaggaagaccaagggacccaagacgtccgcctcaatgaatgaatggaatttggattttgataaaatttgttgttttaattttttgaattgataagggttaaatcccgttacctaaattgtttgaaaattattaaaattttaagaaattagatgctaaacctaacctttgacaaagattatgaaaaaatgaaaagaaatgacgaaatttttggaatgttccttctttttattatctatggattttttttcatgtgcattattttggtgctagtaagatattgtcgaatgaattaattggtttttttcccttcattttaaaaaatttcacgtccccatgccctgcccacttcccgcggaattgatcaaggaaataattgacgctctcccccctccaaaaacacatcggcttttgcgcgtaaattttgttttggcatactttgttaagtgtcggttttattccatgatgagaagattgtttcgcccagagcatatatcaataccaatggcccgaagaactggaatttatttctttttcgatgtttatactccccctatttattttccactctaccaataataacatttaaataaaattatattttttttttattatctgattaatttcgatcaatattttttgataattaaacaaaattgtatttttcccaaaagaattttctcgcagtaacaactcataggcttttttttactcccttcataaaatgtctcgcttttgccccctcgcccaaatcaaggaatcgggtcggcttaacacaccaaaggggaaatttagtgagttccaaacctatcaaattaaaataaagaattttgataatcgttttaggtcttttttacgctctggaaaatgctcgcaattaccaattgattggaaaggggataacggaaaaaacttttcgttatctcatgaaaacggaaaagaaacaaagggaaatggccatggaattgatggaaaaggcagggataagcacggatgacaaaacttttggtacccaacatcttgaggctgtacaaaaatactgggacagggaatttccgggcatgttccgagctgttgttttcgataaggttaataaataaaaacacaaaaaaatcttttctatttttttagaaatttggacttaagccaattttcaagggccaaggcgttcgtaagaatgaagtgtgtgtgataagagagggagaccattgggatgggatcaaatccgcttcctggtttttctgcgtcaaaaatttttgtgttagttgtgaagtgacgtacgatcgacctgaaagacatagaatggaatgtaaagagcgctgcaagaaatgttgtcggatggggttcgggtttccatgtacggatgtctgcgatgagattcactgcggcgaatgcaatctcaagttttacaacccggaatgttttgaagcgcacaagaaggcgacgtgtattgagtacaagaaatgtgaaaaatgcggagctgtgtggaatactcggaacaaacacagtgcggcgaaaagttt

SEQ ID NO: 16505 - DNA, 2803 bp, Heterodera glycines
ggcctgcccattggcaaaacaatcactttccttacggtagaacaaatcgaaaccaacagcagcaacaaaaggcacacgcaacagccacagcaggtaatcaattaggaaggataattagggtaattagcattgttaatcggcaacttgctaaatccagcagcagcaggtgtccatcgccaaaatctctctccaaatggccttccggcagagtcagtgccaaacataagtcctttggcggcatggggccgccatcagcagacaatccgggcaaaacagaaccaacaacgacagcaatggccatattctcagactgtgccaaacagtggtcagcccaatcgaagaaacaatggtaaaaaccattaaaatggattattcatttttaaatttatcacataattttaaatgcgttaagtgggctggccaaactccttctctccaatcgccaaccctcagcaaaatggcatggagcctaacaaaaagtcttcgccatttgaaggagtgccgtcgtttcgcagtcaataccaacaaaatcgacgaaaattcactggtggtgggctaagtcgacttgtgctaagcagcgaggaagaggagcaaagtgccgagttggaacaaagccacgcaagcacaaattggcagcaaatggcacaacggacgacgatggttacggtagaaagggtgattgattacgatgggaaagtgtagcctaaaaggggtactgtaacaatgagaagccccccaaaagagatttgtttacccttttcaaatccagccaagctcaaatcatccgaccttgaacaactttgagcggtacatgccgttgttggctcggcatcggccacctcccaaaaatgggaccgcccgttggagtttgtccaacagtgcggagccgtctacggaggaacgaattggccaatcggcgggcggcgaccgagtgagccaatcaaattaaatagttgtacattgtaacaacacactcctactgtataaatcgcaggccgagcgcgagcagggcactgctgaggaggaggacgaggcgggcagcgacgcgcggatgggcgggggaccgtgcgtatcggccaactgtcgcacgtggatcaccatcacaattcccagcgaattggtcggattgggcggtgccgaaacaaacggcgaaacgcaacacaaagaaagaccacccgcgcacaaagccattgtgacgcaggtgaacggcaaaacaatttcaaattgaattgctcactcatcagggccaaattgtgcagtcaaagccaccgacgaacggcggatggacgaagcctaacacggtgccattccgaccaaaagccgaaaaaccgaacacttccctaccgatgcagcccattcagccgccgaagagtcgcggaatgccgacggcacgcggcggaacggcggcaaagagcggagtcggggaaacgacgagcagtcctcagacaagtgaatgagtgggagagagagagaagggaagggaagagagagaaaagggaagagagagagagaagggaagagagaaagagaagggaagagagagaggaatttaaatggggcggaagtgcaaatttaattgtcttgattttaagttggtcaaatttgaatgttttctatgacggtgccaacatcatttaagatttgcctgtgacgactcgccaggcaccgcccggttttgtgttcagcacaaaatggattttgccggtcaatgggctttccgtgcggccaaatggcacatccgctgcgccgtcatcaatcagcacaacaacgccgactattagcacaatgccgtgggtttagtacgaaaaaatacaaaatttaaaaaaaaatttcaattaaaatggtcaattaaactatcggtcgttgctttaaaaaaacgaattgaaatttggtcagtttatgaaactgatttgcttaaaataacaagcaaaagcagaaaaaaatttctgaaaagacaacaaaaagtttttgattttgttttggaaagtttccgaagagattggccaagcgaaaactcaaaaagtgacaaagcaattaattcccttgcttttttgatcccatagaaagctaaaaaatttataaaatatattactgcattccacgcctaatttaaggtatatttaaataaaatatgtaattaaaaaattttccttttaatattttatatttatttgtcattccccattaaaaattcaaaattatattaatcttaataaaattaaaaaatagggaaaataaataaaattcactaatttagtgtttgatttttgcactttttttttggtcaacattgcatttagtacctatcctcaaagattggcacatgagtgaactacccccccccccctaattttttcgcaaatcaaaaatcagctaaattaaggccattcacaattgggccaaggccaaaagtttctccgacgcaaccgccggtggttccgcgcgaaaggcccagcgacaaaatgcgaccgccgaagccatggacgcacacaagcggaggaaaggaaaaggcgtcgaacgtgccgaaatcgaggcattttatggcattaaaatattataaattaaaaagagaagacaaatttgtgaggcaaaattacttttattttctcatttttgaatgcctaaaataggcccgaacaaacgcaacagccaaatccgacggaaccgacgacggaccaaaccatcgaacaagcggcaatttgggtcagagattggatgaggaacataaggagtggaagtgccacagggagtgattctggtggcacgtcctaaggtgtgcagtgcattgtccccttctctgacc

SEQ ID NO: 16506 - DNA, 4386 bp, Heterodera glycines
ttcccggtgagagttttgacgaagatttgcatgatagccaaattgaaggggtattgaattcaatcgctaaattataatattaaaaggatgatattacaattacattgggaaagaaaaagtgatgaaattggaaagaaacagaaaaattagaaatgaatgtcagaggaggaataagagctgaatatatgtgatgtgtgcggagttattgcaaaggcagagatgcaacgatgaattaaaacaaacatgtggaaagcagagaaagcaaaatgtgggttaatcgttaatcgaagaatggtgggaggagaggcattgggaatgggaagagaagaaaggaaaactgagtgggagaagaaaaaaaagccgtgatgagtgtgggtgagaacagtgagtgtgcggacattaacgacccggacatttgagtccgaacatttgagccgaaaacaattaggcataattgtttagggcgcaaatgttcgaggcgcaaaagtccaaggagcaaacgtcactttgtgacttagttaattaaacaatgatttgcttgggagagaaaataaaacttagaatgaatggatgagttgagcggaggaggtaattaggacgagaatcgttgagaagttggagacaaaataaatgagaaaatgaaaagtgtgctggaattttgccatatttatacacaatcaactcggtctgtaaaagacagaattttttgcggcagtcactcttctgtaatgtagacaaatgcattgtaaaaagtgtataaaaggagcgatttttggccgtccatcgccatcaggaatatgagaaaatcagaaaaataactttccaaaatggaagaggaaaatattttttttttcacgtaaatgaaatgaaaataaaaattttaaaaccggaaatgtttccgagaaaaaatcgtaaaacattgcttaaacgcaaccaaattaaatcaaggtaacttcatactatgtatatctccaatgaaaagaaaattttttgttggacgaaaaggaaacaaaaaaaataacacaaaataaatgttttcgtacgaaatgaaacgaaaatctcaattgactaacgggaagtaggtgcatgacaaaatttcttgattcataaacgaattgctttccccactttgccgctatttttaagctcggaatttgggtttttgagatcgctactctaacaacttattgtcgataatatcttccaaaacataatttatgcttcgtccgcatcatgaactcgcaatatctctaagtggttgtggctttctttgttcttaccatattggggcgatgatttgttttcaaaagcatgccaatgtacaaatatacagtatacaaatacgatacatataatacaatagattttttcaatattttacatttggaatgctccatttacagaaaaatcattataccaattgtttaaaaatgtaaaactgcttctttttggtttagtctctcctctctcgtgttaacttttattgtggtgcgtccgctggtgccctaatcgcctctttgctcgttttatcgcctcattcactggaagtactatattatttggtttacattattaatctaattatttttatagactggattaaaccaattgtacagacttgcagaagaggtgcaaaaccaacgcccttttggtgctcttactcctgggtttaatatggcgcaacggcttgcaaaaattgttgatgattttttacccgaagacattgatcgggcgaatggacggctaatcatttcagtgacgaaacagagagtgagtggatttggtcccttttcggcctcggatttgttatctccaatgatttaattagtatagccaacattttaggactggtcaaatcgtctgatttcagaatatccgagcagggaataccttctgcagtgcctcaatgccacctgttatgtccccttatattcgagcagtactcctcccgcaatcgatggcgaagtattgttaattaattacgctcataattcaattcaacttttgcaagcgctacattgacggggtttattccaacaatttgcctgtccccgatattccaaatgttcacaccattacgatcagtccgttcagcggaggagcaatgatcgcgccacgtgaccaaagcgctttcgactggcagatgataatgggacagcagagaataaatgtgaatttgaggcttttaattgtaattgattttaaagttaacgggtccgggcttttatgttacgcaattggctctattgcagtttacccgaccctaaacttaaaatataatataaaaaaatttatatttataattttggatatggttagtaatttattgtgctttttcaatggtcatgaaatttcccaggtaaacatcagaaatgtcatgcgcggtgcacagtcacttttcccacaatcattggaaagactcggccggctttaccgagcggggtattacgacgcaatgctttaccttctccgcaagggctgtttcgaaagagaagttggaagtgaaatttgattctattttttgtattttctggtgtttaattgagagaacattgttagctcaaatgttacatatttttcaactattgttcattcaaatggttatttattaatttctcgacaataatggatgtttgtttgtctcttatagtaccaacatttcaataacattactcactccgtttcttcgaaattctttcctaaggacgccttttgcttcggtaagttttcatctgtcgaatggctaatgttttgttgagttcagattgttattttgaccatgggcatcaaggatttgtcaaaggtcattgcggatcattcgccgttcgccattaaaaccaacgaaatgaaagcgtatttcggacggcgcatcgcaatcgacgcgtcgatgagtctttaccagtttttgatagcaattcggcaggatggtgctcaattgacaacggaggagggagaaactacgaggttttacggaaaaatgccattgttagtgccacaattacatcgactttagtcatctcaatggcattttttaccgcaccatacgaatgatggacaacggaattcggcccatttatgtcttcgatgggaaaccaccggagcttaaggtcaaccattgagcaaacgttttgccatttcgtgttttcagtcaatcgaattggacaagcgaatggaacggagggcggaggcggagaagcagcacttggaggccacagagaggggcgacaaggcggacattgaccggtttggacgtcggctggtcaaagtacaacaataaattgcgcacggcatggtaacatttcccttaaaaggtgaccaaggagcaaagcgacgaatgcaaacatttgctttctctgatgggcgtgccggtggtggaggcgccttgcgaggtgaattaatgattataggttcaaaacttaatggaattgccaggccgaggcacaatgtgccgaactcgtacgagcgggaaaagcgtacgccactgccaccgaagacatggacgcattgacttttggttcgaaaattctggtccgccacatgacattcagcgaagcgaagaaaatgccaataaaggcaagtaaagttgatttggtgagttagttataataagacgcttttctttgaggagttctctttggaacgcgctctgaaggactgggagataagccacgacgaattcgtggatttgtgcattttgctgggctgcgattattgcgcgacaatcaaagaaattggcccgaaaaaggcgttcgaactcatcaaaaagtacaaaagtattgagacaattctcgagagcattgaccaaaaggtgtgatgacacaacgcgttaagggggatggtaaaccggtaacaatttcagaagtacgcaccacccgacaattggttgtacaaagaagcgcgacaactttttttgcggccggacactacgccaggagaacaattcgaagtatgaacaattgcaatatagccaataattaatggaaattcttccgaattggtttctttttatccgttaagttcacttgggctgagcctaaagtgccggaattggtggactatttgtgtggtcagaagggatttaagtgcgttttttggctccctttctttcactttcaatgaatttccctttttagcgaggatcgcatccgatcggcgcttgaccgactacaaaaaagtcgaaaaatggcacttcaagggcgaattgattccttctttaaaccgcaagggacagcaaataaagcgatcacagaagagacaaaaaagaaacggaaggcggaggaggaagagaagacgacgacgaataagaagaagagcacagtgaagaagacaaagaaaaaatgaagggacattctgaagaaaggggggggggaggagagaggggttggc

SEQ ID NO: 16507 - DNA, 3566 bp, Heterodera glycines
ggtcgcaaaaaaaatgcattttcccttacgttttaatgcccatttgtcttctttttttgagattcaatattttcaattgaaaagtagcacctttgtacaaagatttataaaatggtttttcatttcacaaaagttggtattttcgtcagatttttaatgttttcaatttcttcatttttggatttattgtacgaaattcctgtaaaaaatttttcatcttcataaaaatttctatctttattagttctttttcgattttctcctgaaagtcgttgaatacttttaatttttgaaattttcttattaaagaattaagattttttattgaaaagtttcaaacataaatgaagttttaaaaaaattggggcgggggaaagaactgtgggaaaacttacaattagtccacccggctttttcgtcatagtcaaaactcaacagaaaagaattgaatacaaaactacgagttttcgataagtacaaattttgactggggtttttaggtgtttaaaatcgtaaaaaggcacttaaataattgctgaacaataccaaaataggtaaaagaaaaagtaattccagctctgatagacaaaaaaataaagcttttgaaaaagttttaattttgccattggcgggaaattatgttaaatttaagaaatattttagaaattctctacaaatgaatgagacagtgttatgccctcttttcatccatcccataatcccttgggattcctctgtttcccatttcttttgcaatttcctcattttatcgacccaaaactctgttttctgtgtttccaatttgatttaaatcccaaatcttcgatttttttaccctttaacttttataaaaacagcattttttattcaatgtcttttaattcgctaagtttccaagtcacgcgattgcgtgcttttttatcgaatgcaaaactttgcaactaaaatggatgaataccacaattgcacataaatatatatttttagcaatttcttttttaatgattatccttccaattgaccggcatttccattgtcctcctctcttttgtctttcattgcccattgttttctttcatatgccgaccaatctgtgctgaaatatgacacaattccctcccttactccattttaaatcctctgctgaacggccatcggtctcaatttgttgagtctaattacccccccccccccatttgtcaaattaacctttccgtggagtgtgccattctgattattttctgtttctcgtttatgccattttccttacaaattactctttctattcctttcacctttttgtgttatattaaatcttaaatatgttttctactgttatatttgctcacacttttgcctttgcaatgactccatatttgccatttaatgccaagtgcaaataaggccacaatgatttttgctcaaatactcttgaaaatgtgttgtccgtttaggaatttattcgggtgaattcgcaaatgtcgtccctccaaacgcccaatcaaagtctttactttgccaattgtgccttttgtaccatcgcatttcctttcattttccgtcacatcaatcaaaccggacagaaccacaaaaacggggggaacacagggaatttttgttgcccaaatgcctccattcgctgctgttgttaatcctctctctgtgttggtccacccgaccccccctccccttcccatgatgaatgtggcggggcggggagcgaggcaaaaggcatgcaaaatggtcgatggacgaccgaccggagatggtcgacgcatgaccaaaaggggttggaggcggcggtggtattccatgggatggaagtgggagatcatctcttggggcggcggataaatttctcctctcatcagcacatctctcccctcagaccattcgcttgaggaaagtaatttacttggaggtcgaaatgactcactttgaattaaatggcaaaacaaactcaacgcatcacttaagcagcacttatttgtaattatttaaaactgcaattctgtatgattgctaaactgaataagccgagccctaaatggtctttggccagattttgaatttgaccacaactctgacattctcctgttttcaccatcctcagaattgtgctaatggaagtaaaaaaacaaaaacaaaccattaattgattttcgtttggttaaattacatttttagccagcagcacgtatccgcctccgatcattcagtatggtcatcaaaaccagacacttatgttcagtgacatggcaattttgccctgtcaggcaacggggcgagtgcccgtccgaatcacttggttgagggatgggaaagagttggacttggacgcaatgcaacacaaagggaggtaccggcagttgccggtgggcacattgcaaataacggatttgaagtgagcaaagccttctttttatgtgtaaacaaatgcccgctcgttgcaggaaggaggacagcggcgtgtacacgtgcagagcgagcaacgaagacggcgaagcgacttggaccgcttctttggttgcggaagggcacaccaaccaagacactgtttttcaccggatgcccgatgctgctgctctcccctcatcacctgggcaacccaaagtgctgaatgtgactgaaaacagcattgaattggagtgggcttccccggaacggcatggctcttctccaattactgactaccttcttcagtactggagtcctgaattgggagaggtggggtattataatgataatgagcgatttattttaaatttcgttgtagtcttggcgaaatatattggatgttgtggcaaagtcccgttttcgcatcactggtcttcagcccgaacattcttatgtttttgttatccgagcggagaactcaaaaggcattggacttccttcgtctatgagcgaaattgtctcaacaaaaaaatcgaccgaaattgaagagggcaattatcgaagtcagcgaatgaatcgacttttggacttggaaacggctcgtcaaagactttcttcggaacaattggtcaaactgttagaagtgcgtgcattaaatgcaactaccgttttattagcatggaaacggcagagaaatgtaagtagaaaatttgaaaaccaaaagccaagggcggcgaaatttaattttaaaaatgggattttgaaaaaataacattttttaagaattgtttttcgaatttgcaggaacctctagtccaaggatattatataaaatggcgaggcccgccgcttgcgcaggaccacagttgggtcaatgttaccaatccggagactgatcacgtggtcattaacgggctcaggccgttcaacaactacgagtttttcgtgattccctaccaccaaactgtccaagggatgccgtcaaattcgctcgacgggaccacggctgaatctcgtatactttaattcaaaacagttgcccaattcttttctctcccgtagctcccaacatgcctcccgtctgatggtcggctgagaatgcttaatgtcacattcgcttcgtgtttcatggcgtcctcctcccgctgatgcaatcaatggaaattttg

SEQ ID NO: 16508 - DNA, 2626 bp, Heterodera glycines
catttctctgtcgctatttggaagtgaataaacgaacttttatggactggacaatacacaaatgctcaaattggagccactctttaacaaaaagtcaacaaaaataggaaaataaacaaaggaaaaatttaaaaggaaaaaggtagagtagagcgctttggcgaatacaaattgtcacccgacattcaccgccacccaaggacgtggactgatggagggataaaaagggatcggattttgaaagtgccgtttttggacaaattttcacgtgacaaatttctttttaatttccgtaatgctgtgaaaaaattgcccaatgtgccccaacatatcaaagtccgaagggatatgacccaaagtgagctcaaaatcttatactcccttcggcaacaagcctatcaggccaatattgccgcaggtgagtataagtattttgtggttgacttggagatcagatctctgaaagacccccgcccgctcagaactcgctagggatacgcgagcaaatcaaacaaaaacattgggaatacgggaaagaaaaatccttggatttattgcctattaataaacgcccgatcgataacaaataaaatagctgacttagaacatataacccaaaaatacgatccttttataatcataataaatgagacctggttaaactccagaaacacagtagaatcagaatttacaataaataatcaatatcaaataatctttgcaagccgaaatgataaaaagggcggaggatcggcaattttattaaaatcaaacatcccttatcagacacttttctctgggacaaaattccaaagcgaaattattcacataaaattactttttaaaaaacctattcaaattataaatgtatatcgtccaccaaattgtacagttcagaatactaaaaagctactcaaattcatttcggaccaaagcgattctgaaaataccatattctgtggtgattttaatatcccaaatatattatgggatgaaaataaagtaaaaaaaataaatgatccggcgtctaattctctaattgagtttatgcaccaaagacaattgatacagcatgttaaggaaccaaccagagaaaaagcaattttagatttagtaattactagtgaattagaattaattaatgaattgacagttctagaaaatttttcaacttccgatcacaaaatggttggatttaaaataaaagtaaaattcagtcataaaaatcctaaaatttacagaagagatttaaaaaatattaatttttcgaaattaagtcaggcgttacttgaaaatcgaattgatttatcaataaactcagtgttcaccgttgaacagaaatataaagaatttttaaataaagttctgaaattatatgatatttttatacccaataggcctctaaaatcgataataaaacaatcgtatcctcaaaaaataagagacttattttcagagaaattacgtttgcataagcttgtaaaaaaattccctgaaaaaagtgatctcattttaaattacaaaattatttctagggaaatgaaaaaacaattgtacaaattaagaaatgaacaagagtcaaaaattatttcccaggagcaaaattcagttaacaaatttattcgaaataagttatcaaaagttaatgaaattcctacgttaattgataatgctggaaatatattttccagcaatgttcaaaaatgtaagatattagcagaaatatttcaaaagtcttttttaagaaaatcaattgttaatggtccacaaactcaatcaacacagaataagattaaactttctgacattgaattgaatgcgggaataatttggaatatattaagaagacttccccggcgtaattccacttcaccggataatgttccttacattttattaaaaaattgtgcagaaccaattacaaaaataatagcagatatatttaggctaattttggattccggtcaaattccggaaatatggcgaacatcattggtggtaccaattttcaaaaaaggcgaaaaaactgatccattaaattacaggccggtgtcattaaccagcactgtctgtagagtttttgaacgaattttaagtagcaaaattttagaatttctgaacagtacaagattctttgataaagaacaatttgggtttttaaaaaatagatcgactacaacccaaatattaaaaatgatggacgatatatataattctatacaaaagaatcaacaaattgacataatctatattgattttgtcaaggcgtttgattctgttccctaacttattactaaaaaatcaaagttttaaggttaaaattggcgaagaattgtcagaaagtttcagaatattttcaggagtgccccagggaagtgtcttagggccattactctttttaatttttataaatgatctgccgtcctttattgcaaatgaagcatcatcagttggcataaaaatgtatgccgatgatgctatattatattatacacatgaaaacgatgaccattcgaatcagttggataaagcaattgaggctatggaaaaatggtcaaaaataaatgagttatcatatttcaactgataaatgttctgttttatatgtaggggaaaataatatgaa

SEQ ID NO: 16509 - DNA, 2898 bp, Heterodera glycines
  misc_feature (784)..(784): n is a, c, g, or t
  misc_feature (860)..(860): n is a, c, g, or t
acctaacaaattcccaggtctcaacgaacgcgccgtccttctgaggaaggaggaggaacgacttccaaaggagacagcctttcggacaagccaaaggacaagaaagaagcaacatcaaaaggcggcagcagcaccaccaataacgcgccgaatgccatggtagatgaagcaacttcaaaaatgcggcagagcatcaataacctaacaaattcccaggtctcaacgaacacgcctgctcaaagaggagcaatgacttccaaaggcgacagcaaaacggacaagccaaaggacaagaaagaagcaacatcaaaaggcggcagcagcagcaccaagaacgcgccgaatgccatggtagatgaagcaacttcaaaaggcggcagagcatcaataacctaacaaattcccaggtctcaacgaacgcgccgagtattgccaaaggaggaggaacgacttcaaaggcgacagcaaaacggacaagccaaaggacaagaaagaagcaacatcaaaaggcggcagcagcaccaccaataacgcgccgaatgcccaggtagatgaagcaacttcaaaaggcggcagagcatcaataacccaacaaatttccaggtcacagcgaacgcgcctgcccaaggagaaggaccatcttctgaaggcggcagcaccaagaagccaatcacagacaaatcaaattatatgagtcaaccataaactttcttggaaaatgatcctgtatttatgttatttgtggtgataagtttataattgatccgtattttatgttattgtntgatcattctatgattcgatccgttatttatgtatttattgtttcattgttgattgatccccgtattatgtatgtntttattcactcatatacgaaatataaaaccccaacctcagggtttgtcagatctgaggattttatcctcattttgtggctttattgatatgtcaatgagggatttttttgaaaaatgatgattttttgtggcttttcgaggcctgtgggaaaaatcctcagaatcttttaaattttgataaattggcataatgaaccaaaagactgtattttattaatttgaatgctgtttgggtatttgggattgaaaaattgaagattgaacccgattttggacataggcgccaatgtcgggacgcaaatgtgggataacctttaaaatataacatttcatgttcgcttaaaaaatttatcaattttttaaaaataaacaattagcataataataagtgatcaaaacagcaagatggactttttgcttgcaattagaactctcgtagaagccaattctgaaaagtgcgttttaaaaaaacatgagggaatatccatccgttcctctggatctcgatcacccactttgatgatgtgatgagcaattgcgccctggggcggaatgtatcgcagttggattctcgtctcgggatcctttccactttctgtttaaaaatattttaaaacgtcatttctcatgtccaagatggaatatttggcacgcccatccgatcaaattgaaactgtaatttaattgtttaaccccaacaaccgctaagatggcggtacagcttgatcagcagcggatcttcttcagaacggcgcaatgcttccgcaacttcttgtcgactaaaccatttggcgtattccaactcggaaatgctcgcttggatcttcaacaaaaaaaaacagtggcaatatgttgcggaaaataataatagaaaaaaattaaaatttgttcgtaaaacttccaagaaaaaagccccaaaaatgcttccacatgtttttacacaacacacacttcgtcacccatgttagcagtcgcgacaaatggaaccatcagcgacccggcgggcaatggccacgtctgcgaaccgtccagcggccgaacatcccaacactcaatgccaacttcttcggcgacctctcgtcggactgtttggtcaagacgctcgcccggctgaaaagaaaagccaaatatagcattcatcaacaacaagaagagacatgatgaatttaaaaaaaacgacagggtaaattattggccggtgatcccatgaaaatcccatggagccccgatcatatggttctataatcttaatcgaaggattacattaatattataatttttcaattttgtaatttacaagttggaaaaaatcatttttaaaatgatgcccccaccgaccgaacaaaaaccggcaatgcacgtgtacacttggccagcactgcgtttatgcctcaccaacagagtgtgctcatttgactcgtcacgaagcaaagtgatcgccacgggcgaaatctaaaatttaggaccaattttgcaataaaaattatttttcaaaattctttcaaaacaaatttctttcaaattttataataatcgagaaatttttttctattttttccataaaataaatatacaaatttaaaaaaattaggggggggggtgcaccgcctgcccacaggggacaaaaactatttttctgtttaaattttgggaccattttttaaaaaccaattcagcaaaaaaaaaaaaaaacatgacgacacttattgacactgcgggataaaagaaatttccggtttcaaaaaatcacaaaattttcgattttttttaaaggcaaccccacatttgggtagaaatcttgctggcaatgtgtgcacgttgcggacgctttggacgccctcattcggagcagctgtgcgcactggggacagtgcaaaaagaggcggtaccaacgcgtgatgatgatacactgaagcaagcaagcaaatacaataagtacatttttggtatgggaaatttaatgtaaaaaaaattcaagggaaattgaaaagggtcctcccgcccgaatcatatttagaataaggaaattttgtaaaaa

SEQ ID NO: 16510 - DNA, 2960 bp, Heterodera glycines
cgtccagtcggccaaacacaatgccataaaaatgaaacctaaatgccacacaaatgccaacgaaatggcgccaaattcaaaattggccaacctttggccctccaccgattgtgtgcatcgcatttgtccatttctgttcctgttgctgttcgccctgttactgctccaacaacacatgcacacggaacagttggagcagcgactgtcccggttggaacagcggtgcaaaaatgttgttgaactgctcgaagaaccggtaaattgattgaaatattattttgcttttttaatacaggggaggggtaactgggtgccgtaaaaattcccgaaaattctgcctctaaaatttgcagattaggaaactgctcggttaaaaaaaatatagactttaggaagatatttatacttaattaaaggatttttatgaaaaatctataattagtgggatgccataacatttgggccaaattttaaatttctctaggtgctgaaaaagcattaactaattaatttgtttttatatgaaattatatttttacattaaattttaaattgtgtaaaaaattttaaaaatagggttttctaaaaataaaattaaaatagaattttgaaaaaatttgatctactttttgagatccctcaggaaaaaaccaaaaaaaaaaaaaaaaaaatcaaataattcaataattaattaccaactagagacgcgatttgactttttgccattgtaaaaaaaatttcttgtcaagtttttaataattaaaattaataaaatttgaataataatttttttttggtccaaataatttaatttaattttaaatatatttgttttttaattactttaaattatatttttaattattttccttctttttttattatttaattaatccaattaaatttggcttgtattttgttttgttttttttgttaattggtaatgtatttcattaatcggcacaaaaaaaggtgccaattaaatttctatttggcccccgcggggattaaccggtgtcagaaaatgggcacggatttgcataatcggaaattggaggttttttgggggataatctccccgttgcaaaatccattttttctgctggtgaatgagatgaatgaatggggaacgcaaaagaaaatgagaaaattgagaatctggaatggaaaatgtaaattttttaaaaattaattattttaattaataaaaaaacattttagatttaatttttaataattttttaaaaataacattttcatgtgactgaatatttataagcatgatttgttatttgttaatgaattgtttggtttttcaacgaatggttttgtttaatataaaaatccgtttatctttgtttaccttttaaattcacttcaatttattatttattaaaatattttatgttttaacattcattttttatgtaaaaatgtttttttttatataaaaaagtttcaaataaatgttttttatataaatggtttaattttactaatttcactaatgctactaggtaaaaaatttttaatgaaatttttgacaaaaaaatcctttgattccaattttttatctaattaatgaattaattacatatttatttaaatttttttggaaattgatatttcattaataaaaatagaaaaaaactgctttatccgtagaattcaaattatacacatattttgtgcaaaatgtaaattgccctactttatccctccgacccaatcaatttttgtctgtttgtttatcccatcccaagccatccttatcctctcatttttgtgtcccccctccccattgtgtcagtacaaaaaaaaattttttgctttgcctttggcaatccttttttaaataactaattaattgcatagagactcatcaaaaaatggtctgagatttttggccccaaaactattcccgattttcaattgaccattattttgccaatgctttttcttcaataaatttctctctctgaaaacggtaatttgaaatggtttaaagccttattaaacccgtggacacaacaaaaacattagaactcattagaattttacaaattaattgccgattaaattttagaatggctttttaattgtttaaaaacttttggcttacattttgtaaaattataatttatttattttttttttattacatttttaaattgtattaattttagtcggatgacgtcttcaccattgaaaatgctcaacagttgaggcgaacattgcgttcactgtacgacgatcggagacggcaaagggacggcggcggcacacggcaccaccaaaatcggcaccaccaccacaatcagcagcagaggacagcggcggcaacaacaacggcatgcatgtgccctcatggtaattatggcaattaaaatattggctaaatgatttcagggggtgtggggaactcagctgcccatcggaaataaaaaatgaatttgttttttaaatgtgtgcgttttttgaaaaaatttttgactcaaaaagtttatgcgactaattacaattaaataaatttaaaaaataacaaataaaacaatgtttaaatatgggaaaaggttttttagatcaagcaattttttatgaaaattacgaaaaaatgaaattgtcaaaagattcatgttgtatatattgtgtattatttaaatatttttctcatttgtcaatgcttaatttcaatttcgccttacctttcacttttacaacatttatttcacaggcattattccatggttttaattctttcccccattttccgcttttttaaacatttcctccaaaaattcttcgaattttttttatttttatcgggatatattttcatttgtttgtcattcattcgctatgtcaattgccaagtgtaaaatcatttaatgaattggcactttctgtctgcaatcataatttgtcaactatttaagaattaatttatttaaaaatatttt

SEQ ID NO: 16511 - DNA, 2932 bp, Heterodera glycines
ttttttgttttttggattggaaatcaacctttttcaccccccccgccctcccctccactattttcttgagccgaagccgccttcttcaactttttgtaaaaatagctaaaaaaaaaaggataatttttgtgttcgggaaatccttaatctcggttttattgggtctctctttcggttttgattcttggggtcaagtctcagtaagttctcggtcattaacggcacttgtactgatatggcttgctctcaaatatatttatataaaaaaaatcctttgaatcatcttcagcatatatcagggtatattactcgtctggtgtctctcgtaatctcgtattctcgtgtttttagaccgtctcgttctcgtgtcttgtattttggaacgagacacgagatttttatgcattggtaagtgggggcgggggggggggggggtgagagaaaatattttctcatacgtaaagaatttttttgtgttgaatttacatggaattttggtcttcccttgagaaaattataaaaattttcaatctttacacaatcacgactcttttaacaagaaatatgaaaaaaatattacaatatagaatatatatatatataattttttgttcatttctgccgatttgcaccaaaattattttgattttaaagtatttttatcataaaatagtgctttttattgataaatattaatcgagaaatgccgtatttttgtgtcatttctcgttggccaatttgtcaaaatattcgggccttgcgaattataaatattttattttttctttctaaaattattgttactaccgaattagccaggctctaatgcagtttacgcgtccaatcgacttttaggcgtccaatcaatgaccaacctcggtttcttaatttttacttaaattataaaatttataaaatgtttgtttttttattttatttatgtttattaatttattttagtgtttttttctttggaaaaatggacgaataaaaaaaataaacataacaaaacattaccatcatcatcatgatttgtgcagaatcagccaataatgggaaataatcatatgatagtgcccaaacagtaattaattcataatttattgaattttattggtgttttatgaatttcatcatcattatcttgtaaatcatccttacggaaaataatcttgtgattttttgcattttttatttttatgattaaaaataattaaatgggccggaaattgtttgaaattgcaaaattagttgttaaaatttgcatcatccacacttaatccatgacgaaattagtaagggcaaacaaataaaatggcatatttaagctgagaattttgtaataattttaacttaatgaaattcaaaaaaactaataattatttttttttaattttaaaataaaatttttaaaattcagaccattcatttaattataagaaaatattacagcaaaacattttatgattttgacaatatttatttccataagcataaataatcactatttagcaaaatcaagtttaaaataaataaataattcaattaataatttaattgttcaccttaaatgtcaacattttacattccttcaattctcttttacggatttatttggcattttgccaatattttgctttgttcggcaccaaatccaatgaacaattttgcaattaataaaggttatgaaaatgtgatttttataaattaaatttctaatttaaaggctcaccattttttggccaatcgccaaaatttcactttcaattaaaatcggaggaacaaaaaaatcattcaaaaacgatgtcaatttcacgaattgcatcatcccattcttcaatagaaattggtaaatttaaatgaaaaactaaaaaataaattatttttctaaaaattagcgcctaaaaagtcggtcgaagcaattgaaaatcaaataataaaacgaaaatcagaaataaatttggaaaatgaattggatggacaaagcgccacaaattcaaacatttcgccaaatttcaaatgtcctctcaacgaatatttggccgctgttgttgattataacggcttttatttcaatgttccggcgaaaacaatcgcaaaacttgcaatgaatttgatttttgctgttctgtcatcccaaaattggtccgccaaacagcaacagaattctgatcagccaatttttgatggcattttgacatttgaccatttttcggtgattcgtcaaaatgaatttgaatttggcgccgaagaattggcgggaaatttgaaaattgaatttaacaaaatggtggaaatggtcaaagacccacgggaaaggacacttccgccagaacagagaccaaaacagcagataatttggctcaaagatgtgctgtttatgagtccagagcaaatcaaagtttgtcattaattgcttaattacccatttaattacccaattaaataaatatttattaaataattcaggataaaagaagcacaacaaccggcaaagacttggtgtggttcgtcggtttgctgctctaccgaatgttgttcaacaacaaacaccccatggacaattgggagccaaagcgccgtttggacatggaattcatggccaagatgggcttctccaagttgaagcagttcaattgcatgtacaaaacggacgattttgtgacgggagactttggcatcgttccactgaagccgaaaagtcggtggatttggatgccggagagtgggcgagacgaaactggggaaatggcactggtggaggaacggattggcatggaacaggtggctgccaattaaaatgtctaaatggtgtaattaattaatgattattatttaggattatatcggtaaattgagaagcattgttagtgaatttgtgcagaacaatcaaaaatgcatcaattattaagatttgctggtgatgaagaga

SEQ ID NO: 16512 - DNA, 1641 bp, Heterodera glycines
aacaacgattggaagcgagcaacttttcagtgttgcgcgtgatgtgtttgactatcgtcgatctagtttaaaggctgaacatgctgaaatgctcatttttttgaacaaatcaattccgaaaattcagttttattgatttatcactttgattttttattttttctttaataaacgtattgccgctcaaaatttgtgcattaaaaatatttttgtgagttttaattaaattttcgaattactcccgctcccgcccgggactcccgttaaaaatagacgggatttgaacgggatcgggatttttacgggaatcccgttcgggactcccgtcccggaaaattttgaactcccgatcccgctcccggaaatttttttttaccgggctctaatatcaacaatgttggatttagatgactcagaaaaaatttttagtggaaaaacgagctggcaccgaaacgaagtggaccccatttcacggtcctaataagtttcaaaaatgggtttaagtgcaaaaaaactccaacattgtataaaaatggcttgctatctatcgaatgtatgaatttctccttgaaaattgtggcaattaattttcgggattttgacgcgggatttacgacacacaaaattagcaattagcaccggcaacattaagtgccgatttgctgctgttcttttctcttttcagcttcattctctcctcctttttgcgccgaatttttccttttcctctctttctcttccgtctctcctccttcctcaatgctatttccctcctcttcccttgtttctccatttttgctgttgtccatcttcatctcgtttcccatcaaaatttgctgttcttgttgtactgcttgaacttcttggttttgctgctgttgttgggtaatcatcggttttactggtcccataaaaaagaggtaaaaaagagattttgagcgattttgaggtgctcttgggggtttagggggcgatgaacacgaatatcgacatccatatcgacctatttcgaaacccggacccgaattcgagcaatttttttttttgcatttttcactcggaatttgcgtcaaccttctttattgtatcgtaaaattaccaattttataatatgaaaaaataatttctcaaaagattttataagctttagttgattcttattttaaggagttgctaattagtttctccggtttttttatttagacatatgcttaatttttacaaaaattcacttttaaatgattactttcagcctcagaaaagcataaatctgatccattcatttttcgcttttcactttttggttgaggattaggttgcttttcccaaagtgccgttgtgcgagcaaagaaaatgccgtccgttcctattcactggcagagaagggcattaagccactcaaattaacccaaggaaaatcaaatggacagattaatcaatggcaattaatctgagagaagagaaccaaaatgggtcaagtgctgagtagagacgaagcgagaataccctacttctcgagcctcggggatgagtctctgattaagacaaaacattctattttttggaaatgatttcaccccacctcagggctatacccctacactcataattttgtcacttcggcatagcaccaaaatttta

SEQ ID NO: 16513 - DNA, 1323 bp, Heterodera glycines
  misc_feature (12)..(12): n is a, c, g, or t
atttatatatantttgagaggtttttcttcataaaatgcatttgatcaatgatttgaattatatcggtcggtcattctcaattaattaattcatttcttcttctgcggctgatcactgtatttgttcttttgtccgtcactcattttgtcagcagacgacgcccctttttcgctgctttgtcctgcttcgtcttcttcttccggtggcggagacaatggccttaattatgcgaaatttgaattatttaacaaaactaaatgttttttttaattgctcacccaatgcaatcagtactgaaaagccaaatggacagacacattgttaaaattgttgtcccaatttccgtcttcccaatgaaccgccgcggtctcccaaataattttgcatcgtttcattatccaacttttgtccaattcattttcgttttctttggtcaatgtcagcttttggaaaacaacaatcagtgatttgccaaaaatgttggaacacaccagggatggcactgaattccgatttccgaaatttttgataaaattcggaatttttcagaaattttcgatttataacttttttggggtcaggtttcagaaaataactcagaatgccatccacagaccgggtacacccctaaaacgtcgccgtctcgtataaaaactaattttctgaatttccagataaataaaaaacgacttttttacatttccttgaattttcttaataatttttttcgaatttatctattttttttgatttaggctagataactaaattttaaataattttttaaattaaaataaaaatttgcggctacgttttgtcccccccccccccccccggaccacacctccttgaaactgttgacccaatagaagtccttcaaatttctgcaaaaacgaaatcgcttgggttggccagcttttctcggagagtgcaaccatttggacaatgcttggccagcagaaattgttgaatttggcccatcaaaatcagcatcaatcgcagcgggcaacagatcaaatgaatcgattgaattcaattggttgagatcagtgagaattgtcggtgaaatgagactacgcaaattgtccaaatgatcaccacaggaaaagcccaaacagcgaatgtttgtcgaaaaaatgggccaaatttcacgaacaaaaacatccaaaattggctgctcttccatggtgtgtgatgatggaatccgcaagtgtaaataggtgcctcttttgtcgaaaatttgatgatttgaacgaagaaaagcgatgacggagtgatcgatgtacctaaaaatgggataaatgcttttattgccataaatc

SEQ ID NO: 16514 - DNA, 1291 bp, Heterodera glycines
tgattaattgaatgtttgaacaattttcatgcattctttgaccttacattttgggtgaccataaaaatataatacatactattaattccttcatattatttttttataattagatagcccaaagatttctctattatgagttaaaattcaaaaaattttattgaatttaaaaaaaaagttatggtcaaaaatgttgagtctaaatttttcgagctttttgcttacaactttttgtaaatttttgcgaaatttttaaaaaacttataaataacataatagaggataagcagaactactttccatttttaaatttaataaacttgattaagtttaagctaagttagcaaataaaatttaaataataattaaatttaaagtagcagcagctcacatttttgtaaaacatttttccagcaaagggcaaagcgggagaagtacaagaagtacggtagtaccaccacgcgcctccccccaccaaaaaaaaaaatccagcgccccaaaaaagagaaaattggataaagagtggaaaatttgttatattcagaaaaggaaaagcacgtctatcattggcaaacttgcaaaaatgaaaaatcacgtagccagacaaattgccaagaagttggttacgatcgtgcaaaaagagcttttaacattggtggagattggaaatgcaaatgtgcacaaaccaaaaccgacaaagggaagaacattggtaaaataatttattaaaaagtgccagaaattttgataaaattcaaccaaatttggggggtgggggcggcatcggcactttgcaatgacagccaaacaagcagggcacaggcactaaccaggcggtgccataacaactcgtacaaaaggctactcgtacataggcttaggctaagcctttgctttcggcttaggcttaggcctaagcttagtatcatttaggcttattttattgtacgagttgcttttttacgggttgctattgactcaacggaggaaagatttttttaaataccttttttttctaaaaccaattttgttagaatctgcaaaatgtaaaattctccccagcggcacctaacggtatcgcagaactaaaaaaaatccataaatttttttcaactgtaagtgatcactgatcatttttggcgaaaaacggtgctaggacgaagtccgaatatggcaacttattaaatttaattaaaaaataataatattttgtaaaaagttaattcttcatttttatattttaaaaagttggatacactttatctttttaatctgggaatttatttttaaa

SEQ ID NO: 16515 - DNA, 2353 bp, Heterodera glycines
catttaaattattttatttacgttatttccctctctctgtctcccgcactatttctctcattttattgtgtctgtgctgcctttgtaaggtcagacacatctttcctccccgactttgtgacccccgctcatttccaacattcattctgtcttcctgttaatttcccactttttcctccaattgtcctccgccctgatttgaagcaattttgcaaaatgtccttactttggacccaaaaatcttattttttggccttgatgttcttattttgaaaaattttcgatccgagccctgattttcagaccacttcgaactgtattcgaaaaacgggtcaaaaattgcacttttttgcgaggatcttttttttacgtttttttcacaccttaaaatgggtcaaatcaaaaaacaaatatgtttgggcacatctacaaactcttggctttctaatgacaccagggttgttttggtccgggtccggaaagtgccctgaaaagggaggacaagcacttttggtcggcatttcttccaaaaaaaaaggaaaagggaattaaaattatgattcatttccaaaaatataagccttctccctaattaaaccatcttttattattttatgcattttttattgttaataaagttttcatctcaactttttttgcccttttcccacctctttctttccccgcagttttgcccattttagcggctatagcagaatttagcgttcatttgttcatatttttctaaattcattataaatttttagttaaatttaaaatgtcatcattaaacactttttcatcagcggacgaattttctcctctccaacgtaaataattaaaacacaataataaacatttttttaatttcaaatttgttaaaattaattttttaataatttcatttttagcaatttttccaaatctgagcacatcggaggaaatgagtgttctgattgcccgaattgctgagctgaatcgagccaaaacaatggagccatctgttgccagttttgaagtgtttggacaagacggatacggtagggaattttgtataattgagtggatacagtatgaaaattatacaataaaagaaatggttttgaaattttaaaatcaaagaaattattttgaaatttattaataaaaaagattattttgaaatttattaataaaagaaagcgaaaaatttggccctattgctgcagttcacaggacaataataaaagaaatggcctaaaattatttgaacacttgaaactatagcattttatagaagcaccacccaaattaacattctttgtatcatttatagctccaagagtccttttattctgtaaaattcataaaatttgttttgttcaaaaaaagtaatggccaaaaatatttagaaaataacttttttatttaaaatagagccaaaattattattttaaattttatttcataaattttattttgaggaatgaatgatgatcagttcagtctggaagaagaagaaggaaaagaacagcaagaagacaggaaaactccgacaaaagatggtaatatacaaatattagaagacattttcagaataatttgctaacttaacgacaatttaaaaaataattgaaaattgcttcaaatttcagtttcggaagatcatttgaaagcaattttggagagaattggtgaattggagaagcagcaacaacagcagacaaaaggcgagggcaatttaacgaaaatgaaaaaatatttaatcgaattaaatgtttccattttaaatttaaaaattaatccgatttttaagctactgcggggcaattgtcaaagattttggaaaaaattggtgaaatggaaaaacagaacgaaaacacggacaaaggcgagggaattttagcgaagaataaattatcacttattaaaaattctttttttttgaataagtttcttatgaattaagaatttcatttaaataaataaataattaattgttttctattttaagccgctgaggaacggttcttacaatcgcaaaatgatcagaagaaaattttggaaaaagtcagtgaattggagaagcagcaacaacagcagacaaaaggcgaggagaaattaacgaaaatgaaaaaatatttaatcgaattaaatgtttccattttaaatttaaaaattaatccgatttttaagctactgcggggcaattgtcaaagattttggaaaaaattggtgaaatggaaaaacagaacgaaaacacggacaaaggcgagggaattttagcgaagaataaattatcacttattaaaaattcttttttttaaataagtttcttatgaattaagaatttcatttaaataaattataacat

SEQ ID NO: 16516 - DNA, 1229 bp, Heterodera glycines
aaaaaaagtccccatttgcggttaaaaagggcgagaaatgtcaatgggagcaatattttcggcatgtagtgctggaatttcagaattctcgaaaactggcatctttgtgagaactgaaaacggtacgggagaattacaaaataagtccccatttgcgcttaaaagggcgagaaatgtcaattggagcaatattttcggcatgtagtgctggaatttcagaattctcgaaaactggcatctttgtgagaactgaaaacggtacgggagaattacaaaataagtccccatttgcgcttaaaagggcgagaaatgtcaattggagcaatattttcggcatgtagtgctggaatttcagaattctcgaaaactggcatctttgtgagaattgaaaacggtacgggagaattacaaaataagtccccatttgcgcttaaaagggcgagaaatgtcaattggagcaatattttcggcatgtagtgctggaatttcaaaattctcgaaaactggcatctttgtgagaattgaaaacggtacgggagaattacaaaataagtccccatttgcgcttaaaagggcgagaaatgtcaattggagcaatattttcggcatgtagtgctggaatttcagaattctcgaaaactggcatctttgtgagaattgaaaacggtacgggagaattacaaaataagtccccatttgcgcttaaaagggcgagaaatgtcaattggagcaatattttcggcatgtagtgctggaatttcaaaattctcgaaaactggcatctttgtgagaattgaaaacggtacgggagaattacaaaataagtccccatttgcgcttaaaagggcgagaaatgtcaattggagcaatattttcggcatgtagtgctggaatttcaaaattctcgaaaactggcatctttgtgagaactgaaaacggtacgggagaattacaaaataagtccccatttgcgcttaaaagggcgagaaatgtcaattggagcaatattttcggcatgtagtgctggaatttcaaaattctcgaaaactggcatctttgtgagaattgaaaacggtacgggagaattacaaaataagtccccatttgcgcttaaaagggcgagaaatgtcaattggagcaatattttcggcatgtagtgctggaatttcagaattctcgaaaactggcatcttagtgagaactgaaaacggtacgggagaattacaaaa

SEQ ID NO: 16517 - DNA, 1586 bp, Heterodera glycines
ttttaaggcaaaatttgaattttagcgaagaaaattccgaaaaataagtgaatcttggagagcaagaaaaagatttacgtcaaaaagcattgaaatgcttttgattagaattgtactagtgaaattgctaaaaaatgagatttttgaaaaattaacttatttttgacgcagttttttttttgttgaatttttgttgaatttttggcctttttgagattttggtggttttttgtcgcatatacatgcacatcagggatgtgccgaatcggaatcgtaatcgtaatcggaatcgcaattaatcggattttgggccataatcggaatcggataatcgtaatcggattttgccttgaaatccgattattacacccctaagaattgacctttgaaggaatttttttagcgagaataccaatgaattttgaaaaaaatgttttctgaaacgaatgttttaatcttattttaacataatgactgaaattaaatttttctcacaaagcagtgccggattaattctccccgatataatcaagttttttgttatttagcaaaaatgtcaaagtctttgaagggttgttaatggtgtcagtttaagaacatagcagccaattcacctatttttgaatcccggacccgaattcgaaccaaaagtcgaaattttgaagaaaaaatttgttgggacattaaagcagaaaagaaccatgaatgaattattactaagttgcaattttcctatcaggtgcgttggtcatccaccttccaaatgcttgatcgttttttgcaaaacaaaacagttgttgggcttctgtatgcagaagacatttcgtttccgaatctaagctatcaaaaaaatatttctcagccccagctacatcgactgaaagcgaacggcttttctacaccgctgggttgattgtgacagatctgagaaaacgtttattgcctcagaatgtggacaaacttttatttttatgattttgattatgaataaaattttgggaaaaaattattttaaaaaaatcggaatcgtaatcggaatcgcaattaatcggatttttggccataatcgtaatcggttttaaaaccgtatcggatttttggccataatcggaatcggcgatttaatcggaatcggattttgtctggctcggcacatccctgatatatatgcttgcctttatatgcattaattcttcatcagtaggattatccaaatctattttttacttaaagaatttattattattattttactaaataatgatgcaattattcaaaatggtgaatgatcaccagtaggattattcaaatctattttttacttaatataatttttatataaaattaaatattgtgcaattatttaaatggtgattgctttaatcggttgtgtgggaatttttacattcaaaaagccttttttgcggcggcattttttcaaaaaaactttatatagaataatgatcaggttcttgtggaccttgaccagaaagaacgcattagaaacgaaggagctgataaagtgaaaatttttttcaaaaaattttcaaacgcaacggaagaatggcccgagcataaaagggtta

SEQ ID NO: 16518 - DNA, 1704 bp, Heterodera glycines
gcaacggcgatgcttcgatgaagtcgtaccaatgcgccaactgccccgggcacccaaacggccatccattcgtctacgtgccgaccgcccatcctcgccaatcgttttggacttcgactcaagatcagcaacttaccgatcacgcgcatcaagcctgacaatcgacacgccattcgggaagtcgcaaccgttcaaattggcagacgaggattgaagaaaggaagaagactgatgagcccaccgtctcgcgcggggaatgttcgaattgggcataattttccataattcccccaattctcggccaatcaaacaatttattgcctttcccatgaccctcatttcattcgccccattttcccccgtcatttcattgtaaaattcgccaaaggtgggcctcccactcatttcttcgccccaattctgcacatttctgcaaaatcgtatagttccacgtcgaaatgccactcaccattacgcccgccaatcccattcacatgtatttcattgtcgccaaccgtcaattcatcgatatttaagcccctttcaatcatcccaccttatcagcacaatttatggggaggcaaaaatcatgccaccattgccttctcttctccccccaattcattcgatcattttatgtaaaattgtaaattgtacaatttccccccattcattcattcatttttcgctcatttatatgggcgaggtttaattacccaagtttgagatccggataaatttgttgtttttattcgcttttgaatttgggcacattttgcctatcgaccactcgccaaccccgaccccacgaacaaactttggactagtgtgttcgaagtaaaagttaacctcggacgcccacgccgcgttcgaacaaaatggaccaaacgttttccggcggcgatacgattccacaaaacttaaaaatttggacttttttaaagatttttatgaaaaaaaaatcagttatcaaagcagaaagaaaacacaaaaaattttccggcggcacctatcggcaccgccggacctctcccctcgcccattactcaaatttttttggaaaaagcacgccgcaaaaaattattaaaagtctgatttcttaatccaaatgtactgaatattacgatttgcttatttgtttcccaaattgttaaaatcgataatgggagacgaaaagcataataatttgatactttttgatcgaataattgtaaaaaaaactgatttaaagcaattttgcaaaattttcttatttttgacccggttgttattctacaaattagagtagtacgggaccgggaatttggccaacaccgggactgggacttgccgcgactgaaaagtgggaccgggagctcgtttctcgtccgtgactgggaaccgggaccaaccgggaattttttcaagaaaaaatccaaaaaaaatcaatttttgatttatttcaagcaagaatattacaaaatttatttatttttcttttgttttttattctataacacccaaaattaaagcaagttaaatataatatatatttaatcaatattttcaaatcaaatttattcaattattttcaaaaattaatccttttttttttgactcaaatgatcgaacattgttagaaattcagaattttaatcttagtgtgtaactaacgatttggaaaaccgaaaaaatttgtcaaaggcttcagaaatttcggtattt

SEQ ID NO: 16519 - DNA, 2236 bp, Heterodera glycines
aaagtctaaagttcaaattttcaatttcgcattttttcgtctaaaaaaacattaaatgatgttttatcaaagcaatgatgattttcacttcggtttccgtgtatttaaaacaaagtttgaaaaaaatgtgaaattcgaacatttttactgaaaatgaatttttgactttgtgttcgaatcctggttcggggctcgaattaggccaaaatgaatgccagaaaaggatttcccgccacttaaaggcccaaaaaaatttatatcaagaaaatttgactttttaaatattcggcccgacatttacggccctaaaatatttccagttgaaggatgtgacgcaactctctcgcaatttccacacatttctttgtgaaccgttgcgttttgccgcacttcaaactcctgtagcccttcttcattttggcgaacttggcgtgggaaaacgacatgtagcacgaacaattgcggacgaggcgaagtttgaactggtccgaatggtcgctttggacgacaacttgtgccaacactcaacaacacgccgaaaaatgtatttgtccgccgcttttggtaaaatttggctgtgtttgggattttagcactaacaaataattgcgcaaggggcagaatttttatggactcggtccaaattcggacaaatcaatttttgttataatgaaacttaattgctctcaaaaaaacttttaaattcagaaaaatagctattaatacgggttggtgcattcaaataattaaaaagtttttgcataatctttaattttacttttttgcgattgttgctctttctcgaatttctcatttttgatctaaacatgacttatatgatcttttattgcaaaatttttttgaaaattttttttcaaaaaaatggggggacaaactaagtattaccaaattaccttcaattcatccaaaaaataaacgaaatcgaaaacaaaactagaatttcttttgattaatcttaaaatcttgtttttccaatttcctgaaaaatcctttttctattgcataatttcatttaatttttgttagagaggccccgtttgcccttcccagtgttttgctgattgtacacgttgagaagctgtcgcccatacgatttagcgctgcaattgacgacgcaaaagacaaaaaggcttcctcttcattggcacgtcaacggagaagaaagctgtggaggtgttcgccaacatcgacgagtcattgtgcaggaaaatggagattccactatcacttgaaccgagacaccatcgcctttttgagtaggaattttaatgcaacttgttgaaaaaagcgtattttttccttttaaagaaattcgcgcaacggtgaaccgtactggagcacaggccgttttggacagactgccgtttgcgttcatcagttttacaaggcactcggtgggtgatgaaattcgtgagacttgttcaacttgattgtccctaattcctttagttgaactaatgagtgaggtggaaaagtcatgagacattcccgttttacggagcattggatcgtctgtgagttaataatccatttagttagatatcggtctgccgacttcggcttgccgaagtaggcaagctgaagtcggcaagccgaaatcggcaagccggtcggattttttaaattaattatataatccttttgcaatccctagtaaccattttacacccataaatttcatccaatgatggaagatcgaattcaccgccccccgcttccgcgttgctccatccttgtcctcttcctcctccactccctccacttttcccgccaaactcgtcaaattctcctcttcctcctcctaggcccgctccgttttcccctcctacccaacctccgttttgctctcccccatttcatcttcctcctcctccattcccgtcactctatccgtttcctcctcctccgcttccgccacttcctcctcctaccgctccattcccaccacgctctccgtttcctcctcctccgcttccatcacttcctcctcctccgcttccactctctccgtttcctcctcttgctcctccattcccgccactcccttcgcttcctccccctccgcttccgcttcctcctccgcctcctccgcttcctcctccgcttccgcctcctccgttttgccctccaccgcttcctgcccctcctcctccaccgtctcgtcccccaccaattcctcctccacttcctccccctcctcctccgcttcctcctc

SEQ ID NO: 16520 - DNA, 1668 bp, Heterodera glycines
cactctcctcctctcccactctctcctcttcttcatctctctcctcctcttcctcgctctcctcttcctcgttctgatcatctccaccatcatcgctgttcatcctctctcccgtcctcaaatacttatgccacgcactattcaaactgtataatgcttccttacgctaaaattttttttgttatactaattaaaaataagatttttttataaaactcaaaaagcttgtattttagtgaaaaccctcttttaattgtaaattcaaaatttactatttgaattttttctcaaaaatataaaaatctatataattgatgtgtcaaaaataattaaaaagatggcaacccaccaaaaaacacacatccaataataaccattcgttgcggttgcccaggtgttcttgcatttttggcaaccacggcgtttcgaagttcaaatacgagaagcgcgccaggacgaagcggaaggtcttatggcaggtcggacatcgtcgtcggaaattagtcggctccaactgtttttgtaaaatgttatattttcatgtataatttgagctgggaccagtgtaaatgttgatcggaacaattaatacttgataaacttattttttacatttgaacaacttattattaaatatatttttagaaaattgataaaattccttaataaatgtttaattccttattaaaaacaaaagcataaataataaaaatattttaataatactttaaaatgtgactttacagaatgttataatgcaattttactttttttattaaaatattttttatgcaaatatattcatttattttttattaaactatttaaagtcatgataagtttatctaaataatttcacaattagttttattttacagcttggatttaaaaattattatatttaataagatatacattatgaatttcaatttattattcaaaaataattgtgttgatttcgaatttatattatatatactttaatataacacgtattaaaacctataataaaataattttttttcatgtactatttttaatttcaatatttaaatccatttttatattctgattgtaaaaaaatgatcgcttcgaaagacgttctagatttcatcgcagagatccttgttttatttaggttatactcaattattattttatattcattttttttaaaacaaaaaatacatttgttttttattattttttcatgataattttttacacacattgaattataattaatatttatttatttcaaaaatgcaagtattgaaataaaaaagaacttattaatagcattatttaatttttttattcgtttaattaattatatcatattttgcaattttatatttcgaaaacttttttaaatatttgtaattatattgtgcgttaattttgggtgttattcacatattaaatttctaatggcattgatgtccgtattagcagctttgttaatcaattaaatttatgttgcgcatattttattatttaatgccttttgtttttaaaattaattaacattttattaagaaattttgcattattcaaaaaatatataaaacggaaagtgtgataatgaattatttcgaattctattatttttaaaagaattattacaaacgtgatattattcatttagattcttattgtcagaatgaa

SEQ ID NO: 16521 - DNA, 1314 bp, Heterodera glycines
acaagcttaaatttgtcattgtaagtttttgaaccggcttaaaactcgaaaaatttggcatttctaacttttttaaatgaacagatcctgaattttggcgaaaatctgaaaatccggactccaataattgcctcaaaataatcactacagcgaaaattgacaaacaactttcgtttaaccgagtatcatctttatcaaagtacacatacaaaacatacagacatatacatcgccggtccaaaacgccggttcccgggccgggttgcattttagaaaacgacgcggtctctcaaaaaccggtcaaaccggatttttccaaaaatcaccggttccgttttccgagtccggtaaaaaccgggcccggctcggtctctactaatgatgatcaaacctaatcctgaatttaagcctaaattgcttccgttacatttttttgccattatgtacaacaaaagggcaatgccgcggataatggcacgcggcgtggcggtgaagcagtgcaaattcgacattggcggaggtggtgaatataaatggggatgagagcattcattggtcattattaatagacggaatgcgaacttttgggcacgaattccggaatttttgaaatttggatggcatccagtcccattccttttttgtacgtgccatgcaaccaaccaaaattattagaaaaacaattaaattttgtgccatttatgcgtttgtcttggttttgcctttcctttatatttgaaggattattaaattttgaaaatttatctttcaaaacttcccattaaatgttttttttgttcattttttgctttttccccattttaacagacattcccttcgcttctcccttttcgttcccttctgagccgtcgtcgtcttcgaccagtaacagcagcagcaacgagaacaaccaaagcaacgaaatcaccgccagtggcggcgctctttccgaggctccggcgatcgatggtttttaattttcaaaaaacccccaaaattttaattaattaatttcgttcctttttttgatgagcttgactacgaaattggcaccaaagtgttcgtccatcgtgcgcttggcaaagtattatttgtccaaccggcggccgacgacattcggcaaacgacgggtgccattggtcggtttgtagaggatttattggcggggtccataaaaaccagaaaaaaatcttcggagggatgaattcgaagacttttttttttgccccttcccccgggcgacggttttttgttgcttttactccatgttttttcatttcaaaaaattctggagaatatgggatgggggggggg

SEQ ID NO: 16522 - DNA, 1403 bp, Heterodera glycines
  misc_feature (1376)..(1376): n is a, c, g, or t
gggggggggggaaatttgggggtataaatcccaaccccggccccgaataaccaaaaaaaaaatctaattttttttaaattttattttaaattcgtattatggacaaatccaattgagcatatactgtcaatacttcagtttttgaaacctccccactttgaacgattagcacagtgtccgctcaatgtgcccttttcgtctgtccaatttcggcacttttcaggcccttctcacagtcagttcatttcggacggccaaaatgctgctggcgttggccacggcgtcacttcggtggccgcgtcgtctcttccgccgatggcattggccgttttgccgggtaaatttctcaaaaaaggccaatcaaattacctaatttttttctctcaaccgaaatttaaaaaatgaagttcattttataacataaattctagggtttttagtaaaaaaaaaaaaaatttttttttgaattttttttctaaatgagaatctttctgaaagacgatttttttcaaattttcaaaatgttcataaaattattagaaatattttttgaattttaaaaactaaaaaaaatcattttaatttcggtttaacggaaagttctaataaaaatgaaaatgaatagagtccctaattctgttcggtttaacggcatttcaattttcttaattttttgaagggattgccaatgacgtggagtgtttcccgtgccgcgtgtgctgttcgccggaccaaccccagcgcgtgttcctcacccgggcggggctggagaaacacgcggcggagcagcacccgcaaaagctggacgaactcagcggcatggcccagcacattcaggtggaggggacggaccgtttaattttcctttcaatttcttcaaaaagtaaaaatttttagtgccaaaatgttttttggcagcaccgtttacctcaatttgcgattttagtattttttttattaaaagttcatttttagaatgtgtgggccaatcgacgatggcaccagcaccgcggccatggcggagcaccgccgatgccaccgccaccgctaattgccgtccccagcacaacgccggtggtgggcgactgttacgaaacgatggcgaatggcactggcggcgcactgccgcagtcagagaattgcgacacggtcactcaccaggtcagcagaatggcacgaaaaattgatacatttgcctggcgagagcgtggccaggggaaatctccgccaattaaatttttcacggcgttccaaatgggcgatttgggcgaaaactattcaaaaggcaattttttgtaaagaaaatttggggtcgaagtgctagtaaaagaaggttttcgaatcccctccaaaattttttccatttactggtttgngtggcgaatttttcatttaatttcaaa

SEQ ID NO: 16523 - DNA, 3082 bp, Heterodera glycines
ccccccccccgcccttcaaaattttgaaaaataaataaaataataggagactcagaattttgaaaatttttctgtaacctttatactactattacaaaaatggcggattttacgaaacgtcccagcacgtttttcatctaccgtattttcccttgttcaattgaattttttttcatctaccgtattttcccttgtttaattgaatttttttcatctaccgtattttcccttgttcaattgaattttttttcatctaccgtattttcccttgttcaattgaattttttttcatctaccgtattttcccttgttcaattgaatttttttcatctaccgtattttcccttgttcaattgaattttttttcatctaccgtattttcccttgttcaattgaattttttttcatctaccgtattttcccttgttcaattgaatttttttcatctaccgtattttcccttgttcaattgaattttttttcatctaccgtattttcccttgttcaattgaattttttttcatctaccgtattttcccttgttcaattgaattttttttcatctaccgtattttcccttgttcaattgaattttttttcatctaccgtattttcccttgttcaattgaattttttttcatctaccgtattttcccttgttcaattgaattttttttcatctaccgtattttcccttgttcaattgaattttttttcatctaccgtattttcccttgttcaattgaatttttttttcatctaccgtattttcccttgttcaattgaattttttttcatctaccgtattttcccttgttcaattgaattttttttcatctaccgtattttcccttgttcaattgaattttttttcatctaccgtattttcccttgttcaattgaattttttttttcatctaccgtattgtccttgctcgccttcctttcgtccttgcttcttcttctgctgctgctggtggtggtccaccattttggccaccttcgcttgcagttcattttgctcctccataagctcatgatgcttcaactttgattgaagtaatttctaaaatctaagatttaaaaaaaaacctatttttcgataaattgaacccaaatgataacctaaggcgttagctaaaaaaagatcaatggaacatttttaacagataattctttatattaggactcaatttttggctctaaaaaccgccaaaataagaaggctttatgctctaaaaaccccaaaaaataggtgctaataagaatctattttttggcaattttaaaaatacatcgacccaaaaatttataaaaataaaccccataagaaatgaaaaatgttctcaaaaatctaaaaaaaaatttacaccacgaaatttgtgaggcgttttggagcatattttccatttttagagcctatttttgggggtttttagagcctaaagcctaccgattttggcggtttttagagcctaaaaatattcgccctagtcataaaaccaattgagtgaaattaattaagattgatgaaacgaatatttattgaaatgtgaaaaagatggttttaaaatttgtaaaatttcccaaccaaataattttaaatgataataaataacccacattcttcaactgcgtaatcatgcacaattgttctgtgttgctcaattcctctttcattttcgaaatattttcacggaatttctattaaacaaataataaataactaatttaaaaaacataatttatttgtataaaaattttttgcaatttaaaatattctaaaaattactttctgctgcggatcggcttcaatttgtccttgaatttccacgatttgcacgccgtcgtcgatcacttctactgaatttgctattgtgtagatcaatttaaatgaaatttaagtaatgtagtcgtaaaatccggcattttaactctttttttcgacaaaaaattggcataactttgcttaaaagcaatcaaatttacatttatggtataattcgataagcaagctttttctctattagccttagcctgcaaaatttgaactaaacactagcaaatataacataagttagtgcagaaatattagttgttatttgcttacaattttttttatattgaccaattttttttttgaaattttacaggctaatagagaaaaggtgggctatcggatgatacaaattttgattgttttaagctaattgtaagttattgctgctctctttctcttatatttattagaaactcagtttttctgaatttcaaatttatgcaatattttcctaccgtatcccaaatttaaaattattttcctaccgtttctgctttgttcaaacgcctcggaaacattcgtttgctccatgcattccaattccaattccacaattctcgccttcaaaacgcgcaattcttctgatgcatttgcttttcgtttagccatttaaaccaaatttactctaataaaaacaattatggtaatacatttcgtttaataaaactttttttttttaacgatcaactaattaaaagcaggtaattgtgggtttttctaccccccataaaaataatcgactcagaaagtttattttttaaaactcagaaaaatagttgctaaaaattcgaaaaaggccaaaatagttgaaaataattgctaaaaagtcgctctaaatcgaaaactattcggagaaaatgctatttttgggtttctctcgccacaactaagccgcaaaaaaaaaatagtttaaaaactaaaaacccggtctctaattattatttatttaaaaataatatttgagaaaagaaattaattggacagcgatgacttttcaaacctttaaaagcaatcgaatgatatcgagttaaatttttatgtttatgaaatttattgaatgacacgaaaaacatttttggatgtaatttaaaacataaaaaagttaaaaatgagaaaaaaaatattttatttcaatatgagttaaggttaggcatgggaaattaaataacggcaaaatgatggaggagaaaaaaaccatcattatttatataaattaataatccctttttttcattaattagg

SEQ ID NO: 16524 - DNA, 1238 bp, Heterodera glycines
tcttttcttggcccattttggtggagtgggggcgcggtgcggagcggtccgtggccacaaatgcatttggcaaaaagcccccaaggcatttaagcgggataaaaagtggggaggagattaatattattattaatattaatgttatccgctttttaataatttaatcagattttgaaaagatttgatgatcagccagagaaatctttttcaggaatttgatgtcaaatgacgattttttgaggggggggggatttgaatattgtaagatattttttgaaaaaaccacttggaaattttggtgaatttaattgaaaagtaatttttcgggaagaattgtattttttgaaaatcaattgaaattttggctaattttaataagtattttaattattaattatttttcaaaaattccaaattattctcagtttaatttgttattttttcatatttcggcgtggtctactcagttttcgggctccgatgctgactaattaggaaccaataagtatttaaatagaaaatcaactattttacatttcacaaattcaaatttggacaaaaatgagttaaaatgccgtaaaaaatgtgaatttgagtgtcttttaaagttaatgccccgagaaaaaaaaacaaaaaatcgcatccaatttgggacttcccaattttccggtaatatcaaatttcatcccttaggcaaaggcacatttttttccttctctttttttgcaaaattttaaaatattttataaacattttaaatatatttttaacaaaaaaaaatgatgccaaaaaggaaaagttatccataaagtaaaaagcattcgaatccaacgtaaatattgcggccatttttcaatgtaactaatcgactgtaaacgcgatggacaagtgccaaaaatgggactagttttagtggcattattttattttattttttatgaaatttgcccatttttattttttcaaaaattgtaaaaataaaattaattttaaaaaggcaaaaaaaaggtttttgaaaaaataatgggcattttttgagcgtaaaaattttctctgtaatttccctgaggagcttttccgtgttgtgttctccccgcccatgcaaataaggtaattgagataagaaaatggctttttaattaaaaaagctgaattgcgaataaaatttaagtgaattttacacagaaaaaatgaaaaatttattttttaaattaaaataaatttatttatttaaatgt

SEQ ID NO: 16525 - DNA, 2161 bp, Heterodera glycines
  misc_feature (43)..(43): n is a, c, g, or t
  misc_feature (108)..(108): n is a, c, g, or t
  misc_feature (2141)..(2141): n is a, c, g, or t
ataatttcagggtttatccagtttttggggtaaaatgccaaanatagtcgctagttaaaagttagcaaaatttcacacataaaaaaataaaattcaccgtcttcggcnccgaaaaggggagcccatcccaagcagaggcggcggtgtggcaactgaagtggacaacgagtctcgtcctgttagatggagcacaatgctggggaagtccagggagcctttgaagaaaaaaaagcaaatttaaaaatgagaacaaattcgaaaataatttgaaaaattctcaagaaaaaaatagtaaagaattgaaaaaatatataatgaaattaatgatatatttgtcgaataaaaaagaaaatttttatttatctttattagaaaacctcattgacatacattaaaagacttttattcatataaaaatttgattttgaaaatctaatacccaaattttgtgattttaaaaattgtgtaaaaatcaattttgagttttttaatgaaaaaatttttctgattgtgaaaaaaagtttttatcgataaagtttttgtaaaacgagccgagcgactgaaaaggagtacattttttgtcactaatgagcttcatcttttgtgtataataaatgctaataagagataacaaaataggtaaaacatttaatgagaataaaattgtttatttggttgactttgccaaaaaatgaccgactatttttttttgtcggaaacagtacgagtctagacgtattacgaattgaatttcgtccgttcaaaataatatatttattatgttaaatattaaaaaagatttttttcttgtttaaatattaaaaataattttaattaaaatagaaaatgaaaataaaaaaaataatattaatataaattaataacatccaaagtttattattgttatatatgtgaccattttgcccaccttgatgttgctgctgctggtgctgatggtggtggtggtggttgttcatcattaccattgtgttgttgctgctgtttgttaccaggacggcactttccgggtcgtcgagcggcaccgaattggacaattggaggcccctcttcaccaacaacacttgccgatggagaggctctgctgttgaaaaggacaacatttatcaatgccattattcaattgattcaatttaaaaccattaaatgcaaatccatgtgaaatataaaaattattcgatatgcttataattttgcactcgattaaacctctaaaaacacctaataatttaataataaaaatatagaaaagtaaaatattgcagaaatataaaagcttagaaaactcgataattaaatttaaatattattatttaagagcattatttaataatggacggaaaacccactttttggcatgccgccaatgccaacagcgacggattggcgccgtttggcgtgcatttgaatgcgactgccaaccgcaaacattggactttttatttcctggaaagaaagaaaaaatagatttgcttaatgctaaatcaaatttaaaaattgagcaaaacgcaaaattaggcgaaatatattttcttcggaatcattgatttcaatggcactgccaacttggcgttttgcccacacacacacaaaaagaaaatatattatggcccaagaaaaagagcggaagtaaaagtcacggaagacatgcttccgtagccaattttataaaaatttaagaagatatttagaaaaagaaggaattaaataaaacaatttccgtaagaaatggttgaaaacgagagaatggatttaaataaaattttaaaaaataacagtaaaaataaattaaaatttttacacaatttttattaaatttaagggcacaataaaataaattatttaaaaaaatatgcgcaacaaaaagcgaaaaatattcgcacattcattttttaacattcacaaaaatattcacacaatattattttaacataaattttggggcccttaattatgtatggttgtgctgcctaaaaattgaaaaaaaaaactcctgaaaacttgttctcgggggttttgggtccttgatcacgaatctgacatcttttttaaccaattccgacttcctaacttaaatttgaattaaaaataattataaaacgagaaatttgaactttcgactnttggtttaagtccgggtcat

SEQ ID NO: 16526 - DNA, 898 bp, Heterodera glycines
  misc_feature (851)..(851): n is a, c, g, or t
  misc_feature (881)..(882): n is a, c, g, or t
  misc_feature (890)..(891): n is a, c, g, or t
ccccccccccctccaccctcgggcgagcaaaatttttgatgttaatgtaatcaaggcaataataataaaataatcaggcacgtagccaggggggcgaaaggagggggagaaattcccctccccgaaatggtaaatgaaaaatttttcaagaaaaaatggacaattttttgaaattttgcataattttctttttctcattaaaatttccaaaaaaaaatttccctgcggcggctaaaaaaaatacacccctatgaaatgaacccaaaaaatttcataaaaatatttaaatttattttaaaaattatttatctcaaaactgtttggcgtaattttggaataaaaattatttttactcaattttttatttgacaagacacttttaactagctagcgccaagacaaaactatccctaatagaaaaacaatgtttaaaattgaggaggaaaattagggaaggaaatcaagctgggtttaaaaaatgagtgcgagatttttcagatttttttttgttattattgttatggacgaatccgttacgggataattatttgccgtaagctggacaccacacccattaagggcatatccgtctgtttgatgtgtgccgtcttcgtccaccgcaatgctcgtccgtccgtcattaaaatttgtatatttgtcaaaagcaattagagaaatacagctcaaaagatgctgcaaatttttgataatggaaggaagtttggccaacagcagaggacataaagaaaatggcaatattatatttatacattataaaaaataaaattatactgatttttaatgatttatttcagcaatttttagtaaattaaggatgctttttgagccanaatgactgaaattttttggcgatttgaccnntgcaggcnnatgcaag

SEQ ID NO: 16527 - DNA, 2189 bp, Heterodera glycines
cccacaaccaccaccgcatccgccacctccaccgcatcctcctccgcaacctcctcctcctccgcaacctcctccgcctccgcaacctcctccgcctccgcaacctcctcctcctccgcaacctcctccgcctccgcaacctcctcctcctccgcaacctcctcctcctccgcaacctcctccgcctccgcaacctcctccgcctccgcaacctccgcctccaccgcatcctcctccctgacttccgcctgaaacattaacatagttggccgccaaagattgattgcgtattacttacctccacagtttactatgattggacctccaccaccacccccgcatcctcccccgcctcctccacatccgcctccgcaacctcctccgcctcctccacatccgcctccgcaacctcctccgccacctcctccgcaacatggcggaggacagggaggggggcagcaacagctgctgcctccgacgagcccaccgaagaggaaagcatgggaaagagggaacaaagcaagcgaaacgagaaagatgcgctgcatgtttaataaatgcctaaaatgggaatggaaattgtcctaataaagtggaagcgctgttttgagttcagctgaattgggaacttggaaggattgaatgatgacatttgccaattggacaccgcttttataaggcgatcggtgatggcgcgcggataaatcagattagaagccgcccattgttcgctgccgaggaacaggctaatctggcaaacttgttcgactggcaaatgtcggccaaattagggcctttcctgttgaccaaaacgacccccggggccggatattttgccctgaagcgttttgcccccctcagaatgaatggtttttgcttattatctttcttttgtcgtggaaggctgacgaagtgattgtgtctgcttttatccattgtcagtcaaaacaatcgcggagagtcggaaaaagggcgcttctcccatcgatcatcggccgcgggtgggtggcctgtttaggcgtcggtgatcgccaagcagttcagactgattgccgtcatctgctcactgactgatcactatgtgcaaattgatggcctggagctcacaaaccaaacaaagcgcggattagcggggcagcaaaaccatcgcacgttgagggccattaagcaatgggaggaagcgaagaaacccgttgggaggggagagggggcagacacaccgaaatgggagaaaaacggtggggacagacgctgagagaagctgatcagaggagggaggagagattgctcacctcacagtcagacaacattttcagttcgaacaatcatttaaatcaaatattgagttaattgcaacaaacaataaaatcaatttgcataagtaacttttagtaaataattgtcatttaattccaattatttccttcattgctttacccttaattatgtaattacccctccgccacccattgtgatagtccatccctccaataagtgatcaatctgatacctaaacccgtttccaatcacctttttccattccccagatatttccgtctaattatctctgccgacccttcctcggagaacattactgctgttaatgggaaaagttaaaaaaaactattattaatcagaaatgccagaaaatttcaatgtgcgaaaggggcgggcgagatcggaattcggcacgggaattacggcatttttgcaccatgtcatgatgggaaggattttttcgaacttttttcgttatttatcttattgatacaaaactgtctgatgttgcatatttgtctcattggtttgtgtgtgagattgtcactgtttcaatacccatgccaaggatgaaatattggaggaaatgatcagcgaatcggaatcggacagcggatatatattacttatccagctaattaagatataatttgaatttatcactcgtttatttttcctgcttttgctttttttttgttttgttttctcctcattttttattcatttaatttatataaattaaataatggtaaaattcctttctgctgcatttgggagagcctattctcattttctcatttcgctactgataaaaaagaatggtcaccatatttaaacaaatgtttttctttacctttggctctttaaaaatttttttaaaaaataataaaagcgaaaaattaataaataat

SEQ ID NO: 16528 - DNA, 2672 bp, Heterodera glycines
caatcacctttttccattccccagatatttccgtctaattatctctgccgacccttcctcggagaacattactgctgttaatgggaaaagtaaaaaaaaactattattaatcagaaatgccagaaaatttcaatgtgcgaaaggggcggaagagatcggaattcggcacgggaattacggcatttttgagccatgtcatgatgggaaggattttttcgaacttttttcgttatttatcttattgatacaaaaactgtctgatgttgcatatttgtctcattggtctgtgtgtgagattgtcactatttcaacacccatgccaaggatgaaatattggaggaaatgatcagcgaatcggaatcggacagcggatatatattacttatccagctaattaagatatcatttgaatttatcactcgtttatttttcctgcttttgctttttttgttttgttttctcctcattttttattcatttaatttatataaattaaataatgttaaattcctttctgctgcatttgagagagcctattctcattttctcatttcgctactgataaaaaaagaatgctcaccatatataaacaaatgttttcattaacttttgctctttaaaatattttataaaaaataataaaagcgaaaaataataaataatcacatgaacaaaaaatgaatatatttattttaaaaaaaataatactgtttactagagaccggacaaatgaggtcggagggatccgaccgaatcccggtccggatccatcttttgggtccaaaagtggagggaacggcggtgtcgaaagcgccgcttaaagaatttgttatgagaattagaaaatgacaatgttattttttatttattttttgtatttgaatgttatcttcattagaaaatggaagttattcgaaaaattataatgactccaatcccgcgggattggcgaaatggtcgggagagattccgactcggtggttaggtattttatcatttttagtaaaaataaacctacaaattcattaattatcaattacctaaaatataactgaaattgaatagtaaagaaattcttaattctaattgatcttttaaatatttattatttatttaacattttggaatttaaccttggtgcctaaaaaccaaaggaataaatctttttggtctaaaaagaagtcttttatcggtaataaaatcattttttgcctgggaaattttaaggatcttttaattttctggatttgtgactaaattttgaatatttttaagggattttgtgtatgcgaaggagaaaaattgttttaatgaataattagaattttaaaattctacaaatgtaaggaaataagcaaaaaaatattagtcaaaactctaaaacgtttttatttactaagattagataaatcagaagatttcatgaaaaaaagtacggacgggcacctgtattcaacataattgctgctggctgccttatcagtcgccggtcaatttccattttggtccataaatgggcatcgccccccccccctccgttttccttctacgtatgcactcacaaactgctggtttatttatgctcatatcaattaggtactttgaatttactccattattttttaagttcaattattttttggctttttcaccgaatgccccccaatttcaaatccgtcccctctccgacaacgaccttttatgggtctttggatcagcccaactgccgcagctgcaggtcgacattgccaccagtgacttttgctgggccaatgccttttttggccgatttgccaatcgcccctttggtcaaagaacggaccaaaattcagtgcaccgcttggccttccatttatctctgtgctttgttcactttcgtggcatctgtccaattcactctgttaacagcgtcaatgtggccatatttgatgacggtgaggcaacaaaaagggccaccgaatgttaatgagttaattagtgagaaaatgattgacagtgtacgcaatcacttggaaagtgatttgattaccgtttatttcagctggacacttctctctctgaaggttttttgggccttttgatcgcgttgttttccctttcgctgatcgtcgcctcggctttgttcggcgtttggtccaatcgcatccgtcgctttaaaccgccgctgtaaaaataatttaataaaattcataattgtaaaatgctccccttttagcatattttgcaacttttgtttattctgtggcaattttctgtatttttccgtttcgcttttcccctcccattggattcgtttcgttctcatcgcttcgcgaattgctgctggcattggattgggttttaaataatcaaactaatttatcgtaatttattttatacttagcccaaattgggcttctcaaatcctacggcatttcgttgactgtgccaagcgatcgccaaagagcgaccgcttttatcaccggagggagcgcaatgggcacaatttttgggccacgtaataattcaatagccatttgtatgtccactgattgcttttgcccagttttgcaattgctgttcactttcatcgaatccaatcggtggtccgtccgttttgtcattaataatttctccgttcgcctttctttagaagcgctccgccgctcttcgcttcatttgtcagtgttctt

SEQ ID NO: 16529 - DNA, 2914 bp, Heterodera glycines
ataagataattcgctaatttttaatattaaagcaatcgtcaaagtttgacgaaagaatgtcaaagcagagttcacaggtgttcatacgaggaatgttataattagagacgcatacaagccgtatagaacagacccacggtggatgcctaagtattaatagtggtaaatttggataagataattagctaacttttaatattaaagcaattgacaaagtttgacgaaagaatgtcaaagcagagttcacaggtgttcatacgaggaatgttataattagagacgcatacaagccgtatagaacaacccacggtggatgcctcagtattaatagtggtaaatttggataagataattcgctaatttttaatattaaagcaattgacaaagtttgacgaaagaatgtcaaagcagagttcacaggtgttcatacgaggaatgttataattagagacgcatacaagccgtatagaacagacccacggtggatgcctcggtattaatagtggtaaatttggataagataattcgctaatttttaatattaaagcaattgacaaagtttgacgaaagaatgtcaaagcagagttcacaggtgttcatacgaggaatgttataattagagacgcatacaagccgtatagaacagacccacggtggatgtctcagtattaatagtggtaaatttggataagataattcgctaatttttaatattaaagcaattgacaaagtttgacgaaagaatgtcaaagcagagaaaatttttgattgtatttctttccacttatttttcgtattttcatgtgcttatcagatgcaaatcaaatacgacggttgtccaacgtgtcctttggctaagattttgttgaattttatcccgcagatttaaagaaacaaaaaacaaatttcaaagtgtattcattccaaaatcagagtaaacgcttatcgttcacaatattattccatcatatccttttcctccatccgttccttctccccgtcattttttgtgtgaatttccttcctcccaaaagcactctttgggcccattccctcatttttgcgctcctccgctcattttgctctcctgccatttcttttccatccctccgccttataatttgcgtgctcaatttgagttcgttccatttttgcacacgttggcattccgccagttcgagttcaattagctgaatgccaaagtttttttctgtgaatgtctgttgtgcccttccctctcttttcgttcattctctcaccgtgagctgttcgcttactgtcgccctcaattcgccactcattgcgctttcatccgctgcgaatgctcgcgctttttccacctttatccgcaagtgataaaagtgtcatcgctttttctcaattttttaattctttttttttcttgaactcacttcaattatgcataacatttgggtgggagtgtcgcaaatatcggcgaacagatgcagaaactttgcgaggtgtgcaatcagcgtgaaccgtttccacgtgggtctgtttgaacacctgagaactctgctttgacattctttcgtcaaactttgtcaattgctttaatattaaaaattaacgaattatcttatccaaatttaccactattaataccgaggcatccaccgtgggtctgttctatacggcttgtatgcgtctctaattataacattccttgtatgaacagctgtgaattctgctttgacattctttcgtcaaactttgtcaattgctttaatattaaaaattagcgaattatcttatccaaatttaccactattaatactgaggcatccaccgtgggtctgttctatacggcttgtatgcgtctctaattataacattcctcgtatggaacacctgtgaactctgctttgacattctttcgtcaaactttgtcagttgcttttaatattaaaaattagcgaattatcttatccaaatttaccactattaataccgaggcatccaccgtgggtctgttctatacggcttgtatgcgtctctaattataacattccttgtatgaacacctgtgaactccgctttgacattctttcgtcaaactttgtcaattgctttaatattaaaaattagcgaattatcttatccaaatttaccactattaataccgaggcatccaccgtgggtctgttctatacggcttgtatacgtctctaattataacattcctcgtatgaacaccagtgaactctgctttgacattctttcgtcaaactttgtcagttgcttttaatattagaattagcgaattatcttatccaaatttaccactattaataccgaggcatccaccgtgggtctgttctatacggcttgtatgcgtctctaattataacattcctcgtatgaacacctgtgaactctgctttgacacacgttggacaaccgtcgtatttgatttgcatctgataagcacatgaaaatacgaaaaataagtggaaagaaatacaatcaaaaattttttcttcgttaaatgttgttgtaactgcgactttgtcaagcgggacccacgcgtttcggcgcccgcgtttcggcgctcgcgtttcggcgcccgcgtttcggcgccagctcgtttcggcgcccgcgtttcggcgccaaacaaaaatataaaaattcaaatatttggttaaaatcaacaaaaataaaacttttttagttaatcaatttcatcgaatatggcttcacaaattgaaacaaaaaaacaaaaactgaagcttccccacggtggacatctttacacattcgataaaatgagtaaagatgaaacgacaaaattttggaggtgcgaattcaaggatagcgtcaacaatgtaaaggccgcatttggacgactaaacataacttcatcgtcttgcacgcacacacttgtccgcaaatt

SEQ ID NO: 16530 - DNA, 3183 bp, Heterodera glycines
tgccatgaatttgtcccgaactgctcggctgtcctcctactgtccactgctggtgcttcaactgttcctcctggtcacgctgtagtcgtgccagctctccaagcagtgcatgcagttgcgcgttctggcgcacactttgtacatggacagcctcctggggacaaatcggggattgggttgaaacacggggacggggggccgggggagacgggggacgccatttgtgcagcttttgaccgggctgctgatgctgctgttggatgtgccgtttgattttacaaattcgcatcgtttttttgtggtaggccctaagggtattggcaatttatgtagctatcttcaaaaaatgatcagggcaaaatttaggtgatcaaagtagggctggcttttcatacattttatgtgggaccgaatttttggtgggtttggaagggggagggggtcatttgtaaactttgggcctcagttatttttggcagccaaaattggaaaattagtaaatttacggtcatttttttttggcattttgtgttgtgccctacagagacagccgacgctgacccaatttgttgtacccaaattttgttataaaattccaaaaaagctatttcgtggagaaattttggattttttagcctcatggtttcagatttgaaaaaaaaatgtttccggtctttcattgggatgtaatttggactattttgaatgatggaaaatttctaggaaagcaaatgaacccaattagtaagtacaaatgactgaaattgacacccaccaataccaccaaattccgattagcagcaatttggggttgatcagtttaataatggctgggcgggtggtgttcatttaccaacaaaggtcatccatccagcaatccattcattcattgacacggaattcgcccaccattttttagcaatcattcattcatgcatacattgaatggtggttgtggtgggtggcatttaataatacatatgatcagcgtaattagtcaatcaaacaattgattattgattgattgttttttgacattttattatttttatagaccgtatatagcgggtgtcgaccgttttatttgctaattaatcaacgattacggtattgttacagaattacttcgaatttagccagcttagttgttaatattttgttacaatgaacatatgtataaaatgatcacggaaaaatgttaatagaaaggcaatttgagaaaaaattaattactgagttatacactaccgtaatactccacaaaaatacagtaagcagatgttaatgaatgtgcttttgagtaattaataattttatcatctcttacaaaggtcaaattgcactcacattcatataatattactttactgactgttacaccaaagagactttcacgtttagtgcgcaacaactcattagataatgatctctgatcagtcggtcggtcggtaattaattttggatatccactttctgcctcccttattacgctttaatgatcaattaactcacaattttgcaaagtttaatccattccggtaaattgcattccgttaattaccatgattgcttgccaacatgcattgacaagcaacagacgcaaatgcgtgtaatcgagaggcgaatacaccgcgcgcaaccacccgcacgctgccgtcgctcgagttagcgcacgcgctctcgcgcaagcaatcgcgcgcaaatattcaccaatcgccgctgccgtgcaaacgcggcgcctgtctcgccgtgttgccgccgctcgctagcggccaacgtggcaaaagtgcacaccaaattttaccgcagaacacatcttctatatgattgcgggacgatgtagattatctgtgtgatacagcaataatatgtatatatgttttgaataaatgcaaaatgtaaaatatgatttaaaaaaaacaaatatctaaaaatgctagcaaaaaatcgattgatcaaagcatttttgatcaatcgataaaaggggagagagagatgaagcgttggcaagaggaaatgaatgatcaatttgaaaggctgaatttttattttaccggaaaatcataattgataaatttatgattattattggaacaattttaataccaattaaccagctttagaaaatccgaattgatccaatcaatcgacggtgatccgttcaatcacttagatttaaaagtaaaagccaattcctctcaccaaatcacttcaccaacactatgcaaatttaaaaaagaaaaataataatatctagtaaaagataattgtatgattagagaatggacagctgcgggatggaccggggactatgacaattgttggcactttttgcgagattcccgagtttcaccagtcccggaccgtagcggggttggccgcgagactggggcataaaactcatttaaattggacccaaatttcgaattaatatttgcattaattaccccctaattagtgtccgagctctctctaatcactttactgatatggatatcaacaatatgtagcagcaatatgtggtggtggtatggaaatgaagtaggattttgatatgagtgatatgggcataatacatgacgacatattttaactttggcggtggtagtgatgataggtgataataatgataataagcaattagggttaattagttaattgaaaaaatggtagcactgttaacaaatcaattgacaaaaaaagaaaaattccttctggctcttcagtggtttattggtggtgatatggtggtgatgctgcgcaatgctttttgatgatgcctgcggcattgtgtggtgaggttgtgaacaaaacaaataaaacaaaaaaatgaaattacggtaaaattattattattattacggtaggaatgccaaaacgaaaaaaatgaattaagtgagcgatttatttggggaggaatggacgagaagggcgacaagtgaatattatgcagtggttggcaaggcaaacaaaagtgtacacaaaattgggctgggaattggacagtctcatcagagacaaaaagggtggcgggactgagtaaaaaattttaaagcttaggagcgacggagtgccaataaatatatgaattttcaattaaaaaaatttggcattttatattgtgggaaaattaaacaggggtttcaagaaacgaagtgttaaaagtgaaccgaaactaattaa

SEQ ID NO: 16531 - DNA, 1550 bp, Heterodera glycines
ttaattttaaattaaattgtcgaaatctttcaaacatctgtcttaacgctaataaatgttcattaaagtcggaggatttagtaaaaattaaaatatcatcaacataggcaatcacattatcatgaagaccagttaatacctgagccattgctcttgaaaatgctgcggtagcattttttaatccgaatggcatatgagtcatttgatatacattatcttctgttataactccacattttctggatgcctcgggacttaattttatttgtaaatatccactagataaatccaaagaggagtaaaaatggcaatttgcaactctttccatgattgcgtccatacggggaagtgggtaatgatcaggaacagtaatatcatttaattgtctaaagtctaaacatggtcgaattcccccgtcctttttctgtactatgacaaaaggagtgacccaaggagtatctgactcaaccattactccagactttaaaagctgatcgatatgtttttgcagctctgccctatacctataaggagttctgcgaggtttggcagacatgggctcatttgttgtggtaactatttcatgttcaccctctgtaaatgaccctaagtcatattgggaatgactgaaaatgtcatgaaattcttcacatagtattttcaatttttctaagtctgaacccgttacagaacttttggaaaaatctattttgaaattggggtcaatcactatgtccatcattggtgacatactcatcactttttcagagctatcagtcattacaccattactgatttgtctaacctcatcagcataagctaaatgctggcctttataaagttgaaatggcatagcagacgggttaattataaacattttcactgtccctcgaaagggcgccgcaattacaggaattagaccaaaggaaatattgttaagtctttcatcgagtgaatggataaaaataggcttattcaggtctattgaggtgtctatatttgcctggacaatcatacccctgtttggagggaggataattgagttacttgcttgaattctcaaattattaataaggcaattattctgttgaattcctaatggagtgatatagtcaccaatttggaactttttatttggataatcaaaagtgaaggctggcaatttaccaagaatatcgcagccaataagtgccttataaaaatgagttttgaatttaaaatcatcaacaaaatgaataataccttcaactgaataattcccaattgaaaaaatgaccgtgcccttttctttaagtgtgaaagtgtggcctgaagcactaattacactgactgaagttgggtataatgtacaaccccagagttttgccattaatttcggtgctacactaatactggcccctgtgtcaattagggatttttcttgcgatgagttaatttttggaatcaataatcgaacaattaggggatattgcttcccagaatttaactgaatttttctaattttggaaaatctatcatctgagagtgaagctttgaaattttctaacttt

SEQ ID NO: 16532 - DNA, 1670 bp, Heterodera glycines
tgattcccgctttgagggattaatgataacaccaccatttgatcgatcagatcggcaccaatgatcaaatcaaacccttccttctcaaagaaagcattattaataaataaaagtggtgcctcgcccaaaatgacccctccttttgagaagagaacccacgccacagtcttgccctcgggtgcattatcagcagctttctccgggtccatcccgaaaggtcttaatttaacgcagacttccatcatattaaattcaggtactcgtaatgagccgagaattcgtaaaggagcaatagaagtctgtgaagcgctatcaattactgatactaattcaattccattcaccttaattcgagtgattgagagatctaagcatactgaagtaaaaccaattttctcttgatttggataaactctgagcattaagactgattcacaaattgttgcattttttctttctctccgaagagagttcaagtcattagtagatgaggctatcctattaacaggaacaaattgaatgtccggggtctcatcagcggaaggtgatgtaataggattacagacaatattttgagattgggactgtacaacattctgagctagtctagcacctcgatttcctaggagtaattgacctaaacgtccctctcccaggtatatctgtaaagcaaatacactaaacctgataaggacatcacagatagtgattagtgagataattgttatgcttactttccaaatgtaagaccagtcgccaaagagttccctttttaactcttctttagttttttcccatgtaccagaaatagatgaagaaattttcgtgtccctttgatgaatctgataagtaatatcgctaactttgactaaattattgatgaaggcatgcaaatttatatcggtgatattaaacataacaatgtgatgaaaagcgtgtgttggaatttggggaattaggtttaggttccacttaatattatcgtccctgagaatatttagctttgaaattcgagccgtgatttggtcaatgactaaaacatctccgtcgagttggagaataatttccctattttctaagcagtccgtcttacgggagtaaggtacaataatcatggattgtggatttaaaaatgctgttatttcatcagtatgagtcttaaatgcaattggtataaattcaaaacaattattttcggaattagtaggaacgaagtgataatcctttggttttaattgtgtacatggccaaactttaataagtgaagcaccaaccctttttgcaattaatttatagttagtgaacagcatgcgagccaaagcagttgggtcagtaagcaatgccgtttcggcccaacgatgcgtctctcccatgagctcacacgtggaggccgcaacatgacgaaaagcataactcatagtttcagacacttcagtgtccaaataagtcaattgtgatgcgaattgagaattagtaacaagactatccaatgctctttttcttttggtctgacgaccattctttacaataaaataggctaagttttgttctgttaatttcagagtactattacagctacgcactgtcgatttccctggtgcgtcagttaaagctaattgagtttcatctgctagccaagtattgttaagaacacgcccattgaagaccca

SEQ ID NO: 16533 - DNA, 1483 bp, Heterodera glycines
cggaaatttctttttttttaattttatttttcaaattacaaaaacgttttgccaattcaaaaagatttattttcgggtgccaaataattaatttttataattttctattttattttcaaatgaaataaactattttcagctcaatgtcccaaaaaactgttgatgatactagcagttggtggtactattttatccgtacggatgaaccccatgtcaaatgtaatagcggtgaatgggagcgagtctatgacagaaaaaagggacaaattcattgaaatgccatttggaaaaaaacacgatgataagtttaaggaaaaagaagaagcagagaaaaagaaaagagacgctgaaataaacggaaagcagcgagagagcagcagccgaagttttcaagcatgggttttcctcctcttgtcaaacagagcaacagtcatcacgcaaacgtcaacattcgccaataataaattttccaattttcagtaatttttattaatattgctaccttcaacctttttagaaaaatttgaatcgggaagtgaaaacgaggcgttattggaacataaaatttcggaaaagattgcgcttgattatcagccattttcagtggtcgaggacgaaggattacaaggcttttgaattttcttgcccctggctacaaacaaaagtaagatgtaattttgcgacaaaactactatttaacttaattaaggacacgaaagcacttttccgactgattaattcccagcatttatcaaaaattattcgcaaaactcaagtcaagtataacaaaatctgaccatttttcattaaatcgacggttggacttcaaggaatgaagcgcagtcattgatttcactaacagttcatttcattgatgaattattcgagccaaaattttatattttggaggcaagaacccgttcatgggcggcacacggccgaaaactacgttgaaattttaaatgtaataaaagattaagtttttagaattaaatcaatttttaggattctttggaactctggcattgagcggcacaaaatccacttatttatgcgcgatgctcaaagtacaatgcaggcaaccacgcgtgtttaaatgttgacggttttgattgcttagcccataagattcaattggttgtaaatagtcgctataattatacgcagtttaatttttagtctgttaatgtgggctgagaacgattgatggttttcggacaatcagggagagtgcaaaaaaataacgcgaaagataagaaaaagtcaaatttgcaaggaccggctcaaggaattacaaaaattcaacgaatttccgctgcggatgttgattaaagtaactaattccgaagattatttgttttaaatctaattttaggacgttgaagtcagatggaacagcacatattttaatgttaaaaagtttgcttgaaaaccgaagggtgttgtcgattttaagccaaagaagtaaacttacccaaattca

SEQ ID NO: 16534 - DNA, 1923 bp, Heterodera glycines
aataaagaataatagccttagataattatatctaataattaaataattcataaatgacaagatacggtgaggacaaacccaaccgtagtaggccaactcgtactgccccaactcgtactggtaccccgactcgtattaagtttcccaactcgtactaagactcccgactcgtactaaattacccaactcgtactatttttcccaattcgtactaattttcccaactcatactgtgcaaccaaaagaaaattttatcacaattttcactattttcattgaattagcttattaattatattttttgtctttttacaactaatgtatttgttttttttatcaccccgggggggggttatttttcaaccttctcagaaatggggggattattggatacgggtggataaatgaagggggattatttttcgacagattccgggcttaattagggcgaggatttcaaagtttttactcattttttctggggctttaactcgacgagaaatgcacgaaaaatacatgtttggtttgaaaatttccgttttatcgcccttattcgaccttagaaatccttattttgggtgttcgcccttaaaaatccatatttttgattattgcccataaaataagtttttgcccttattttggcgttttgtccaaatttattaacaaaaatgcataaaaacgaaaaatacacccctaagaatcggcactaaatttttaaaaatagacccataacaaatgaaaaatttcttaaaaattcaatctccaaaattttttgggccgataatcgtatgatcttatttgtaactgcaatcagtgaacaaaattgcttgccttaatctataattattttcatatagaaagagcaattataaaaattatacccctaaatttggaactttttcgtccttattttcgcccttatttcgcgattttaacgcccttatttggtgataagtggagacgggtggattatttttcaaactcctcagaaaggggggatacttggagatggagggattaatgaagacggggtgataaaaaataaaaagagcaatacggtagattataatatggtgagatagagaagaacaagcttccccgagaggaagattaatggatcaattgagacaacaattgatcctatatgatcgagcaaagtggggagctggagagggcagggtcggtagttcagctggtagaacactggtccggaaagccagagacgccggttaaaatccggcccgccccatagtttttccctcaaaggcttccccgctcgttcatatatttcaatggcatgctttattcaacagaatttgctcaaaatcagtaattttttaaggtaattctgattccattttttttcgttttaatcgtcgccgccggtaaaaaatttgatttttttgtgagaattagtagattttacacaaaaaagccaattttttatgaaaaaaaaattttggggtccggcggtactgatagactggaaaggaccaattacatctgaataaatttgagtcaataatataactaaatgttgttgacaaaatccaacaacttgtatcattcgaaagcctttcaaaggatctattagcctaagaataatttcttcagttttcattgaaaaagggcaattattaagtcaattttttgaaatcttagaggaatttttggcatggcggagccgataggcgccgccggggaaaaatttttttgggattttaatgaattttgttaaagaaattgtttaaaatttcaataatttttccccttttcccccttcgctggcgaccaactcccacaaagggtcatcattaacagtgtaaaaatactaaaaacccgagaccgggaaccgagaccgggaagcgaaaacccgagaaatttcccgagtcgggaaacgagactctcgcacagccctag

SEQ ID NO: 16535 - DNA, 2762 bp, Heterodera glycines
caaactggtgccgctagcaggggctaactgcagccagaaatccggtcaacgaacgaccagcgagcacggaattcgagaagctaacggcaaactggtgccgttagtagggggctgccagtgaaacatttcggtcgacgaacagagcaggcggaaacgaaaaatgcaacgattcgagttcgaggacgggagcgaaagcaacatggacctagcgaatgagggccatcccaacggcgcacagcacgacgaaaatgtgcaggacggggatggtcccgtcgcttcaacgaacgaagagcaacaaaaaattgccagagtaaacgaagcaacgagaggaagcaacatggcgacaggcgtggcgacaaatcagcaagggatgctacccttcccatcacgcaatttgcggagtgtatccatcccggtacggacagcgcgggacagaatctagagagcatccgggactctcgctactcgaattgcggaggctcgagaagtgatcgaccaagaccttaccgaaggggaggcagcgtaccaagcggcgcgacttttggccatggagaggggactccaggaagcaatccaaatttttcaaggacatttcgagattggaatggcagcaacgggagcagaacccgcaggtcaccaggacttcttctacgacatactgacagcgccactgccggcggcgacgaaagagttgcagttgcgaaaccatccaacaccagctgaactgcttcaaattgcggacgagcacatcggagacttaaggacgatgcgacgggcactcgaggatgaagaagaagcaatcgcgcggtctcgattgagcgggtcattcgggaccaacaacagccatccggtgggggacgacccacctccactggaaaatcggaacatggaagaatgggagagatccttccaagtggcggccaaacgatggaaaaacgacggacaaggtgtaccgcaacacaacagaagaccaatgggacgagtcgcgatacccgtcatgtcgtatttggacgggatttttcagcggcgtgccaaagtgccgtccgtcgccagcatgagagtgacgaacacagcgcgagaatggatcaatcgaaatcgagacgagatgggggcgttccccccagcaacagcccatcggccggcactgatgcaaccaaaaatcgaaaagcatcaggctcacgtgaacgacgactatcgggagcgtcagacataccccattcgacggcatgctcgagacgagggagaacatgatcggaagcacgggagggacgaaatcacgggaatgacaacattcgagactcggctgcaaccggcgattttttccgaaaagcccgaggattggacgacattttgggcctatttcaagcgagctgtggacgacaaacccattcccgggttcgagaagcagcttcatctcctgcgctgcttaaaggagggatcgccagcccggcgggctgtcgaagtctaccctccctccgacggcaactacccggtggtcgtgcaacttttgaaagagcgattcggcgacacggacgatttacagcgggcaattcgggcccggcttcttcatttggcaccggcaaaggacaatgtgaacagcctgacgacgatgatcgacgagtttgagcggtgcgtgtgccaactcgagcagctcggagcgaacgtggacgacgactcatttggcccattgctggaggcaaaattgccggtgcgactgctcacggaattgcggatcagagaaagcatgatgggctcgaaatggtcagtgcgcgatttcaggagagcgttgtcggcacaagtgcgatgaatgcggatctgtgagtcacgactggagtatatgaaagacccgggagatcgcaatgatttcaagaatttttatatgtgcacgacagtatgatatggtactttgggtataatttcctctaagcagcactagcttaacttcggaacttttagtacatactctctgaatgagctgagaaataatatatatttattcaaggtcatgaaaaattcaagaatttttatatgtgcacgacagtatgatatggtactttgggtataatttcctctaagcagcacaagcttaacttcggaacttttagtacatactctctgaatgagctgagaaataatatatattttttcaaggtcatgaaaatttcaagaatttttatatgtgcacgacagtatgatatggtactttgggtataatttcctctaagcagcactagcttaacttcggaacttttagtacatactctctgaatgagctgagaaataatatatattttttcaaggtcatgaaaatttcaagaatttttatatgtgcacgacagtatgatatggtactttgggtataatttcctctaagcagcactagcttaacttcggaacttttagtgcatactctctgaatgagctgagaaataatatatattttttcaaggtcatgaaaaattcaagaatattcatatgtgcacgacagtatgatatggtactttgggtataatttcctctaagcagcacaagcttaacttcggaacttttagtacatactctctgaatgagctgagaaataatatatattttttaaaggtcatgaaaatttcaagaatttttatatgtgcacgacagtatgatatggaactttgggtataatttcctctaagcagcactagcttaacttcggaacttttagtgcatactctctgaatgagctgaaaaaaatatatattttttccaggtcatgaaaaattcaa

SEQ ID NO: 16536 - DNA, 2847 bp, Heterodera glycines
  misc_feature (2840)..(2841): n is a, c, g, or t
cgcccccgaccccgaaccccgacatttttggccattttcggggaaaaccccgaaccccgacgcttcataccccgacaaccccgaaccccgacccttaaccccgatcggggttaaatatacacccctaagaatggcattttcgtgggagaaaatgcaaaaaagttagacgaaatttgaattttttttaaccatttgctaaatttttattaaataaagaagatttgctcaatttttgacatttggaagttcgataccgtttgacgttttcttctttaattattttctttgtgacaaattgtttttttttaaattaaatactcatagaaatcgaccaatcttggcatattttgacaaaatacatatcgaagaaaaacaaaaatttaccgaaattcataaatttttttggtgaaaaatcttagaaaatagagcttaattccaaaatttagcgctgcctatcggcatcacagggcccaaaaagtcataaaccttattaaaaaaattggctcaaaatcgcaaaaatttagcatattttggacaaaatctgttaacagatctaaccaaattttcaaaattttcccgtgcatatctaggagacattgggattttaagaagaaatattctggcgttttgtcgtgcgtacaaatctcagtttgaaattatttaaattttgcaggtttcatattcgccaaataaacaagcggtgaatttgtttgattctgatgaagaaatggggaaagaaaaagaaatgtttttaaaaatcgtgcttgatttaaaaatgcttaattatttattcaaaatacataaaaatcttggcatttcaactgatcaataaatgaaatttcacagaaacacacgaattctgaaccgtgtgccatttgcgccacgggaattttttcccaggacattttcgcatcgggcacttgcgcaacgggcaataattccgttgattgaataattaataatttttcaaaaggtttgattgacgatcaatttatagacgcaattactttcaatctcataattttccgacagaaaattgcatttttcggcattttctcctaattcgttttactgccggagagttaccggtaagaattttggttctcgggaaattttccgtccaaattgctgactttcttttgaaaatttcgaagtcggaattgtgagaccccaaaaatgttgaaaaaggacaaatttttgaaaaattggcagaatttgttacgggatattgtcccaaaaataattttttatttattgcgcatagacacagaaatagatatttaggcattagtagacacaaaaatgccgaaatagtcagacattttttttgaccattttaaaaaagtcttagcgaaaaataaataaatttatcaaaaagcgagctattgccataagttttgagttaaacaacaataaacattttacaagagccacacatacagtatacaacaatcaattatttaaaattctatttgtagagactaaaagtattggcgtattatgctttggcgtcactcgattttgttttgtcattagtttaattgcttttttaagttccttttggaatgccagacgataatcagtgctgaaatatgacttatgttgcattttttaaagtattttaataataactactatatgcgacattccgtcagtgaacaatccgtcattagacaatcagccagtgaaggacaatccgtcagtaacagacaattcgtcagtggacaatttgtcagttcaaattttgttttttgagcaattacaaaaaatcttgcgattgcaattgttagattaaatatttaaacaattggatgcagttttacatgctgacggattgtccatcaatgacgaattgattgtccactgacggattgtccgggattttcaagaaaattttcgtctcaattttgaaaattttacaaaacaaaatagaaaatttatttttattttttgataagttagctaaatttacaagaaaagccacggatttttgcatgccagatgtgattatacctcgtaaaatataaaatgggtccaatggaagctgagccaatgttcagcagaattgcagcgaaaacattgaagaaccaagcagtgatcggtgaggaaatgtacggtttgatcagaaagaaataacacaggctgacattcacggcgacaatccaaaagagggcacgaaatgtgcgaccaatgatcgaatttgcggacggtaaccctagggaaagcattataatttttgaattaaattcattattaaattattttcaaaataaaaagtaattaatgaatccaaaatttcaaatttaaaaaaaaaatgtgtgcaaatatgcacaaaaatgtacatattttcctacttggacttctttttctgcattttttgaggctttatttaaggaaatttttcttgatgcttaaaataaaattcaaaatttcacaattgtaatttttccgggtcttttgggttgagaggcagggataaaaccgaataaggataccggagtcaattcaaatcactttaatcacaacacaaaatttaaaagagaaaaagaacaaacaaatttggttgaagtcaatcaaaaagcaaagactgagaagaataaaaagaaccattcttaaatgaaaaaaataacgccataacaaaagaaaatacattaagccaagaaatatttaaataattatagtcaatttaattatcaaaatacaacatccctcaacaatcaaaaaaaaaggcgtccccgcctttcagcctttttgaaccgaaaggggtgtccaacaggtagttcaacggcgggtggggcgaaactcgcggtggcgcctattgtttggatcgctgtggtcannatttca

SEQ ID NO: 16537 - DNA, 2156 bp, Heterodera glycines
  misc_feature (2053)..(2053): n is a, c, g, or t
  misc_feature (2143)..(2143): n is a, c, g, or t
attttggcccttcttgcatacttattagaattcgtctttttaaaagcattgataaagtgcctatttttctgtaaaaataaatccagacccaaaaaacctagttccaaaaaatgcctaggcctctgcccttgtgctaaaagtttataaatttcataattattatttttttttattttaggcgaatcaaaaatacgcagatgaatgaggagggatcaagagaaagaggaagtagcgcgaatgattgctatgatggaaaaattaatttttaaactgaccattttctggcattttgcttttgtgccatttatgcataaaatcgaattggaatacggaattttttcatttttttatgctgctcgagaccgagaatcccacctttctcctgtcgagacttgtctcccaaagcagcatttcatcttatcatcaataaacttattgaattttaaccttcggcgtctatcgccggggagcagctcgtccccgcccccctcgccggaacgaaaatttcatgattcttattatgaattcaaaggaattaaagtgggccaaaaatcgcaaaatgcttatttcgaaaaaaatttctcaaattgatcatggacaattaaaaacaaagcatttgaatattttaagaagcgtgttttgaataaattttgtaaaaatgaggcttttttaactgccaaatgaggcttttgaaaatttaatctgggagccctggaaataacactttttcatttttcaaaggaacaatgccgaccaaatttgcgagtgagtggggatgccagaattattcgtccgatgtttgcggcaaacacgcggacaaatatggcttttctttttacaaaaaagatgaatgctattgcgcaattggtcattccaactacaatattacgtcactgttgaaaaaattggaattgcccgccggtcgtttgaattaaataattttttatttaattaatatttttgcattatttatttttacaattttgaacaaaataaatatggtaatttttatatgactcccgaaggatgcgttattggaaaatgctgtagtggtactactgtattttaaagtaagatactgtagcataacataaatttttaaacataaatggtcaaaattctataaaaatgaattcatcttttgcattttccattgacgcattttctgtcaaaatattattttaaaaaataaacacttttctaggatagttttctgatcacaaaatgatgcaaaaagtgctaacatgcatgtgcaaatttgggcgattcacaaaaaattacaaaaatcaaaatctgaaatttccaatcattttttattcaataaaaacattgaccagtttaacatgttttgtcgtgtgaattgtagataaatgccgagtcattctcgcgcgatttatttattgattttatttatgatttaaatgataaaaaaaaacataggaaaagtgagacttttgatttttgcacatttttgtgaactgccaaatttgcactttttgtgaatcgaccaaccactgatgcaaaaatctaattttccattttgatttccattaacaaggcggtggcgttggtttttttaacgcccattaatttgattatttggtaaattcatataattttttatatatttctaattttttaatcattttttgttttttagacttccaatcggtgtttaaatggtgaattttggagtaagaatgaagaaaaaaagcaaaaattacgtaaaaataaattcaaaaaataaataaattatttcatattttatgtccaactttcattgttattatgattttttttgtatatgtaagtgcttaaatttaatatattttttataaatataaataaacagcgcaaataaaaaaatgtaaaattaattttaaaaaagtccgagatttagatttaaatcaggccggaatttattttgacaaatatttttatcaaatatttaatacaatttttacaattcaaattctttctttcttttggcgttgctgcttctctcacaatttcagagttgttcacttgcaattttgcaagttgagctgcaganaggctgcgtttctttaagcagaaatttttcattggacaacgccttgttacagtaacacacctgggatatacggtcattaggtataacaanatcaaatatcatc

SEQ ID NO: 16538 - DNA, 933 bp, Heterodera glycines
gggggcaaaatgtcgggggccggggacctcggggggcgacatctcgggggtcggggcggggaataggcccaaaaaagtcggggagctcgggtcggggagcaaccctattttgaggtaaaaattcttcaaatgtatcgtcttcacgtgtataatatctttgcaaaaagaaaattaacacaactaagagcccaaagatttggcaatttaaaaaggtagctaagaaatgtgccaaaaattattgtttaaggaagttttttcaagacagaaatgaaaaatacaccccctaattatcgatttcaaaaaaccaaaaatacacccctaaaaatcgacttaaaaaagaaaaatacacccctaaaaatcgacttaaaaaagaaaaatacacccctaaaaatcgacttaaaaaaccaaaaatacacccctaaaaatcgacttaaaaaaccaaaaatacacccctaaaaatcgacttaaaaaaccaaaaatacacccctaaaaatcgacttaaaaaagaaaaatacacccctaaaaatcgacttaaaaaaccaaaaatacacccctaaaaatcgacttaaaaaaccaaaaatacacccctaaaaatcgacttaaaaaaccaaaaatacacccctaaaaatcgacttaaaaaaccaaaaatacacccctaaaaatcgacttaaaaaagaaaaatacacccctaaaaatcgacttaaaaaaccaaaaatacacccctaaaaatcgacttaaaaaaccaaaaatacacccctaaaaatcgacttaaaaaagaaaaatacacccctaaaaatcgacttaaaaaaccaaaaatacacccctaaaaatcgacttaaaaaagaaaaatacacccctaaaaatcgacttaaaaaagaaaaatacacccctaaaaatcgacttaaaaaagaaaaatacacccctaaaaatcga

SEQ ID NO: 16539 - DNA, 1054 bp, Heterodera glycines
ccctttcttctccaaaattttttttaaaaaacccccctaaaaaatttatctcaaacgtaaatcttaatttctataatattcaatcatttaatccaaaaatcattaattatttaaaatgacttaacatcatttcatcttaaaattttcattaatttaatttatctttaatttttctattttattcaataacaaacaaaataaaaatttaattttgtattattttcaattgaaatcacttaaaattaaattttttttaatttttttaaatttgtttgaatttctaaatttcccggttggtcctggttcccggtaagaaaaatcgaggtcccggtcccggcttctcaggtcccggaagtcccggtcccggttttgcccaaaattcccggtaccgcttcactctagtttttagtgcctattttccatttttagagcctatttttggggttttttagagcctagagcctgccaattttggcagtttttagagcctaaaaatcccatccctaattctcacatgtatttcaacccaaaattgatttacaaaaatcgtgtactaattttcggcttttgttcactttaggcgtgaataaatcacctcttcagttataatttataaacttaaaaaaacataaagttttttataagaaaattgcaagaaaaatttttaaaaaatttctgatattttttataattttttttgaaatcattaattcttttaaaaattaaaaaaaagattcctggatttttgtccgggaaatccagacaggtccaacatggaatccaggtcctggcttttttcaaaataccaagctctacttagaatctatagaagttttttatttatttctgagctaaaggcaattgaatgtatgaaaaaaaagttgaatttcgtattttctcgttgtaatttctttcttaatgccagtattttctctcttatctttgtaaaattttctaaactttcagctttcgtttgatacaaagaatatatgtagacatttaccaagcaataaaaaagataggatttaagaaattgaggatggtcactgattgg

SEQ ID NO: 16540 - DNA, 3035 bp, Heterodera glycines
ttccgaaaatttagtcaaattttgaaccgttaataatttgatttccgatcaactttttaccgtcggatccaatcgaaaaatcttagtcgacccatcagccccttttaatgcatcccgccagcccctaaaaatttatttttcagcattttttgatttttggaaattctttgaatttaattgaaatttttttgatttttcaaaatcccgcaatcccgcacgggatcccgcaaattttaaatgcggaatttgcgggattaataccgcgggatcccgtcccgcaaaaaattttgagttccagtcccgcagcaggatccgcaaatttgaaattggtctctactgattggacgccgaaaatgcaatagagcctatcaaaacgaatgtcagaaccgtgatcacgacttttaaaattactttttctaaaattttgtaaattactaaaaaaccttttttcaaacaatattttaagatttaaataattaaaatgttaaattttattttaattagcatgcacttttctcttcaaatcaaattcaaagtttttttgaatagcattgaaatagcagccatctttagcatttcccggctgttccatcaaactccgcgtcaactttctgtttgcactgtcgcattttgtccaaaaaagcagagagcaattcgttctcgttggtttcccccttccgtttgtctcgtcgacaaccaaccaattaattaattaattatcaattcaaattcaaattattcgctgctgccatttcctccgtttcgtttttctcggaaggatcggcaaaggcagcaaaaaaagtgccagaaaaaaaagctgaactgaaaagcgcagcagcacagcaaagagagtgcaaatgcacaagtgtggatgtgctctgtgcgagtgttgttgccaattaaaattggcaataaacgaaatggcaaacgcaaaatgctaaattggggcaggcagagggggggggggggggcaactccgtccgaacaaagcttaattaatgaatggaatgtaatagtacaaggtattccatttattatacctatgtgtccagtagtgcaaggcattgaaatgtgttggcagagtgccaattgagcattggcaattggagagagtgtcaaaagtgcaaattgcccggggtgtgcccggcggcgcttccctttgaccttcccgccattcacacatttcttctaaccatttctgctgcctatgtcacagttgttggcaggtggatcgactggaagcacgagaaaaagaagtagaagaagaagcgggtgtcatcaaaaagaaaagggagatgagagagagccgggaatggaattaacgcgagagtgagaggaggagagagaggcagaaagagagagagagaaagagagaggaggagagagagggagggggaggagagagagggggaaagagaaatggcctggaagaaagacatagagaaagcgagagagaatgagattagaagctggaagtgagaaagagatggagaagagaatgcgagcgagggaaaagaggaaggggaagagagagaggaagagtagagagagagagagatgaaaaaagtggaaatgtttcgattttctctatgtaattttcccattgcctccatcgcttaattttgtgttctgatcgtctgtgcgcgtgcgcgcacatttatcaaaaatcacctctttttccctacaccccaaccagcagcccttccattgtttaaatgagtgcacattcatgtgaaagaatgaatgaatgtcttcatattctcgtgccatccacccgaggcgcgggggagcgaaacgttgccaatgaatgaaaggaaattgattatgctcacttctgagcaattatttaattattttaattgccataaagccaaacatttcccactctcatttctctcgacctttggcccttttttctgcatatttctcccatttctctcccatttttttactctctcactttttcggcatatttctcccatttctctcccattttttcactctatcactttttcggcatatttcttccatttctctcccatttttttactctctcactttttcggcatatttctcccatttctctcccatttttttactctctcactttttcggcatatttctcccatttctctcccatttttttactctctcactttttcggcatatttctcccatttctctcccatttttttactctctcactttttcggcatatttctcccatttctctcccattttttcactctatcactttttcggcatatttctcccatttctctcccatttttttactctctcactttttcggcatatttctcccatttctctcccatttttttactctctcactttttcggcatatttctcccatttctctcccatttttttactctctcactttttcggcatatttctcccatttctctcccattttttcactctatcactttttcggcatatttctcccattttcgccacttcttttctttcatcatttaatttttacggtatatacataacctttcaataactgctctctcacgttattaaaacctgtcgcctctcccccatttgtggtgtgcaacaatcattcattttgtccctcatttcctcccaccgctcatttcgtctaattagtgtctcgtggcacagaatttgttcccaaatgcgtctcgattgctttgcaattttacatatattccatttaattaattattatctttatttttgcgttacttcctccccaaattgttaaactctttccacccataaatgccattatttttattccttaaaaattgccaaatttataacggcaccgctggcccattttctatggcactaacttgtcgcattcatcttacatgttttatttgatacggcacagaattccgatttccgacaattttggggtcggaattccgattttcaaaattcgggccgcggaattccgatttccgaacaatttttgggcctcggaatttctattcctaaaaaaattttgtgccttcgaatgccatgtgtatgctcct

SEQ ID NO: 16541 - DNA, 1947 bp, Heterodera glycines
agtttgtgaaaagcgtttgattgacatcaccgaataaatgaaatggtacggatcaaaatcgccaattttggcataaattttgtcctggacaagaatgtttgttatgagcaaccacgtcccgctggtggaccatatcggacgggtacgcatgattccactgttccaagcaccccaccgaaagttgaacgaaataaccaaaatataaggaaaaaattttaaaaaatttttattcttcacccttattcataatataagcctaagaggaccttgttaacgtgtaaataaaattaggtgcgtttcagagcactttctgaaaaaatattcatgaattaattttgcaaaaaattggaaaagtacgcaaaattgcaatgtctaaaatttttaaagaaacattatgggacagttaaataattatatgaataagcattcttctcagctgttaccctgcaaaacctggtgcgcttctgagcactactcgaaaaatgagtaaattaattttcactaaaaagttaagcctaaactttttggcctgtttaaaaaggaattaaaaatttttaaaaattttaatcatcttcctttttgatagaaaaagcatcagagagccttattaacatgtaaataaaatttatcagattcagatcgccatgaaggagtaatctgatcatgttggtccaaaagatttatttgttcagcatcaaaagttagcttacaaattagaggaaatttttctgatttttttctctatataaatagatttttggttaaatttaagaaaaatttgaaaaattttcttaataaacttagttaaaaaataaaatttgtccttggagatttctacaaaaaggcctaattttcatcaaaaaatttgctcaaaatcgtaaacttagtcattttttggaaaaggtacgcagcaaaaaaagctgatctggacaatgcctttaattggtggcagggctgcaagaatacaaaaacgaaacgaaaaagggcatttgatacgaaaacgaaatacgaaacgaaaaataaaattttgaaaaccgaaaaacgaagatttaaaaattttaaactctaaaacgaaaacgaaacgatttcgtgcagccctgctgttggggatactacaatatatttcattttctatattagccagatttacttgacttacccttttgatttggcataagacacaattccagcccaatcggagcctccattttgtggcggtaaactgccaaactcgccgatgatcagcgaacgaccagccttggccaggtcgtcaatatccgatttgtccacccaacggctcttctgctggttatagcctcccggataaaggtgtaatgatgggattattttagtgtccgcaattttggcaccaccaataccttgaaatagggaagcatcgatcattaatcaaaaaaataataatgatgccagagagttcgtgattactaataattattgtttctcatatgaagggtgggcaattttatccatataaaatcgcaaattatacgcataaaatcaaccaaaaattgaaaagaatgcacataaatttatcaagttcagtgtaaaatatctcaaaactcttctcattaaatttaagctaaaaatctctaaaaaaaactaaatattaaaagtagccgtttaagagaagatttttttaatatccaactatgctaataaaatatgcctgaaatgcaaaaatatgcacaaatatgcaaaaggtttcaaaagtgccgacagacttaaatcagttgggaattattaaaggtacttttcggttttgtgcctacacctcaaaattttaaaaaatgaacaaagggcgcgctgaaggcattttttacaattactattctcatagcataaattaacggagcggtaaaggtcctctgccctcccaattttgcacataaattacataatgtgaaagcgtctgcttaactcctattt

SEQ ID NO: 16542 - DNA, 1556 bp, Heterodera glycines
aattaatctttcataacacaaaatatgaatgtattcttttattagcaagagatttgccccctccttcccaccttaaagtgccgcccgtccatcccgatctcggcaccgtcatagaaccatttcacatcgatgtccttgtcgttcacttcgcattcaaaagtggcattttccttttcgttggcatgctgcgagttcaacggcacaacaaatgtgtcacgggtctcctccaccacatacacttggtatttgctggaaatttttgtgccataatttaaatgaaaattaatttttaaaaataataataattttggctcctggcaaatgcgtcagtggaaaaggtgtcaataatacagtatttttaaaataaagttactgtagcattaagtattgtattattacaaaaggacaaaattgtctaataattttgttctgaattttatcaattaagtttttaaaagtcaaaatacctaattgaaactttcccaaatccctaaaaaaacaagttgtgatttcggtaatattactatcgtatctcaatttaaagaaatcctgattcactgacgcattttccactgacccattttccgttcgagatttttatttaatcgaaaaattgaatttcaataatttcttttgccatgtctttaaatttttgtcaccatcaaaaaaaagaagaggcactgaaattttttttttgaaatttcagtcaaattaaaaagaaaataagcgaagtgcagaatttggcatcgattttttggcaccattccaaaattcggtgcaaaattttttggtggtagctgtttttggctcaccgtcgttcagattcataaatattttttcagaaagggctctgaaacgcaccaaattttatttaccttttaaataaggcactctgatgctttttctatcaataagggaggtgaataaaattttcaaaatgttttaattgctttttaaatatggcaaaaaatttaggcttaacttttttagtgaaaattcgatcactcatattttttgctaattgagcagaagcgtaccaaactttgcagggatactccccggtaaaggactaacttacactgaaatgagcgccgagttagctggctttaaaatttttttcgaaaatctgagtctttcgtttttatttatttttttgcaaaattaattcataaatattttttcagaaagggctctgaaacgcatcaaattttatttaccttttaaataaggcactctgatgctttttctatcaacaagggaggtgaataaaatttaaaaaatttttaattgctttttaaatatgccaaaaaatttaggcttaactttttacggcctttttggagttacggattacggattacgggttacggatttttgggatttttccgtattttgatccgtaactggctttttagattatttttcgagacgatttcttgcaagattattttttataaaatgaatttttttttctatagttatataaaggctacccatatttcgatttaatctccaggaggggtaatttgtagtattattaacatacataaaggggg

SEQ ID NO: 16543 - DNA, 1162 bp, Heterodera glycines
caatggggactcaactcaccagcattccaatcactggggacttaactcaccagcattccaatcactgggactcaacccaccagcattccaatcactgggactcaacccaccagcattccaatcactgggactcaactcaccagcattccaatcactgggactcaacccaccagcattccaatcactgggactcaactcaccagcattccaatcactgggactcaacccaacagcatttcaatcactgggactcaacccaccagcattccaataactgggactcaacccaccaacatttcaatcactgggactcaattctcctgcatttcaatcactggcactcaacccaccaacatttcaatcaatgggactcaactcaccagcattccaatcactgggactcaacccaacagcatttcaatcactgggactcaacccaccagcattccaatcactgggactcaactcaccagcattccaatcactgggactcaacccaacagcatttcaatcactgggactcaacccaccagcattccaataactgggactcaacccaccaacatttcaatcaatgggactcaaccgtacggggccttcggccccctcaccaaatttttgcgccaaaggtactcactcggccgcttcgcggcctcgtaactggagtcttcggctctattccagtcaccagaattcaatctcaccaattcttcgaaacccaataaccggaaatgaatgataaaaccgaacattttcctcgtcttttcttatttcttgtggcatccttatggcacaacattcttggcattttcatcagctcttcttgtttattggcattttcttaaggcataacattaacattttcattgtctcttctattttcttgtggcattttttatgccacaacatttcttatcacatcatctcttcttgtttgttgacatttgcttatggcacaacattcttagcattttcgtcgtcttttcttgtttcttgtggcatttccctattgcacaacattcttggcattttcatcatctcttcttgtttcttgtggcatttccttttgcacaacatgacacacaatagtgtctcacactaaagtcacagaacaaaccactaatgtttttcaaaagcatgacacacaatagtgtctcacact

SEQ ID NO: 16544 - DNA, 1641 bp, Heterodera glycines
gcagtattacccaaaatttagcgaagtaattattagcaaatgtctctgtcgtcgtcatcatcaaagttggcgaatttggcggatcggatgaaagtgttgctgagcacggccaatggggcggacattcactttttggtgggagaggaaaaaaaggcaagaaaaattagaaaaaaaagaaaattcatttttatttgcattttaattttagctttttcgagcccataggcacattttgacgttgagttcggatgcatttgaagcaatgtttcgttatgacacgaaaaatgcaaaaagcgaaggtggaaaaagcattttttcaatctttttttagatttttcataatttttaggcccttccgctgatcagtcaaatcccgtggaagtcccagacgttgaagcagcagcgttcaaagtgatgctcagcttcatttacgcggacgatttcagcggattgaacggagacaacgcaatggcagtgctttacgcgggtcggaaaaacggaaacttaaagaattactatttatccaaaaattttaaaaaacatatcggaaaatcttaaaaaaaattttttacaaggcggtatcttggaatcaatgagatcaattttcatacctaaggtcaattgtttttccgtcgacgtctttttttgttgctttctcacctttgctcacgttttttcaaaaagagagggtggaaaattttgaaaaggttttcccccaaaaatttcttcaatttttgggtcatttaaaattttgaaatcaatgcaatttccttttttacatttcagccaagaaatactgcgtcgctgggctgatcggtcgatgtttgcagaaaattccaattccgaagctgcccaatgttttcttggcctatgcccaggcgcgtcttttgcacttggaggtgggaaaaacgactttattaaattttctttttaagccacatatttaaattcacgaatttacaaaaaaaaaaattcccttttcctagcgccacccatcgtcacccccccccccccccccccgacttccaccattttttttaatcagaaaaaatcatttctaagagtcaccatacattaaaaaggtggcgggggggggggggtcagccaaaatttttgcgaaggggggtcggccgccgatgacctttttttgcttttcaaaaaccgtttttttccggcgcgtttttccaaaaaaaaaaatttaccggaacaagggggcccgcggtcgtgtcccgacatttgcggtccgacatttgcgggggaaagctttggatgtgcttcgttaatagattttcaccaaaaatggccagtttttgtgattttgagccaatttttttacgtttctgccgccggcggcgcctatcggcacttttttaaaattatccaatttttcaaatactaaaatgtgattctaagccaatttgttttgcgatttttcttagatataattcccaaccctagtaattatttttaaattgcattttcccgtacagaatcggcatggaatgcaaatcagtataaaaacattgaccggcaaaacagtcacactccgtgatgcccttccaagcaacaccatcgaggaaatcaaagccaaaatcgagcgcattgaaggcattccgattcgtcagcagagactgattttcg

SEQ ID NO: 16545 - DNA, 2865 bp, Heterodera glycines
tttgaacaaaatattttttaattaaaataatatcttcttcctaagtatttttattaatttaagatttttctactaatctcttccaattaattaaatttttaaactgtttagccaactgcctgatgagaagggcacgttcaaatgagacgaatgaaacaattggaatgccgtggaacaaatagaaaatacctaagaaatttctagaattaaattgtgataaaatgttaattttgaaaaatgttgtagaaaattaaaggaatatctagcatttatgtgatagaatgttaattccgaataatgttttcttaaatcgattaccgactcgagagtggtaattgagctagagcaattaagactaattagtgttggagccagaaaccaaattttgggcctttttacataataaattgtattaggtatttattaaataaaaataaaaacaaaattggttttgggttaattcttccggttaaatcggcgatttttttttaaattaaaaaatatttctcattttagccagattttcaataaaataaaataaagtccgtaaatcattgatttgcaaaaaaaggtctgcacgcttctttcaacatcaataaaatgaggataactcctcaaaccattgtttttatttcataattgcaagttttaaaattgagaaatgccccaaaaaaataaaaaattattttttttttacttttttgcattcaagcgactgccaattgttagttgtcgatgagggctaattttaaaaatgtggctttaaaaagcttttttgggggtttttttagattttctgaggtatttttggtttctttttaaaatctcagtaattggctttttgtcaaaatctgaaagcaaaggcataaaatttccaaaaattttccaactgctgaaccacaaattcgtttgaaaatactcatttgataataaaatttttataaaatgaaaaaacacaacggaaggaattggaagaatttagtggaaaaaattctgtacgcataaggaagtcgagatggcaatgccaaatttaatgaacaaattaatggatttaacagctgatcatgtggaagcaaagtgccatttttgaggccggaaaatagcaaatggcgaaagaaaatgttgcgcggaagtttagcggacggttggcacaaatcaacccgtggccggtcaccattgtggacaatggcggaatcttgaaagaaaaacaaattaatttttaaaaattaaataaaaataaaaacagggcaaataggtaatttctctatgtttttacaaatctgccaaaaatttcataatcaatcaacggcggtgaatgtcggcatggcactgccggacctctcttttctattttttttttaaattcgcaacaaaaaagaaaccaaaaatccaaaataattgtttgttttttatagaaatatcagatttttaatgttaaaatgaaattttcgaaaacattttgaattatgaaaacttgcactaaggattaacaaaattaaattaaaatatactctaaaaaagcgaaatttgtataaatatttagccaaataaaacctcgtgaatatgtttataaaaaaaattaaaaaaccaaaatagtgcaaaaattaaatggaaaatatcaaattttttttaatagtgaaaattttctcaaaaaatgtttattaatcagcttaattaatctgaaaacttcgttctatttggaattgaactgctgtattattcgacggggttttttatgcgataaaaaatgcaaaaaaaatatgtaaaaacaataaatccagtgcttagatcctcaataataattgaaatttgtactcattaaaaattttttaatataatgtttataaataagttttatcatttaagtaaaatttacatgaaataaaatggtaattaataaattctgaagaattaaaaacaaaataatttcatccaattaaaagaagtataatttaaaaagaatcgtaatatagaaattttttctagattttcatcaaaatatatttctttaaatctataagtagaattttgaaagaaatgtaaatcgcattataaaaaaacaagtagaatttcttagtgaagctatgtaataaataagcataaatatggaaaataaaaccaattaataaaaggatttttaatcattttaatggctttattcagaaatatgaaaattaaaataatattttcaatattatttttcataaatgcaattgataacatttatgctggaaaaataaacgaagaaaaaagttttgacgaaatatttggccaaagatgggacgaaaaattggaggaaaacggagagaatgaaaatgatcaaaatggaagaataattggacaaacggatggccaaaatgagacaaattatgacgagaatattgcacaaagattatttgcagaacaatttgatcaaatttttgatgataattcggaagtgcatgacgagcagagtgtactattgtccacaaattgtgatgaattggaacaagcgccagtaaaatttgtgatcattttataatttttgaaaataaaagaaaatagaaattgtggaaaaatttgataaaattaaagaaaaagttaagcaaatgggaaagaaatattcaaagaaagaatgggtgaaaattgaaagaaaaattgcaaaaaaattgggtacaaatagagaaaaaatttacaaatggaaaagagaattgggattgaatatcataaacagatattcggatgaagaaaaacgtaaaatattaaaacaatttgaccaaatatatgcaaaataaaaaataaattaaatgaaaaattggagggaaaaggaaaaatatgtcaaaaaataatagcaaaacatatgggaacaagcctaagcagcattta

SEQ ID NO: 16546 - DNA, 3950 bp, Heterodera glycines
  misc_feature (166)..(166): n is a, c, g, or t
  misc_feature (260)..(260): n is a, c, g, or t
  misc_feature (284)..(284): n is a, c, g, or t
  misc_feature (312)..(312): n is a, c, g, or t
  misc_feature (2092)..(2093): n is a, c, g, or t
caagtttttcaacggtccccaaaaatgcatttttaaatcggtctgattatttggtgatgtccgggaaaataattattccgattattcagaaatgcggtcaattaattagagagacatttacggatcactttctttgccttacaatttttgctcgagagtttcggcntaaattcatggcacatcaaaatcagctgatcatattttgttttagggctgaccgcgttagggtattggattttcccaaacgaattgagtaaatntaatatagtgaagaaagttgaatntatttacacgaaatgaaaaagtcatttnaattcggctgatcggcctgcaggcgtgattcttcgtttttcttttgtttctgatcaattcgcaacttccgttttgtactatttggatttaacaagtgaattttatacctttttatttttgaaaactgaatataaaaattaaaaatgttttatataaattttggaattatttaagacttttccccttgaacataaaaaatatctagtcactcatttgattaaaatgggttttccgcttttattcgtacaaagttttgcttaatcaaaaaataaattgaaaaattgtgccatcgtcacaatgctctctaacacatccgtacatttctctctttctctgttcaacaatgtctcgttttctttccgctctctgtccgttccgcgtctgtgccaccgcctgcgccactcaacggaagttgggcggtgcctgttgctgaaaaaggggcaggaaatgatttgttccaaatttaactgatcaggttcggaatattcgggattggattaacagtgcaacatttcgattattcacgtttcttgataagttagaaaatatgtgatgcgaaaaagggacagacactaggctgatcagtgatcactgaaagcatttcataactgactgatcagagaaaagccaaaagaaagtacgatttatcgttaaagccagtgatcatattttttgagtctaagaatgaagataacgggggattattaatctgatcattatacaaaggagggggatataatcagtgatcatcttcctaatgatcggtttatcctcacaaagaaagggatgatcaatctgatcacctccagaaatgctaatcgtttaacagttataagctccaatagataattagctaggaagtgatcagttgaatgccctgatcagaattggcacgatctaaccgacctgtgccgcctgttgctgctgctgtggcgcggcattgaccggcgccgtcggttgctgatagtcagccgcctcctccggaaactccaactcccaaatgcgcttcagatgtttgcccttcacgtcacgcggcgtgccaaagttggtcatcagctgaacagacagaagagagttaattgaggggatggcaccaacaatttggcaaaaataggaaatcgaaattgtggccataaaatgccaaaatatggacaagaatcagagaactcttatattaaaaattcaaaaaggactgaaatttttaaaacacatatttttccctgagttttttattccttttaaattaaatttatttggaattaattaaaacctgaaaaatgcaaaaattgctcatatatttttggcatttaattaaaggtgaaaatgtgatacaatttatgaatttggagggaatcatgcaacgattaacaaatttgccttagcttttggatgatgatttacttatataattaataaactgaacagttactgactgtactgcttgaacttggtgcctatcagggatggcattccgaggccccaaatttttcggaaatcagaattccgagccatccctggtgcctatgatgaccaataaatggctgtcaaaaatgatattttaacaaaaaaaatgaatggcaccgaaaaaataaaaaataaaattaattaataaaaaagtttcgaatttttatctgttactgttttgttttattagtagaaatttttaatttatgacttttaaatacgtcttcaaaaattcttttttttcaaaaaattttaaaacgttttttttcgaccacctcaaattaatagcactgattcttagaaaaaatacctatannaaaattttcgaattataaaataaatgatggcaaaaaacatttataatatatacctatatcggtcggtctacgtcagttggtccccagcatatttttccactataacttttttctttgtcacccaaatccaataaacttggtatcactcgaaagcttaacatgtttatatttttttaagctattgcttcgagaccgcaaaatccgaaaatggcctataagaaaccaagattctttattttatttttttagttgaccaaattctataaatttggcatcaatcaaaatctctactagtattgagtatttactaatagaacctaagcgattgaggaacacacccaaaattggtccattaaaaattgcaaaatttaattgtgttttggacacaaaatttaaagagtacgcttggcaaaaaaacgcacatcaaaaccttgttaaacgcatttttaacttttgaactcacatcgttcactgtctccatgcccgcggtgttctgctccgggttctcaatgacaacaagcgactgtgcgtcgaccaccatttcgccgcgttcgttgaccatcacctgaacaaaacaacattttttttggcgccgagcagaaaaacgggaaatcttggccatttccgccaaattttgaccatttagagtcaaaattttgaattttttatctctctctctctttctctctctctctctctctttctacctgctctttctctctatctttcacctcccctctctctccataaaattataatttgaattttgacaatttaattaaaataattaaaaaatggtaaaatgtctgacaaaatgtaaggctcagattcttgaaaaaatcacgacgagttaccaacctcatccggtctcggactccgactgcgcctatctccaaaatctgcttcaaaataaactttttcaagccctgatagcctaaacattctgtttattaggaacattatttctgttcaagcgtcacatcctgctgttggggaggaggaggaggacacagtttattcaatgacgaagaaacaaaaataaaatataaatttctaaagtaagaaaattggccaggaaatggtgaaacgaaaataataataacaattattattattattatcaaaatacttagaaatgaacgaactttgcatttcgacatgcagcaggggtttgcactgacaagccataaacagaaaaaaaaatcggatgggaatatatataattcgggtggttccccacacccaaaaattgaactttgactattctcaattgtctgcattcccataaaaatttagtttaattcaacaaattaaattgcttttaatcacattatttatggacatcaattagtgtaaattaatgggtgggtgacaattaaaactttgtcctctttgctcctgatctcctctttttttgtttttttcattcttcaatcacccactcggaattcactttcatttctgctgaccgttttctgtttcaattaaaaatggcattgactgaaaatgtcaattttaattatttatttaaccaattgccatcggcaccaaaagtgccacaatcaaagacaattcgccgacgcggagacgggcagcgaacgaataccagggcgggtaatactcagctggacagaaagaaaaataaaaattatatgaaaatttaaataattcaattcaattatcctaattataggcacttacattttacaggcagttttacattaaaatagctatgtaaaaaataattaattaataatagctaattagtaattagttgtccataataggcacttatttattataatcataatcaatctattctttattcatatgaggaaaagattttcgtaaaacaat

SEQ ID NO: 16547 - DNA, 1494 bp, Heterodera glycines
ctaactgataaatagatcagatgaagacaaaattgattttctagataaaatacgggccggactcgtacatgggttcttatggacacttaacttgcaacccctatttttttcgacttatacgggtttttacgggctacggattttacgggttagccggttaattcgtaccccgtataagtacccagccaaacataatccttactcttattcgtatatgtaattctttatagggtttacgggtttttccaacagataaaaatttgcatatgcatatttctgcctgaatataatccgaatttcgtaaggtcctcaagccaccgtatcagcacaaatcaagagggaaacacaaaagaatgggtcagacatataatcagatcatcgatcagagagggcacattgattgtaaatccaaaaaagtgatcagagaccttttgattatcagatagaatgatggcattatgaaatttcctgacacataaacgaagtaaatgctgcaattcgccatttaagctacggcatttccgtcgtccatcagttggaacgcggtgatttgggaccggacggcagcaccggcggacgggcgcagggcgcggcgccgagtggggacgaagcggcgattattgtgcacggagtcagcaacaaaataacgcgcttcaatgtgaaattttgtcaaaaatattaatgaaccctcaaaaggcaccattattaattaaataacccagggaacactcattaatatcaattaccaattaaatgatcaattttatcccgagggcatagtattaaaaggtccttatggcactaattatcaattaaacactcccaagggcattatcaatgcgttgcgcgcccgtggcatcgaagcgtacggcaccacgtggggagacggcggcacgacgccggtgggccttgtggagctgaaatgtgcctatgtgaagcagataaggcgggaaagcaattaatgtaattggttttgattaaaccattctcattctcagaagtatgattatcgcggtgagggaatatacgggcaaaaaggtggacgtaattgcctattccatgggctcaccattggcgcggaaggtaattaattaattgatggattggaaatttgaaatttaaattttaagtgctggaatttgttggccttttccaattttttgcttaatcatttgccaatttcaggcaattttgggcggcatttgcgtggacacgcgcgagttgctcggcgtgccgttgacggaacacgtcgatacatttctaagcgtggcgggggtaacaaaaaattaaattgtttcattaaaatgggtatttgttaattaactctccccctaattttggccaataatggcgccgctctgtgcgttttgcccgcccttctgccgcttggcacgtgcaaccgcaaaaacgggttgcactgcgagtccgagtttctggcggatgtgaactcgcgcaggaattacgagggcgccgccacgttcagcatattctcga

SEQ ID NO: 16548 - DNA, 1659 bp, Heterodera glycines
  misc_feature (1613)..(1613): n is a, c, g, or t
  misc_feature (1628)..(1628): n is a, c, g, or t
acagtacaccatccactcacccacccagattggctaccgtatctgctcccgtctgtcctccccaattgtgggcggcacgggcttcgtgaagaaattggagatgagccacgacgaagtgttggacaaaaccatggaaatgcaaatcaatttcatcaaacggcacaagccaaaatgaaagaggaaaaagcaaacagaaaaagtgcaaatttattttaaaataacaataatcaacttaaacatttaaaaggtcaattaataaaatttgaattaaattttaaaacacaaaataattgctaaaaatgccgaacaaaaactggaagaaaaagccaaaaggttgtttaaaacaggctattttttagagaacgacctgaccgggcccggtttttaccgggcccggaaaccggttgcttctgaaaatatcagaccggtccggtcgggcacttttggaaaatccggtctctactatttttctctaaaagacttacaaaacgacaattttttttgtcaaaattgtttaaattatttcattatcctaatctcttatttttctgatgcattaattcataaataattttttttggctacaagtaaaaaatgtgctaacggaatatgtttttttatgccatactccaaaattatgtttttttaatgtgataaattttcagattgaaatatatgtattcaataagatattcaattcaatctcaacgattcttggcatttaaaattattttctggcatttttccggtccaccaaaagtgcaaaaacgaccaattcgtaaacggcgataattgtcaggccaaagtaaagtccgagaactccgccgacgtccgctaaaagtaaaattggcaaataaacaaaaattaataataaataattttattatttctctttttaatttttatttttaatttgctttgctttaatttaaatcaaaaatttgtcaaattcattatgattgacaagataaagctcaaagaaaacattttacagagaaactcagggtttcatggcatttttaaccataacttttaataacaatgaccagcttaacagagaaacccaagttcatggcatttttggccataattttatttgttgtaactttttcttgaacagttggtcatttttaatgatgataataaatgaatattttaattatttattggggtgtttgtttaattgacaatttgccctcacataaaagttcccaaagtgtgtagtcgtcccggtagacaatgcgttggaaagtcgtcccgcggtaattcaccgtcagaagggccatgttcgagctgaaaaccaacaatgaatgctcctcattgagaagcattcattcaatttttaaacaatttttattttgctttttgcctcataaaatcctccaaaagtcgcgcgccgctgttttgagccaaaaatttggcaaatcgttccatccattcgttgctctgacggcctttgggtcgccttgccaacacggaccaattctgaaatttgaacagcaaatttaattgctttttgattgataattgattgattaattaattaattggcttaattacgatggaattgtttccgtccaataattgccgcaccatttccattttcctctccnaacattctccgctgnttttttgtctcccccatttccttcgttttgc

SEQ ID NO: 16549 - DNA, 2712 bp, Heterodera glycines
  misc_feature (17)..(18): n is a, c, g, or t
  misc_feature (57)..(57): n is a, c, g, or t
  misc_feature (271)..(271): n is a, c, g, or t
aaaaaagttttgtattnnatgcgataccagttagaatttttgccgtttttgtttgtnccgcaacttattttttcgcaatatttgaatcgggaaaaattgtgcgcaacaagccgtccgaggacaaacaatccaccgagcgaaaagattggcaatgttgtgcagtgtgataagcgatagtgcctattaataattaattaaaaattttgattagaaataatcctgttaaccttcggccgcccagaactttaagatcttcgagttgatggggccngaagtatttggcaaaaattcatgcaatggaattgatcggtttgcggctttcgccgctttctgatgttttcccgttttttgatgcacagaaattgcggttttcccaatggaaaggagattaatatcatcgttgcagacgacacaaagggcaaattcttcgccttttcgacttttctttatatgccggaattcttttgcgtagctttccaaataaacatgtttacgttttggtggcattttgtgaatttcactcaaaaaatgaaataaaatgtaatttttttttaaaatcaaattaattcaaatattcgcttcagaaaaaaatgaaaaatcaaaatagtcattcaaatttttcattttttattttcaaatccaaaaataagcacaaaataagcacgtaacgctgaaataagcatgaatcttagaaataagcacatttttactttctaagatccgacccctcaaaataagcacaaatcttagaaataagcacacttgggaactctgatttacacacaagcgcgatatgaacaatataggaatatcacatatatacaaatagctaaggcctaagagattcagaacaactagaaaatctccacattatgcaatataaagtcatcatcatagatcgatcctcccattatgctttcttctccaattcgatcaggtgtttcactccgtcgtacatctgcttcaccgcttcgaactccgtgagaccaagacgggccttgtttctgatgtcataaacgccgccagcgctaaataaaggacaattgtttcaaaaacaacaataaacaattacctctcggaatgttcgccgtgaatcccgcggatttgcaatttcaggccgtcgcagatggacttgaattcgggttttgcgctgattttcggaagtcggatatgcacactcgcgcgaacagtcgttcccaagttggtaggacagaaagtcagccagccaagacggtcgtcacgcgaaaacggaactttcgattcgatggccttgactccctttatgagacgctccagcacttgtccaacattgccgccattttgcatcgaaatgatgcggagatgcttaattaaaaattatatcaagatggaataaaaaacaaacaaacatacatcttcctcgttgacccacaccaaaaaggttttcttggcgttatggaaaattccgcgtccggtgggccaataacggcacatgccctggagcggatagtaggtgcctcccaactcggcatctaaaacataatgttacaaagaaaataattagcggttgcctaccgctcttcagctgctcgaagaccgctgtgacctttgattccatatcgacgcaattctcctccgttgccggttgcttgctgctcggtccaaagccaccatgatagtcgttgatgatcgggtcgaacaatggtttgaagagtgtgtaagcctcggctgaatgaatgtttaatggttgatgattgattggctatttaactgaccatctggcgcatacacgccgacaccactgtccaagttggcaacccccgactggatgacgtccaaaaaagtcgctccgagcttggtacgcttgtccttgcatgcatcgacgacgtccttggtgaggtacttcttcaacaacgatttgcaatcagccgccgcctgaaagttagtccaaaattagagtagttaacacacacattgtgtgcacctgaagcttcttgtagccagcctcaattttgtcaattacttcctgagggacagccattttggtttatttcaaataatatgtatgtctgaaaataaaaatatgcatttaaagagaggataaagttggtgtaagtaaattgagatgattaaattggaatttaaaaaaaaattatgaatgaatgaaggacgtatacgaacgtatgaatttatatactaaaatttctctagagactcactttggctatgggtcaactccactgtgcagagaaaagcatagtactatctcgtcattttctttttctttgtaatttctctcactttggcataatatctcttcattttttaataaaaacaggatgccttttcggcaatcattaagaaggcgctatgtaatttcgacactgggtaaattcgacactgagtattttcgacactaagtaatttcgacactacattttcgacatagagaaatttcgacactgaactatttcaaaaactcactgttttcctgcattttcggcactggaccatttcgacattgagtaaattcgacactatagagaattttttagaaagtaatatggaaaatttgaaaatgttagtacatatttatgataaattttcctgttattttctaattcgtaatcttaaaaacggtagcatggtataactattggttaaatcaatgttagacaaatcaaatccagtgttagaaaaaatgattcataatcccaaatagcataatttagg

SEQ ID NO: 16550 - DNA, 916 bp, Heterodera glycines
tacttttgaccgattgtgtacgggaccccgtgttaggattgacgaagttttcaccgtgattcacagtgtagtgttggtatctattttcgaataatatacgccatcctatccattactctaccaccggggaaggttaggaatccccccatacgctctccacacgtcactcgtggatgacgctcgcctcggcaagatgtgttcagtaggtgaattcggattgatttgattgacacttaacgctttttgggattcactgaggagtatttctcgcctaaaatgacatgtttcaatcaaaaattggcacattgtttggatggggagtaaaaagcaattttaccaatgcttgtccatccgatgccatggcattgtcatcgcatagtgaaaagaccgccaaaattctcccaatttgaaaaatgccaatgtccttttgcgggtcttgaaatgttcgtccacgtaaaagtcaaatcactggctgatcagtgcaatgccaaggccaagttgtgaaggcgcaagcaaatcgaacacacaaagctaacaatcagcagagatgaagctgaaaaaaagggaaaacaaaatatttaaaatttaaattaaaaattgacattttaattttacattgcttttcctcacggtcgcacttcttgcacatctatgtaacatgggtgccactttttgggtcaatttaatatctatgagttacaaaaatctcaacctataaaacaaaaaaatttttacttttggtgtaaaattctcgcgcccaaatttggcaattgtaggtcaatacacaatacccatgtcctctcattgctttaaagcaatcatccactgtgttgtaatcaattgttacatttgaacacttaatgatggccatatgcttgcgatatagaccagaactaattgtagaaaaaaagttttg

SEQ ID NO: 16551 - DNA, 2699 bp, Heterodera glycines
cggcacacagggcacaattcgacctccaacattctgtgtgacaacactttcagctttgtcacttcacaatttgttgtaaggtgcccgcatggctcggaagtgagccagccactgagggccatcgtgtttggcttagaagagtcagattgtgaatgcgacggagaagcggatgccatttctatttgggaataacgacaacaacaacaacaacaaggtgagaaagctgattatcagggcttcttttttatgtaagaaaaatcgcgaaatatgtacataaaatgcgtaaaaaaaatcccgaatatgtaagaaatatgtacaaaaaaccaaaatatgtaaataaaattttttaataatttttttttggaaaaaaattctttgtaaagcgttaaataggtacaaaaatggcataaaactgacctaaatagatttataattcatattttatattttaaaaagttttggaccattcccgtatttgccctcaaaatcacaaccctgctgtcctaaaaaatctccatttcagcagcaattccatgtggatgtcactgatgttatatggaaaagaaaatttgacccaatttaaaataatttttattaccacgactgttttctactgatttcgcaattcactcccaaaatccattcattctctcttttcattctgagtaacgtcatcatcattcattattccaaagtgttcatttgaacagttttacacaatttatacatttttgctaagctaatttaaaaaagaacgaaatctttcttatttaatttgcctcaacaaatgtcagaccgccgaaaagaagtggaaaaaaagatggaaaaagcaatgtaaaattcaaaaatgccaattttcaatttcactttaatttttgttttcctttttttcagtttcatctccggcgacggttggctcaaagtgttcgatttgctgccgccttcccaacttggacttgaaattgcgacgatcagccaccgttttaacacatacgtggacgaccatttcaagacgcgcaaatgggcgctgaaatttattcaaattcgacgcgaatttggaaagaaagggaagaagaaattggaattggccgctttggatggagaaaaattgccaattccgaaaaagccgatgccaaagaaagtggtcggatttgaagccatttcgataaggtgggatggaagaatttcgttgttttcaaatgtaaatgccattttcacagattcatcgaccaaaatgccctcacttttctgcaccgttttcgtcgtcttttcgccgcctctccaattgtttttgccatcggttcgacgagtgatcgcattttgatcttgattttggaattgatttggccaatgttcgcgaaaaacattgattccatgcatttgatggcggatactttcttccgtttgcgtctattcgaatcgtcatttctcaacaaatgtccttcacttcgcattgtcaaattttgtgacgatgacaatttcttcatcaaatttccggccgatgaccatgccgcggcatcggatggacaagtggtggccaaatggcttttcactgccctccctgacaatgtgccgccgaagatgttgaaatgctcgttggacaaggatgatggctttttggagtcggacattgaagacttaaaagaggtgaattcggattgatttgattgacacttaacgctttttgggattcactgaggagtatttctcgcctaaaatgacatgtttcaatcaaaaacgtcctatttgttagcattttattatggccaagtgccatgccaatctttgggtttttgtgccgttccccaatcataaagtttcgttcattgtcatcatttccaatcttttaggcttttgccgaagcttcttccgccgtcaatttcatttttgtcgtccgatttccgccgtcttttgccaagtccgttgtgccattttcgctgatcaacgaattgactcgcgaacaattggcattgaaaagcactcccaatagccgtctttttgtgttcgtccgttctccaattgagcgtgtcgcgagcgaatggacaaaatgggaaaatgaggcgattggctgggattttcttgctcaatcgaatcgaattgacatttatatgtatcatgaggatcaaattggcgatgggtgagcgaatgattgattatttaaaaaacgaattcaaatttattgtttttttatttttaggattctcaacacaatgatcggcccaattaatcggaagaagaagaagtgaatgaaggaattgctgcgaagtgatccgatgatgaatttgggaattgacgtgttcttaaaaattgtcctttttttcttggatcaacttggattatgttacaccattatgatacctatttgtcgtttctgaagtgaaaaaaatttgtgcacaaaaaaactcattcaagaggtgtcgtatgataccaagattatttctgcttaaaacatttgaacacgcggcctttctttttgtggacataaatgcctgaatccaaacctaaatcaaaagggtattagtgcagtttgtccccccccctttttttcgaaaattttttttatgttttcaaaagtcatgaagacatgtttccaagggttttcctggtcgctgatcacgatccggcacccatttcgaacaattccgaaccccggacccgaactcgaacaaaaaatcgaaaattcaaatctttcgattttc

SEQ ID NO: 16552 - DNA, 1703 bp, Heterodera glycines
ctccctggcacggaaacgtgcgcacgtaactgagccctcccaataataaatagaaaatggtcattaatagagctggactttttaaatcatgcagttttaaaattttaaagtttaaataaggacatcttttaaacaaaaattttatcaagattattatattttagagaaccaatttatgggctatttttcaattcttaggggtctatatttcggtatttcattcatacacaataatttccaaaaatagccaaaatatgctctaaaactcaaaaaaggcgaaaatatatgcatcttctttaaaaattgaatgcctatcttagtgactaataattttttaagcaagcctaagcttaggcctagcctaaaagttttagccctaagcctgacctaatcaattgtacgagtcgcctttgtaacaatgtacgagttgtcatgacaccaccaaatcattgcatgaaaaaatgacatagaatcagcatcatcgcttctaacaatccctgtaacccacgtaatgatcaatttaatttaaggatttaattcgatgctatattatgttgtttcacttctaagccagatctactgtaatgggcccattcttcaagctgttcaggaggcacacctctttccagactcgaaatattttgttgacatgccactcaagcaggacccaggtttgcctaaactaacgctcgctcacttatacttttgacaaatattagtgagcactctacgggatttttacgaattgggcgattcggtaaaagaagtttcggttctggaggcctttgtcgaggcgcatttcgaagcaccgggccaagaattgattgaggtgtacccggacgactgggctccctatccaaacgggtttcagcacatcgacgattatcgattgaaacgttgggctctccacttgcacaggttaactgataaccccctgaaatatgatttttattcttttacccaaaaccttctcatttttaagttggcgaggggtggtgatttcgggatatcccttgcacttattgcttcccttttctttacagaatttggcgcgacctttgcagacgagtaaccggctgatttcaactttccattttaatttttaattcatctgaaggtcaaagacgacgttcggattcaccaagaacgctattccctcctctatgttccacattcattcattatcccgggcggacggtttcgcgagttttattattgggacacgtaaatgagaaaaattgagtaaataataatatattgcattttagattttggattctcaaagggttgttgttttcggagatgtatgacactgcgaagggagtcattctgaatctgatttttatggtggacaagtgagcgctcactttttgtttgatgtttaactgctatattctgcatctctcacaagcagccatggctttgtccccaatggcgggcgagtttattacctgtcgcggtcccaacctccgctgctcactccgatggtttatgaatacttcttggcaaccggcgacctcgactttgttgaacaggtttacacttaattgtcagccaagtttgaatctttactccctaggtacttcccacattagagaaggagcaacacttttggaatctgaacagggctcgttcgtttctacaccccgagacaaaggaggaaatgttccaatattaccaatatcgggcgaacatgaaagtga

SEQ ID NO: 16553 - DNA, 962 bp, Heterodera glycines
atttttcactttaattttcaagtatgtattttaaaggcaattttgataagaaaaatgaatattacgggcgctatcaaaaaatgaaattggccatcaaacggttgcattggaatgaaactgatgggatttggtatgactacgacttggagagagaagtacgtactcatcccctggctgaaatactcattaagcttggcacactttcaggctcattccaatacctattacgtgtccaatgcattgccgttatattcaaaatgttacgacgacgaggatgacgtcacgccgtacaaagttttcgagtatctgaaggtgtctagagatgtttgcatttatgaaaacagcaacaatcggccaatttatgtagcgtgaaggtgtgctcaacttcaccagaggcatcccaacttcgttggcgatgggcagcatccagcaatgggacaaggagaacgcatggccaccgatggtgcacatggtctgcaatgcaatctgacttcaaatcaattctaatccatgattttcaaggtagttgaagcatttcgaacaagcggtgatctaagtcttatgaaagccgcggaacaaatggcaactcaatggttggtcgtcaattataaagtgagtttttacaaaataatgattgtaaaactatgaatgtttaaacattcctttagggttatgtatcaacctatgcgatgttcgagaagtacaacgtttccatgatcaatgaagagggcgttggtggttcaggaggtgaatatgaggttcaggtaggtaaatggcatttcacaattaggttttaattttctggttattttagaagggatttggttggacaaatggtgttattttggatttgttggacaagtacgggtccaaaatctccgtctccggtgcggctgtccccaacggcgttcgttttcttcctctcgctttgattgtgcttttgttcatgaccgtagttgaaa

SEQ ID NO: 16554 - DNA, 2076 bp, Heterodera glycines
tttagttttggtcatttaaatgattagtaaagaaacattttataattttttcgaataaggaaaatttttaaatctaaaatttttatatagaaaaaaaattagaatttggcgagcaatttttgagaaaatttttcatttcttaggagtgtattttttgaaaatttttcgggtcatttcttaggggtgtattttcgctattttattgcatttttagtggaatttttcggtaaaaaacgccaaaaagggcaccaaaacggcaaattgtcaaaaaaggcatttaaggcacgaaaatcccgaaaaaggcaaaaaaggcctaataaaagtcaacatagaagcttcaaaccaagtggaaatgtaattattaaaaatcaaatacaacaaataataatataataacatattttcctcttggggccaattttcttcgcatttagtgcgagtaatttaaacagtaaaattcaggacaaacacaaatgaataatttaagagtaacaaatattaatatgtattcaacgttattctcgatccccacattattagctatttttgaataccgctaacaatgacattttatgagggaaagtaataaattgctttaatttatattaaaatttatttttttattgttagatatttttcggtaaaattttccaccaccgttagtttaattagttaaaattttctttttattcaaccaaactaaatttgataagtttgtttcagtctataatatattctgtatgatttggattattttcatacttttcttacaatgttattaattaattttgtaaaatttctaattattttaaaatattgttcatttaaccgatctttaatcaattttctgttctatgagattgtatgaagtttctttttttattgacttgttaaatacttgaattagtttttaataaataaatttctaaattaaatagttatgtcgttttcatggaacaatttgaatgatgattaagttctgttgcatcgaatcatttttaaaaattttcctcaaatacaagtgttttttgtcttcaattttttgaattcaaattctttccgtaatttacttattccttttttaattttagtttgttttaaagaaaccattttaggtaaaattaattttattctttcgtgctattacgtttatattccaaattaaaacaataatttgccacgggttttcaattgtatcacagattcaattttttttttaatatgtcaatttaaattttattattatttaaaatatctatttgaatttaatttattttgtcgaatgggtaaaatttttttcattatttaaatttaattaatttttgtatattgccaaggacgtccttggaaatgagcatatggaaaagttttaaaaattcaaagaaatttgagaaatctttgtgatttttaacaatattttgattaaattatggcattatgtcaataaaaatgtaattttttctcatggttgagaatttttgaaatttgatggcataaagtcactatttttcttaaattcttaaagagaatgaaacctaaacaattttaatcttaaattgtttttttaaatattatttcaaaggtgctcctttttatttttgtgaattttgaatattttatttataaaattttgatttaatctttatttgttgtttatcttgaaatgacttttattgtgtttattttatttttcatattatttttactggtttttttattgtattattgtaattttttcttccctttttggtgttaatattttttcttgtgtaactttttgatttatattattttacaaaatttcaaaaaacttcgttatgttgcaagaagttatgacaaaaaaaaaatgttcagaaaaaacttgatttaaggatagtgtgcaaataataaataaacccaagcctattgcaaggactaattacggtatatccactgtaataaacctcccatgacacccattcattaatctctcttctgcttcccccccccccttgttttctttccgttttccattcctgattgcttccccctgattttttgctcccatcgcttaatcctcccttctcctcccttttg

SEQ ID NO: 16555 - DNA, 1669 bp, Heterodera glycines
tttttttttaaaaaaaaatattttttttaaaaaaaaaaaaaaaaaattttttttttaaaaattttttaaaaaaaaataaaaattttttttttacaaaaatgaggaaaagaccaaaacaaatttttttttggttttgactgtttttttaaaaaggatgcaatttcctttttagggattttaacttttttaaaaaaaataaaaaaattttttcactcaaaaatatttaacataaataagataaaaattaggttaaggttaaaattaacacatccaaatgtatagcaagagcacgatgagccaacaaaaaaaaagaaaattaaaagaacgaaaaaaaaaaaataaaatgaaaaattaaattataaataaattatataagatgagttacaaaaatagtcaacaaaattatattcttttaataaataaaatttcaaattgacagcggcaataattaacttaaattcaaatgaaaattgtttggtccaagaaacaaagattagaagcgattgaaaagaattaattgaataaaaaataataaatgaaaatgaaattcaaactttaaaattatttcaaattgaattaacaataaaattaaaataaatcttgtaaatgaatatttttaatgaagacaaaaatattaaataaggaaaataaattttgatcaactgaatatatacaatatattattaaccaattttattgattttgttcaacaaaaaataataataataataataatatgagaattatatatttttttaactacttcaactctttttttcagaagcaattaattgattttctttttagaattttaactcctctgtataacttttgattttaaaaattccaaaaaatttcatttagtttcaaaaaacttatgtacaaaaattttctacataagatttacgccataaaaacattaaaaaaactatcaataaataataataatttatattttacggaacataagcaataagagaaaaacgaaaggacgtttgttcaatcgaccacacttcaccataattacaataaaatatcgtaattttctttgtttttaacttaaaactcaattcatactttattaaaataatttcttaaaaagtcttaacaaggactacaaacatttaacaattgaattctttaaatgcattttattattgtaataaattactatttttaaacaaataagaaaatatcacataaattgtgagaaataatattattcaaaatcaataatgtacaatattaattcacaaaaaaggtaaataacaattatactcgtttcacttatcgaccggaactattaatatatgtgaattaaaaatttaaagcgtcaattttaacgaataacttaaataaataaagcacttttaactaatgggtaattaaaatatctctaaatatataaattgtaaggtccaaaaatttattaaaatattattcttactaatattatcattcgcgcggaaatggactaaaaaataattatgtattttgtttatatagctaataaaaaaatatttaatagtcaaaatgctaatcgtaatatttgaaaaaaataacagaattccttcacacagttttttttttaattaacagattacaggacatgagagaagggattatgtctgaagaaaacacaattaatgaactgatgcttataatataa

SEQ ID NO: 16556 - DNA, 2048 bp, Heterodera glycines
aaatctcagtccggaaacagagttaattttaaaaatattatttaattttttcttgcaattgaattaattctggctaaagcagacgtaattttgtctaattttgggcataaaattaaattttaaatattttttgttttagttaaatccacaaatgtcgggttccctaagtgtcggatacccaagtgtcgttcggtccccaaatgtcgggtccccaaatgtcgggtgcccaaatggcgggtccccaagttgcaaatccccaaaaagtcgggtagcccagcaaaaaatctattggcttcgttcatacaaaccgagaggagtcgattggtttttatttagccattttgggcttcggcccatatgaccgatgttttccctaatcataatagcaaaatgaatttaattactatgttcgtttcagcaattttgtgcttcatcaaaaggttcggatcgaccaatgtggtcgcgagtgaaactgatcgcctcgcctcatataacttcgaattgtttcgcaaagacttggccactattcgctacatgcttctggatgacatcgaacttttccagagagtgcctcgatgtaagttgttgaggccgcatttttccgcgttttgcgaccgcggtgaaattaggccacgttctacatcaattttcaaaaatttaaatgatattttttccaaaatatatgtaattaattagttgttgtacagggaccgggaatttgttattttcaagtaaaattataaaaattaataatttaacgcaaaattaaattataatatatttaatcaatatttcaaaccaaatttatttcaaatatttcaaacaataatcattttggactaaatgatcgaatattattagaaatccagatttacatttcaaatcacttttttctgcgcgcttttttcaaaaaacttttgggaaagaagggggtccgggaaaattcaaaatattttaatttctgtagagggattgaaccatgggaagaagattatcgatatcgaaaccgggaaataaattttaaaatccgggaattgggaccgggacctcggatgtccgggaatcgcccggtaccggacccgtacaactctagtaattaggcttcagatttcctaattttttttaaagattacagtaatttttattttttcttcgaaatttattgtatttctttcaggaaaggtactagggaattgcccataaacataaaaattgttatattttgttcattacaattgaaaaattttcttgtattttgtcatttataatctatatatatatatttgctaaatttgagtgaatagcaacacgtacaataaaaaaattacaaaagaaagcctaagcttagacccaagaaaacctagccaaacctaaagcttttagacctaacaccctaaattttacgcatttaataatattttggtgttttttcgtaatatttttaaaaatatttattatttttcaaatcccaatcctagataattaaaataaaaattttatatttgcatgattctttcccattaatttttagacttagactgcatttccgcgttctatgaggaggaagatgaatggacacaaagattctgggaaaaatgaagaaatccttcatttgaccgttggaaattttcattaaaatttggattttttaaaaatcttaaaaaattatgcacaaaaatatgaactgaaaatttttgaatatttttgtttaaacttttttttcaattttgggtaatgctctgaatttatttcattttcttttcccctggcggaattttaactaatttttattaagaagatttctagaattatcgaaaaaaaatttcatgtaaacatattgcataattgaagcattttatgcaggaatctcggatttgctgataaaattttacttactctgaaggcctctggtttccaaaactttttcagagcaactaaatagaaattatttttcgggtttgaaatcctttgcatccagccaccaccattgaaaataagtggctggcttggttaaaacaatttttcaaatcgaataaaaacctgagggg

SEQ ID NO: 16557 - DNA, 1390 bp, Heterodera glycines
atatatatttttgctaaatttgagtgaatagcaacaccttttataaaaaaattacaaaagaaagcctaagcttaaacccaagaaacctatccaaacctaaagcttagacctaacaccctaaattttacgcatttaatattaaaattttatatttgcatgattctttcccattaatttttagacttagactgcatttccgcgttctatgaggaggaagatgaatggacacaaagattctgggaaaaatgaagaaattcttcatttgaccgttggaaattctcattaaaatttggattttttaaaaatcttaaaaaattatgcacaaaaatatgaactgaaaatttttgaatatttttgtttaaacttttttttaactttacattcagaaaattcatggtaattaataaattaattacataaagacttaaatgatacaaaattataaattgtcaattttggtaatgctctgaatttatttcattttcttttcccctggcggaattttaactaatttttattaagaagatttctagaattatcgaaaaaaatttcatgtaaacatattgcataattgaagcattttatgcaggaatctcggatttgctgataaaattttacttactctgaaggcctctggtttccaaaactttttcagagcaactaaattgaaattatttttcgggtttgaaatccattgcatccagccaccaccattgaaaataagtggctggcttggttaaaacaatttttcaaatcgaataaaagcctggggggaacgcatctcggtgatcggagatcgtcggggaggacaggtcgaggataggggacgaggaaaagggaactcgggagagattaacaaccatatttttatataattaataaaacattaaaagttttagtgtccaaaattcaaaaaatggtgggatgaacaatttggagagtggctgagggtgaattcattttacactcatttgaattgtcagaaaaggggattaaatttggcaaacaaaaattttttctatccgtttttaggaccagtgatcaatccgtcagtaagtggacaatccaatccgtcagtggacaatccgtcagtaactaacccataagcaaatttatttttaaaatacccagatttatttaaaataatgtgaaaattatttaagtcgctaaaaatgtgaattaataatttgtgttattttataaaaatgtgaaatgatcttaaaagaaataaatgattatttatcgagatgctcaattaaataaattataaagtaattagaaatgttaagaatttataaaaaattatttttattaaatttaacaattatttttgcaaaatttttgatcattgctcaaaaaaaatttgctgacgaattgtccgctgacggat

SEQ ID NO: 16558 - DNA, 1908 bp, Heterodera glycines
cggaagtcggaattccgacaccaaaaatgtcggaagtcggaattccgtgccatccctggtgtacaagtaatacagcaaaatttgggcgcaaatttctaatttttaaaccaacagtgtcgttaattaattgggctgattggctgtttaaattgtgtataaattacacctgccgatcgggaagaatgtcaattttgtgaaactgattcgaaagtaattaggcaataaaatggaatggtgatttttatagttaaaattgctatatttgtgcaatttttgacaaatttgacagtggtattaattagggatagatgggtccgggcatttgagcaaaaaccgggtccgggtattgccgggtccagaaaaaccgggtcgggtcccagtttttcaaccgggtcgggtatcgggtctaaccatgtattgaaaaattcctaaaaaaaatccattttttcaaaaaaattttcatgaaaataaaagcttatactttcaaaaaagcatgaaaaatataatgtttttcaaataacgctttattaattgcccaatgttttattgttattacttttttgcggtgcgctttttccaaaaaagtttttgtttacagactttatttgttttttaagtgttacaacaaaagaaattatatacaaaaatggtcaaacgaattaaaatgtagaaattttttaaaaaaatgcaaaattaattagttaaatcattcgcatggttcgctggcgccaagcggtgaagagccatcagttgaatacagctcaaaattggacttcaaatgaaccgcgtgggccacaaaattcacttcgggcttcaaaatacgctaaaaagaaaataaatttatttaaatataataattatttgagcccgaaaccgagatttgctttacgccgaaatttttaaaataacaaattattagtaaaaaaaattgaaaaaatatttggaaaaaaatacactaattaataaatttatataaaattgaatgaaatttaattaactaattaattaattaatatttcaaaatggtaattaattaaatatttttcataaaagaaattcattataataaaaaatttgctcttacaattggtaggccaccaacgcctggtggcaaatccaatttgcatccctttgccaattttttgtttgccgactgaaattttcaaaaaaattttttaaatttcttaaaattttcaaaaattcgaacctcgggcactttgtccttcaccaggccggtcagtgagtcgagcccatcttgggtcatgccactttttatgtcagtgccaatgtcggtgagcaccaaagtgggcagtgttaggttggctttgatcaaatcgcctgaaaaattttattttaaaaattaaaaattaatctaattttaaaatattatattataatttttatttgaattttgtttaaataattaaaaattttattagaattaattttattcaaaaaaatttactaaagtgaaatttaatttaaattttataaattttattagaattttgtttaaataaatttttatttaaattattgaatgaattcccaaataaaaaaatttacgacttatattttaaaacattttttctttaattattttattatttttttaattatatttcttaataaataatttgttctaattaccctccgttttgacgtcaatttgtgccactgatgttgctttaaatgtgcccaacttcttcttgtttgtgtgaccataaaattccaatttggcaatatgctccaggataattgtagctgaaaaaatgatgaaaaattaattaaagaaaaaaaatgttgtaaaaaaaattcttcaaatatttaaaatcccattaaattttctataaatttaaattgcggggagaaatttcgaattaatttctaatttataaacaatgaaaa

SEQ ID NO: 16559 - DNA, 706 bp, Heterodera glycines
ttccagtttttaagatcatgaggataatcctggccaggggactcacgactggctaacttaaatctggcagatactactttttcggaaattttcagcgccggaaagaaaacatagaaattcttagccgtttttcgctgaaaaggactaattttttttttcattttggagtcacatttccaaaaatatgaaaaaatggggggggaggtgtgggaacccggcgatgcttgggggaaaatgtaggaaattttaatttttttttttttgcccaaggcactgtttttttttgaaatttggattagtgtaatggattaaaaatccgtgccaaatttttgaaaattccaggaatttttttttgtttgccatgaccccgaatcctagatatgctctctttttaaatttccacctatgcatgtggtaaagcattgagttgatggtgtactcgttgagcacaatgtcagccattttgcagccttttccaatgcagggctaggaaaaatagaatttttcaaaaaaaaattcaaaaaattcaccggaatttccacgggcatcggcgagaacggcgtacagccccagccgcataagctaaagtcgcctgaaaaaagaaaatttacaaaaaaaaatttgtcgaaatttttacaccttttaaactcaatgtgtaatcattgtcagtggctgaactgccggtcaattggagctcaggaaaagg

SEQ ID NO: 16560 - DNA, 2173 bp, Heterodera glycines
tccaattccaattggagtttcatgtcgtctccaagagacttagaattgagagccgggccaattgattatgtaaatctctgattaaattttcatttttcccatacttgtcctttaataaggacaccgagagatcataattatccctggagaagggcaaaagtccttgaatgacctttttggcttcacccctcaacagggaatccaaataactcattttttgtacgtaatccaaatcagcatcagcatgtattgtcgattcgaataatggccaaaagtcatcccaattactgccatcgaactcctttaggtttaattttggcaaggcaatgtttcggcgtgccgttcctccgggcccatcttgaagaagacgatcaatgttccctttcagcgtgcgggtatcggccaatttatgatttgctcttcgcaacaaattttgcagatcgtttgcgttgactgatgcacgatactggcgttgaaactccgttttttcatcgccgtgaagcgtagaagcctcttgattgtacaatgcccttgctgcctttatttcgtccacttgcgtctgaatctcgtccgcaacttctttccattccctttgatcacaaattaaattatgtctctgttgagaggttaacaccccttgcggaagaatgggcaatggcttgtccagatataactcaattgcatatttagctgtttctatgcgttcgacataaatgtccgacattatgatccctttttaagtttaattcagattttatttgatttgactaaatagtcacgatttgattcgtaaaaatgtatcaacttgataattcggaagcccttggttaatgatatgaattaaacaataaaatgttgaataacaaattgtaaatgcactaattaaacttcaaaaaattgaaattgtttagtcaaaactgactaagcaacgctctccccaaaaaaaattaaattagtaagttcaaaactgacagcaactcaacaaaaataaatattaaatgcgtaatcaaaatttaatatcaatagacaaatacttgatcaggactgatcaaaattaatcagaataaatgtgtgaagtcaaattggttcacaaaaaaaataggttcaaaactgaccgaaaaggatgtgcaaacaaaaagaaaaaattaaaattctatgattggacgtatcggaccgtacaataggttttggggtttagggttagtaactgatagctgcggtcgtccctgtggggacaggtcgccactaacgcaaaccgcttggaatgggacttaagcggcggttgcctgcgcaactgtgaatgaatgggccgttgggagataggatgttaagaccagattgttagccgattaaacaatcgactaattgacacgcgagggatagccggttaaataaccggctaattggccagttggctgtgcttgacctgatccaacggcgtcaattggtcctcgactggtgtgtgcagcgatcagttggcgacagcgattggtgaacaccggacccggtgatgctcggacagaggcgaagagaggtccgagtggtgatcagttggtcaacggagaacggtccaagtggtgatcaattggtcagcagagaaaggtccaagcggcgatcaacggagtgaagaatggagagcaacaaaaaaagggggagaaaacaattattttggaaatgaataacacagtggacaaaaatgccaaacgatggagcgagactgatcgggcaaaggaccgatcaaatgattaaccgggatttcaagcactagtgcttgatgtgaggggataatgtgctaaacagcaatcggcgaatggaaaccacaagcgatccaaatcgcttttaccgtaccaagtgtcttacggtaccgttcttggtcccagggttgggaattccctgcttacagtttttaggcccttttctaaaagacgattccctcccgggatttaatttagaaagggaaccccgaatctgatgtttattcaggattagaaaaagccgactttttccccttgtttgacaatttgacggagcaaattttattgtcagttgagatgagcgaagcaaaaattatatgaatgaaaacggggaaaagaaaatcgtccatcggtgggggagggggcggatcgaagggtcgcaacagtttaaacgatgtgaaatgtcttccgtccatcgt

SEQ ID NO: 16561 - DNA, 1106 bp, Heterodera glycines
tcgatagccctaagtgttttctattatcatgcaaaatttcaaaaaatttaattaagtttcaagaaaattatgaccaaaatgtttaaaaaaaaaacttggttttttgagtttctcaggtcttaacttttttgaaacctaacgattttttttgaaattttgctggataatagaaaacacttaggttattgaataataccaagattataaaatttaattcattttgagttatcaataattttctgtcaaaaattttaatcgggtttttgggcatttaagaaaaatttccttaaaattaaaaaaaatgttaattatatacgaaaaacgcgaaatacagtgtaaaatttcgtatttcttaatatttgctcaatatttcgactttttcaatattttggtcaattgcagcttttttttaatatttatttaattttcggaatttttaataaatataattcgcaaccttagttatggggttttctttttctggtttattgtggtaccttttcttcggtttataagtctttttttatagttttttttgttttgttaatttttgttaatttttttactttttttttagctaaattaattgttttttaagacaatacaccttcttttttttacgaaattttttgaaattttgtagactgatagagaacacttaggactatcgaatacatgaagaaatacaaatttggttgcttttgagctaatttataaataatttttcatcaaatttattgatggttttttaaataacgactccgccccgaatgaatgatatctttgtcgaaacagctgatttgtgagcatttaaattctttgctcgattatcaacctgtaattcggccgttcacttaaatattggatggtcgccaaccattatcattctatattaaccttaaaatttccttttaaatttcttactaataatttgtctttctccgttttaagtttgttgatggccggccttgtcaggttttctgcctgcaaatcgaagccacatgaaaagcataaatcagaatgagttcgacaggataacaattgagaatgcttgcagaagattttgcaaatcgtgtcccattagaatagcatgagcctattcttat

SEQ ID NO: 16562 - DNA, 2322 bp, Heterodera glycines
tttattaaaatattgtcaccatgcttttcttcccctatttccttaattattattgagaaacccataatgaatataatcgattaaaaatgtttccgggctttatccaaatttccaataatattatacaaaaagatttattatttttttttgtaaatgtaagtgtttcctcaaatgtttcttttatttttttattatttcttttccccaatttccaattcaaatgcttcggtaagtttcgtttttttttgttttgataagcttttccttctctaatcacttcaattattgaagattgaagatgaagcattggttgccattgtgaagggtccggcattttttgagggattttgcgcgagttacgggatgacttttagtgcgaataataaacttttggcgcaaaaatatgaattacatcttggcgatttgtttttcctcagaaggaattggaaatgcgaagaagttattgaattgattcataaagaggtactaatttgcataagctaaacaattcaattaaatgaaattttaatggggaatttaggcaaaaatcatttaaaaagacaaatatttttaatgtttttaatcatgaaattagtaagaaaatgaaacttacgaatggactaaaccgaacaattaaaaaataaaaatgaggtgttttctacccaacattttataagttttagaaatttaagacatacagtaattcaaaagtggaagaatgtaagaaattcgggaaatatgcttatgtgttgtacgaatatttgttctgggagtacgtccgaatgtccattgaaggttttgaattattaagcaccaaaacttacgtaaaaacaattaagcagttgcgccgaccctggtaaacaaattaatgcccgaagtgcgggagccaaagttcaattttgggtttaactctgccgggacactaattgaagtggtcaaaagtctgggccaaatttgggcattcttttttgataagcagctcagaaaacggtttggcacctattggaaatgcatgagtgagctcagtaattacaagcgtaagcccaaattggcaaatgaacgagaaatcgtcgagattttggagacgaatgccctgaggctttaccaacattatgaatatctgtttaacaatagcgaaacggccactctgagtcccaactcaaagttggaaaatttattccgaactcttcgcaaagtttttgataagaatttggaagaaatgtggagcaaaatggaaatgatcaagtcatcattgaatgaactaaatgtggaaatttcagagatgccattttatgacattgacaaagcggtgagttcaaagagaaagttactgccaataaactaattatgcacaattaaataattcattaatatattcgtcatttatttgatttctgctgatcttcagatcaaggacagtgcctttcttacatttatcatcgacagaaacaatctgaaaatctttagtatgatattaagcgctaaaactttttttaacgtttttggatcggtgcataaaataaatgtcggcacttatcctgagaatgtggtaggatatttggcgcaagaatatgaagcttatcttggcattgtgcatttgctgagagagaaatggcaatgtgccaatgttttgcacgagcagaaaaaatgcgaaacgttccgcgattatttggacattttgtatgaatttttgttccatatgtattatgaaggtaatcacacagaaaagacaacaaaataatttaattaaaaaatatttaagggcaaaatttagcgatggaacaaaataaatgcgcggttaggccaaattttgtgcttggcaacgaaacgaagattctgtcactgattgaactgttgaagaaattgggccgaatttcggcattctttttttctccaaaatattcaatgactttcgcccacaaatgggaagtgtttgtgcattataattccgagctaaaattggtgattgaccagcaattagaaaatgaaaggacccaacaatgtccaacacttgtgaaaagcattaaacatatgaagatccgatcgcagaaaaggaagccgaccatggatttaagcacaatggcacaaattagggggaactttgtcaatttgctggcgatatgtgccgaaacagtgaaaaggatgaatttgaaggacgtatttggcgagtacgataacaactgggattggttgttttcaaacaaagaccaattaacggtttaattatttaaacacgattttaattgagccgcgttttaattagttaaattgttttctttaatcagcagattgatgacaaagtgctgttttcgtatataaatg

SEQ ID NO: 16563 - DNA, 1732 bp, Heterodera glycines
ttcataactaagccgcagaaaaaaatgtaaaaacaaaactttcttcgcttatttataacacataaaatcccattttattaaacataatattttagtataattaaaaattatatatttatttcatttcgacgcattaataaacagaagggcaacgtgtatttacgtataatttttgaagtaattatcagtccataaggactgttcaagtcgtaaaaatcgacaatcataaggagaatccattcggcaattggtgaaagttcggcatgccctcgggacagaatttccctaaatttaatgatgctttaaatagacaattattacaatactttgcttactcttttctaaaccataaatggcttttattgtagtcaactcattttttatcaagaaaattgattttatagtttttttttctttcatttttggtttcggattcccttttaaaaaatggacgattcagtgccctaattcctttctgagcaattttgaggattgggacatattactagggctctaatttatagttgctaaaaacggccaaaacaattagtttttagattttaaaaaatgactttttttctactgaatcaaatggccttaaaatgactcaaaaaagtattttaaactttgtttaatgcttccttcacacttttttggcgtttttcagctttttgggattttgatgattgctcttttttgactttttaaggaaaaattgatgaattatttttaattatttgctattcaataagagtttaaaattaccaagtgattagataaattgcgaagagaagatttgcaattgaaagcaaaatgatggcgtaacacattcgaacttcaacacggtgactgcgctgcttcaaattcatttgtctgacccttcggcacattaacggataagcaaagagcagaaaagccaagtggcaaatggcaaacattttggtgatattgtaataaatttgctaaaatgaagaaaattcaaaaaaaaataattaatatcaaacatttgtaaaccgaagctgtgaattccaacggccggttatccaaaaaagattcgaaaatcaaatttagaagaaaaataaatttggaactttaaaaaaaatcaccaatgttaaataactcattttgtattagctgacaaaaatattttgagtagcgcctccattcccgcccatattaaaaaaatttacaattttcatacaaaatttttttttaattttaaaattaattttcctatatttttatactcctattttttacttgggttgaaatctccatgaacacgaggccgacaattttgtgttgtccttcctcaaacggtgttctcacttcagacaatcgaaagcacacagaatgccaaagaattggtgcagaaattgccaaagcgaacaaaagaataattgccaataaatatttgctaattttatgtgaccaatggcaccgatacatttgggaacaacaaatggcacaaaaacggttcaatgacattagtaaattcagctaaaaatttaaatatattttctaacatttcatattgctaagaaattagaataaattgctttaattttaaaaatgcctgaaattggattaagcccaatgtccatagcaaaaagtaaattaaattcgctgcggcgtttgcatgattcagcggataaaatatagccggaacatagccccaatatgcgcattttttgacaatgtacaataaaaatttgctaaaatgaattaaaaa

SEQ ID NO: 16564 - DNA, 1125 bp, Heterodera glycines
gtgcataaattattaaattattctgttctccaccatccacgaatgtaattagcaaattccgcgatgagaatccaaaattagcaaattaaattattaccaaagctaataaaaatatgaaagatgataattattaattataagtgtaattaagtataatgtcctcaatgtcattttaaaaaattataaaataagggaaattctgtaaaaaaaatcagaaaagatttgaaaaatcgttgccatattgggatcaaataaataatactcagcaaattatacaaaattttatctaaacaaaaaaaaagttatttttttagtttatttaatgtattatttgtaaatatttgaaataaatggactaatggagcagtttgatatgttttaaaaatttgccacccatggattagagtcaaacgcttacaaaattggatattttcaaaaaaaatgcaatttgatttcggtaaatgccgacaggccattggaaaatttttgaaaactttattcagattcatttagttcaaaatgctcaattttttatgatttttttaatttattaatttttatagaaattttgccaggaatttattaaaaatgataattttgtcaaacttcaagctaaaatttacattttcttgttttgatatataatatcatatacataaaaataaaataattaatttagaaataaataaaaatatagaaaaaatgtaaaaatgtttttgttttttatatttttgtttattttatttatttatttttgtttccatttgtttgacttccttttttcatctcataagaactcctttcatattgcattgttgtgctgtttgtggaaagaaacaaatgtttaagtgagaatgttattcaacaaaatgtcggatttatttttattcatttcttttattttttgtttgcattttttgaaaaaaaaaacggctgagatatatttaggatttttttatattattaagtctcccgaaaatgtctgttatttgtctaattttttgggagtatttaaacacggtgaacgaaacactcccaaaaaatatttcttaaaaatcaaaaattcttacgacgtaataatggcaaagtcgtcaatcaaaatgtatttttttttgccatttttaa

SEQ ID NO: 16565 - DNA, 2563 bp, Heterodera glycines
  misc_feature (2510)..(2510): n is a, c, g, or t
aaatgccatcaaagcgttggacggcgcgtacattggcggctcaaaacttacggttctgttttgttggacaccatttttgttctttgggtggaaattcaatttttgactgggaaaattttttagattttaatgccttttcagtaaatgacaaattacaggtcgaagagtgtaaagcattgacaactgaccgaacggcgatcaccaaacaactttcgttgaacaaacgcaaaaaactgaggcaaaaaggcaaatggtaagcgcaaaatttagttttcttttttaattatttgttttgaattcgttttattgctttcattttccaatttctctccgccattttaattattaattgcattaataaaaattgttttacattttattcttttaagcgaagttgatgaggaggaggacaaagaagaaggtgccgaagaggcggacgtcgactcactaattgaaaagcaaattttggacaccggacgtaaacaatttgacattttttggcacgagggttgggaagggatgcataaattggcactaattttcaaaatcttttgcgactcgatttttctgtatccgaatttgcactgttttcaggacttttccttcgaaatttgccctttgtgtgctcggaagagcaaatacggcaacttttcgagccgtttggaccactcgccgagttggaatgtgtcgtggacaatgcgggcaaatgcaaagggtacgccctgtgcaccttcatcttcccggaacatgcggttgccgcgtggaaagcgttggacggcaccgtttttatggtactcatttggacataaactgagactatttccacagctttcttctcattaatagggttgcaaattatatggactaaaaaaacgctaaatatggactaaaaagctcaaaaatggccaaatatggactaaaaacatccaaaatatatgttttaaaccctcaaaaattccaaaaaggtttatatagctattcaatacttgcttaaataagaaatacaataaccaaccaaaaaatggatttaacatttaaaaatgcaaatttttttattgtcgtccgttgtataaaaaacacctctaagtttgccaatttcaaaaaaaattcccatttaaaaaaaaagaaaagttcgcaaaaaatggtgaaaatatttattaaaaatgccaaaatgacaacgaaaactcaaatttttcgtatttttggggggtgtaatttgtaaaaatttccaaaaagtcggtcttcaggtgtatattttcagcttttttaaatttttcttgtgaaaatttgccaaaaatggccaaaatatggactaaaaaccaaaaaatgtcgaaatatggatttattcccgaaaacccccaaaatatgtatttatatggactaaaaaccttcgccaaaacaaaaaatgttaacgcagaaatgctatttttgagcccctttcttcatagcatatgcgcagaaaaaataggtaaatccatacaatttacaaaacttactcatcaaaaacaatgaacagtttggagaaattctgaatattatctttttataaaaaaagaaaataaagggccgaatgctgcacataatcgccggcgaagagaagagagtgcggacgaacggtgcagacgacgacagcacaaacgacggatgccaaagtgcgttccaacgcgaacggaacgaaaaacgcaaggcgaacgacgcggaaggggcgacagaggcggcgacaaacaatcggtgagcaaaaaaggcaacaacaacaaagcctcggaacaattatccgaccggtggcaatgtgctgcctcggaattgtctcccattaattaatgcatttgcaactaataatgttttcctctctgttcagttgcacttggaacgcgctgtttcttggcactgacgcggtggcggagacattagcggaaaattatgaagtggagaagcgcgatttgctgctggttgacggcaaacagcagaacaggtgagctggggacggagttggaggagtacggattcgacgtatccctccgtacgcccccgtctctgttttaagtcggcatcaaaattttaagatgttttattgtttaaaaattagcctcatttggttgccaattctgctctctttccccctttaattgatatttctcccatagtgccgcggtgcgcgtggcaatggccgaggcgcgtttggtgcgcgagacgcgcaaattcctgcttgacaacggcgttcggttggacgcgttcgcccagcggcggcaccttttgagcaatggtggcgacaacgtcgacggcactgaggacggaaccgcaaaaatgagacgttcaaagacgacaattttggtcaaaaatttagacgccacgagggaagggaaaaaggaatggctgcactctctgtttggacgctttggggtcgttaagacggtgctggtgccaccaggtcggaaattgactgaatatatttcataattagaaggtaatggttacttttattcaatctgcgagttttttaaccccgatgntaattagctgcaagtattttggcattgcttttttcaataccatacatgaaaaa

SEQ ID NO: 16566 - DNA, 2999 bp, Heterodera glycines
tctgccggtggaccaacacgcggagcagttaatgtcgttgaaccaagtgcgttaatattcactgaatatctattttcaacactttcaaaattttttggctcaaatttattacatctttcaaaactcccttagaattaattattcgctaattgccttttgatttgccctctaaattttaaaagatcgttcgttccagaggctgtcttgtaacaacggcgctggacttactgcatcatttgccccaacgccgtatggccaatcgcctcccgaccaaaatcaagccatgcttgccgtcccgatggcaattcgtccaacctccggcgcaccaccgacaatgatccaatacgggaccacgaccgcgatgtacttcaatgcaccggcccaacagcaccaaatgatggtcagcagcagcggcacaagcagcagtgccgaacagcaacaagctgctgcagtccatgcctatcaacagcagcaacaacaacaccaccacgaacagcaaatgttgtacgccacgggcaccatggccggcgggtcacagcagcagcaacaaccacagcagcagcagcatttcttcccaccgcaaggagggccaagcggagcagcacacccgggtaaaagttcactcattcccaacagcaacatttaaatgacacaaattcgtatgtaattcgaaattactgtccaggaaccccttcaccatttcttcctccgtccatggcgcgacaaccgtccttaaccacaacagctgcgccttcctcttccccggccacaccggtgtcaactccgaccaattttttggaacgcaacgcggacattgaggcgctggtggcgcgcggagtgcacacgtggaccgtaagatttaaaaaattttgcttatgggcccacttatattttttatccacagaaggaagaagtgtccaaatgggtcaatttcgtcaccggctccgaaaccaacggggaccgttttgtcgaggaggacgtggacggcgcttcgctgctttgcctccagtcggagcagttgaaaacggagctgaagttcaagctgggcccgcacataaaaatttggagcgctttggaggcgcttaaacggacgatgatgtgctgaataatggagggagggatctcgcgaagcaaatataaatctgctgctgacgaatggtcatatattgtagttctcctgtgtatttctatcacattgaatttacctaattattttcatttatataaaaatatttattgtccgtaactctctcttttctcgcctttcatatacaaacacgcttcaaatgcgaagtataaaagtatgtttgttttttttggtaactgatcgggtcctaatatgtgaccataacccatatcgctcagttgacatcgccagcccttagggattggtaaccatcccgctgtagcttttaaattccagtttcaataactattaaaataaataggtcaaaaaatcttagaaattcgatcgattcggctcaaaaaacgaatcgtctttttaccaatcaacatcgttcgaaaacacttaataaaaacagaaaagaaaaaacaaactatgtagcattaatacatataaaaaaatattattaaaaagattttttcattgttaaatttatttttttaatacattcaattttttgaagagaaaaagcccactgattgcaaaggtgccaaaactgccttaatagtttgagacaatcgaaaagaagcagaggaaaaaatggcaaaagctgtgtaaaattaaaaattcacaatttcaatttttaaatttaggttttccttttcagcttcatctccggcgatggatggctttcggtgttcgatttgttgccgccttctcaacttggcctcggaattgcaatgatcagccaccgatttgactattacgtcgacgaacacttcaaaacgcgcaaatgggcattgaaatttattgaaattcgaagcaaaattggagagaatggcacaaaggaaatggaaattggcaattgtagtggaaaattgttgccaattccacaaattcaattgcctcgtaaagtcaccggattcgaacagctaatcatcgcgtaaattggcgattatggagaaatttcagaggacattttctatttattagtttcatcgaccgcaatgccatcgcttttctccaccgttttcgcccacttttcgcctcctgtcaaattaatttgaccatcaacacggacagtgaacgcgttttggagttgattttgcacaacatttggccatcgctcggaaaaaacatttgtggcattgaattgcccgcaagaactttccgctgtattcggaaattcgccccttcaattctcagtgattatccatctcttcgcgttttcactttctattctcccgatctgcacaccgaattcccatgcgatgacagtgccaatgcgtcggatggacaagcgatggcaaaatggcttttcactcctcatccaaacaatgtgccaaaggtgttgagatgctcgttggaaatgaatgatgggaatttggcgtcgaagattgaagccttcaaaacggtgcttacttattaatttacttaattagcacttttatgagtttttggggttcgctgacctgacaaaaatgatttcgtcttaataaatttttccatatttaggcatttgctaatgcttcttcccctgctaatttcattgttgtcatttggtctccgacgtcttttgttgattccgccttgccatttgatcaaaatcaaaccaacgaattgactcgagaacaattggtgttgaaaagaactaattatagcaactattttttgttggttcgttgtccaattgcgcgagacgcgagcaaatgggcaaaatgtgaaaaggaggcgattgattggcgaatttattatcaaaggaacagaatttacattcacattagtcgtgagaatgaaattggggacgggtcagcgaatgattattcaaaaattcaaatttgttgtgtttctatttttaggcttctcgacgcaactc

SEQ ID NO: 16567 - DNA, 1795 bp, Heterodera glycines
  misc_feature (216)..(216): n is a, c, g, or t
ccccccccccccgtaaaaaataaacgcaccaaatccgcctttattgtagtagctgactgcggcattatacggtgccaaaattggccaaagaatggtgtatttgatggcataccaagcagcccgagtggtcagatagcggaaggcgtaataaactgaaattaaaaacggaaatcaatgtcaataggtgtactattttttccgtttatcttcccattntacaaccatttgtgggttaattaaagttgaatccaaattaataaatgccttgtgaaacatagtgcaaggagttgatattttttgtataaaattttgttggcaccgtctcaaaaatggttcggcgtgaaaagaaattctctgctatacaaaatttttaaaatcaaagaaaaattaattaaatcgtgaaatcaaaaaaaaagagtcggacttaattcagaaacaaaaacatacctcgcactaacgcgtattgaacaacggtgtaggcaaaaattgcaaaaaactgcactgcataaaagaacagttgagtccatgtccattgatcaggacgacgccttaaaatgcattttccaacggaattgatgttacaaaaattacatattataaaattgaatttttggttgaaaaccggagtttaaatcattatttaccaataattttgccatgtgcccgttgggtatgtcaagaatggtggcgatgccgagcgtggtatttgggttgctggaaaacgacgacaaagccgaggatgcacgtagtcatgagagccaatgtgcggcttgtaggcggctgagtcggaataggtgtacctcgtctcatagggactaaaaaaactcgaaattaattttacgaatttttttgaaaattttttgtcagttaagttgctttttatggttgaaaaaaaaactaaaaccgacaattaaaaaatttaggattgggacagcatcattaacccttgaaaaacactcgttttttgtacgtatttttgccgggaacggaaatggtcgaaattctatctaaattgcaacgaccagaaaatatggatgaatgattcagtgaggttcaattctaccgggaaatgtttttttcttttatattttcttggtaattgctacatccaaaaccccataatttttgtattattttttttactacgaatacctgtcaagaatttcatcaatttcttcctttgagagtcgggatgaagttgatgctgaagagccggcacgaagcatgggcgtcggtgtccttgaatctgacggacccggcgaaaaactccttgaaatacagaattatatttatatgaaaaaaccgggttattctttaaaatatactaattgtaagtttgttctaacatttgaaaccatttttttttgctcaaataatgcttgaaagattgaaaaaagaagtaataaaatttcgagtatgtaaaaaaatggaaacctaataggctctaaaaaacgtgttgtagaaaactttttatagttaattcaaaggcttacattcgtttctgatgcatcaattcgaaaaccaccgctgtttgtatgtatgtagagaggtagagagatgaattgaagaaatataaaatgcaaaagctaaaattcgaaatttttcatcctaatgaaaattacatataaatagcgcagatttaaaaaaaaaagaaataataaaattcaaaattggtaaaaaaaaacatgctttatttttttaaaagggcatgcatttgaacttaaaatgaatgtatttagaagtaaacacaaaaaccaattttaagacatcaatgttcaaggatgatgatgaaatc

SEQ ID NO: 16568 - DNA, 1671 bp, Heterodera glycines
cttaattcttaaacattaatggttggacctgtcgggctctttgaacaagaaatagggcaatccaaaagaacggaggtccctaatttattttattttttaggctcaaaaccagttttcagtggttttcgagagtgcttgttacgaatatgaacttggctttgcccaactcagaatcccgaatccgaattaagtcaaaacttcaaattttcgaatttcgctcttcattctaaaattgattaaaaaaaactagcaaaaaatcagtcacaggccattgttacagcaaaaataagccattcattatattcatatttgaatttaaaggtaaaactcaaaaaatttgaattttcgacttttttcgagttcgggttaggggtagaaaatagtctgcaaattcaatcacggccagccctgctttatattccgatttttataaaatttttattcaaaacgaataataaaattaacaaatattttccgaaaattttaattttcaattgatgtgatgtgaattagttcttgcggaccaaatccaatctcatccaaggtcgagaagcgattctttaaaaataaatgattttatgaatgaacttttaataccaccttaagcaagaaaaataattatacagagttttatggaacgcaaatattcataaaccgagttaattaactatcaatatgggttaattcatggaaaattgccaaaattgatttatttcttcgatttttgtaaatctcttataaaatcctttctttaaaaaatcagatttctaaattcacttactatatttttgcaaaaaaatgtcatattaaataggaattaattagccacttgtgggcagagaacaaattctcgtcttggatagtccaacaccaattggtaattgtttgacgaataattatgccctttagcaaggagcattgagaagacggccttaattaaaagaaaaattgttaaaaattaattaaatcaatttttgttttagatttttaaaattgatattttgacattctcactaaatataataataagcaaatttatttatttacagtattttaatcaaaattcattcttttgatcatttttttataattttgcttgtaattttttaattatattttctgtggaaatttgaaaaaataatttttacattcaatggcgctgctttccacattcggatgcgctccatttgtccatttggcaatcgaagtgacaattgaaccgtttttgggcatggccgaattgataaatccgcctcattcaccgtccattttgaccattcatcagagctaatgagctgtgctggagtccaacaaccactgctgctgctgctggacacttaaaatttaaatgtgctaattaaaattaattaccctaaatttgatttgccaaatccatcagaactggaaaatttcagggtgccatgccattaccatgaaaaaactttatccgatttttggtgttttaaaatgcgtcatccggttttcttatccccaaaataataataaatttttaaaatggtgcaaaaaaatttaacaaattttttatttcataattcgtactcatgtcattatattgttcgcggttattaattcgcttctgctgctgctgtcttttgtcatctgtcagctaaaaagaattgattttgaatttaaaaaattaacattttttca

SEQ ID NO: 16569 - DNA, 2438 bp, Heterodera glycines
tttgttttttcggaattttaacggaatttgtaggccctaattccgtaggtcttccagaattttttcttgctgcttccgtcgttccaattgtttcctcgacggactaatcaatttctgttgtgtctgatcacttttttctgccattgctttcaaaatgaattccttcgattgactttcggctttatattctcttttttcatgaataatttcatcattttctggcgaactgatgcaattcggtcgtaaaaatacggtcaaaatggcttccagaaagcgattacgataaacggacggatgtttgaccgagtttggcttctaaacatcatttaagttaaaaagaatttcaaaaataaattatttatttattaataaaaagatacttaatttttaatattaaaaatatagctatattttttaaaaattacaataaaaattttttgtttccttaattaagataatttaagtaaatctaaattaatatttttataataaataatttttacatatttttgccgtgtttctggaggaaaaagaaagccatctttctaaattcaaaaatataaacattttttgccgacattttgtcattttcggccaattttcatacctttctaaaaatggacatcgaagatttgtatatatcttcgagttctcggggataatcatatgtttgcaaagtgtcgattatgccaatgctaattaacagcttttggtcattttcgtacacattacgaaacggatttttgcaattgttacatttgccatggaacacgccaaatggcctaaaaaataaacaatatgtagtaatattttgaaaaagtttttcggtttttaaaatagaacttatttaataaattattttttaattggaaatttaattgaaaattatccaaaactagaagaataattaaaaaattatctataattactacacttacagctcatcaagccattcatccggtaatttttgttttccaacaaaatgcacagccatcaataaactgtagtccataatattgtgtgcttttaaaaactgaaatttaaattactaaatttgaattttataataatcaaattcaataattaaaaaccaaatctctcttttagttttattgtaaatttttttagaatttaacttcttataaaaaataccccacccccctttcttacccatgtgtcatcctccaaaagttgtaccaattcttcatgcttttccctgccaatgcaaatgccgtgccgaaacagtccctccgccattgtaccatttttgtcctcgctgttgaagcggaaaaagtccaaatcgcggcatgttttgtgctgtgcttcgtcactggtgccaaattttaattccttccgatttattgaagcgcctttcagatcaaatttgtagtgaatttttggaaagttttgcgggaaaacgctgtttatcattataaaattttgatgttccttgcttttagagtgcttgaaaaagagaatgattaaaattattaaaataaatatgaggtaattataaaacataggaatgataattattagaattgtatgaacttttgaaataaatcatttaatttaataaagacaaccttcagatcaaataatgcaaaatatttgggcaaaagtgtgcgtttgccattgatcaattggtcacgaaaatattcataatagtcccaaattccgccaacaaaaaaatttatttgttctttctgtttgcctctaaatttttgtttttcggcccaataaatatttaaatcttaatagcaattttcaaaatagttcagaaaatgggcaccgaaaattatacaaaaaaaaattgctaaaggtaaaattagtaatttaaaaaaatacattctatctgtaaatgtgtggaagaatttaatttcattttgatcagccgatttgatgaagaattgggcgtcattagtgcgtaaaaagctggcaccactttgtgccggatttggcatcaatttaagcggcttttccgctatcgaacggatcagatcttcactggtgatcacgggtggatggtcaaatacggcacgtaacgctgtgaacatatagggggcacagaaccgtaatttaaatgtgcccatgtcactaaaatttggaatatatgtatttattattattatttattctttttatcttcttttatcaattggttttgagagcatctaggtacttcggctgtttgttgattaagcttactcacgagtgtccaaaaattttttgaaaccataattttgctcgttgtcaggtcaatcaaattaagcaaaaaattcaaattttctaggttcattgtgtttttgagtgctttcgaacaatacgaataatatttgatttggatgagaaagaaaaaagtcctgctacgatgaggtgtttaagttgggagcccctgccctcaagggcacaggcagggggggcggctgatttgtgag

SEQ ID NO: 16570 - DNA, 834 bp, Heterodera glycines
  misc_feature (151)..(151): n is a, c, g, or t
ttcttttatcgactaaaaccaaactcgatcagctgtttagtgatcagactcgtattcttccccctcccaaaaaaatcacctcccgacgatctcttccactctcgaatcgatcaacatattatggaagtgccttattcttttctttgtctanttcctcctcattatcatttttaccagtttcaaaactttcatccaattcactgattgtttccaattttttgtttttgttgttattatttttgtcgtcaaattttatgtcaaaagcacttggaaaagtctggccataaaaataaaaaatggcaaaaggcatttctaaggccaatctgtgccgcaacagcaagcagactctgtgctttaattgactgaaaaaaaataatattaataaatttacattcttataagcaaggtttgccggatttgggcaaaaatcgggtccgggtagtgcagagccagaaaagccgggtaacggacccaaccgggtcatgaaaaatccaatatttatttcttcaaattaatctttttatgaaataaagcttaaaccctaaaaatactataaaaatattgtcataaaaatttatatttcacaaatatacgctttattcttttgtcataaacttattttatttaaaaatgtttgagacttctttatgataaaaatacagttgtagaaaaatcattaaaaaaggctcccggacaatccgtcagtggtaatccgtcagtggtaaatccgtcagtggacaatccgtcagtaactaatccataagcaaatttatttttaaaacacccagacttttttaaaatcatgtgaaaattaatttaagtcgctaaaaatgt

SEQ ID NO: 16571 - DNA, 683 bp, Heterodera glycines
aagaaattgctatgcgtggcattggtgccgcgatattatcgaatattttagtttttttcgaataacgacaaattttaaatcaaacatttttatgaaaataaataaataaattgtggagacgaattttttgagaaaattatttgcctaaaaaagaagctctactggtttggcttaactttgttgtctttttgaataaattttgtcatttacaccagggacgggctttcgctttcgcatatttcgctttttttgttactttcgcttttgctttcgcattttggcgagaaacacgaatattattcgatacgcaaacgaaatacgaaacgaaaataaaatttttgttatcatttgaaagtttaatctattttggagctttttctaaaatattatcaattaaattggttatgccaacgatttgtctgaccattaaaaaaatgtaatgaaatggaggaatgatttagcaaatgatttgtttggtcactcatttgctttcctaagctgcaactgagcaccaaatgcgaatcaaatggcactgaaaaatgactgcgaaaattggatgaaattcaaaatgtaaaatgaaaagattttaagcataaaaaatcggaaaaaaacaaatttttttatttaatttaaaaagggcgttgtgatggatttcttctattgccctaaggcacaaacaaaaa

SEQ ID NO: 16572 - DNA, 2427 bp, Heterodera glycines
taaaaattccattaaaaatgcaacaaaatcgtgaaaatatattcgtggatgagagaatcagaatcttacctagcatatgaattcctacgtattatcatcgtgccctgcatgtgagctacgcaggaattctgattctctgacccaagaaatagaaaagtcactgctctgaattgttaagggagcagatgcacattttatataaattttattacctaccataataaaaaatttattttagattacttagtttgcgaaatgtcaatttttgggtgtgttggtgaaatgtccgaatttggattagccggcgaaatgtccatacacacctttctcattgtaattttttgccatactgttaaacgaaaaaaaattttgaccataaaaaatttagaaaacttcaactataacacgattaaaccatgtgttatgacttttgttttaaaaaaaataatggaattttgtgaatttgtttttaagtttcgaataaatttagctaggcctgatattagtgctgacaaatggttgctgagcacgaagttttgagccgctttaatctcgaaaatttttgtaaatcagcaagtcgagaaaaggaattgaaaaaagtgaaatgaagttgacaaatttgtaaacgattggtcccccatacacagaattttgttttctttgtgtgatcattgattgatcagaatcagagcaacgacggcggtgagcccggacgatcgggcacttggccattttcgatctaaatttaatgaggtgaaattatcacattgaactgaatgttttaagcaaaattggtgcgtgaaacacaaaacaatttccttattaagctcgggcggaagtcgtatttcgatagctatgaaactttttaggcagcgcccaaaacgctaacgcacgcgaatcgccaatttttttttcttgcatcatttttcctcgtcattcttgtcttgctccctaaaatttatttccaagagccaaccttaattccattcatcaaaagcaattttttggttatttaattttttttttttttgtaaggcccaatcatcgcccctcccctccactggtgatgagaaaactttctgaggttgtgatgaggataatggtgatgatacacccaccacctgttgtaccaccaactgcttacagcaacaccaacaacacaacacatcatcacaaccaccaactcattcggcggcggggggggggggggggcattttgagtcacacacaaaaaaattttctgccctccggcgatcgccgagtgatttttccacttcttcaccttctgctggcgcctggcttaataatcataaaaaataattattgcgcagattcgttgtcttcgtcgcctcacagatcagccagcaccagcagcagaagggagcaacaagcaacaagttgaagccataataagtgaatgggtgggcaaatgattggtgaaaattatgtgacgaaaaaaaagttgggtggtcgtagttgatgaggtggcggcgcacacacacacaataatcaagttgaaggtgctgccatagtaatttgtattagggccttagccatcggggtgggaattgatcaattgatcgcaggagccggagggcgaaccaatttttctttagaattttacaaattttgcaagtatatttaatttttttttaaatattgatagcatgtttgataaaattttacagctgtgaaatttctcatggtgcatggttcatttaatttttctaattttttttttaccattggcatcggttttttggggaacgtggaattaataaaatgaaataattactcaaatttattattgcaattatttgtatatttttgactatcggtgcataatcattttggaataatttagatgaaaaactatctcttcatggagaattcataaataaatgatggaatttactccaaaaatccaaagttcacaaatgccattcgatacaaatatttaaattaatcagtcttaattgcccttgatatatgagcatgattctgatcaagtccaaagcttcgccggttcacaatcagctgatccaactggtatttgcctctcttttaggttcgtttaaataccaattttcattttttttcaatttaatatttaaaaattcaatttattaaagtgcttctcaaaatgccaatgccatatgctgagaaaacgttgtgtgagcgtcggttggccacccttccatcggcgccgggccttttctattaccaacgcattgaactgaacagtgcggcaccgtgcgcagaacgctgcgtggacgactgggaattttgtcgcagtgccgtcctaattgaggacattcgggtttggcacacattattggcattctgatttttgaattatttcaaattaatgaaaagagtcccggttaagggatgattaaaaaaatagttaaaatattactaaaatag

SEQ ID NO: 16573 - DNA, 2924 bp, Heterodera glycines
agtttgtttttctcattataatgaaaatttaaaagtgtgaattggaaggttttcggtacttgataaaatacttgaacctgttgttttctggacaaaatgccacttttgttaaatcccctcaaaattccaatcctatgcttttatgggttgttctaacagtaatgttgtgcattgtcattttcgtcttgattttttaaatttttttcgctgaaggattgctcaaatttggccgaattgacggagtctgaccttgtcgcgctgctctctcaattccccattcgttctctgctcgacgttgcttttaagcacttcacacttttgcaccgtaacaatttgaaaatatacaaatgaaatagaaataactcttttcccttttccgatggtcatcgcctgtctacgctttattccctggtcgcatttgtgctcattttgttgaaactgttcgacgatggtcttcaaacgtacggggcacacaaaaatttctgcaagaaaattacggacaacatcaggttggttgtatgaaggatttgctgtaattttcttatacattaacgtgtttatagcaaaactgtgcattttttctgcacctattgggagttgatcagaaatgagttggctccatcggatcgctcattggtccaaaatgaaatcaaccgcattgttctgcaggctgttttttacatcgtatcaaagaaaaggtgctttaaatttttaagtaatcccatttttatttcaaaaaggaattgttccatttttttctaaaccaaatttcagtgccggcattcgccaatttcttgtcgattttccgttcgaaacggtcagcgagtgttgccgactgagatgccaacttttgttgaggagtccgccaaatcggcaaattccaacggtgaccgcactgtacgtaatcccagcgtctgagcttgttcaacgcgttaaaaacagtaaacaaatttttatgcgattttaatacaaatcacattttagccgggaatttcatggacaatattggcggtgtgtgtcgcgagagtgacgagttgacgtacaccgtgtccacgctggcggccattgtgtcccgttctgagttggaattgcagcattttgtcgtcgagttcatcgacatttgttttctcaacgagaatttacgtgaaaagttctataaggtaggggaaccaagcatttgttagttttcacatttgaatctttcatttacaaaaaaatgattggcattaggtgggctccgaggccatggctgttctaattgagcgcaacccgcctctgttgggcgccgtcctgcgttacattgaccgccatgttgaccaccttgacgagtacgctgtcaacattctgtcaacagtgccgttaggcttttgcactgtctccgccgaagacatcagcgaccgcttgggcaagtggctgatcagccgatccattgaccatccggcatccgccattgcgcggtgagaaagttgtggctgctcatcatagcctaaaaactattcagaagagttctgtcctctttgaactgggactgtcaatcgcctcaaccggcatcgttgcacaaatcctcagttacatccgtgggtagccaacctcaatcaaatcggctttgtctttccgttgaaatacatgacctttgcgcagaaacgcttgtgaaggtggtgttattgtcgtttgagacaattggattgatatttttggacgatatttaaggctcacattgtccaatgcaaacagagaaacaatttgattgccaagtcggtgaacaaagcggcacgaatggcactgaaatgtcccgacttggagcaacagttcgaccgcttctgctgggacgtgttgttgaggctaaaaatttcggaaaaggtcgacagcgtcatctcccttcttcaattttgtattactttttgaactttgttccaaaatttcagccaaattgtccgactccgccaaatgatctcaccgccttttacgtgttctgtgtccaaaagtgtctttcatcgtgcgttttaaattgaaacagttcaaaaagttgttcaatttcctcttttttaagttccaatctcttcttcgaagcgggtcttccccttttccaagagttagtcaacgcttcgtgcttcaaggcggccgccgtacttttgattcgaattgtacatgccttccccagcagcaaccacatgcagaatttcatcgcaaatcccacgtaaaaatgaattttttttttaacttttccattttcgaaataatttgtcatacgttgctttttccgattttgaattatgcacaatttaaaattttttttagattctgtgaggtttttgaacgacttctccacgcggacgaatcggcgtacgctgttcagctgttaatgggagctgacaaatttcctggtccggtgctcagtctggtgtccggcggaatcattgtggagaaacaaaattccaattcaattcccaaatttttttttcagcaccaaatttccatcgacgccttccattttgagcagcgtaaagtgtacgcgcaggcctgggttcgcctgttgacatgcgacaaacgaacgcacgagtggaactcggacaaattcgtgctgtacttgcttggctgtgtcgcaaagtgttgccacctcttcgacccgcaggacaattttgggatggtggagcttttgcgggacctttacaaggccggttaacaccggggaaacacagattaaaattctgtttttcaggcccgacaccaggcctggagggacaccgttcgaggccccctctcctggttctcctcctcgtccatccctcctcctctgatcgctcaagcccaattcaccgtctctccatgggccacgttcatgttgttgcgtgccgagcaggaagtgtttgccctctttcacttcagtcttagtggcttcgtggcaaagcatccgagccgaagca

SEQ ID NO: 16574 - DNA, 4362 bp, Heterodera glycines
  misc_feature (4247)..(4247): n is a, c, g, or t
  misc_feature (4330)..(4330): n is a, c, g, or t
ttgaaattgttcaaaaattcattaaaatgacaaatgaatttaagcaaaaaagaaaatattcaacaaaagaatggcaacaaaattatgccgaaatttgtaagaaaattggagttggctatgaaacaattaaaaaatggaagaaacaatttggcattagcagtaaacgaataacgaagaatgaaaaaatggaaaaaatgaatatttattggcaaacaaaaatagaaaatccgaaaatgagtgagaaagaaattgcaaagatgttgaaaattgatagaaatagtataagtaattggaagaaacaagttgagatggaataatggacgattattaattcggaaaaattaaaaaaaattttaataggcctatttccgataaagttactcacattttacaatttatatatgtcgatttgttagaaggttataataaaataatatttagcgccatttttttaattatatttattatgaataattataatttttaattttttgaaattgatatttttattttttcgataattcaaaaacaaaagattataaaaacatggacaacaaaagcaaaaaaaaaaatttttaatttcataatttttgtcataatgtcacttttatgagaattttttaatccaggaaaaatcgtaccaatttatataaaaatttattaatatttaatttttgcaaaaatacgataatttaaaaaaaataaacttaataacaaattcgatggatttaagaaaattaaatttattgaggtttttttggccataacttttttgtttctgagataaattttttgaaattttgaagacgaataggcactgtcaaacgctttaaaaatcctgccaagtttatttaattcgtatgacaaataaaaatgtgtatagcatttggcgccaaatcgatgcgcaatccgcgattctcggcatttttttccgcgatccgcgatccgcggaatttttgaatccgtggcaatttggatatttaaaaagaaaaattttttgaagcgattgtttcatatataaaataatttaaaagtaagtttttgtaaatgaaaaagcaagagatttgattatttttttcgaaaattcctttcaaaataagatatattcattcatttgtctagacaattatcctaaaaagagtgagcggaatttccgagcttgcgacggcttatgaaaaagtatcatagtgcgccgccgggaagtgttgagtcggaacgactattcagctgcgcaggatttatttttaatgatcttcgaaagaacctatcgcatgaaaatctcgaaaagcttatttttcttcatcataatcttatcctttacaattttgattattgattaaatggaaatttttttgaattatctggaactccttgcaattccccccccccccccattcagtcttcccaaatttgtatgcatcggaattttaattaattttttatataagaaaaaataaaaaaaagtgtaaaaaatggtttaaaaataggaaaaaaatgcgcgaccgcgatctgcgattcgcagtcatttttttgcgcgatccacgatccgcgaccgcggcaaattgaatccgcgatgcgcgaccgcgggatttttctgtgcgcgctccacccctgatgtagactctttcagaaaagaatttaatatttaaagcaaaaaatatttgtcgtttggatattttatttaatattgcaataatttttttttaaatttcattaaaatagtatctatttcattcaaatattcatttattaattattacctataattatgaattagtatcaattaattcaaaataaacatttggaaccatgaaaaataaataatttataattatggaaaaaaatttatgttaaaaattcattggttatttatttcttattaaaaattaatagaaaaactagcttaatcaaaaatattatttatatttccaattaagcaatattttttattttacaggaaatcaattgaaaggcgattttaacatcaataaatagccaaaataataatcaaaaattatattttacaagaaaaaataaaatttattatttttttaatttgtgaagaagatgaaattccgcctattataccttacaattttattttttgtgattgaaatcaatcaaattaaaatagaaaataaaaaactaccgcaaaaatcatttgatgaaatatttggagaaaaatgggaagaaaaagaaggaaaacaacgaaatgaactcaaaaaacgagaaataattagaacattcaacaaaataaaagagaaaataaaggaaaaaggaagaaaatatccaagaaaagaatggaataaaattgatcagaaaatagcgaaaaaattggggacaaatcgcaattacattcaaaaatggatcaaagaattggggcttaatcaaaaaagacacaaaagtcacaaatcaaaaactgatgaagaaaaacgtcaaattattcaaaaatttattgaaatgaaaaatgaatttaagcaaaaaagaaattattcaagaaaagaatggcgccaaaattatgccgaaatttgtaagaaaattggagttggctatgacacaattagtaaatggaagaaacaatttggcattagctgtaaaataacggagaaagaaaaaatggaaaaaatgaaaaaatattggaaaataaaaagtgaaaatccaaaaatgagtgacaaagaaattgctaaaatattgcaaattgatagaaggaccatttcaaaatggaagaaacagtttggaggagagattttggaggatttaaatggatgattataaaaaaaattggataaattttcaaacaagaaaattatttacgacataaaaactgattaattcttatattttatagaaccattgtcaaaataactggcataaaatccgtttatttttctcaattggatacgctgaatttgcttctattgtaaataattttttcttagtaacgaaccatcattgttatgatttccgaccagggctgcacgcaattacggattgcggatttcgggaaattacggggtttttggacccccgtaattacggattacggatttccgtaactgagaaattcgccgcaattacggattacggatttccgtaattgcaaacccactgtccatataataaatctatctacaaattatttagaaaaaaaatatataaaaaattttgaataaaataaaaagcatattttttacggcggattttcttgtgaattaataaacattttataattaaattttaaaatcattcaccagtgcctccttgtaaataatcgtaaccggagctttggtcttaaaattttataaatcctcattgaaacgcagaaaatcttcaaaaaatgtatggacacgctaaagtacataaagcatgcccaaaataatatttaagttttatgataattagggcccggatttatatggacaaaaaaacccaaaatatagattataatatggatgaaaaaatcgcaaaatatggacgaaatatgaacaaaaacgcagaaatgttgacaaaaaacacgaaaatatggacaaaaaaatctctgaaaatttgtttgaatttagaaaaaaaatcataaacccataaattttttgtcagtaaagaaaaaaccatttttaatgaattacagaattccacaattgggaactcctggttatcatttactgaaaaatattgaagttggaaaaaattcaaaaattagtaattttttctaagaaatcatattaagcgaatgttgctaatgaaattttttgcacaatttttgatatttaatcaaaaaattttcgattttagggacgtgttttccaaaaatttccaataattttccatctttagggttagattttggaatttttagtgaaaatgcccaaatatggatgtcaaatatggaaatattgacaaaaacttgaaatatggaaaaaaatggaaataaaaagggatcctagaagcaccaaaccaagataaaaatactatttacgtaatttttaggccgtaataagtgtgcaaaaaaatatgtaaatccataaaaatccgggtcctcccggacttttcgatagctaaggacatttcgaagcaaaggactttatttatttattccaaaaaacgtttattaaataccgttttaaaaacggagcataattaggccattttgctggcaataatcacttaagagacttttgtgacatttttaatattgtagcatatttatttgttaattgttttgtcgaaatttttaagttttcatttcttanatcatgttaatattgtaaatttgggattgctaatttgccccgaattcactatttattttcataatcacaattaatttaagaanatatttgtcaaaaaatcaaaaatcatttaatt

SEQ ID NO: 16575 - DNA, 1357 bp, Heterodera glycines
  misc_feature (1169)..(1169): n is a, c, g, or t
  misc_feature (1188)..(1188): n is a, c, g, or t
  misc_feature (1310)..(1311): n is a, c, g, or t
tcatatcagcactattaccgctctttctttaccttacgcaatattgagaattcgccgggcgtcgactccgacctccgaacaagaaaggccccgtctgggttgccatttttcaagaggaggagctaaatggaaaaggctactatttttaatcaagattctcgagcagtacgaaattgggcaaaaacggaaatatttagtgattttaggtttggcaacgtgatgtcatccggtcattcataagtcaaaaacacagtttttcccaattttttgattttagtgttgaaatcaaccacttcaatcgacattaaaagtcctggtgtgaacctttaaggttaaaatttcaaaaacaatggaaaagtccttgattgttttaataacaaagtaagaaattgtcgatatttgttcgagtcagagattcaaagttggcgaaatggatgtcagaattgtgattcgcgaccagaaaatcttcccaatttgttgttaattataaataaaaatttttgctaaccaaaagagtcccctatgatttttaagaaacttcaaaaattcacatttaaaggagagcccttactttcttcatgactagcatttattgctcattacctccgaatcacttctcgaaatgctgccgagataccaagagtgttccatcattcgaatataatttgaagggattaatccctcaactccgttaatttccgctttgtaccaatgcgggtcctcgtctttgttgagaacctgaatttggctttgtttagattagcgaccttaacagaaattttttcatgccaactaaaatatatttaccttcaaaatttgacctctcttaaagctcagctcgtcaggctcaccagcgttaaaatcgtgttcagcaacagcctccatgccaaattgagaaagtgaaacggacacaagaataaatgagcaacaatgaaaatgttttggaaaataattctattgatatacctaaaaggcagattaaggaattcaatgatgcaattgcaagtgcatcaagcgattccgagaaaaagctcatacgatttggtaataatgcatggacggtaaaaaaaagaaaaaattgctaaataattggcacaaaaacaaaataccaattcattcaaaaagaatgcaaagtctctttatttgatcaaattcctaatccgagctcnaagctttaattccacttcnaataagtaaatcgtgtgtttttagagataataaataagaaatgatatttataaaatttacgaaaatttcaaattggtaggcatcttaaatttttttcatattttaattttcaaaattcatannacaaaaatggatgaaaatgccaaatctttgattttactttaacatt

SEQ ID NO: 16576 - DNA, 1876 bp, Heterodera glycines
  misc_feature (142)..(142): n is a, c, g, or t
attttcatgaaaaattttaaagattttgtttgatttttcatgactggactcggttaaaaactaggactctgacccggctttctgtacccggcaataccctgacccggtatttgcccaaatacccaggcccgtagcgctaatntaatatacgattttgaagttttttaaattaaaaaataaggctacagaaaaaaattgaaaaactctcgcctctcgccaactctcgtgtttttggggactctcgccaaactcgcgctctcgtctttttggggactctcgcctctcgccaaactctcgctctcgtctttttggggactctcgcctctagccaaactctcgctctcgtcttttctgagacaagtcacacccctggtactcagtcgtaccagtctttttcagtaccagtcccggtcccgtgcaactctaatcagacacagcatttgttttgaccaattaggcgatttcggcctttatttgttcgagtccatccattccaagttctatgctccctcacctgaacatctctgcacacccacccatggttatcaaagtgccgtcctgcttaagcacaagaaaattaaggattttagggtctggcggtgccgataggcgcagctgggaaatttttgaaaatttcagtgcaatttattaacaaaaattgtacaaatcctaaatttttggaaaaaaaaaattccgactttttatcaaaaatttcggaaatcggaattccgtgccatccctgacacacatgttggttgtacacatcaaaccaatgctttagcaacattaacaaaaaagatatggaaatttaaaatttcgaaaaatctttgaatccggattcggggttaggagtagagcgccagtaggccattgcttctgatgctgacgaatactaaaatgaagagtcaatgaattttggggtaatagtgcaatttgtcccccccccctccttttttcgaaaattttttgtgttttcaaaagtcataaaaaacactttttatggggttttcggggttgctgatcatgaattctgcacccatttcgaccaattacggtcctcggacccgaattcgaacaaaaagtcgaaaattcaaattttacgattttctatttttagtctaaaaatgggttcaatattttttttgaagcaatgatatatttcagtttttcattatataaaattttatataaatgactaaaatttagtaactttaaaaacctttgtgcttaaaaatttatatgttcttgaaaattaaaaaatttatgtatggaaacctggcaatcttatatggttgtttaaacgagatttaaacgtctactagtttctgtttggacttagacctgaataccggcttagttggcaatttcggcctttatttgttcgagtccaccccttttcagtattgctccctcacctgaacatctgcttgtccagccatggttatcaaagtgccgtcctccttaagcacaaccaatgtcggaatgactccccaattaatgatgttaaacctcgcggccaatgagctgaaatccaagtcagattcatgatcagcacccttccccagcaaactggtttagagccaattatagagtatcgaaattttccatcattgtcaacgaagctagttgcccgctttttgggatgctatgtcaaacgacgaaaagtgctaatttgggcgaccgaccaacttttattaaatttttcaaaagttcaagccaaaaactggaaaatttcatacttttgaagacccattaaaccccttgaaactaattggccctctaaataatactaggtcgttgcataaaaaagggcgctttttcaaaatgactttttttaagacttgattaacgtttgttatgtcttttttgtgtgtaa

SEQ ID NO: 16577 - DNA, 3431 bp, Heterodera glycines
  misc_feature (48)..(48): n is a, c, g, or t
tttatggatataattggagaaataaatgtgcatgcaaaaaaagttttntggtcaacaattatatgagtaaggatttgaaattatttttggcaaaataatttttgatctatttaaatttatttgttaaatacataaaaataaattaattcacaaaaagaaaagaatatgctttttgtctgtccaatttgtttttacatttttagaataaaatctgttcagccaaataatactcaagttgacgccgaaacatttgaaagcaagaaattaaaagtgctttatttttacatgcaattattttgaaaattaattggtcaattggaaactccgtataataaaaattacatcataaatgacaaagtaaaaactgaagtattaaaattttattattatttgtttaatttattaagatttatcaatgccaaacagcagaaagacgattcattgtgttatggatccacaaagcaaaattgcacaattcgtttttatgcaggaatatagggcatcgccgtgtgcagcggcacagggagagagtccatcccaaaagtttttgggaagagagatacggacagtgctggacacaataaaaatgtcaactaatgcccttgggcgaaaacagcgtctgttgccggaggaaagccgaggccacccgcgaccacaaaactttgagcccggtgatactatttggttcagtgaaccaaatggaaaatgggcaccaggggtgttgcttcagccaatgggcgaacgaatgtggcaattggaattggaggggagtacttcggcaaggaccgcccatttggaccaaataaaaagccgaagaatcggcccaacgcgccacatttgaggagacttgcttaatgctttgtacataaccccctctgcgtttaaaaaaaaaacaaaaaaaaattaaattaaaaaaaaaaatatgtattttacattacccatttattttagtgtatcacttagtccaaatgcatgagtttagaaaaagttgaaaacaaaaatttgtcttctaatgcaatctgaaaacgtgccacctaaaccactccaaaatgaggcagaaaaattggagaaacagttgctgaaggcgaaagaaaagaagcgaagtgaagagaagatcacggaagcggttggcaaaatgatggatgagctcaagagctcgatcaaagaagagatcaaagtcgctgcggaggatttgtgggccaaaaccgagcctttgctgaaggagcaaaagcgagtgactgcagcaatggtcgaatctctggacgaattcatggctggaaaaaatggaattgacgaagaggaaggcacgtgtccggcaccagcaagtgatcagcggtcggaaggcacagtggagaaaagctcatcggtggaagatggagagcctgcccaggctttgcccccacagaacccaggccaagggccaaaagagcaaattaatcgggcgcctctgggaaagagaggcaggggctatgccatgggagggcatggccctagaggacaatggaagaatggaggccagaaaacccaaaagcgcgtgggctatctggtccgtcagctggagcgcgaatgaacgacgagacgtctcgaaggaggagagggattgcggtgtctgcatttcggtcttttttatttttgtttttggcatttttgcattgacccattttccaccaattctcatcgtaaacattttatccatccacatctctcaatccttaccaaatccttctctcaaaaaaattctctctccgctttgtgtaatgtggcctagaccattctcacccgcttggcttcgcttgactcctcccaaaattgtgccgtatttaagctctctttctgctttggatttcacccttcttactgccattctcccttcctacttactctccctttgcttactcttaaccaattttgctataaccaattttgcttattcttactcttaaacgattttgctttgctttaataactgttttgctttaataaaacctcaaaaaaaaagtcgaggaaaaaaagagattgaattgggtcaaatttggaaaggttgtcagaactgagaaaagtgcgtttgcctgaaactcgtggggacacaacaatttttggtgccacgacccgggaagaggagaagcacgggttaaaccaggcgctgaacaaaattcagcaggggtaaaggctcggtgccattaccaaaacaatctctgtgagctggtctagttgtgtactaccagccgggctgttgtgcaaaatacaaaaaataaattttgagctggtcaagtgtgttttccagccgagctgttgtgctaatttttaattttcaaaaaaaaaccaaaaagtgaatcaaaatgagcaatcaaaattgttctaattcacaaagtggagaaaatgaaattggctccgattttgacccagttttcttcaccgctgaagaaaatggaaattttgcaaatattctaaaccgaatgagactttttgagtcggctgtttgccggcaatttcggagattggaatacgagttagcggagataaacgggatgttccaaaaatcgaatgagaacttacgtggtggaaaattggaacaatcaatggctgatttggaagaccgtgaagaattggaccattttcagatggaggaaaaggtcataaaaattgagggaagaatagatacggtcggtttaagtctgaaaagtcttgagaagtttacgaaagtcagatttaacaaaataattgagaaaatgaaaagtgaaatggcgaaaatgacagaagacattgatattttgcgaaagcgagttgaatttctggaaatggaggaagtgtcagacgaaaacctatgggctgagaatggacattcctttgagcatgagcaatttcttaatgaggacccaccaaattccggagaaaactgtgaaataatgatctctgacccatttcttggtggaattgccccgttggaaagttatgacggaaacccgagtatttcattttcgaggtggtcctcaaaattcgaagacatgctttcgctctatccacagcttactgaggcgcagaaattaagtcgtttaagaattcttttgattggacaagcccgcgccgagttggaatcgatggaaccgcaaccggaaaacttagctagtgcattaaattatttaagacaaaaatttgaaaatgagaatacacgctcaattgcccgtcaggcactctcaatctgtaaacaagcgccggtagagcgagtttacgagtccgccaatcgattaaatgaggcaataaggactgcactggccggagagggtgaagacgtgataaggaaaagacttgaagaatttgtggaaagattaacccccgacctacaatttgaagttaaagctggaaggccaactaattattcaagtgcatatgagctagcacagcattttgagctgattttaagttcaaggcga

SEQ ID NO: 16578 - DNA, 984 bp, Heterodera glycines
acgaagtgttcttacgagcccctcaaatttagaaatgggcgcgaagcgcccatcttagggcggtaagctgcctacaaccccttaataacttttcaaaaattcattgctttcattatgttaatacatgttacatgttacatgctcagagaggaaattcatgaactccctccgttttcatgtaacatgtaatgaagcgggcgcgaagcaccgaggccacgaagtgttcttacgagcaccacaaatttagaaatgggcgcgaagcgcccatcttagggcgtaaagctgcctacaaccccttaataacttttcaaaaattcattgctttcattatgttaatacatgttacatgttacatgctcagagaggaaattcatgaactccctccgttttcatgtaacatgtaacatattttgaagcgggcgcgaagcaccgaggccacgaagtgttcttacgagccccacaaatttagaaatgggcgcgaagcgcccatcttagggcgtaaacctgcctacaaccccttaataacatttcaaaaattcattgctttcattatgttaatacatgttacatgttacatgctcagagaggaaattcatgaactccctccgttttcatgtaacatattttgaagcgggtgcgaagcaccgaggccacgaagtgttcttacgagcaccacaaatttagaaatgggcgcgaagcgcccatcttagggcgtaaagctgcctacaaccccttaataacttttcaaaaattcattgctttcattatgttaatacatgttacatgttacatgctctgagaggaaattcatgagctccctccgttttcatgtaacatgtaacatattttgaagcgggcgcgaagcaccgaggccacgaagtgttcttacgagccccacaaatttagaaatgggcgcgaagcgcccatctttgggcgtaaagctgcctacaaccccttaataaactttcaaaaatcattgctttc

SEQ ID NO: 16579 - DNA, 981 bp, Heterodera glycines
tagggcgtaaagccgactacacccctttaataacttttcaaaaattcctttctttcacaatgttaacacatgggacatcttacatgctcagagaggaaattcatgaactccctccgttttcatgtaacatattttgaagcgggtgcgaagcaccgaggccacgaagtgttcttacgagcaccacaaatttagaaatgggcgcgaagcgcccatcttagggcggtaagctcctacaaccccttaataacttttcaaaaattcattgctttcattatgttaatacatgttacatgttacatgctcagagaggaaattcatgaactccctccgttcatgtaacatgtaacatattttgaagcgggcgcgaagcaccgaggccacgaagtgttcttacgagcccctcaaatttagaaatgggcgcgaagcgcccatcttagggcggtaagctccaacaaccccttaataacttttcaaaaattcattgctttcattatgttaatacatgttacatgttacatgctcagagaggaaattcatgaactccctccgttttcatgtaacatgaacatattttgaagcgggcgcgaagcaccgaggccacgaagtgttcttacgagccccacaaatttagaaatgggcgcgaagcgcccatcttagggcgtaaagctgcctacaaccccttaataacttttcaaaaattcattgctttcattatgttaatacatgttacatgttacatgctcagagaggaaattcatgaactccctccgttttcatgtaacatattttgaagcgggcgcgaagcaccgaggccacgaagtgttcttacgagccccacaaatttagaaatgggcgcgaagcgcccatcttaaggcgtaaacctgcctacaaccccttaataacatttcaaaaattctttgctttcattatgttattacatgttacatgtgacatgctcagagaggaaattcttgaactccc

SEQ ID NO: 16580 - DNA, 1485 bp, Heterodera glycines
ttgatccctgaattcgtcactttgattattccgaaccctgatgatcaaacgggagaggggtaaattcaaatttaaatttaatttaattaatattatttaattattaaacattttaagtggaatattgttttcctttttattgctgttttgcaaacattgagcgcagcaatttcgcacatttcgattatgaggaagaaataaaaaaagaccaaaaacgataaatatgtttgtctaattcaccgcaattatgtacataattaattaatttaaataaatttttaataaattataaatgattataaataggggtgatatttttaggcaaatgcctattttttcctgagctccccgtggcctgaaacgcacgaaaaaaatatgtttttttgggctgttgttaagctacttttcgagttattaatgcctattttctagtcttttatcccctatactaatttggtgctgtacgtacgtaagtttttaaaattgttaacaccaaagttcaaaaaccaataatactaatggtatatgattaactttaaaagtgccggatcgatggcagttgtgccagctctcaaaaattagattggtttaaaaatgcccgtcattgtgccaaaatggttgtcgttgtcgagagtggaatcagttcgggattcagaacagatttacgggaattagcagcaatccttgtgagctgcttgtgagttggcacacaccaaaatgccaaattggcactttctcaaggggataatcaattcatcccttacaagtggtaaaagaatgtcttaataatggcaccagtgagaccaggacgggaaaattgtttaattcaaattaccaattttctttggaaaatccacgcttattctctggcctcgttgaacttttttttagtcttttgcagcttttcctttttgttgcttttcatttcaaaatttctgttttgtgttttcaattttctgttgctgatgcaattttcttggaccaaaggccacaaaatgaaagtgcccatttttgtttttgcattttgcaaccaaagattatgaatattatgtgattttattgttgttatcctcggctgttcttatgtttctttatctttgaaaattggtggtgctttgttttgtaccccccggggggtcaaatcgacggaagaacgaacacatgacggaacgaccttcccgttcctgctgctaatgatgcaaccaactgaacaaattgcatttttccgtgatcagaaaatggatcagtgaatcagaacttcttgtaaaatgcgacatacggtagttttgaggatttgaattcatatgcctgcaatgtcaattatgaattgttactctttttctttacaaattcattatttgaactagaattaattgcacgagacccggaattctgagcagaatcaggtggggaattgccgggagtcgaaaagccgggacctgtaaatgatcgggaccgggaaccggacattacaaggaaacaaaa

SEQ ID NO: 16581 - DNA, 1061 bp, Heterodera glycines
gacatgtgattgagaagaaaaaataaatttattacaaaacaaggctcggttgaaatttaaaactattacgaatgaatgagagtatttttaaaatctcgtaaatggtaaaagccgaggctgatgctcgagagtctcggtcttaactcgagaaaagtctcgattttttggtctaggtctctctctcggacttttcagtctcggtctcgattttcaagaccgaaaaacgagattttttacatccctaatgattatcttttgataaacttaattcttcacattttggtattttttttatctttttgctttgttttttgctcccatatgagttgtccagtgggttgtgtgtgcttttggttgtgttccctatttttgccttggatctaatttttcaaaaattatctctttttcagtgggaaattaaataatttaaatattcgaatttgcattttttttttaacccggcgacgccctaaaaccccaatttttttcttaaatacatgttcaaaatcgcaaaatttttgtcactttttgctgaaaatctattaacaaaataagctcaaattttcaaaatttccccggcgacgcctaacggcacaaaaaaaagaaattggttaagaaaagactcgaaaataatttaaacgctttttaagtaaaaaagaaaatttttggaaaaattctcgggtctcggctttttcggtctcggtctcaggggttctcggccagaaaaagtgaaaattaaattagggccggcgagggacgggacccagccacggcgttttgttggatccagtccgcaatcccgtattttttttggaaatttttttttaataatttgggaccagagcgtttgggcccccgtttttgggccccggggtcgtttgggccccaacccaaaaatagaaaaatgtgcttttttaaaaattaagattctaaaaactaagcctgagggcggtgcaccccaaaacgtcgtcggccgaaacgtcgtcggaagactttttgaaccataactttgttcactgtaaagcaaattaagaattgttggtgttgttcgatagctctat

SEQ ID NO: 16582 - DNA, 1849 bp, Heterodera glycines
tgagaaaaatgggcgaaatggcttaaaacaaaaccatacgaatttaatgttatgacgctgtacccgtaataggcgagagcgatgcccaacctaagaaagagagaaatgatttgatgcagggagagagtcccattctgaggggatttttaaggaaaaggcataattatgaagcggaggttttctccgcccgcccaccggtcgcattccctccgtccgttgatgaacacaatggtcttttctgtctcatatgtcactcctttaatgacagttccttttcaaatgttttttctccttccctcccaccattgtccccgttgttcaattcgttcgatttgcttcggagaagacgaataagcatgggcattttgtcgtatttgttaacctgtaaaacgggggaactgtcagtgcagaaaatgaaagttcacctttaacaccgtttggttgaccgtaccgaccgcctgatttatttcccctacactcacaaagtaatacccatcggtcaaaaaagagttcgcaatttcctgtacttccctgtcgatggttgcgctgaacatcaaagttcggtgccggaaacccttcagaatttttgcattttttaatccccacgcttttgctttgctcaccgatcgtttcatctctttgaaaaggtccctaatgactgtccgcgcgtcttcgtacacaaaaaatttgtccgtttcgtctaacacaaaaaagcgcagtttgtccaatttgatgatgtgctctcgtgcgtaatgaaagagacgcccgacggtcgccacaagcaaatcgcaaccctttctgacattgttaatggagacgcccatcggaatgtctccgtacgccaacgccacgtcaacggaagtgcctaaaaataacaaaaataaataaaagggtgaaaaataaaacaaaacaccagctgagaaagtgcaggcatcttcatacaattgtttaaccttaaccacacaatttgataccattttactgattaaaatattattcaataattggggaagagatttgcgaattgaatgatttacgggaacaaattttgaatacaaaaatccccagtgtcgccagcccttttaaatgcgcaccaattcgcgagttggtgcgaccacaacggagtacggcgagtcgccgttgtgctgtgtgttgcccgcgttgcgcatctgttggacttcgttgatcaacggcagcagaaacgccgcacttttgcccgtgccagtgtgcgcatgtgccaccaaatcgcctgaattcaaatgaatgatgaaaggacaaacgacgcaagttacgaacagtccgtctgctgaattagagggatgacggccttttgcacttgcgttggccgggaataattgcgccgctgaatattccgcagaatggcggggtcgaagccacagtcattgaatgacctgaattgaagtgccaaataaaatacgacggctccatttttacgtggcgtttcttggtgtcggtgcccctcttcctccggcaattcgaatgtcttggtcgtgcaattctccgaagttctcctcaaacaagggtccttttgaaatgtgataccgcgcgtcaaaaagttggtcatccgttttcaattcaggcacatgtttcggccgaggaactgaaaaacggaaatccaatttcaattcaaataattaccgaaaccttttttccgtgtttcttcaacgccagcggacaaatttaacattttgctttgagaaaaaaagaataacagcaagtttgtgggaaaaacttgaatttaagaaaaaatttagagaccggtaaaaaaaattgcgcgttaacgggaaacaggaaaactaaaagaccgggacgggaagggatacaggaa

SEQ ID NO: 16583 - DNA, 2892 bp, Heterodera glycines
caaaaaaggaaaaccaaaaaggaaaagctaaaagaaatgggaaaaagaaagggaatgtgggaagacgaatgaatagcacaagaaagaagaatgggggattatccgtaaagttaattgatcggaggagtaattagtcgattaccacgaccatacgcaaatggaaatagaaatcaatcgctccatcaatcagcagaaaaattgttggccaacgcaacaaacatcagcagaaatgagtgttactcacaacttttggtgattttggggcgaagaccgcgcaacgatttggtggatttggcacaagtgaaggaaagggtccgttttttggtcagactaaatacgccacggcagaagaacacctttggaatgaaatgcgatgtttaaaagaaaggaaacaaaaacagaaagaaagtggcaccgcgtcggatggagtgccaaacggaggcaaaaagtcgcgccgggggtaatttgagacggggggagggcacggaggaggacgggtcggagacggaccttttgacaagcggttgaaggcgaattctgcccggtagctgaaagccaaaatattaaaaataaataaataaaatatttgcaaaaaaggaccggcaatactccgcgaaagtgagcacgtggaccactgcgttcaccgagtcgacgttcaccgagtccaaatgcttggaggcgaacagttcgcgcgggtcgaactcggagagaggcggcgccgttgggagctgacgcggcgtgtagaaccaaagcagcgtcagctgcagggaacggtcttcggattggtagtgaatggccagcacacggccctaaaccaaacgacggtttcacgcgggactttgctgccgtggcaaagcattccgaccacgaaaaggtcgtccgcactgtccgccgaattaatttggacgcagtcgccgacgcgaatggccacatttggcacactccgatggcgaatggcatcgtaacagatggaagtgtcgcgacagtcggggaagggacggcgcacggagccggggcctagcggacgccaattggacaccaacggcagaagagaagcggcgccggctcttaaccgaaacaaaatcacttaaaacggccaaatccagagggattttgccttttgtgctttgccgcgatcgattgtccttttctgttgcgctttttctgcctcttttggtcttccaaattcgcttccgcttcttttggcacactgatcagtgccattctgagtggtgctgtgccgttgtcgatgtgctgttgctcttctccttccccgttgtgtcgttccgcgtcccttcctttttgccgctgcccgcggtgtttccgccttgggccaatccgcgacctgacgcgtcttcgcttccgcaacggcctttccgcacctccgtcagtctgtccgttacgtctctttctttcgtttgacgatggatcgtcagagatgttgctgctgcttgaggaggaggaaaagcaaacggaggaggggagggacggcgcgggacgcgggcaaagggtggccgacgcatccgcgcctttctgcttcttcgagtgcgctgttatcgcagtcaatgccatctccaaaaggcgtttcggaatgctgagaattggtcggtccatcgtttcttccgcgtccaattggggcggacacgcgttttcgtcctcctccccggcgtccgctggcggtgcggcgtttggttggcccataatctgtgaggaaaaggacggaagtgatttgcattctgtcccgcagggagtccagcagcagtgaacagagacaatgagggaaacaaaaaagaataattccaacaattaagacatgcaaggggaagtgatcagtccttaattgagtagtctgatcaaaatgttcaattcttaatgactgctgatcaaaagtgatcattgatcagtagtcctaattgactctattgatcatttcaattgacctcttgtcgctccaattcgggcattataccgaacgactccgacgccacagtcatttcgtacgaaggagcagcggactgcgtttgttgttgttggatcagcaattgggggatgaggtgtttggccggtggagtggggggaagggcgtgcaaaagcagctaaattaaagcatccaaaagggacaaatgaaaagtgaagaatggtcaaagcaaaactaaaggaagaaaaagcgagtggaagaaaaagagtggggaagagagaaagagaaaaaaggggggggggaaggaagggaaaggggtacttttggctttgttcctacacaaaaaattttcacgatgtattaattatgccattaacgtaggaatattgatggatccatttcgttttgtcgcccaaccaatttatgcttaaggtaatttggcaaaattgtgcttgtatgaagtgtaggaacaaaaccgaaacgtaccgggaaagggtgggggagggagattttgagcgttagcaaggcttaacatcaaaaatcaggccaattaataaatagtggaaaaggagagtggggagagaatgggggggggagagatggggggggagagaagggattgattgttatgcataaaatttagacaaaaaaatgttcattttttgaaaatatgcaagaaattttgattatcatttttttatgaatatataacttagttgtgatgctcgtgcctctcggtctcactcgagaaaagtctcgggttttttttttgggctcgatttcatattgttcagtctcggtctcgaaacgtaagtaaaaagacataatattgtatgaacgaaaatggataatacttcttagaaattgttgaataattttaaaactattaatttaaaaaaaaagacgaaaaatttaatttatgaaaaacaatgctttatactattcaggatttattgactcggttgtttagttta

SEQ ID NO: 16584 - DNA, 887 bp, Heterodera glycines
atgcaaaaactttttaaaaacagatttctttaagaaaattcttctcatttttaagaaatctaataaaatccatgttttttcaaaaaaggaataaattttttaaataattttagttttactattcttgctgatttttgtcaagtttaaataagttgttttttttcaaaacaggtttctttaattttttttttactcatttttagcatttttgaattagaaaatttaaaaaatccatctttttataaatgtgaaaaaattagagtgccacgggaccgggacctggtagcggacaactgagtacaactgagtgccaaggtcccggttttgaccgggaccgggactagtcccggttttttcccggttttcccagccaaaaattcccggtttttcaacccgaaaaggtcccggtcccgggtttgcccaaaattcccggtcccgtggcactctagaaaaaatcataaaataattttattttacaattccttacaaatattttcttagtaaaataaattgactgttttttcaaataggatcattgctcatttgtttgtgagtgaaaggcgcggaaaaactgaaatttttgaatttcctatctctgaaattttccaaatgtccctaaacaacagaattgtgcggatttggtgcaaagattagaccaatggacagaacaacagcttggacccatggaaatggaattgaacccggacccgtcacgagttcaatgggaagttgatctgctgatggttcgggccgagttggcatggcgaaaacagacgacgacaaagaatggtaatcctccgatcagaagtgatcagagaagtattattggcttttactcgattttaccaaattggtggtatctggactggaatctgatcaggattttg

SEQ ID NO: 16585 - DNA, 977 bp, Heterodera glycines
ccccccagggcattttccgcattgatcatagttttgggccacacaatgccaatgggatgacgcattttgtgccgcgcgatgcaaattgggcatccaaaagtgcatgggaatgccaatggttgatcggttgagggccccattaataatgggccaaattttgttggagacgacaacaacagcaataacaacttcaaagcgatcagaccgctttcaaagcagtagcagcgaagaagaagtggcacatttttggcttttttggcactttttagtttttggtgtgttggcgagtttcttaaaaacttcgatttttaagaaaattttcgaatttaaaaaagaaatttccttgaatttttatattttttcaagcaggaatttcaattatttttttaaattggttttttggaacttagggggagggctgcagttttaagaaactcgccatcgctcctttttgcgcatttccatggcttagcacaacattggcattttttggtactttggtggtgcatttttcacccaattaggatgactttggcactgtccctgaggggccaattactgccatgcaaattttccaacggatcagacgacgtgcaaaatgcttaaatgccacggaagaactgaaactcgccgaggaatgcttggcacaatgccacgttagtttttggggaacattttctcgaaaattaattatttttaacaatttacagaatttgttaaaaagtgaaaatcaatgccaaattaaccaaagcaatggcattgaacatgttcacataaacatcaccaaacttccacatatgagaagtgcttcggaaatgccattctcacgagaagtaattaataaaattgtatctccgtggactcaaattcaaaacaaaattccgaaaattttctctggcattctttctgtcatttttgtgggttttcgagaaaatttgaccggcaaattcaatgcctatttttcttgaaaaaaacca

SEQ ID NO: 16586 - DNA, 1248 bp, Heterodera glycines
  misc_feature (14)..(14): n is a, c, g, or t
  misc_feature (34)..(34): n is a, c, g, or t
  misc_feature (36)..(36): n is a, c, g, or t
  misc_feature (52)..(52): n is a, c, g, or t
  misc_feature (54)..(54): n is a, c, g, or t
  misc_feature (67)..(67): n is a, c, g, or t
  misc_feature (70)..(70): n is a, c, g, or t
  misc_feature (82)..(83): n is a, c, g, or t
  misc_feature (90)..(90): n is a, c, g, or t
  misc_feature (105)..(105): n is a, c, g, or t
  misc_feature (234)..(234): n is a, c, g, or t
  misc_feature (321)..(321): n is a, c, g, or t
  misc_feature (396)..(396): n is a, c, g, or t
  misc_feature (1179)..(1179): n is a, c, g, or t
gtgggttttgcccngcgttcgtttgcggcgcgtncngtgggctgcgccggcncngctttgcctgtgnggntgtggcgctttnnttgctcnttgtccccgtgccgncctctgttcggctcgggttccgccggtgcttcgggctctgcccgggtttgcggcggcgcgcgttctgctgctcctcgcgcgccttctcggtgcgccggtcgtgtgcggggtcgtcgcgtttcgtgcgtnccggttcgccgcgcgcggtgggcggtgcttcttttttgccgtggtttgggccgtgtttttcgggcccgcctctggtccgggggggcngctgggccgtttttggggtttcgttttctctcgctcgggcgctgggttttttgccgtccgcttgtttggggcgcntggggtgtggtgtgggtctctttctttcgtccatttatgtcttcttttctctgccctctctcatcactctctcctttctttctttcgctcactctctctctccctcactttctctctttctatcgctctgttatcaaaacgccaaacaatacaaatttgaattgttttccgattgtcatgttgccaaactgaccaaaattgtgccctgatgattgcaaatgcgccttcaaatgggccaaacatgcgaatgcggcacagtccatgcaacagcacaacaacggctgcagccgactgtcctcctcacactgggcacatttcacaaacgccgcctgatttggttaacgggaaaaccgttgaatggggatggactcatttccgaattaaagcaataaaagtcgtgattttcagggaggggggaattcggggtcgctgattatgaatccaagccggtatccattcgacacaactccgaaccacggatccagattcggacaaaagccgaaactttcaaaattttcgagtttgcccttttggctcaaaactgtataaattacagtagtgacaaccttcagccggttttggaccaaaatacgaaattgcatattttttttcatttcgcttacgggattaggaatttctgaatttcttggactttctcggctgaagaaattcacggtttttttggcatttctcgggttttggcaaaaaaaatgcccaccttcaactgaatgttatgccgattggccgggaacacaatgcgccgctgcaacagttcatatttgngcaacaaggacgctttgcgcttgctgtagtggagacatgagcgcaatttggactcgtacatgtgccaaa

SEQ ID NO: 16587 - DNA, 2337 bp, Heterodera glycines
  misc_feature (2205)..(2205): n is a, c, g, or t
  misc_feature (2235)..(2235): n is a, c, g, or t
  misc_feature (2260)..(2260): n is a, c, g, or t
  misc_feature (2288)..(2289): n is a, c, g, or t
aaaaacaaatttctgccggaaaagggggggaaagaagcaaattgtgcaaaaattatggcggcggggggacaaatttaaataaaaaatcgaattaaaaatttaaaaaaaaccagggattagttggtggcattaagtttttttctttaaatcatttggtttttccagggtataatttgtgttcattgttgtggctatgtgtgcattttaccagggcaatacaactaaaaaaacggcattaatttttaattgagaagtaaaggagaaagtgcgcaaatggcataaaccgattaaaaaagtaattagataatagctggctgggttatatttttgttaaatttcgtatctattgactcttgactccatttgactttaaaggtttgaattcaaaatctaaaaaaaaaaaaatccgggcaaatgcacaacaaacaattcaatctctgttccatgaataatttaaaagaagcaatgaatggaatcaggcccgtagagggaaaaacaaacagcgggaacggagacgaagaattaattttctggaagacaattgggaaaaggtagtgccggtgccatgaaataactacgagaaatttccaaaaaaaaaaaaattttttttatgaatcaatttacatttactacttgctgctacaggcctgaataaaaaggacaaaaaaaatccatgaagacgacaaggaaacaaccaacacaaaaaaaaacaataacaacaatctttggaatcaataaaaacataataataataataataataataataataataataataatcaatagccctgcagtccgttgtacacccgtggcacatggtcgccctgggcgagcagttcagctaacagtgccttctgttcagcggtcaactcaccgcgcgggaattccacatcgaatgtgatgtacaggatgccgcgctcctggttgttggtcatcgacggcatcccttcgtcctttttgcgaatacgcgcaccgggccatgtgatctgcgggaaagagtgtgtttttttaaaaatgaaaaaatttttgttcgagttcgggttcgacattgggcgaaatggatgcgtaaaattcgtaatcatcggccccccacaaaattgaaaaattttacaggcaattggatttgaaccgatgccttaaaaaaaaaaaccattttttcgctctttcccctttgtcgagaatggataaatccgaaaattattagagcaaataattttgtgtcacccttttactggtattaccttatcccgaacaatgtgcactttgtgtccatccaaatggtcaatgtccatctgaaaagcgttaagaaatctacgttttgaggaccgttaatttttttgaaattttggtaattaatttgaagcaaaaaaaatttacaaaaccaaaaatttaaaaaaaaaccaattttttgagcatttttgtcaaaaaaattttttttaaattacgcaattttttgaattttgcagaataatagagaggggatgatacaaaaaaacagtcacctcaaagccggacaacgcgtgctgcaacgaaatggtcacatttgtgtacaaatcatcgccacgccgttcgaaaagtttgtgcggttccacgcgcactttgaagatgagatcaccagggtcaccctgtgtagtgtggcaaaattaaaaaaaaattttttttttttttgaaattcactctacctcaatgtgcggttcgccctcgccaatgaagcgcacttcttgcccattgtcagcaccaacctccacttccacctaaaaatccaaaaatgaattatttaaaatagaaaaaaaaatttaaaaaaattaaacgaaaaaattcaaagcatatagggggattgaacccaagcctatctttttgttgactaccacaaggaccacttagacaaacggttgtcttcaaatccacttaaaatggacctccaagttctttgtttgcgcctccaacttcacatttggacactcatcacacacgcgaacttggaacatttgaaaacgacccttaaaacaaatgaaaacaaaaaattgtaaaaaaaaatttttaatagccgaccatgcccaactgttgtgtcctcatttcgtgcctaaaaacaaaacaaaaatggtgtaaaatattaaaaattgtactccaattaaaagcacaaaaaaatgaaaaagtttgccccaattcaaagattaactccttattttgaagggctagtanattctaaaaaaaaaatttttttcaaaaaantgagcccccccccccccccctcccntccgctgtgtgcacctgcaattgcattnnccgagtccgctcgtctgcttgtataccgatttttttgcgcgtcatttc

SEQ ID NO: 16588 - DNA, 1573 bp, Heterodera glycines
ttaaaatagaaaaaaaaaatttaaaaaattaaacgaaaacattcaaagcatatagggggattgaacccaagcctatctttttgttgactaccacaaggaccactgagacaaacggttgtcttcaaagtcttcaaatccacttaaaatggacctccaagttctttgtttgcgcctccaacttcacatttggacactcatcacacacgcgaacttggaacatttgaaaacgacccttaaaacaaatgaaaacaaaaaattgtaaaaaaaaaaaaaaaaattttaatagccgaccatgcccaactgttgtgtcctcatttcgtgcctaaaaacaaaacaaaaatggtgtaaaatattaaaaattgtactccaattaaaaccacaaaaaaatgaaaaagtttgccccaattcaaaggttaactccttattttgaagggctagtaaattctaaaaaaaattttttttcaaaaatgagccctccccccccccctccctccgctgtgtgcacctgcaattgcattcccgagttccgctcgtctgcttgtataccgattttttgcgcgtcatttccacaaatttgcctttgtaaacctggcaaaaaaaacagataaatttgtgcaataatttaattaatttaatcaaaatttatgggatttcggtttgccccccccctttttttccttaaaaaatggttcaaaattttaaaaacctcttccagtgtgacgtacaaatcgacaacaacgtcagcaccacgtggcgtctcttcgtcctgctcttgactgccatggccgaagaaatcgccgaaaaatgacgagaacgggtcatggccaccgaaggcatcgccgtcgcccattttgcggacgccctcctcgccatgcctagtgggggggggggggggggttaattaaaatgtggcagattcaaattaatcagcgaaatccgagagcttacaaaaattttctaaaaatttcccggtgtaaaatatttatttaaaaaagttgtgttacgaaaatccaaacctgtcatacactttccgtttttccgcatttcccaacacactgatcgcttcgcccaattcttggaatttttcatgggcatccgggtcttaaaaaaataattgcaaatttcttgaatgtcatttagttggccaatttactgtctgggtttttgtccgggtgatgttgccgggccattttcctaaaatcaaaaaataaacattactaaaaatgggtgatatttagagtccgagctggacctgggtacagttcattttttggctcaaatcgattttcctggccctggtttctatattgtaataaatgcagggaccatgtcaaggtaggcataaaaaatctggataatattttagaatttttttcaagtaacgaatgtttttttaactatgaaaaaaaaatacacgataagcctgtgatttttcctgaacctggatgcattttttggcgctatatgcaaagtggtcaattttgaattttatcaaaaagtaaaaacaaaagtgggggggaccctattgttttgcaaaatttttttatatatagtcatgaaaatttattccctg

SEQ ID NO: 16589 - DNA, 1588 bp, Heterodera glycines
tgcactcaaatttgccaaatttttaaatttacctttttttctgctattattattttttaatttaataatataacattttacccatattgatgatgggatgagcccgtccagccgcagtgcctccacgaaggagttggccaaactggcccaaaaaaggactgattgccaatgagtgactagagattgtttgtattacatttttggcattatgttttgcgtaattcaaaaagccacaaattcataatttactttatatataaagtagagtagagcgggaccgggccgggaattcccggtcatccgaggtcccggtcccggattttgaaaagctcaggtcccggtcccggtagggcaaccgggaaccgggaaaaacaagcactggtaagaatggaggtctgagtgaaaaattagagatgaaagttggagttaaagggaaaaaattaagaaataatcatataaaatattctgaattttttttgtatactcattggttttcctatcaagaaaatatcattcctcatatattttacttgatatatatatatatatattttattattttttaaatgaaaatccatacaaattgagcctaataatcccaaaaaagaagccatttttgttgaaaatctgtcaacaaatctcctcaaattttcaaaatttccccccggcggcgcctatcagcaccgccggccccctttcttccccaaaagttttctggaaaaagcgcgccgaaaaaagtggtgtgataagtaaatctaaatttcaaataatattcgaccatttggcccaaatgattaattgcttgaaataattgaagaaattttgatttgaaaattttctttaatttaatttagctttaacttttggattttattaaataaaaaaataaaatttaattttgttattattttctcttggaataaattaaaatttgaattttttaaaatttttttgaatttttaaaatttcccggttggtcccggtcccggtcccgaagaaaaatcgaggtcccggtcccggcttctcaggtcccggcaagtcccggtcccggttttgcccaaaattcccggtcccgctctattctagttaaaatcctttgcgtttcctcaaatccgccaatttaccccgtcctttctctacaattgttcgtctcttcaaattctctctttctgtgacggcattttgcccgaatttccgcccgatgacagtgccaacgcgtcggatggcaaagcggtggccaaatggctgttctcgcctcgtcctaacaatttgccgaagctattttatgtcagcatttggtcagagatggggccacaatggtcggcaatcgtggaacatttattgatgcaattatgtgatatctaactggtggactttgctatttaaatgttgttgtatatgatttttgttcacccactatttgttaataaatttaataaagtattttattacataaggcttcaaaatacgaaattcaatttttttttttccatgggtcttaatagctgatttcaagacccgatgatgattttttcttgagatgctgaatttcagagcgtaattgacctaaaaattgccaatttccagt

SEQ ID NO: 16590 - DNA, 2172 bp, Heterodera glycines
ttttgcttgggaagggtgcataaacttgctgtagttgatttaagagtaaaaagagggcttggttcttttgcttaggagaaaggattacttactatagttgacttttacagtatgaaatgggtccgttttttgggggaggggtggagataatttactgtcgtcaatttgtaagtaaaacaccaataagagcttgtcttgggacgtgaaactctctgtccgaaatctcgcattttttggagggagaagttcaaaatttgttccgtgagatccctacgtcccacaaaatcattaaaaatggggttctgaaaatggatgggcctacataaacgtgtgcacttcatttccctcgcccccgtcgtttccctcccgaaatttttttttaattttcaaacagaaatttaaaaaaaaattcttagggattttttagtaaaactttgaaaatcagcgatttcttttgaaagttttttttttgaaaaaagttagtaggtaaccataaaattttggataaatcggtgaaaagtttttcaaaaattttttccttgaaattttaatactaagaaatttcctgagttttttcgttcccgatcagaattacttttgcagaaaaaatgtaaatgatggcattaaaaaaataatcaaatttatacattttaaaaacggattcagtgccaaagaattaccgagcattgaaagcgggtataaatgtcagagctgacatgataatgtaagtgatcaacatgtataaatatttattttggtgaattttgtgatataataaaatatgcaaggacaaacacagaattaattttctatatttaataattttctcatctcttttttccttttctttttatttttatcctttaaaaatttaaatttatattttttaagcaatttgctaaatggaaaaaaataattgaatttaaagatagaagaaattaatgaattctctaaataaaaattattttaaaaaaattactttaaaaaataattattttgaaattttcattttttaaatttaataaataatttagaaattggtttcaatccacaagagaatgcgttgcaacagcttgtatgggataatcgcgttgataaattgtgcgaaaatccatggcccacttaatcgtatttttaaattaaattcttggcaccattgtttgttttcaattaaaatgccatgtttgggttcacaaatttttatttattatttttaaattttcatttttctattttttaatttaatgccaaataccggcacattaactatcatacgtttcatttctgtttccaaattgatgtttgaagtttcgtttaaatttcttccacaatgattcaacattttgggtatgagcttgattgttggcaggattgacaaagttctgggaatgatttatgcgtgtaattttggggtaagttcggaatgcaacggtaagaacgctattcatccgaaataatggtgttctctgggttgatgtattgttggatgagcaatatcagacggattgcggaacgtgattccacagggaccaaaaaaatctcgacgaaccgtcctatgttgtttttctgggaccaataatcgaaatgattgccaagaagttttgataaaaactttttggaaaatttttgaattttttaaaattttctcggggacgggaggaaaagagctgctactccccggcggaggaacataacacacttccctataatttttcaaatttttttttaaattttaaaactttccagggtcctccaatcgtccagtccactccgcttgtgccaccgccgctgggaatttctcagaactacgctcggcacagtcaagcaccgacaatggcattgccgtctccaatctttggccatcacttcccatcatttgggccaatgccgacggtcagcagcagggcacgcgttttttggggggtacattcagaaagtgctctgaaacgcaccaaattttatgtacaagttaaataaggctctctgatgcttttattatcaaaaaggaagatgaataaaatttttaattgctttaccaaattttataggcatactccccggtacagggctaacttaacctgaaaaaatgacaattgtaattgattttaaatttttttagaaattctgagttattaactgtttatttattttttgaaaaattaattcataaat

SEQ ID NO: 16591 - DNA, 1952 bp, Heterodera glycines
aatgccagcagcaggtaaagcaatgaattggaatttaacattgaatgccatattgagaaagtaacatgactgcattcaattacggcttacgaaaattacgggcatttttttgggtcttgtattctgtctgaataaagattttgcgagttttccgtaattttgatctatgactggaattttttctcaagaaaatttcttgcgagttgtttttttttataaaaacaaaaatttttcctttttttatgctcacccgtatttctatttctcttaaaaattattcctgataattagggatcggattcttagttttttaactattttttctgcggctttaactcgacgagaaatgcacgaaaaacacattctttttcgaaaatttttcatttttagtgccactattcatcactaggaatcactattttggagcttcgccactaaaaaaaactatttcggaagttagccactaaaataattttttgccactattttggcgtttcgtcattatttttgccactattttggcattttttggaaaatttcccaaaaaatgcaataaaaacgaaaaatacaccccaagaatcgacctaaaaattttcaaaaatacatccctaagaattggaaaaatttcacaaaaattcttcccccaaatttttttttcttgttcaatattttctaagaaaatattttgtaactgcaatcagtgaataaaatctttttccttaattttaaattattttcaaattaaaaaacagctatttaaaaaattacacccctaaatttggaactttttcgccactatttttgccactattttggaatttttttctcactatttagttaattattttgggattttttatcactaaaaatccgatccttactgataattcgaagtataaatgctacacccctaattttggttgtttttttaaaccagaatatagggacctccctttttttagttcgcccccattttggccttttttggatgatactttgagtcatgagagagggatttttaggttaaacaatcacttggaaatctttcttgccgaatttgagtggcttagaaagtaccaataggcttaactttgaatctgttgtttcaatcaaactgaatactaggtcactccttcttaagtaactttataattttaaaaggaacaactgcaggagatacgctcgcctcatcatcaaatttcgacgacttctcctcggcaagcatcaacgagccatcagcacaaaagttcccaccatccccaggaaaaattagtgactttgagacggcgttcggttcatattttgacaacaagcaaaaccgcaatgattgatgcaaaagttcaaatcgaaatggaaagtgagaccagtgagaaatgatcggacggcagcataaattcggaggagtgaaagaaatgtttgcgattcattggctcagttcaatcaactccgatcatcctcagtctcttttagtgtatcaaatgaaagcttgaagcttaaagattttttttaatttaccaagaatgtagggattgaccacggaagaaaaaggttatggcttaagaaactgagtatggccttcgagtatccggaacagagcctttggattttcaattttgatatttttttggttgagtttttgtgacttggcttcagtaaaaatgctttcgttaagcttctggttggcatattaattcaattattctctagtatttttacgaacaaatacacaaaccaaaactacgggggactaggagcaagatggttttgaaaatgctttaatattggactatgatggcgccaaaagagtgcgatttacgaagctggaagagagataccaattaattgttttggtgaatttaaccgaagtttttttcgtttttcgtcccaatgttaaaaattgatcaaaacttgtttattgttccagaaaagggaaaaatccgcttacattgagg

SEQ ID NO: 16592 - DNA, 969 bp, Heterodera glycines
aaaatccgcttacatgagggacaaaaacattaattaaaaatgtcctcaagaaagcgaacgagatcatctccaaaataaaatataatatgaaatcaatacaaataaataaatatttaccaaatcacttttagttttaatgaattaataattcgactttaatttttccggactattttacaggaatagagatagttttaattttatttctaaattgatttaatgagtttatttcaataagccttttatcgagttggttccaaattttagttacccgccctacaaaaggtataaattttttgcctattttatatttcgaagtctataaaagggaatgttaaagcgttcagaaggtttgaatatttcaaagggattcagatctgttcggccataaattattttatcagccatgaacagatcagaaagctttcgcctgctttcaagtgttgacagttgcaggtattctaatctttgttggtatggaatgggtggaaggctgcatttgaaaagaactcttttggtgaaatatttctgacacttttcaattttttaaatatttttttgaatagatggattccaaacctcaggagcatattccaataacggtctaacataagttttgtacaaaataatccaaatcctagaagacttggacttaataatccgaaattaagaacgcatacgtaaatatgcattctttattatttgtgtgacatgattgcaaaattgcaatttattatcaatattgatgcccaaatccctaattgtatccacaacatttattatatttccatcaattttatatttctttggggtttttattccccaagtgaagtacaaaagttttttgaattgagattctgatttgccatttatttgcccattcggataaattatgcaatgctttatgcataattcctgtgtcggctcttgctttataacaaatatacaatttaacatcatcagcatata

SEQ ID NO: 16593 - DNA, 3850 bp, Heterodera glycines
  misc_feature (42)..(43): n is a, c, g, or t
  misc_feature (75)..(75): n is a, c, g, or t
atttcaattggggacgctgtaatttaatagaaaaaaatatannttaatattaatagttatttattgttttgcttntcggcactccattgggccgatgaaaaatgccgtgaaactggcattgaatgttcagcagagaatcgccgtcaaattcttggcccggcactgttcaaaattcgcttttcgcttttctcgcaaaagaaattttctgaaaaaattggtaaaaaataaataatatttgttatgtatggtccgcctcttttgagttttattttataaattatttttgttagattttttcaacgaaatattttttttattcaccagtctttccatatttacagttccatccggcattttaacagcaaacgaagtgatgggcgtggaacaataccataccaatccaaagttttgtgggatttccgattgcttactgtatccaatgcaatttccaagtcaccagcgaatttgggcatttggaacattaataatggacattgaaaaaatgtcggaatttgtgggagaaatggctgtgagtaaccgatacagcgaaactttgtacataagtggacttccatggcgaatgttagcacaaataaaaacaagaaatgaaggcactgacaatgaaaaatgtttggaattttaccttttgtgtaccgctccaaaagaaggttcaaattaactcttaattaaggctaattaacaaattaatcaccattaaggtttgatttggcgctgctgcgttcattcggccacttttcgaattgtctcgcaaatgaaagtggcggaaaattccactgggacactttgtgaccatatttttaacaataaaaaatactggttgggtttcaataatttcatgtcatttgcggtgagtttgacaattaatttttcccttaatttatccaattatgaacaattaagcaattgatggacccgctcaatggcttttacaacaaagaagaggacaaagtgacacttaccatcgatttaaccgtcaaaaaagaaaaaataagcaaattcattttcgatcaaagcaaatcggaagggacaattttgatggaaattgaaaaagtgtcggaatttgcgcgcgaagttgttgggagtgaacgtaaaagcgagacagtcacgtacataaagggattaccatggaaaatattggcacgaataaaccactggacagaagacagtgacaatgcgaaaagtttgagcatttttcttttttgtgccactaccaaaaaaggttcagtttaaatattaataaaatattaattaataataattaatttgcattggcgcagaaaattggagctgcaaatgttccgcaatcatccgaattgtctcacaaaatgacgcagtgtcggattacagagtcgaatttaatgacaaattgttaaacaatgaaaggaaaggctggggcaccaaattctttttatttgctgtgagtgacaattaatttttcccttaattcatccaattatgaacaattaagcaattaatggacccgagcaaaggcttttacgacaaaaacgaagacaaagtgacagtggccgttgatttcattataaaagaagcaaaaattgacaaataataatagacaatttgacagatttctcaatgaaatctcttttttgtctattcttctgttgttattcgcatttgtttttagacttttttttagtcttggaaaatgtttccaattatttatttttttggctttcacaaaacaaaatttggctaaaaagaattccgattttgtgtttatgaatgttaatggtgtttctttgtcaaaaatgttattcctatcaattttatcttacaaaagatttctaaaaaatgtaaaaaccaaaaaattaatagtgcgtgttttacatagaaaaactaagttttgagattgagcaattcaaaaacttatgccacagagaaagcaacaggcgccgccgggggaatttttttaatacagttcgacattttgaaaaaagcctggacttgggttccatgttggtgaatttcctgggcaaaaaatccaagaaaaatccaggccaagctctagtatttattgctttttgcttaagaaatttttaaaaaattgcggaaataaattcaaaatctggaatcgtgccatttctatggcgtttgtttgttgttccgtcgcttgcaactagagaccggagcaggaccggatcctgcgcaggattttgccgggttccagtccgcaatcccgcattttttgaaaaagcgggatttgcaggatttgcgggattaatcctgccggatccggaatggctaagtaattctctaccattttttttgcgtgtttcagttgggtgtgcaacgatgtttggatggacattttgcccctttttgaccatgcccaactcggcctcaaattggcactgatttcgccacgtttcgatgttttagtggacgcccatttcaatggcaaaagcgaattgacaatttggagacaaatcacaattcaaaagttcaaaggaccaaaagcgaaactgtctgaatggatcgatgacaaatgggtggcatttcctttgccggaccgtccgctgcccaacaaaattcgttttaggaaccttcggattgagtaattcaaacataaagggaagaaaatcactcctttttcaccattttcacaggaaacccgaccattctgtgctcgcatttctccgtgccaatcagcaaatttttgaaaaagccaccaatttatgtttgtctgtttcttcatgcttccatgattgcctttcattattcgtcgacaataatgtccagccgatttgggatgtttttgcctgtgaaatttggccgatttttgcgccaaacattcgccgctttaactttcgcgatggtgatcatttggacaatttgcgtcgccgcatttcgcccacaattctcaccgatctcaacaaccttagtgccatcacttccggtcgtctgttccccgatggcatcgctgatgatgggccaaatgcaactgctggccaagcattggccaaatggttgcacactccgcgaaatgatggccaaccgaagcgattgcgttgcggtggtggttatatgtcaaaaactgaatttgtcaacattttcaaagaggtgtggccatagtttaggccttttccagctttttatgtttggaattttgggccgctggtcgcgaatctatgacactaaaaaagagttaaaatccaagttttctaattttcctttgtttaaacttaattaggaattgatttgaacattgtcagaattgtgaatgttcgggagctataaactggaaaagggtcataattttttaagcgaatgattttgataagctttaatttccgttttttcatcaattagaaatttatccgtgccaccacttccgccaactacgaaattcatttttatgttaatgagtcatatgagtcaacgccattggtgccatttgaatttgtgaacgaacggacaaacgaaaagcttacactgctaacagaaaaaatagatgtacagtgtatcatagggctaatgaagcgatatccaattggggataatacggtggcggatcagtgggaaaaagaaggaaattggaacaatttaaactatgtcaactttatgctttgcgatgccaaacgatgcactgggtgagcaacagggatggcacggaattcgaccccctaaaaagctttggacgtcgaaattccgatttctgaaaaaatttggaagtcgaaattccaattcccaaaaagatgtcaatctaaagctcttgatgagacaaaccgatctagggcttaaagtagttgatcagaagaaatccacgggagaaaaccctttactttacaatagccaaaaaacagttgat

SEQ ID NO: 16594 - DNA, 3587 bp, Heterodera glycines
  misc_feature (112)..(112): n is a, c, g, or t
agagaccaaatggcaaaaaattcgggaaattccctggtaaaacattccccaaggaagaagcgtgcccagctttggcttggtcccggtgcctacataaaccacgactgcgccncaaactgcgaatttgtgccgaacaaacagcaaaccgcgacgataaacgttctgagggacataaaagcgggcgcagagattaattgcttttacggggacaactttttcggagacggaaattgcaattgcgaatgtttaacatgcgaaaggtatcaattttgaaatcacattaaaatttatttccaataaattttacatttcaaaaatcgccttttcattaggcttcgaatgggtgccttcgccgatcgccgtttggctgctaattttggcgagattctctccataaatggcggcaccaaaataaggtcgcgaattcaatttgaccgaagaataaaaagcgaggacattgacgaagaggaggagcaaaagtacaaattgcgtgccaccggctaccgaaagtgccgcgcggcggtggcggaggacggcggcggcgcagtggcggtgctaaacccattatcaatgcatttgttgaaagtgaccggcggggcattgccccaacaaaatgccgaacagaacggcgaaacttgcgaggagtcattggaatgtgagaccgttgaatttgcattcattaatcattcttttctttcagacctcagagaaacgctgaatttgtcccggtctttaaagttcgaaattcccgacaaatcgccactgaaccgttcgttgacaatgaatgggcgaattccaatttggagaagggaagcggagccaaaagcagacaatgagccaaaacagcagaggaaaatggcaaacggagaaaagcgaatggtaaaacaaaggcaaagccaaagtgaaaaaagaaacaaaaagcaaatttagagagtaaaagccgaaaagagaagagaacggaacagaggagaagagccaacccaaagaagagtgagagcaaagaggagaaacgcaaaggaaggaagtgaagggcacagaaagagaaacggcaggaggaaaaagaaagaagtggaagaagagagaaacggaacgagagaaaaggacgaaaaggaggcggaaaaggaaaaagaagaagcgaacaacaacaaagagataggggaagaggagagaaatgagacgacgggagaagaggaaaagggcagggcgaaagcggacgacggagaggaaaagaatgagggagcggtactggacgaagaggaggagaagcaagaaacagcggaagagaagagcaatacgtcttccatggcagaagaagatggaggagggaaagagagaaatggggcgaggctggaagaagaggaggaggaggaaaaggagagtagcagtaagaacgggacagaaaaagagagaaaggaaaccataggagaagcgaggatggaagaaaaggaagaggaggagaacagagaaacagcggaagagaagagcaatgggacttccaggcaaaaagtgaacgacggagacacggctgaagaagaagatgaaggagggaaagagagaaatgaagggaggttggaagaggaagagatgagcagtaagaacgagacggaagagaagagcaatgggactttcatggcagcagaagatggaggaaggaaagagaggaatgaagggaggttggaagaggaagaggaggagaacagtaagaacgagacggaagagatgaaaggacaagaggaaaaacaggaaatgaacggaaaagacaaatcggaagaggggacgatgacaaaacgaaaaatggccaatgactgcccgaagcccatcagagtttcgaagcggaagcgcaacatttccccggagtttaatttgaacgaccttttgtacgaagattaccgaacgaagttcggtgatgccattccaagggatgtgtacaggcattagcaaaaagtacaatgcaatgagtttatattgttgtgccgttctactacccaaactgtttttatggggactgggtcgttttggcgccagcgcgagttttttgattataacttttttcattgttggccaaatctaacaatcttggtatcattcgaaagcccttcacaagctctattagccttacaaaaaataaaaaaaaattttagcttgtaaaaaagttattaagaaaaaacttccaaaattttggtttttttgttatttcaggttataacttttttgataattgtctaatcacgaaacaattgcttagaaatagcttctaaacaccttaagcttttgaatgataccaagaatgttaaatttagttaacaataaaaaagttataatcaaaaaactcgcgctggcgccaaaacgtcggcgccaaaacgaccccgaccctcgactcaccacggttttttttgttaccaacgttctcatgattcgaatcgccacattttttcaaattttatcaaatttaaatgaaatgaaaatgttaatgcaaaaattaaacatttttgctaatgcacaatttttcgatcaattttataacctctcttccattgtcattcgaattctcgaaaattgggaaaatgacggaccgaagtatgtaaaatacgataatttacaatattggaattaatgagtttttttttgttttttttttgcatgttcagtccgactccatcatttctcagctcaccggcggacgacgatttgaagggtaattggctacaattcatgcaatttagccaaacccatcattttggaggggcggctatatccaaaaactattttatttgtttatttaaccaaattcattaacagagtgacccaatttcggaggcgaaatctgacttgtcgaaaaatgttcaaattttactatttcaaattattttcaaacgttttttggggaaatttctttaaataagtgcaaaaattccaacccttaagaattaattttctttttgtcaaaatatcgattttttagcgcctctttatttacattttttgtgattttatacacataagcacaacatccgggaaatgctgtaccaaaaaagatttgctttgaagcattagaaaaaaaggcaatggtatagattattggtcccgaaaatttttttttacaaaaatttgagaaaattgtttttaggagtaatctgaggcgccgagcacgaatccggccttgttttgactcattcgaaccccgaacccgacccggatacggcatttttcgaaaattaaaaaaaaatattgcagatattgctaagggcatgattgaattgtagaacttattgcctagttattcgatgaatacatgtggagacagttcaatgggaaaaagacattggctgcattcgacaacagtatcgataagacttcccatttttaccttgtgaatgcgtgatgcacatttgggtcccttaagttaactcatattgttgcacaattcaatcaacgccttagcaaaaaatttaattttcgaaaattgttcgagtccgggtttatggttcgaaactgagtcaaaataaggccggattcatgctcggcgcctcagattgcccctaaaaacaattttctcaaatttaaaaaaaaaaaaaaatttcgggacc

SEQ ID NO: 16595 - DNA, 1137 bp, Heterodera glycines
  misc_feature (1050)..(1050): n is a, c, g, or t
  misc_feature (1067)..(1067): n is a, c, g, or t
  misc_feature (1115)..(1115): n is a, c, g, or t
gggggataaatggaggcgggggattattttgagaaacccttcagaaaatttagaatttgttttaaattttgaaattttttcattttttaagcccttgaaatttacgctaatttttggaaattcatcgcttcagggttggactatttagtggataaagcttaaaaaataaagaaaatccgggagttctaaattaaagatgaaaaaaattcttccagaaattttcaatttttcagaaaaaatcaacattccattctgaaaagaagttttcataaattaaaaaactagaataatctgcaatttttttcttttgagtggaagaaattttcacccaaaatgctccaaaaatatgtcactagggtattttagggcgctgatcaataatttgaaattttgctatttttgaattccccccccccatatctaaatttttttctgacactccgatcactaaatattattatattaattgtttcccgccgattaagtccgttcccggcaccttccaacagctcaactgatcacgacgaattgacagtgaaaattggtgacaaacaggtgaaacaacagaaagagcaaaatggatttaaaaactgaccatttaactgaccaaactttatcagatcactgataaacttttaaaagatcaatgataatttgatcagaccaaagataagaattagacaggtaatttaataatttctggtcaaatcactgccattttttgatactgatcatttttggtcagatcactgtaaaccttacttaaatcactaaaaaaaatatgatcagatcactgattcttatacggaaaattttcgtcagattactcataaatttgtcagattactgatatttcttgctcagatcactgaaaacccattctgatcagatggctgtgtccgcccattggctgatgtccgtttccccggtgatcagtcgcatgctcagcgtggagatgaaggagaagcagcagcgaatgatcactttggacgaattgggcgtggacatggaccaattcatggagtttttggaggccatctcttatcttanaggatattttctgcccnacccgtaatcattgatactgtatttattactactataacccctgaggngtgaaaatatgattttaatttt

SEQ ID NO: 16596 - DNA, 2031 bp, Heterodera glycines
atgagaaaaaaacggaaaagagctgccgaagcagttaaaagggggggggggggacattttaatatgagtgggctgccggcgggggagcccttcggaatcgacgacgacctatggccctttttccgcgacctttgcaccattcattctttacacgttgatgggggcggggatgttttcttgtttgaaaatttcgctttttgtactcctcgtgtaccgtccgtcccgccgctccaccaagccaatcgtcgttgtttttccgcagcagatggctgtttctactgatggtgaaaatgtgtgttcagccgttgctccctatcgttgcatttatttcattcgcattcgcaccaccacatgtgggcccctcctctgctgacggtgtgcgggggggggggggaaacgagggcccaaaaacgggggcccaaaaacgggggcccaaaaactggggcccaaacgcccccgactcattggcaatgcttcttccaagccaaatgtgccagtgattccgttggcacaaattgtccgttggcattgggacgaaaatggggcacaacagattatccaagcaataaaatatgtataaagaatggatttaaaatttggttaacaaatttagaccaacacactaaacaagggcactgaactaagttacggcagctgtgccaatgccaatgcttcttcatttgttataagaattctcaaaaaacgggagaagaaaaagtaatccattgaaaattagcgtttcaattatggttaaaaattaggattttttgagttcggatttaattttcaaccttacaattgggtccaatcactaaacattttttccattagtctcttctcggcgccttccagcttgcctgacgacgacgatttaacggtgaaaattggtggcaaagaggtgaaacacacaaaaaggacaattgcttttttaaatttaaaaaaaaagaaaataaaaattgttttaaaactcgagtaaattgagaaagagataactcccataaatctttgtaaaatcactgacaaaatgttttgatcagatcactgattaatcttggtcagatcactagtaaagcccggtcagatcactcataatccattctgatcagatcgctgtgtccgcccattggctgtcgtccgtttccccggtgatcagttgcatgctcagcgtggagatgaaggagaagcagcagcgaatgatcactttggacgaattgggcgtggacatggaccaattcatggagtttttggaggccatctcttatcttaaaggaccttttttgccaaaccgtaattcatgatactgtatctattctactatatccccaggagaaatttctctccccttttatgggattggaatatttttaattatgaaacggattcctaatttttagccaaaaatgtgctgatgctgctcaatttggctgactacttccaggtgagtgcccttgcagaccagcagggctggacgtagttacgtgttacgggaattacggcgttttcgaccctgtaattaccgcttacgggttacggctttttgagatttctccgtaattttgatctctaactaatttggaccctacagacagactccatcatttttttcaaaaaattagtttttactatttttgaatttattaggctaatatattaggggcactaattgctccgttttgaggtgaccgcgttgaagtcgcgctgcgaattgcatctgatcaattgcgtggaaattccactgatcgaccgtttccttctgattgatcgctacggactcgacaatttgaaagtgcttttgcataaattaatttttaatgatttttcaaatattttaattatttcccacttttagaattattttttgcattttgatgttgacgaattccgtgcctttttcgttgcgaacaatgaacagttttttcctaagatcagtaaagaatttttgttggctttgtccgtccgactttgtggatgaatttgtttaattatgattgggcctggctttgatcaaactgatttttttggcattttcat

SEQ ID NO: 16597 - DNA, 3039 bp, Heterodera glycines
  misc_feature (25)..(25): n is a, c, g, or t
  misc_feature (41)..(41): n is a, c, g, or t
  misc_feature (53)..(53): n is a, c, g, or t
  misc_feature (68)..(68): n is a, c, g, or t
  misc_feature (101)..(101): n is a, c, g, or t
  misc_feature (106)..(106): n is a, c, g, or t
  misc_feature (121)..(121): n is a, c, g, or t
  misc_feature (2924)..(2924): n is a, c, g, or t
  misc_feature (3014)..(3014): n is a, c, g, or t
ttttggaaacaaaattttttttcgnactcaatgcatttttntggccaaattcntctcgggaatttttnggacataatttcattttttaaataattttaatntattntaggaattaaaaggngaatttattatatttttatataaatattcattaaaaataaaaaatgtcctcaattttaataaaataattcatttggctttgtttaaatgacaaatttctttaatcatttttatttaattttttggaaattctttttaattttcaatgaaatattttcaatcttttttcaatataatttttaatttaatttagcgttttcaattagctttaattttcgaaatatttttctttttatattattatatttaacccaaaattttatgattttgtttttttaacatttttttgctccatccaaatttatttttggcattttccgttttttttaaaatttcatgtttggcattatgtccattccttttttttaaatatttcctcaattagctgcccattcccaattttcatgccattctttcttcccccaccccacttttaaagtctttatatttccctggcgacctaaaagcatttaagtacccaggtaaattagccgtgccgtgccgtcttacagccgacggcacgaccattgattttgcgtttggcacaaatatttttttttgtgccatgccaaaatatggtgcttcaaattttccagatttatttatttttataaaaaattcaatccgaattcttcagagacaaaaaaaaaatgtcggaaaattataaaaattaaaaaaattaattttaaaaatgacacaaactttcacgccaatatttttcaaaaatcatcatggatattttgattattaattaatttttaattagataaatagattttgtggaaatgctccataaaaatgcaattaattgctttattaaaatcaaaaaaggtgggcgttagaagcctttgaataaaccgcacataattatatgcactaaatttattccaaatgtgcttaatgggcgtcattcatcatccattgggattaaattgaaaatttcttttttttttggaacagccattttttgacgcttaataagaaaataaaaattcaaaaataattttaatttaatttaattttagataaatttaattttttaaaaaattctgtaaatgaaaattttgatttatatataattaaatggtagtattatttcattttaggtttttaataagcaattttccattttctaagcattttcccccaattcatttgcctaaccaaattggttttcgcaaaattaatttgttttggcgttccgtctgatgtcattgctgtgtgtgacaggtgaaaaatgcacacaaaaatagaaagtgacaaataaaaattaataataaaattggaataataataataatttaataaaattaaataaataaatcgaaaattaattaaattaattaaaaaattattaataattattgaataataattataatcataataataatttgataaaattaaataaataatcaaaaattaattaaaaaattttattaatttttttaacaattattgaataataattataataataataatttgataaaataaataaataaatgaaacgcaaataaataaaaattatttaattattcagtgaaaaaggctcgtcttcaaggcacaatcggttagcaaattaaataatttaaattaattaaattattaaaaaaaaaaaaattaaaaatgccaaaattaaattttctaaaattcttttccagaagatttcccatgcctatgtgacgttaaaattacaaaatgtgaagtcaacaaccaatcgctgtcaaaggcaatccagccgcaatgggagcaggaatttgtgttgtaagagaatataaataaaataaataaaatttattaaaattgaatttatttttaatttaattttatatcaaaaaatttactctgatgactcatccatccatttatttcattttttattgcttaatttatttcaatgtatgtgaattgaacaaaaattaacttaatatagagtgaattaaaattctgccgttaatttaaaaaggatttatttggcacaaagtgcccgccactgacatatgccgtccggacggaccggcctagtatggcacctctgattttattttactttactcacaaattttttttcccatttaaacgtttataataaattattcaatgagttatgtgcataattattataattgcctcattaggcatgcaattaatttttcatttagtttttttgataataattttttcaaattttaattttatacattcatcactacgcctgttttggcaccattttcggggatattttcggcccggcatttgaccccgactcgggtcgaacgttgtgccgggattgggcaaaggttccccaagaattaatggcaccaaatttgccaaatcctatcggatttgttgtgttagctctgatcactctgatcatttttgtttgccatttcagtgaaactgatcagctggaccagggcctggtacttgagctgtggaacaagggcgtgttgtgggacaaactgctcggtgttcacttcttaccacttcgtcagattggctatgcccaagaggcggggcccggccgatggctccagggcaagaaaaaaatgccataaatattaaaaataaatgggaaaattaataatttaattataaaaaaagggaaaataattaatttgaataataataataataataacattatgggcgaataattaacataattataaacaggcgaattaattaatttatgcaataaaaagagtaaaataattagttgcatgtgttaaagcaatgaagtaaaaaataatttttgttttaaaaaaataataaatacgaagtaaaaattattcgtacanaaaattttaaaattaaaaagaatgaatgattgttttttaaacattttttaaagttaaaatatgtgttttacttaattattaataatttangtataaatattaactcatttcagtt

SEQ ID NO: 16598 - DNA, 1673 bp, Heterodera glycines
tcaagaatttctcaatgaaaaatttgggaaaacatctcaaaaaatgcgcaaaatttttccgctcctggcgccttacaattcaatttgtaaggaaaacgccggcgggcaaaatggcatgccaaaaagcccgtttttgccaactgctgagcgccgaatggcatttttaaaacgggcactttccctaataactttctttaaaataatcattattaatgttaataggagagaaatttttgagaaatttcattgagaaagtcgtaaagtgcaagttttttttgagattgcacaagttttaatatatataattttttactgctttttataatcagatatgcttcattaagcttttattttcgcatgattaatttagcctcattaaatggatttaatgatggctttttttaagaattcaaaaaattgatgccgtcattaaaatgccaatctgtcccatatccaataaaatccttcattcattttattttaaataaaaatgaatgggtcatattttggcgttttgtcttttttatgtaaaaatattccgttattcattattccgtttcatttcttttttcaattgcactctgaggtgccaattgtgtttgtatattgagcaaaattcaaagaattcctaatctgggcacaaaataaataattccacaatggcattcatttcgattttttgtttcttggcacatgccataaaatttgggccaaattaaaaaattttgttttattatttgctattttttttaatttttaaaataaaatttttaacaaattaaacaaatttataccttttgaagtttataaattcttttattaataatatttgaaaaataaaaaacaaaatttgtttattttttaataatttacttttgacatttacaaaattaaataaataaattaataaatttaattataaaaattaattaatattatttccttcagttgtcttcttctaaattttaatcaggaagttgttccttaaaatattctaataacaattccatcgggaaacaagtcacgaaaaattcatataaaatttaccatttttcgtccattttttgctgggtcaattaaaatttaattgccaattttgccgatggcaattttagttttataaaaaacaatttttaccataaaaaattgtttttttgaagaaaatttgagcattcctatggtgccgtgcttttttgttcgattctatggcacaaaaatttaattggcactttctcgcggggcacaaaattacgaaacaacatgggcacatccattctcagacactttcaacttttcttcttttctacacaacgttttggctttctttatttagaaaggatttttattttcaaatattaaacatttattgggcggctcaattagaaacaattaatccctaattagaggcacacattactcattggaaaagaaattaaaattctttttttttgtattaatttttgccctcttgaaaaatgccgtttcaatatgcctatttaaaaattaatgccaccgtaattagaggtcattagtcctttgtaaatcaaaattaattaattatacattaatcattggaagcgaatgaaaattcattttttgatattcgtttttgccccacgattaattgccaatttaatatgcctcaatttaaaataaatgccaccctaattaga

SEQ ID NO: 16599 - DNA, 1872 bp, Heterodera glycines
tttttggtcataggagtcgtcgtcgtttcattttttaggttgtgcgagtcgtcgtcgtggcattttttggtcattcgattggtcgtcgtggcattttttagtcatactagtcgtcgtcgtggcattttttggttgtgcgagtcgtcgtcgttgcattttttggtcatacgagtcgtcgtcgtggcattttttggtcatacgagtcgtcgtcgtggcattttttagtcatactagtcgtcgtcgtggcatttttggttgtgcgagtcgtcgtcgtggcatttttggttgtgcgagtcgtcgtcgtggcattttttagtcatactagtcgtcgtcgtggcattttttagtcatacgagtcgtcgtcgtggcattttttggttgtgcgagtcgtcgtcgtggcattttttggttgtgcgagtcgtcgtcgtggcattttttagtcatactagtcgtcgtcgtggcattttttagtcatactagtcgtcgtcgtggcattttttagtcatacgagtcgtcgtcgtggcattttttagtcatactagtcgtcgtcgtggcattttttagtcatactagtcgtcgtcgtggcattttttagtcatacgagtcgtcgtcgtggcattttttggtcatacgagtcgtcgtcgtggcattgtgaagcgattttgtgtgtaaaatgtgaattttttaaaaaacggattttgacttttttgttcgaattccgggttcggggttcgaattgggcgaaaatagatgccggaatcggtttttccgaccctaatcactttggttggattttagaatttttccgttgtccagcactgactatctgtgtataaaagggatgaaacttttcactttatctcataccaaataatttttttcgcgaacaccaccggacatatttaccaaattcttgccgttatgccgctgagcacctccgaatgtattttgttttccgctattctgttcggcatctgcttatttgttagtcatacaattccatttttctgaataacactgtcttcctcttcaggtggtggattattatgccctgactgttgcgaccttttcattcctcattggaattatggtagttgttatgtaattttcactttagcacaaaatatttcttttttaagttcggtgcactctggccggtgatttgttctactttttacggctctgtcaaaacttcgaagaagaccacttccgcttcaaagcaatcggcatctgccaatgcatctggaactgcgaacaccaaatcatcatctgaccattcctctggcacttccaaagacaagtcggcatctgccaatggatctggagcgaacaccaaatcgtcatctgaccattcctctggcacttccaaagacaagtcggcatctgccactgccgcgggcacttccaatgacaattcgtcttccatggcaaaatcggattacgttgaacgccagaaggaccgctccagccgcgtatgtttactcactataccttaaacaaaaatacgcatttctttttttagtgcggtgagcagcagaagaaaaagtgatggaagaaaagaagaagcggatagaagcaacaaagatgtcgtctgattaagtgtatggaaatgaatattattgtatttgagaaatgatcgatctcaattgttgtgcttattttctctcagaaatgcttgttaattcattccttctataatatacatactcatttatttttctcgattttttttgttggccaattggtttaggataattgaaagattgtctaaagaatttggtagtagtttaaagtggttcccccccccccccaaaaaaaaattcccatgacatacataagagacaattaatttatttatttgcttgcttttat

SEQ ID NO: 16600 - DNA, 1387 bp, Heterodera glycines
ttgactggcgttcacttcgccattgttgttctgttgcagaaatttcagcaaaagaaattgtgggtggttgtcatcatcaaaatcatctccggctaacggcaaacgcatttttcaatgccaaattgtgaaggacaacacttgcaataattgcatttgaaatattttgaattggcagcctataaccggaatgatttgccgaaaaacggcgttttaaaatgccaaatgctctttcaacacatgtgcgaccccggcttaatgcataattaaaccagggtgcgtatcgaaaatttttcaaaatcagaacagcaagcccgaaaaatcagattttggggtcaaaaatcagaacattttgcaaaattcttcaaaacagttgtttttacattttattcgatacaaaaatgtatcaaatattatatttttcatctcccattatcggttttaacaattttgggaagaaaatgcgcaattaataaattttggtgcatttggaatcaaaaaagcagatttttaacgatttttttcgccttaagaaatacagtactttttgctgataccgaaattgaagtgcacatacctcagcgggtataagtcgtagagaattgttgttttttgcattttgtagaccattttgtactctttctaatgggcccacttaaaatttccagaaaaattttcccaaccccctaggaatttttttcgaaaaattttccgtttttcactgtatattggggtgttcagatcaccaggaaggagtgatcggaccaagttgctgtaaaagacttttttgatcagcactcaaagttaccttagcaggaattttttcagaatttttggactgcaaaattgtgccaaaaaatgaaatgggacaacacttttgaccacctatattttgatcaaattgtgaatatggtaaaataaatcaaataaatgtttatgtcacaaatgcaaatatggtatcattggaaagcccataaaaaatgctatccaatggtatgctacttatctgttgaaattggaaaatgacaattttatacgcaattatttttttcaaagcatgatgggacaacacttatgaccatgactgttataatgggcgaaagtatgaatgcttgcttattcatctgattattgagttcattcgatagccttaagtgtcctctattaacctgcataatttcgaaaaatttcgtaaaatttcaaaaaagttatggtcagacgaatgcttaactcagaaaaaacacatagaaaaaatatatttggtttacataatatttgaaaaattttagcttattttcttttggcagtttaatccaaaaataataatggtacgcaaaagtcggctaaccaataatttatagatcaaatccaatcacattttgttgtataa

SEQ ID NO: 16601 - DNA, 2962 bp, Heterodera glycines
  misc_feature (1541)..(1541): n is a, c, g, or t
  misc_feature (1593)..(1593): n is a, c, g, or t
  misc_feature (1602)..(1602): n is a, c, g, or t
atttatttttctatcggaaatccaaaaataaaataatatgatgagaatttaccatcggtgttcccatcgtctgattgtgagtgccgtcttttcccttcgtccgttgttttgccgtgggctgaacgacggagttgagtgccgaaataaatggcggccgattcttcgaagggctgaaggaccaaacggaccaccaaactgccgaggcgttcgaccgcgtcgtaaattgctgcaaaaatggcaaagtgaaaaaattaaacacaattcatgcagaattatgtgaaaaattggaccttgaacttttaggggcaacaaatcggtgaaagacatcaaataattggcgccatcagtcaacgattgtttgagcagagaatggcaaaggaaagtgccgagcaaatgcaaatgggaggagtcgaaaaggcgaagagaggcaaaggaaaaggggagggaacggtggagccaaacgaagaggagggagccgagcagctgaaaaagggggacacaaattaacggggaaagaaaagtgccaaagatggatggataaatgccatcgcaaagcccagtcaaaaacaaaaagacaaggatgccgaattttaaagacactgtcccaaattcgaacacaaattccattcggattttgtgttttgacctttgcttttgctttacctgggcgacggggaaaacgaacaacggattcattccgaagagaacggcgaaaaaagcgatggccttttgactgagcaccaaaatggcattgtttttcgcatattccgctatgctaaacgataaattggtttataattacactttgagttatgaatttcgtcaataaaattacggactttcccattttcaattggcaaacgatggacggctcggcgaatgtttcggcgagcgcggacagagcgaacagtgcgacaatgagcgcatttgtggcccgactgatggccaattcggacggcggagaaacgacgaaaagggcccacgggacacagcagagggaaagggtggccaaggcgaacagcggactggactgacgagttttgggaattgaatgaaacgaatgtttgaaattgtgccaaaagacgaaaagaaaatatgtgccaaaatatttgggggatttttatgagaaatgccgataaattaagtataaattctcaaaaatatcatattttaaatgaatttttaaaataattagcaatgggtaaaagaaaccttagcgaagcgtaggacggcactttgtggagcggaaaatcggaactgagacagagccggcggatgggctcacgggaaagaaagcaaatggtggtgtaaagcaaagtcattctgaagaaatggggggagggaaattgcaaaaggtaaaagccgaaaaacaatccattttaaaagctagggatttccaaaaaagtaattagtattcgtaaaaacatacttcacattgaaaaagcccaaaagggaagggtcgacgaggcgtaaaagagcgaaattgaggagaaaagagacgagccgaatgaccaactgaaagagaaggaaaggcgaatcantttgggaggggggggggaaggggacctggtccagcgagcatatgccctgtanacactcgcngaattgtccatggaagcaatggaggaaaaattaataaaactgaaaatccaagccctaacaatgagcaaatcgaagtaattttcaaaaatgaaagtaatttagccgtcaaaataaaaaaatattgagtacaaacaaaacaaaagacattaaaaatcgtagaggataaaagagtttataatgagtcataaataagtctgagcaaaagtggaaacacaaatttaaatatggcactacaaaaatcgaaaggtaagaaccaaagagaatcactttgacttcttcggaataagcgcgatgaaatcggaatggaacgaacccaaataaatatgggaagcatcgtcaatggcctgaaatgacaagttttgtagttttttgattatatatattggtgaaatgttgacctgtgacacatctggcacatcggaaccggtcgggtcttggtaagtgcgcaagacgtgcccatccaaagccaactccataacgaatccgtacttcttggcgaccaattccatcaacgggaacagatactgctcggggacgacctggcaaaaagaaaaatgtaagggtttgtatggaaaataaagaaatccacggaaaaagacctgcagaatgaatcttcgaactgccggaagagggccaaggagatccatgaaggaggacagaaattggccagcgtaacgcacggaagccaaaccgacgaggaaagacgatttgtcatgggacaagcgaatgttgtcggggaagccgggcaaattgtcgatgaacacctcgtgctgacccttcttcggaccgtcaaaaaaatacctgaaacattatttaactgggggaaaggagcgggggaagaaaatgtcgaggtcagcaagagcgggcaggaccgtcccaagacacaattttaatcttacaattagcaattgaaccgaccgctgaatgcgtgccattgagcactcggagaccagcacagacactttgtccggatgaagttggactccgttggcaaagtgcagtccgtccaacaccacccgcgcatcgccactgcccatgtccaattgaataagactgaaaacttgcaaaaggattgataaatgatagcgagtcgtcgcatttaatattttctgaccgtccgttgggccgattttcgaggaatccctggagaaaatgcgcccgatcaaaagtggtggacgagtcagagaagaacagctttttcccgtcgctgaacacgtccaaatcgttgatgaacatcgctttgtgccctccgggcttggaattggaggagaaaatctgcttcacagtgtccccgttgtcaaagtcaatcgtgaacaagcccaaataagcgtcggcgaccacaatttgtcgggcattgaga

SEQ ID NO: 16602 - DNA, 3281 bp, Heterodera glycines
  misc_feature (3191)..(3191): n is a, c, g, or t
  misc_feature (3263)..(3264): n is a, c, g, or t
ttcctaaaaaatgcaattaaaataaataaaaattttaatagccataataaattaataaaacgattaaaatcattgacccaaaataaaaaattatttttcgacgtttctctaatcgaacggttcaaaaagaaactacgtaaatagtttctcgacctttcgtgttccacaaacaaatatgggtaaaataatatgttaaataaggtaataaactttaaaaaaaattaagggacttaataaaaatatacacaaaaaataaataataccaaagaataatattaaatggaataaaaaaaattaattataattaaaacattttattggtgaacattgaagaaagtcaataacttattctatacgacgtgtataaatatatttgagtgttgaataaaaattcacaagtatatgaggataattaataaatcaattaatttaattaaaattggcaagaaatttcttaaagcttgtcataaatattgagttaaaaatagtaaacgaagtttagtttaatcagagaaaatatgatcacaataagctgcttttaagataaatgcgaataaatttcggtttgttaattaataagactctagaaaaaaaataagaagattgtatgcataaatgatttcaaataagtaaacgattattaaaaaaaaattaatacatataaaaaatttttatcgccattgaaataattttatgggaataacataaacgctaattgagaatttgttttagttaattgaccttaagaacaatagtcaaaaatgaaataaataaaaagtaagacgacttagtaaaatacaataataatgtacttgcacttatccaaaaaaaaaattggagatcatttaaaaaaagagtgagaccgttaatttattctttttaatctgatgatataatattgcaaaaaaaaccaatacatttttatgtaagaattgaaaaaaatgtttaagaattttcacataatttaattaattccgagaatattatgtatcgcttagaatgtaaaagtaaaaattcaatctgaatgaaatctaatataataaagatgagactataatatttgaaaataatgaatagtctattttacgtctcttaatatttcagatatttttgtaaataaaacaaatattgattaagctttaattttattcaaaaacaaaatttctacatagcatgcatattaccttttgtcttcgttttccacaaaaatgaattaatttattttaaattatatgagacaattctttttaaaccaaattatggaaacagttaaatggaaaggatttaaaatattaataaaattcaggaaaagtgaaacggaaatggtttaaaaattttttttgtattataatctcatggtttggctcagtattataactaatgcgttctgcaaccattttgcaacttttttctgcaataaaagtgtacaaaaatcaattcggaattatctttgcattttataaattatttattttcattttttatacgaaaatatcttttctatatgttttttattatttgaaaatatccaaattaattgaattaaatgcttgattatatttattagagattactttaaataaattataccaaacagttttatttatttaatttgcttaataatatttttaataaattaattatgttttgtttgtcacgattgttaactaaattatccttgccaagctataaagtcaattttcctccggtaatttactttttataatatttaattttacaattttaaacttttgaaatttatgatctaataagattgtgaagatttaaaaaaattagctatacatctatttaaatgttgtgttgacggaattttatcgtgtatggctcgttctcatttttgatgttttaatattacttgattttttcaatttcttttttcataaatatttataaaaatttttatttatagtcagttgattgattttattttttttaataaaatttttatgctgttaaatattgtcaatttatcggcttgaccagaagttgtttgtttttcatattttgcatcattataaatttaattatttataatatcaaatccttcaatattttacagattattcctttaattatgttgatgatttaaaagaaatttatactaataaattgtttaaaatttaatttataatattacaattttcatcattttattgttgtgtgataaggagtagcatttagttaccataaccaaaacgtgcagttcaattgtgagttaatcagaaagaatttattttaaatagagttgagcgggaccgggaccggacgggaattcccggttttttcagatcccggtcacggtttttggaaaaacagaaatcccggttccggttttgccagtcccggtcccggcgggactaaattaagcactggtaagaatgggggtctggttaagaaatgagaaggaaattggtggagaagatgatatgaaaataaaaaataaattaatttatttcatttatagcagttgttcaaattcaaatgaggtctagtggctaaaccttccgacctttagtctttgtcacttgggttcagttccccagcggaacaaaaacttttttcatattaaaagttggtcccggtctcgatctcaacttttctagtcccggtaagtcccggtttttgtaaaaattcccggtcccgctcaactataattttaaagcatgaaatggatctaaaatttttcaaaactagaacaccgggtcaaaaaatcagcttttgggtggtcaaaaccagaacattttatgaaattgcttcaaattacttatttttacctttatttgataaaaatttattaaaataaatttttcgcctacgattatcggatttaataattttggcaaggaaattagcaaatcttatatttaagtgctatcggtatcaaaaaatgatatttttatcaaaaaaattttgcggctgcatttttacaaaaaaaaatatattaacagattttgtcgagaattatctatgctttcaagccgaaaataaaggattttttatctggcggtgccgatagacgccgccgaagcttattatctttttaatttaggctaattctcaacggttttttgtacaaaatgaccaaattttgcgcaaaaacttcaaatttttaaaaaatgagaacaaatccgatccttgttttacaatattattttcagcaagaaaattanattgtcttctctttagcttattcgaaaatcaattatttatattttacttttgtattaatttatttaccaaanntatttacgtttttatat

SEQ ID NO: 16603 - DNA, 2301 bp, Heterodera glycines
attttctcactggtgttccccgaaactatgaaatgcgaccttagtttgttctgaaatttgttattttttgttatatttttataaaattttaaatattttttccgtttgacgcacatccgaccaaactgacaaattactgtagaagatattagccgcaagaaataaaaaaattaaaaagttaagaaatttgtccgaatgcgggttcggattcgaaacatggatgttttgcacaaatccgaccaatttcagtcctgaacagctactcacgcgaaaacggccccgaccgattcttagggggtctaagaatctctatttgtaataaattgtttgaaatttgccggaaattccctgagaaatttaatgatttttttaaatcgttaatgggatttggggaacaagctgtgctcctgcaaaacccacgccacaacacaaaattttttgcctatgtaatcgaatgaatgcatttttctttcgaaaattgtgtagttttcaggattttgacggggatttacgacatccattagcaattagcaccggcaaaattaaaaagtgtcgatttgctgctgttcctccctcttttctgcttcattctctcttcctcctctttctccccctccttcttccgtcgaatttttccttttcctctctttctcttccgtctctcctccttccccactgctattttcatccttttcctcctctttctccccctccttcttgcttcgaatttttccttttcctctctttctcttccgtctctcctccttccccactgctattttcatccctttcctcttctttctccccctccttcttgcttcgaatttttccttttcctctctttctcttccgtctgatggcattttcccagtttgacaggtccgggtcggggtgtagaaggagtgaggtggcgcttttggcattgtccagagctttgagtgcattgatgatccctttttgtattggcccagacattgcgtgcagtttggttgtgcgtgtgtgtgtgttgtggtgcacttgttgttttgtgtctttttccgggatcagtctggccttggtcctggaccttttgtgactaaacacctgcctcggaggacaaggtgtttgccttttgccttatggctaaactaaagcctcggaggactgttagtttgccttttgccttatggctaaactaaagcctcggaggactgttagtttgccttttttccttatttgtcaatggcctagtgcgcgaaaacaccctttttgcacgaagtacttcctcgaagggcaagtactttgtccactacacaacaccttccaaccctctgttcggacgaagtgcttcctcagagggtaaacactaagtccgctacgtccctcgtgaagttatgcctcggaggacaataactacacgaaactatgaacactagacaagcctcagagggtcttgtctaggctctctaatttgcttttcccttccccctttgtcaccgggatccgtcgatttcagtccgtggttcacagcaaatccacccaggagcgccaatttgtcccgacttgctctggggtcgggccaaatgaattccacggtgcggggttcaggggcaggcagggacgagacacagaattaataaaaaatttataccgggaaatgacctcaaacttgggtaattaaaccaaaaaatttgaaatggtgaacaaattatcacaaattgatcacaaaaatgccatcaccggggaattatcacaaatggaattgggcaccgggatgggacaggaaatggagggcaccggggccacagaacaaaaatcaataaccgggggtcaaagaatgatcacgaatgggggttatcacagttaaaggcaaatggaagggaggggagagaaacggcaaaaatgcctaatgaattttggttgtgaaattgggggacatttttggccgcttaaataacaataaagttaaataaaaagtggcaaatgtgagcagaacgaaaatgggccgaaaatttgggcacgaaatgaaaaacgggggacaaaatgaacagatgaacaaaatgggcggaaaacgggataatttgggggttcattgttctttggagtctcattcgccgaattggggacggtggcagaaaagttgcggttttgacaaattggtcattaatttgtgcgcggggcgggggaggaacacacaaaaacaattgacaatttgaaggaaagggggacagagggatggaacggcgaaaacatgtcgcgcggcgggcgggggattggtgaagggcctcctccctcttaattccgccgattattgatcggcga

SEQ ID NO: 16604 - DNA, 3558 bp, Heterodera glycines
  misc_feature (40)..(41): n is a, c, g, or t
  misc_feature (53)..(54): n is a, c, g, or t
  misc_feature (56)..(56): n is a, c, g, or t
  misc_feature (63)..(63): n is a, c, g, or t
  misc_feature (2479)..(2479): n is a, c, g, or t
  misc_feature (2648)..(2648): n is a, c, g, or t
  misc_feature (2802)..(2802): n is a, c, g, or t
aatattataaaattttatttcacctttaatcggaacaganngccaagctcagnncnactggangaccttttaccatattaatttacaatttaaataattaactaaacgactgaaaatttgaataggatgacatgctaattgtaaaagtgggccaaattgtgcacattttggtccataatgaaggcacaccaattcgcacattgcatcagctttccatcagtgataaaatgaattatttaaaacaaattatttttaccaatttcatttttcagttttatattgtttcaaaaacaattttgccgatgattgggaagaaaaaaattatgttcctttccaacaattctacacaaggtattcaaaaaataataaaatattgttgtgtatttattaattaattcgtaaatccgctacaagaatttttcaatgaaaatttgtagaaaaatttctgaaaaacctggataaaatttgctaatttcatttatcgagatgaaacaatccgttaacaaatgttcatcattccgaattatattttaaattttttgcgctatttaagttgaccaaattttcatcgacggaacgcacgaactgaccaacaaaaatgcatttaacactatgataatgaatttaatcccctttttaccatttaatttatttatattgtttcaatattaatattgatttaaattttgcataaataaattttatccggccaattaactttttcaaattaattcaaatccatgaaatcctttaatccatcggcaataataagcaaagtgacagccgccatttttcaaccaaaaaagtcccggtcccgggtttgcccaaatttcccggtcccgctgcactctaattttcatgcttatttagtgcttaatgattattttttggtgctgaattatgtgcttaatgatcattttttggtgctgaaaaaaatccggtctctaatgatcagaccaaagattgagcaaaagactcgaaacattacaaaacaattaattctaaatataggtatggattttccttttccttttttgtcttcctttatccagttgccgatgtcacacatgaatatccgtccacaacattgccggcatgttggcgacctgccggcacaacccatttcccgttggaattgcactccagcgggagggaacccgaatcgtagttgccaaagtccgtgtcaccgtttgccaagatcacatgtatggaaacctgggaagacagaaaagtgcgttaattgattgtaagacatgacgatttcctaccgattttccaggaattcgaaacccaaagacccgactgatttttcccggccaaaatccgagcctgaaccctgatagtttttccaggccctaatttgtaagcgacttttccgacccgaaaacctaaattttctccagaccagagtctgacagctatccaaaccgctagtgatgcgcgagagtcccggtctcgactcgcgaaaagtctcgtgtttttttgggtctcgttttcgagtcttggagataaatatcgatctcggttctcggctaacttttcaagtctcgatcacctttcaaaccgccgactgcttccgtacccgagacttttttgtcgccgccctgcttcaacccctgtggcattcattacttaccacttggcctgcgtcacagttgggcgtcagcgttgcgcagccggccgcattcgtgccggcagtgttggttggcgttgttgtggcagttgcttgtaacaagccggacgcaaccgcttccggcacgctcagcagccgaagggcgctgggcgaacatgttgtgcatgccgcagtgccacctccaccggttgttgcagcagttgaagcagttgtaagcgttgggacatttgtggtggctgttgatggaagaaataatttaaaaaaaaaatttatccgtttcaacaaaatttttaatacatagaaattttcgagcagaaaatttttgttttgaatacagaaaacaatttattatttactgtatgactacggtattccctttttctgaatttttctttttctctacataaaattgatttatggtccagggaatcgagaaacttagaccccccaaaaaactcgaaatttctcaatgactaagacttttaaaaaatcttattcaattaaaaaatagaataaaataattattttaagaataaattttaagattttcctaacaattttttaaaattttattttttattcaatttatttattaattccctttaatttaaacaaaaaatgtggtaagtcatgttaatttggtttgagtcgagaaccgagactctggcaaatccctaatatcccttaaaatatttcaatccatctcaaaaagggggcatttatttagagaggggggcgggagggggggggggaatattttaggaaatacagtagcaaaaaatattttccattacagtagcccctaatcgattaaattaaaaaaaaactgtcgctgaacaccttctnggtgctgtggttccagcggcggccgtattatctgtcggatggcaactctgtaacatggtgggcatcagcagcaacagaatggcaatgctaatggataatgaagaagaatgcagcagcaccattttttataaactgtgtgtaagataattaaagaatggatgaattaatntaattaggtaattaattaagccaaaatgattttatttgccaacaaaaaagaaaaattcacggcgtgcgcgggcagcgtaatttttaagggaaaaatgctgttgaaactgttttcgattttccttattagcaccgcacgtccaagacctcccccnctcattcaattttgaaaaaaaaaattgctaaattttcccagaaatcataaaattactatttttaatgaaaatctgttaaaaaatggtaaaatgttttatttatttaattatttttgtaatttttgtaatttatcgtaaggcttagttatctatccatcaactgacttatcccaagctgactggtcctgacgcgccaaaaattacccctttttctaactgttttcgccgccgcattccataattatttttttttttcaattaatgaatggctaattagcgcgttgatttaatagtatatacatattaactgcgcatcacacacacacaacatatgcgtttgtgttaaacgctttttacttccgcgtgtgtggcgcggcgccggcggcggattatcgcaaaaattgcggcggcgacggcggcggttggcgaagcaaattaaaaaaaaaaacaaatatgggaaattgaacaggctttgtgctttttgtttttttgatcaccagtgttccttcattttgttatcatcaaattagcagcagcagcatcttgatcttgatgaccatgtgatcatcccagctcagaattaattgatcattagggttgtaaattatatggaataaaaaagcccaaaatactgactaaaaaagcccggaaatgtccgaatatggactaaaaacattgtttcataattaagaatgcgatttttaggtttttaatattattttttttttactcaagcgccaaatggagcaattttgg

SEQ ID NO: 16605 - DNA, 1463 bp, Heterodera glycines
  misc_feature (11)..(11): n is a, c, g, or t
  misc_feature (20)..(20): n is a, c, g, or t
  misc_feature (1360)..(1360): n is a, c, g, or t
acgatagatanaaagaatgnccaaaaacgccctgtgaaaattggacaaattgttggcatccgaagaaaaaagtgttatcggcggaggacattcttccgagacggaggacgtcaccaccactattacaagcattacggtaatgaatcaagcttttgtgtcagtgatacggtttaaaattaaattagtgggcttgagattctcagtctaggatcagaaaaatttcttggattttccggggtttcgactcggacttggttttgttagcaagtcaaagattctaagtctctagcatcgccaaataaaagatcagcaattccatggtaaaaagaagtgagaattgagggaataaataaaaaatttatcaagcaaaaattaatttatctgatttttaaattaattcaaaattttcaaatggattaaatctgacaaaaaatcttaaatagtctctatcttctttttaatatcgcttttctcactttttaaatccaatttttcagcctgaatgcaaaagtgggtagtcaatttctgaaaaccggacctggttctaaaaataaacttaagcaaaaacttcttcatttaccacattataatccattttgataattagcagacgcaacgacctaagctgacggcaaagtccaagatcagtggcagcacttcgcaacagcttatgcccccctcatcaactgccaaaagtcaatgtgcttcatctccaaaaaacagcctaaaatatttatcagcagcacatggcacacaacgagcagtgcctggtgctgttccatcagtgactcatactgataagccacggcatccatcaaagaggcaatgatcagaaaatattttaattaaactatcgattttttgggaagtttgccttttgtcttgaattttggtcaaaattttgagcattaaattctctcataccatattcacaattccacaaaaaataaagaaggtaaaacccagcgataaatatgaagaagaaacattttatttaatttcaaaagtcttgaaaaattgtctttttggatttgtgccttattttgccctttttaatttcgttcttttttttaaaatacgaatttttattaagcaatttccaaatgttcaattttaatcttgctcaaccttgaagcacaaagaagaagcagcactcattgcctgctgctgtgcctcatcaatcataccgtcaaagtcactcgaattcggacactgacaatggggaagaaattgggggcggaacgggcgcgacaaaaccgttacgacataaggccgattcggcgcataatttgtcgcaatcgccgccagcggacccaatcagagcacggccacctgctgctgctgctgttggttctgctgnggaccagcaacaggggtgcgtttgttgagcataatttaagcgttgctaattagtgagtcatttcgtaaataaccgccgaggggtaaccaatgaaaaataaaag

SEQ ID NO: 16606 - DNA, 2055 bp, Heterodera glycines
ttttattttcattttacccccttggacaattctgaaacggccatgatggtggcggaatttacaaacggcattgagttaatgtgccaaaaaacctttcgcatatatgggtggctcggtggttttatcgttcgaaagttcttgatgaggagaagcttattctgagcattttaatgttgaaactataaattcataggcgccgtttcaaagccggacccacagacaacttacaatttgcaatgttcaggaattaattaaaaacacaatgaattttgtccagtacctttggctaatatccagggcccagcttaatccaaatccaaattgtctccgatttgtttaaatttgataggcagttgcttcttgccccgatggacaaccaaatgttcgacgcggataataaaaaagagttcgagataaacaacaacggcatggaaaacgagtcacaacggtggttatgtgctaatttgaactacgcgtccgtgggcactgcgcttctgaagggcacgccaaacagagacagtgccttattagtgcaggcacttcgccaggtgtgggggagaactgttcgagagtacagtctcggctcatctgttgaggaatttcggatcttatttgatattgtgtgcgactagctttttttgattaattataaaaaacaaatgcatttttatagcaaataacgaaggcaggctcaatgaccgctggagaggccaaccttagcaaaatgatctcaaatgatattttcatgttgcgcaataaaaaacaggtcgatggttttgaagaattttcatttggggcgagggaaaaagcacgaaaaatacgttttcaactttatttgtatgaggaagagctgattaattatggtgaatttgggattttcatgcttaatgctgaaaatgagcatttatttgtgtatgtttatttggacatttttgaaaactttcaaaacaaaattgcaataaaaattttttaaagttttgtttaattatttgtgtgcttaaaatccggactctaaataattattgaaaataattaggtcactacaaattaatcattaaaaaaactttattttttgaaatcattttatttgaaattttattacgctgaaagttttcttatgaaaaaaatttaaatattattttcaaaagctatgatttttctagcggaaaaacacgcaatattccatggaaattttcataatattaattttttaatgtatttaatttattcagtccgttctgtccttgtttttggttccctcccaacaatcctcgtccaatttcacttccgttgattctcgtcgtcccaatttgcttccttccttttcctccacctctctcatcagtggcacatcctccacttgtgctggtgttggccttccaccatcaataccctcatttgtggatctgcttaaggcaagaaaagggagcaaatttaatgagtccaaattagtggcaattgttattaattaatggcaaacttacaaattattgcaaaacggctggggtcgtttcggcgaggattgtttcgaagccaagcgacataagcccacaaaaaattttatatttggtatcaatttaaaaagctggacaactcttttagcctggaaaattcaaaaaatttcgtttgggtataaaaaaatatggcaaaaagtgcgaaaatttgattaaatcgtctagttttttcgtacactctcataatttttatacccaaataagttttttttaattttcagctaaatagccggtggcaaaatgaattactgtgaatacatatatattaatgagatgaaaagatatcttatttataagaatttttggctttaatgatatatctaatgaattattattagtttttaactgttattaaaactaaaatacgaagaaattctttttcttcacttaaaaataatcaaattttttgaattttttcttagaaaaattttcgctagccccccccccccactgagttcctgctgaaaatcgaagtcccggtttcccctgaagatttgtcatttttcttgccctgctcaaggacagctcggtcggttgctga

SEQ ID NO: 16607 - DNA, 2882 bp, Heterodera glycines
caccgagaaggacgccgatttttgtgcccatttggtcaaaaatttcgagtccgccggccttccagtcagtgccgagctgctgcacgtggcgctcaaatgcgcctggtacaagacggaacgtgaacagcagctgcaaggccaaccaattgcgggcggtgccgtcggctttggcagcggggcgcgacaacggacggggcttggctatacggcggcgccaacaatgatgatgggccaaggtgctggcaccgtcgccccgggaataacgaccatggcaaaagcgtccgtgacaaaccctcttggccagtcgtcggggccgtcctcccaacaggcgaccattacgaagcaaatcgatcgcgccaagtcgttggtggccaccggcaatgtgaagggcatggaccgggtgtcgatgatgcggtcggcgttgaaggtctgtgacataggacgttcacgcggtgcacctcaaaacgttgccggacgatttttcattgcgacattaagaaaaaaaacatgatgagggagcagcatttttcgagtatattcaagaatattttttgtctttaacccagaaattagctatcaaaaatttgtgcccttttggtttgggtgtttcatttttccttccctttccagagcaccttcaaacactccttccaagcggccactgttactgggtcggactattcgttaccaggcaatctcaacagggcacttttgtggtgaaacttttttccccctcatttttagcatctgacccgaggccagaatggaaaatcaaattggacgaacaggcggaaaagattaaccaatgcatcaacagacaaaagcagcaaggggaagaaggcgacggagagggaaaagtgccaccaaattcggagccgacaaaagcggacgatggacagcagccaaagcggcgatcgagatggacatgaccacacggcattgatccatgacaaataaacattttttcaatgaaaatccttatttttaatggtttatgccatgtttctgttttttttgcgacttgcgctcctacaaacttcgttttgagatgatttcctcggtcacttttcgtttttccaatgccatctcctcccccgtcacttttccgccgttggcattttgcccctttgtcaaccattttcgacatatttcaaaacttcccaacgatggaatgacattgcatgactttttgccgcagaacacaaaagcgattgatttcactgataatggacaaaaaactgagacggtgcagcgacggacggcggacggacgccttcggttgccggaatggctgaagagggacgtggtggccaagcagagcgatgtgagtgagaaaatcagacaatttggagcggcttctttggcatttggaaatgtttgtgatcccatggataaaacttgaccgtgatttttagatttttggatggaattaaacaaccatccatttttatcaacaggtgaatttgatcagaatgaagaagcagctgaggggactgaagttggccaccgtttgtgaggtacaagtaatttggcaaattaccatataaatcaaatgttaattgctttttcaggaagcacggtgccctaacattgggtaattaagagtaacaataaaaaaatgattccgtttctctcatttttattgtagcgaatgtttgggcggtgggcccggcaggccgtcaaccgcggccattatgctaatgggcgacacgtgcaccagaggatgccggtaaatcaatttaatgccagatttggcgttgtttccattctgaattcgttctggaggtttcacttgccatctctagcattattttaggtcagtctttccaatactaatcagtccggtccgtcctcactttttaactgtcatagggtcagatcagtaaatggtttaattggctgacaaaatccctgggtaaatcacacccaaatcggctgatcagacggaggaaattattgattcaatgggcaattcttaattctatcactaaggatgaatccggtctaagtttgctcttacaggttctgctcggtgaaaacggcccgccgacctccgccgccggacccggaagaaccgctgaacacggcgaaggccgtcgcgagttggggcgtcgattacattgtgctgacctccgttgaccggtgggcaaccgaaaattcgacgcattggaattctcgaatttgtttattaagcgacgatttgtcggacggcggcgcggcacacatttcggccaccgtccgccgtctgaaggagcagtgcccccatgtcctcgtcgaatgccttgtgcccgactttgcgggcgtgttgcccagtgtggagcaagtggcccagtcggggctggacgtgttcgcccacaatttggagacgggtgactgactgttgtggcatggtgttatttataaattgtgcccttttcagtccgtcggctgactccgctggtgcgcgacccccgtgccaaatacgaccaatctctgcgggttttggcacacgcgaaaaaggcaaatcaatcaatgattatgcctaaatcggtgccaaattgcaggcgaatcccggcgtgttgaccaaaagttcgctgatgcttggccttggcgaggcggacgcggaggtggaggaggcgatgcgcgaccttcgcctggtcggcgtcgaggccctcacactgggccagtacatgcagcccaccaaacggcacttggccgtctccgagtgggtgagcccggccaaattcgaccgctggcgcgagttgggcgaccgtctcggattcgtgtactgtttttgtgacaaatatccaatttgctcattttgtactcattattttcctttgttttttcagtttcactgtttccggccctttggttcgcacttcgtacagagcgggcgaatt

SEQ ID NO: 16608 - DNA, 1457 bp, Heterodera glycines
  misc_feature (1311)..(1311): n is a, c, g, or t
  misc_feature (1356)..(1356): n is a, c, g, or t
gcgggttttggcacacgcgaaaaaggcaaatcaatcaatgattatgcctaaatcggtgccaaattgcaggcgaatccccggcgtgttgaccaaaagttcgctgatgcttggccttggcgaggcggacgcggaggtggaggaggcgatgcgcgaccttcgcctggtcggcgtcgaggccctcacactgggccagtacatgcagcccaccaaacggcacttggccgtctccgagtgggtgagcccggccaaattcgaccgctggcgcgagttgggcgaccgtctcggattcgtgtactgtttttgtgacaaatatccaatttgctcattttgtactcattattttccttttcagttacaccgcgtccggcccattggttcgttcctcgtacagagcgggcgaatttttcttgaaaaatgtgatcgaaacgcgaagaataaaagagaacggaggtggaataggatgagcaaattgacgaataaaaacataaatgaaaatattaaaattattttcaaaacaataaaaattagaagagaatcacaatcaattaatgcgttatgtttttcaaagaattcgtttgctaaagtaactaaaacattttattcatttgcattgtttttatgttcttttttgttcccaacttttgaattaatgcccattgaagtcgaagtttctttgagccgaaaggctgccgtttttctcaccggggagagtttcactgttcaggtgaattctgaaaatattatccagtcccttgtttgggatttgtgtgatacagctgaaatctcatttttgtagcctatcgtattggggggataggttgagcccctctcttattggtgttcccttaacatgaatttgatcacataatcagccggggcaccccaatggaaaaattggtattttttgctgaaaactcgattttccttgttgatattccttccaagctctacatcactaaaatttccaaaaaaatatgcgatatttttccgaaaatccacaaaaataccaattttggttaaatgaccgagggaaaatctaaaattttcctataaaatactgccagcatataaaatatgcccccataatactcaaaatcattgtcagatcacattggccaacagcagcgacgacggcgaacggtcgttggcctggggctgtgtgcagttgcattgtgaggagaatgccgtgggcggcgctggtacggcacgacaccaaaaagtgcggcacaacgcgtcgacggcggtcacccgcgcgcggcaggccatcttctcctccgcacccgccattctcttctgcgacattcgcattgngcccggcgcggtggaacagttcgagacgcgcaaggaaatcccggncgatttgccgccaacatttaaagtgatcagcagagaaagactcatcgaataaatggggtggcatttgccagaaatgtcagaccgaagcattgatttgccta

SEQ ID NO: 16609 - DNA, 2457 bp, Heterodera glycines
tcacttccttttttcgatttccctatgttttgtaaatttatttctgcttcgttacagttgtccttttaataaatgttcattactctttgccccccccctttttctcattttctatccttccatcgatgaaaatgccgcaaaaggtaatccctcctcccaaatgcctttgcgatgagctaattccgaaaaatctcggaaggatcatgttgtgagtccaccatttctgacagtgattccgacactaaacaaacataaaactgttctgttgttaactcattcatccgatccgacgatggacgaaagctttacataaattggaataaaaaatgaaaagtgatcgaatcgcttcgctttattcattttattcactcataaaaatcagcgttttcttccaacgaaattgaaggcgtttgagtaatggtaataagggttgtggccatagccctccctcggataggcgacattataccactgaaagaaagaaacgatcatttgcatttaattaacatgacatagccagcagacctaattaatggaatgtgttaataacaaaaaaaagcaaatgaaacaaaagcccatttttaaattcattgaataaaattagacaattaattttgattatattgcaaaaaaagatatatttccaaatttaccataagaaaactatttcgattaacggcaaaagttttgcgagaaatttcagaatcaactttttgtttgaaagaatctaaatttgcgcgattgtttcagttccgggttttcccactaattttggaaaatttctgccgaattacactatttttatttccgacgtttctttgctaaaattcaaattttgccttaaaaaatgaaaaattgtaaataaaatactttttaaatccttttaaggcccttttaatcagcagaaaaaagtcattttaattaaattccgggccctattaatcacaaagagagaatcaattatggtatcatacaatactttaaacacttcttgaaataagctgagtttgaaaaaattatttattaaatttaaatttaataaaattattttagcgaatgaaataatctttttaaaaatttacaaaatttccctccttaactaatgtctggacaatccatcatttaattttattttttaggacaaaaaccaaaaagttgcaaaaaatggtttggtttaaaaaagcatgcttttacgatatttctagttatttaattattttaaataaatgtcatttaaaaattttttaaatttttctaaaaatgattttttttataatttaaaaaaatcaagataaattgttttttatataaatcttgataaaatttggcttaatggattatctatccattgctgaaggaccgcccggaaccaataactgaccccatttgctgattggcgaagaactaaatttaaaatgaacagcaccaataggaaaagtatcgaaagttgtttaatgtacaataataaatgccaaggaaccattgccaatgcaaattaagtatttataggaggcggagaatcagcaaattggcgcaattggcctattgcaaaaggcaccacatttctttgacagaaaaagacgtccgactggtccaagcgatcagagggaagcgaatgaaccgaacgaatgttaggtggcccattggttggccaatggaagggtcttttcctaagtgtgcaaatgtttgtcccacccccctaattatctaattaaacaatgcgttgctcacaatgtctccgttgttgcccgttcattcatttaatcacttttttttaccttttcccatatttagagacgatcagtaacagggatcttaggaaaaaacgggaccggaacatgagaagccgggacagggaccggattttcaaccgggacagcgatttaggagaaaccgggaatttttccatgaaaaaaaaatattttttaagtgaaaatattgtaaaatatctggcaaattcggtgtcattcaaaaactcttgatgtgttaagtctaaaaattcgaatacttaattattagggccgggatttctagtgaaaaaacttttttttttgcttaattgttttgaagaaaggagctcaaaaaacgcatttctgcgttaaaatttttcgattctggtgtcactatcggtcactagaaatcactattttggcgacttcgatagttttttctaccttttcggtactcattgggtttgggtccgcttttttggtcgaaatttttcaaagtgtagccagacaggcagacagtgcactatttccttcttttcttcagcatagccactggtgagaaggaagaaatagtgcactgtctgactgtctgtctacgtggggctgcggcgggtggaagggtagacagtaggcagccgtgtgctcgctgtgcagcagcacactgtgtgggaaagggaaggaatgagaaaaagaagagaaagaaatagttgcactggtctgactgtct

SEQ ID NO: 16610 - DNA, 2096 bp, Heterodera glycines
acgaatactggttttaccaaactaaaagtgcaatgctgctatccgattcggtttttaccgattaattgcaaattttctaaaaatggcctcgaattttaaaaaaattatctcgttaatgggtaaatcgtgccagagtcgaacagagctatgccgatccttttaaatgaatattgtattaccaaactataagagcaatgcagaaattcgattcaatttttaccgagttattttaaaattaaaattaattatttttttgttatttaatttgtgtaaatctttaagatgtaaccaatttaacccaattctttaatccatatttgttttgaacattataatggtaaatttttaagctaaaattaaaaatggctaagaattaaaaaaaaattatttcgtttattaaacggtaatgtgccagagtcgtaccaagcaatgccgacccttttaaatgaatactgtattaccaaattaaaagaccaatgcagctatctaatttggtttttaccgattaattgcgaattttcaagttaaaatttttttacatttaacttatgtaaatttttcaaatgtaaccaatcctaaccgaattctttagtcaatatcttttttgggtacattgttaagctaaaattaaaaaatgcatataaatttaaaaaataatctggtttattaaagggtgaaccgtgccagagtcgaacagagctatgccgacccttttaaacgaatactgttttaccaaactaaaagtgcaatgctgctatccgattcggtttttaccgattaattgcaaattttctaaaaatggcctcgaattttaaaaaaattatctcgttaatgggtaaatcgtgccagagtcgaacagagctatgccgatccttttaaatgaatattgtattaccaaactataagagcaatgcagaaattcgattcaatttttaccgagttattttaaaattaaaattaattatttttttgttatttaatttgtgtaaatctttaagatgtaaccaatttaacccaattctttaatccatatttgttttgaacattataatggtaaatttttaagctaaaattaaaaatggctaagaattaaaaaaaaattatttcgtttattaaacggtaaatgtgccagagtcgtaccaagcaatgccgacccttttaaatgaatactgtattaccaaattaaaagaccaatgcagctatctaatttggtttttaccgattaattgcgaattttcaagttaaaattttttttacatttaacttatgtaaatttttcaaatgtaaccaatcctaaccgaattctttagtcaatatcttttttgggtacattgttaagctaaaattaaaaaatgcatataaattaaaaaaataatctggtttattaaagggtgaaccgtgccagagtcgaacagctatgccgacccttttaaacgaatactgttttaccaaactaaaagtgcaatgctgctatccgattcggtttttaccgattaattgcaaattttctaaaaatggcctcgaatttaaaaaaaattatctcgttaatgggtaaatcgtgccagagtcgaacagagctatgccgatccttttaaatgaatattgtattaccaaactataagagcaatgcagaaattcgattcaatttttaccgagttattttaaaattaaaattaattatttttttgttatttaatttgtgtaaatctttaagatgtaaccaatttaacccaattctttaatccatatttgttttgacattataatggtaaatttttaagctaaaattaaaaatggcttagaattaaaaaaaaattatttcgtttattaaacggtaaatgtgccagagtcgtaccaagcaatgccgacccttttaaatgaatactgtattaccaaattaaaagaccaatgcagctatctaatttggtttttaccgattaattgcgaattttcaagttaaaatttttttacatttaacttatgtaaattttttcaatgtaaccaatcctaaccgaattctttagtcaatatctttttttgggtacattgttaagcctaaattaaaaaatgcatataaattaaaaaaaataatctgg

SEQ ID NO: 16611 - DNA, 1799 bp, Heterodera glycines
aagtctcccccccagatgaattacaattattgaaaccatttatttgttcattttattaaacttataatatttagtatttgtacatataattgatgaaaatttacgggtttttacccaaattaacacatgaaaatttaaatgtttaccaatccggaatccagttccggatccggcaatatgaaaatccggattgaccggattatgagagaccggatccgggatccggtcattttttaaaataccagtccggtccggagaatttggaaatctcggtctctaatttttgcccacccccacccttaaattttgattttttttttgctattttttatcctaaaatctgaccaaaattttctcgtttttttttatcggggatttaattccgttagtttattgataaatatttaaattgccaaatgcaaattcgtcctccctttttcggttcttcgtgttggcgcgtacggcggccgacccggcgacgccggccaaagacgcgttcaccggtttcatcgtggaaagggacacgccggggctaaccgtgggagtaaaggtgaacagcaaaaccatttttagagatatccattaggtattttggctggaaattcggttaagggggcttcaggtccgtccgtgttcagaaaaatatttttggaggggcattcctaagatttttttcagtttaatgttatatccacttttattttttggaactcaatgccagggaagaaaaaagcaactatttgtaccgcttttcgttagccaaaatatcgaaatttttgcaattttgaggtcaaattttcaaaaatagggtaaaatggatggctggcggtgccgacgaggggcgccctcggagaaaattttgaaaattcaatgaaatttgttaaggaaactgataaaattttatctaaaaaaaggtttcctatattctctttaataaatttcacttaataaaatgccaatttgcccccccccccctcttccaaagatgccattttttgattttttaaatagtttttcgttattttgcccccccccccatttccgtcctctttttccaatttcgtatccctcactttttcccgaaggaacggaacatgggccaacggtgctgcgacaaccgaatgcttttcctgcaaaatgtcaaagtgccggcggcgaatgcggtgggccgcgtgggcggcggctttcgcctcacaatgcgcgcctttgaccgcactcggcccgtcgttggtgagcacaaaaaaggggcgcaaggcacggaaacgcatttttttcagtcgtgaaaaatattgaaaatttagtttaaatttgtttacacttttccatccaacaaaacaattcttcggggcggttttttgggctaataaaaaatacgacatggatatattcgccctgccggagagttccaatttatgtgattttttagtaaaattagaataaaaatgcattgattgtccgccggcagtgcagaaagaaccgtctggaaaaattaaattttttgtggaaattggttcatttcaaaaaataattcagacaaatctgaaaattcaaaactttttgtcaataataatttgagaaattgctacacacacttgggacgggccaggacgttttcgcgtgggggacccacgcgtttcggcgctcgcgtttcggcgctcgcgtttcggcgccagcatgtttttagctataacttttttctttgtaaaccaaatccagtattgttggtgtcgttcgaaagcttaatctatttagaagctttttctaagctattgctttgcgattagacaattatcaaaact

SEQ ID NO: 16612 - DNA, 2259 bp, Heterodera glycines
tgggaaaattcgttaaaaattcttaaaattcaaaaacccaaaaaccgttttttaggcctagctcgaaaaattttgaaaattttcgaaatttttaaatttcagaaaatcgagcttccaaaactctacaataagtctgctggcaccccctcgctcagttcaaaccctggcgagttattcgcctggtactgaagtgtactttttgagcacgcttcagttgccattttctgcaggccagggggtggctctattaaaaaaataaaaaataccagcatgtagaggacactttggcggggtgccctcgcagcgggcattttttgatcagagttttagaaaaaaagttacgggccttcaaacgcaagcaaaagtgagaaattagccgccgggactcagttggccaccggagcggaaaacctatagttttatagtgattagaagaggtacaacagtgatcagaagaggtacaactgtgattaaaaaaggtacaaaagtgattcgaagaggtacaaccacgggggaagaggtacaaccacgggggaagaggtacaacaacgggggaagaggtacaacaacggggaagaggtacaacaacgggggaagaggtacaacattattgaaacaggacaacattattcaaaattaaataaaataaggaaatgtatttattaaaaaataaggttaaaaatcgaatgctggatagttacaaccacgggaggtacaaagtgattagaagaggtacaaccgtgattagaagaggcacaacagtgatcagaagatgtacaatagtgattagaaaaagcacaaaaattgtgaaatggtacaacaatggttaaaagggtaaaataatgattttaaaattaaacaaataattaaatggtttatgaaaaatagaattaaaaaatgtattaataatttttaaaaaattattaaaaaatgctttcttttattaattaaaaataaactttgaatttacaatgattgagtattattgtattgaaaataatttttttgacaatttctaattaaaaaaacattaaattctttaatttaaaaaaattattatttttaaataaaattttcaccaaaaaataatttaattcaaatgaaaattttttatttattattaataaaataaaaatattttaaatgaataaaaattgaaaataacagtaaaataaatagaaaaataaagtacaccgcccggattcgaacttcccccccccccctcccccctcaaatgatgcctcagaatccccaatcacacagggattctgaggtcttatcgatgttaaaagtaaaatctgatcacgtattcgtgatcagcgtcataaaatagccctaatgacatgtttttggaagatttttgtcgaaaaaatttttccactcaaaaatcctatgctcacccctttggtcccgaatctcaaaatcacttttatttttataaaaattcttaaaaaagtgataaaaatgccaaataaaatttatataatagagaaaaaaattgcggattttttcattatttaaaatttcaaaaacacctttacagaaccgagttctgaatttttttctggaaaatcgaaaatttccagaatttctggaataactttttttcttttgaatattataaaaccaattaaatctcataaaattctccttatttttctctatttttaaggctttattatagttaaatcgatgaaaccatcaccgagttataaattttcaaatattaacccaaatttccaagggctaaaaaattaccaaaaaataaagaatttttaaaaaattccaaaaatactgtaacttaaaacaaacatcatattcgtgctcagcaccccaaaatacccaagaaaaaaattttacacccaaatttaggaccccaaaaaaattttcgaaaatttctagggggcctagctcgaaaatttttgaaattttccagtcatgaagcacaccattcgatagcatttaaaattctctacaaaaatgttctaagacaatttttggctaaaaccaacccctgacgagttatgggcccgggactcaaatgtcccgctgaggccaaaaattttttctatttccgggaaaaaatcgaaaattttccgaaaaaaataccagtcgatagagctcgaaaaactatgttttggaagtggtcttcgtttttctgcgaaaaattcgttaaaaattcttaaaattcaaaaacccaaaaaccgttttttaggcctagctcgaaaaattttgaaaatttttcaaaatttttaaatt

SEQ ID NO: 16613 - DNA, 1537 bp, Heterodera glycines
gattttgggtggaaaaatttttgcactcaaaaatcctggtcacccccctttggtcccgaatcccaaaatcacttttatttttataacttttttttaaaaagggataaaaatgtaaaataaaatttatataatagagcaaaaaattgcggattttttcagtatttaaaatttcaaaaacacctttacagaaccgagttctgaatttttttctgaaaaatcgaaaatttccagaatttctggaataactttttttgtttttgtggtataaatttcaaataaaactcataaaattctcccgattttttgctatttataaagctttaattcaccaaaatagacctgatctgaactgagttatgaattttcaaatattcacccaaaatcccatgggccaaaaatttcccaaaaaataaagaatttttaaaaaattccaaaaattatgaaacgaaaaatgaacttcatattcgtgctcagcacatcaaaataccccagaaaaatatttttcacccccattttcaacccaaaaaaaaattctgaaaatttctaggaggcctagctcgaaaatttttgaaattttccgggcatatagcacaccgttcgatagagcttaaaattctttacaaaaatgttctaagacgatttttggctaaacccaacccctgacgagttatgggcccgggactcaaatgtcccgctgaggccaaaaattttttctatttccgggaaaaaatcgaaatttttccgaaaaaaataccagtcgatagagctcgaaaaactatgttttggaagtggtcttcgtttttctgggaaaattcgttaaaaattcttaaaattcaaaaacccaaaaaccgttttttaggcctagctcgaaaaattttgaaaattttcgaaatttttaaatttcagaaaatcgagcttccaaaactctacaataagtctgctggcaccccctcgctcagttcaaaccctggcgagttattcgcctggtactgaagtgtactttttgagcacgcttcagttgccattttctgcaggccagggggtggctctattaaaaaaataaaaaataccagcatgtagaggacactttggcggggtgccctcgcagcgggcattttttgatcagagttttagaaaaaaagttacgggccttcaaacgcaagcaaaagtgagaaattagccgccgggactcagttggccaccggagcggaaaacctatagttttcccagatgcgcctcaaaaagttgtaagacccttccaccactttcagacccctcccgacagccgttcgactcaaattagtttttaagacgaaaccccctttttctctatgtatatataactagcgtgttgtggcgcagtaattgctcggtgtaggcagttggctttgcacagtaattgctcggtgcagacagtatgctttgcacagtaattgctcggtgtagacagtatacttttggtatatatgggcgggcgctgacatgagacgcggcttcgccgcgtcgcgcaaaggacttcgttgctagtgcatgcgcg

SEQ ID NO: 16614 - DNA, 2787 bp, Heterodera glycines
  misc_feature (1602)..(1602): n is a, c, g, or t
gacacaaaatttaagtaactattttattttttcttcataatcttcacattataaaaaagtatatcttctatatatctcttgacttaaattgattaaatatttataatttcaaatttctcggttactaaatgtttcaagatagccctgaaaaatgccgttttctcggtaggttgttcaatgagtgccgtgttaacaaatatattcgcagtttcattttgcaaagcatgtttgggttcaaacttcactcataaaaacaattaaatatgtgtatatttttaattaaattaaaattttttaaaattttcatggtttttgtttttcaaatttataaattctatattttgtgagaaaaagccttggtcttttttgaattctaaacacataagcatttgtcattttttgcttcgcctattttgctgcactttcattcttcagttattttgcataattattattattattatttatttttaaattttgccgtgtaaaaaaaatcaaaaaatttttcaaaatttattttatttttttcagatgcgtcttattgttgacgatttttttgaccaacaagtgcgacagttttccaccgaactacgtcttggcaatgcgtttctgttccttggtggtgccccgtcggggttagcctcccaactcgtccccgacaatttgtaccccttccggggttgcataaaaaaggtgtgttttgggtttatctttaattatccataaaataattacaataatatatatatatatatatatgtgtgtgtgtgaactaatatgaatataaaatatatcatgaaaatttagccaaaatttcccattttgcaaaatctgttaaccaatttaaaaaattttcacagaggcgcttctcggcactgcatatttttttttttaaatttatgtttaaataaaaactcaaaaattccccttttttggactaaatcaacaacaaatccatccaaataaagaaaatatgaagatatttgggtaataaaatggtgaaaagatgccggggtggagaacattttccgttgatggggaaacgaataatgagaaatcattaatgcccatatagattaattgattgagtgacacatcaccagcagttgacgaatagacaaattaggaggaggcaacaaaaacaattatcagagaacaaacggaccaaatacaactcgtagtgttttaaaaatcgttttaacttttgtcaaagtaaactaaattaaacatttttggcgctacttgcaaagtttgaaattttttttcacttttttttggtcaattttttttttgtttatttttaatgcaggatttgcttttttaacatgaaacgtatttcatactatttaataaactgaaaaaaacattttaaaagaaaatttagcgctagttaaaaattgacaaattttgagttttatcaaaaaccaaaggggggaccctattgttttgcaaaatttttttgagataaaaaatcgtgaatatattttttattcgccataattatgctgttaatacttaatattcatcattatgtgccaaaaaaacaaaaaaaaaatgaccaaaaaaaagttaaaaaaaatttcaaaagggtactctttgcanagtagcgccacattttttggtctcaaacgatattagcaggattttggacacggatcctgggaaaatcctaatcaggattttgtcccattcgagctctagtagctaaatgtcaaaatcgtttaaacagattgctttccgtctattttaattattttacacatataccatatattccaattatttgtatgaaaaaatttttaaatttataaaagtctacagtaaaaaattcttttaaattttaggcctttttccaatcgggtcctgttaagctcaaccttattgcattggctgaccaaggctatggccaatcgcatggtaatctaatacattttattcagtttttaatttatttttctcaaactattagaatttaatttacataacttaaaaaaatttgttcccaaattttcttaaaaaaaaaaaaaaaattaaattttcagttcaaacatttggcgatttatcctattcatgttccccaaatgctcaagtgcctgaagtgtttgccttcaacagtggcaaaaattttagcaaattgccagcctggaaatcgccctccaggggtaccctaggtaaggtgaattgttttttcgaaatttcaaaaaataaaataaatttgtttgccgtttttttcagcgtttcaatttcgcacacttttgccggagggacttcttttgtaccatggccaaacaaattgtccaaacttcaccatctgtgattacttggcttttgaactcattgatggacacctaatggttgtgaaatttttcaaaaaattaattaatccatttttaatttttcgatggtaattaacctcggatcagggcacatccgattgcaggtgataaaatttgttattttaaattattattataataattattattgggttttttcataagccgttcacataatcgagcatttgaggcaaatttcccccgattttttggatttgaagggctaatttataaattcataaaatgaagaattgatggatttgaggtgcagttttttttttttttttgcctttctttgactcaaattggcaatagtaaattttatcgaaaatgtttaaaccaacttttatatggcttcaaaatagtaaatttcaaacccctccgattgatacccacctttataaaaattagatttttcatgaaaaccccaatttttttttgttgtatattt

SEQ ID NO: 16615 - DNA, 2495 bp, Heterodera glycines
  misc_feature (86)..(86): n is a, c, g, or t
  misc_feature (130)..(130): n is a, c, g, or t
  misc_feature (2489)..(2489): n is a, c, g, or t
agcttgcatgccgtgctaggtctgtaataattattcattatgtaagaacttgaaataaaaccttagagaataatcattgatttaanaatttgttttagatacttttattgaatataataatttacaggantttttactcagaactttacactttttcattgtgtattcaatttctacaaatactttaaaaaaataacaataatgcattatataggcaaatttaggataaaataaacgaataaaacaacaattttgagattttaatatctaaatataatgaacaccaaaataaaaaaatgattcaaataataatccgtaaaaattggacaaatatcttcatatcgattaataattagtaaatacttcaaaaataaattaatgtattcacatttaattaataaaatagcaaacaataaaagaaattaaggttatttgatttgtataataatgattcaataaagagaatatttaaaataaatggttcgagataaataatttaaaatactaaaaataaaaataatttattaacaaaaaacctaaactaatacgcaattattatttctgcaatgcatgagatacaattaaatacaaaaaaaaaattgcgtaagtcattctttatttcaaatcactttttttttacaatttattcgatcaaaaatctatccatttttatatttttagcctcccattattatttttaacaattttggggaggaaatcacgcaaaattgataatttcagtacattcgggaccaaaagatcaaaaaattttgcgtcagaccttaaaatttcttgataaaatagtgacatatgccataaaatagtttaaaaattaaaatttaaaacttggcaagtaatggctttaagactgctgaatgttttaattttttcttatttgcataatatatatatgtttctttaataattctaaatattaatatacaaataaaaaaagattatatcttactcttcgataataagtcattaaagttatatttaattcatatctgctctaggtattgccagataaatatagaatattttttccttttccaagtattttattttgcttaaaattattttcaataaataaaattttcaaattcctaaactttcattttaatatttttgttaaacattgcccattcgtatagttgtagttctgaagttgttcaatttttgcataataattttattattttttcttgtttatttcttttttatgaaaatttttgagaatattgacttataaagtttttgtaataattgggtgatttaattattgttataataataaattttaactctatttaaaattattataaattgcttcttatttttcctaatcgtaaaattaaatttatttcagtcaggaaaattccaagatctttgaattacttttgcactttgatgcaaaagcataataatcaagtgtaaaatttatatttaaaattattgtttaaaaatgttttttgtatattgaaaaaaagtccaaaaagcaacttagatgcttccagtttccattaggttaattatttctattgtttcatgatgattttatttatattattgcaaagtaaatgatttagtaatttggtgcgatttattcattttaatcattttgttaattttgacataattactctttgttcaatattttttgcttattaattagactgtagaaaattacttttgagaatgttatttctttgtttcttagatatttttatttttgatccgtcaaaaattgattttcatgtaactattttacaaaatttattttaattattattatttaagcttatttttatttgtgaagttcatgttactcatggcaattaaaattattgttttcagcaaaaaaatataccaagtccacagcagtagtgcatgtacagtaaaagatatgtgaatattcattatccattttcttgttctgtaaatacattattagaaataaaaccataaacataaagtcttaatcaaaataaattatgaacataatattatattgtagaatgcatttaattaacaatgattctattaattacaaaaatcataatatatttattattaaaatttatttaattttatcattaattcattttatgaatataaaaatacatacacaattcataaaagtaacagatgagagttttagtatattatgcaaaaaaaaaagaaaatataattatatattttttatgcgtagcatcaagttaaatcaatttagatgaaaattaagatattcaaatagtgtcaattattttcatgatgtttaatttgcaagattattttaaaaatagaaaaaatcaaattactaataattttatttcaaactataaaatttaatttttaaattaattttcctaattttctaataaatgcatctttttcatatattaaaaaatgtactgtgattaacattcataaatattatttagcgcattaatgaaattaccatttattactacagacgaaattactanatcagt

SEQ ID NO: 16616 - DNA, 1224 bp, Heterodera glycines
  misc_feature (123)..(123): n is a, c, g, or t
ttttataattttttaatgttttaataaataaatttccaaacatttgaaaaaagacattattaaaaacattatgctcttttttcatttgtatttatttatttaattaatttttagttttttttntaaatattccatttaattagttaacaagaattttttattgataaaagccttttttgttatcgtaagttatatatattttttaatagatcatctcttggcaaatattactttgttgaagtacattataacgcgtgttgttttcaaaatctattatttttaaattactcaaatatctaaaatttatttaagctactatttatctttagttttttgcgtcaataataaatatatttttaacttttgtaaataatttctcacgcctattatagtctttttgaattacatataaaataagcataatgattagagaccggaattttgaaaatgtcgggaccgggcccgggctcgggcttagacaattggccgggcccgggcggcccggccaaaaaaacccgtttaaacgggcgtcccgggtccggtcaaaaattttggccgggcgcccgcagggcccgggcttttttcaaaatttcgaaaattggtttgtaaaatgagaaaattaggtacgtaatttctatttttgctttgtttaaataattttatgaaaattttttatcattcaacaaaagtcagtcaatatttgtaattcagcattgggaaaaagatggtttttgagcgatttggtgctggattcagagaggctaaattcatatttggactttccattttctttacattctcggcactccgcgattttgacatcctttgatttttcaaataaacctattttccagattgatgcattcatttctgaaaaacttttaaaggaattaaaaacaaaaagattggcatgtatgtacgaaaatcaattggaatatttatgtaattatattctttcactttatattatttttaaaaagttatttcctttaatttgcaatgttttttttgaataagttagttttcttatttaaattttattgtatttcagaatgttgtcatatttgctaatataaagaatcatctatatattttgatatttaaatttctgttcgagaacatctttagatagatagtattttgcaacaatagtaaatttattttttttaaaaaaagaaaatgaaaggcaatttgtctccgtttaaaaagattgatatttgtgat

SEQ ID NO: 16617 - DNA, 3977 bp, Heterodera glycines
  misc_feature (90)..(90): n is a, c, g, or t
  misc_feature (127)..(127): n is a, c, g, or t
  misc_feature (168)..(168): n is a, c, g, or t
  misc_feature (3804)..(3804): n is a, c, g, or t
  misc_feature (3810)..(3810): n is a, c, g, or t
accattataattaattaataatgtactcacagcttaaactactgaggaaaaaagaaatgattataaaaaattggatgtctccttgaaaanagagaatggaatttgaaagaattggataaattggaanaaaaatgatagaatggtgactgatctgataataattgatanaatggaatgattaattgataataatttgtggaaattatttggatatattatagaatttgattgattaaaatttggaataatgtttaggtaccggaacaacgaactcagacggcgccaatccctccctccccacggcggacggccctcaacaaccgtaaatatgtaaaacaaacataaaattacatatatatattattttataatataatattatgttttttgtatatcctttacagaaaagtaaaattaccttatttttaatgataataatgagaaacccaataaattaaaacaagaacaattgagtatgggatgtgttggattgagcaacacacagtgacgcgaacggcaatgtgcccttcaacgccagaacaacaatgacggcaagctctcgacaagatatttaaaatctgaactcatccaaagcaacgtcaattttaaaaaataaatcaaattaataatttgcaatcttctcaaacaaaaaatatttaaattaaattatataaaataatgatgcgaaaaatgcatcattaggatgttttggtaaattattattttcattcgaaaaatattgcctaattttatttgatttaatttttttataaaatttcttaatgattaataaatgcacatatttttatatcctttagtcaagattgctgaaaaattaatcgattaagggaatttttaattttaactttcataatgattagaataataaagctttaaaaatttttccattttatttacaaattttgctttttattgtaaataaatttaaataaataataaaaaaaaataaactaaactttttgaaaatttttagaatatacaaaacaaagtgttttgccggtccggaccgaatttacattttcaaaagcaaccggtttccggatttggtcaaaccagaaaaccggtcaatccttatttttccaaaaaaacgccggactgttttacggatccagtaaaaaccggtaccgggtctccggtccggctcggcctctaaaacatacattaggaaaaatataaaatttaaaaaacaaataaaaataaactggtccaaattttagagtaacttttatttaatttataaaaaataataattttaaaatacactgcattaaatgatgaaaaaataaatctacataaaaataacatgaacataagaccgatgaaataatcttattatgcgaaaaataataaattaaaattaaaataataataataatagttcccattttaaaaggcgaacattaatggaacaatttgatgagcgcttcgattaaattaatattagtatttcttgattaattaataaacttaactttatctttcttctcgaattctgtcaaaaattacgacttttttgtccgataatcatttagagacgcctattaaatttttggaaattatattggtagattattgtgggcatatattcatattttgctttatatctattttcttctgttatatattattacactcgggtttcacattatctattgaaattgaaatgaaaattaattgaaaattaaattttctttatttcatttagaaagaaaagtgaaattaggactttggagaattataaatatattttaatgaaaagaaaattatgaatttatatttatttatttaaaaatgataaaggcaattagttttgaaatgatatttatatatatataatatttaatatgacacgtaaatcatctacgtgacagtaaatttacccgaacgtgaatttgcccgtgaattgtgatagtgaattgacacgtgaacactgccactcaatattacttgaatcatctaggtgatcatgaattaaccgtgaatctcgaccgtgaccatgcattaacccatgaattgggacagtgaataacacgtgagaatggcatgtgaatgaataaatattggtataattaatattctctatttgaacactgaaaaccatgaaatatttgatgtgatcttaaaatataaatcttgaggacgagtaaaaataaatgtaatatttctatttattgtgattttattactgttaataattttattttgatcattttatttgtaataaaatatgggtggtgtttttttcaattttcttgtatttttcctacagagttttctcaaaaatgccaaaaagaaataaatcttaattaaaaaaatttatcaaaaaataatttcgatacgataagtgcctataggtgctattgtcaaattttgaatatttattgtcttttttccaaagtttttcttctgtgctggtaataagcacattcattaaataattcctagccgaataattcatatttctggaatgttattataacaaatgacggaatatttcatatacaaggaatgatttcaacgtttataaatgtttttatttatttcttttaaatccgataaaataaacctaaatataaatgtataaattcaattcattttattctttttcctggtttatttttgtttttatttacatttcattcattatactgttcgtaaaaataacaatttaattatgagaagtttaattataagttgttgtttttactattatttttttaacgtatttttaggatggttcccttgcttaaaatgaagccattagacatattttttaacaaaaaacgcaatttttaatcacatagtcagtttaataattttaattgtttttatttataaggaaatattatataattttttttatattttggattttttacgaatttaatttttatgaaatcttttttattttccactcggcttttcattaaatactttttgttcaatttaaattctttgaggttataattgttagggcttcgttttttaggcatttgcctattttgaactttttgtgtttaatgcctaaatgcctatttttgtgccaattacgccaatttgccacctattttcaggattttcgaataaatccttaaccaaaatgcaataaaaacgaaaaatacacccctaagaaatgtccgaaaaaatttcaaaaatacacccctaagaattgaaaaaaatgttcacaaaaattgacccctaatttaatttttttttttttgataaaattttttgggtttaaaaattttccttattcgaaaaaactttaaaacaattgaaatataactaaaattaagtgtttggatgaagttttatgttttttgcttatgttgtcaaaaagggaagcttctacaatagatattttttcgttttccaattttttaaattttattttgtgggttttttttaattttcattagcttaaaaattttcggctctttaaaaatataaataaattttgtcatctattaatttctttaaaaatatttgaaagtaattaaattaaaatttttattaaataagtctatattaatcgatggctttcggtctgtaatagaagaatccgaaaaaaattttcgcggcaaccaatccctgaagagttacagacccgggactgaaatggcctgagaaggagaaatttttgcaaaaaaattaaataattaaagcatttgttcatatgtttgtgtggtttagtgactataccttctgcctttcattatttgtcgctagtgttcaattccccaccgggatagatattttttatactttctttacattatttcnaatganatttaattaataaaaaatcaacttataaatttatttttcttttttaacagcctaaaccgcaaatttactttttattgattttcattcgataaaaaattctatcgatttttgaactataataaaatttgtcaattgacccgaaacccgatcctgaaacccgatatttt

SEQ ID NO: 16618 - DNA, 1684 bp, Heterodera glycines
  misc_feature (15)..(16): n is a, c, g, or t
gtccgagcaatgggnncggcgttggcgcaaacaccagcaaaagcgctattctttgccacactaacccagcattgccaacgctgcaacgattttgagcttaaagcgctccaatctggtgcacaaaaattcgaaaattgtttttaaatattttaaagagcattgtcgtccaacgggatattttgatgtgtacacgtgcccagcagtggcggagtacaaagtggacaatggcacaaaatcacatcatactatcatttataagtgagaaaaaaacaaatttttttttcaattttggcgctagtgaaaaagtgacctattttgaaaattttttcaactttttttggtctaattttttttctttatttatttgcatataatgaatattaagcattaacaacacaattatggcgaataaaagtatattcacgattttttatcaaaaaaaaaaaaattccaaaacaaaagggtccccccctttggtttttgataaaattcaaaaatccaaagtctaaaaagtatctttttgaaatttttttcactttttttttcaattattaaataacggaaaatgcgtaccatatgttaaaaaacaatttacataaaaataaagagagaaaaaaatagaccaaaaaaagttgaaaaatttttcaaaataggtcacttttcactggcgccaaaattttcttacccaaattttaacataaaactcgcgaaaaaaatcgaaaacgtcatttcctaacaagaatttttttctagaatgaaatttttttcgaaaaaatggcaaacgttttcctgcgcagcacctatcggcaaaatggacgacaaaattccctcaaattttcaaatttttttttagtaatttgccttttatgtcccattctaaatgttaaaaaaatttcatttctctcaaccaatctattttttaaacaattttaggccctgcttgaccatgtcccgggaccaggagagtgacagcttttatatgttttgtatggcatcaatggccagtgctgtgctgtccgcgctgtacgttcgctggcgtcgtgaactgattgaacggcgtgcatttggctcttcggcacattcatacgcccgattggccaccgctgtgggggacaattgaatttcgttttttttttttgtggaaaaccaaaaattccttcgatggcacttttgcacagtgataattagggccccgacttttagtgacaaaaatcgcaaaatagttaactaaaattgtgacgaatagtgacataattttcagccaaaaatcaagcaaaaatttttttattcactgattgcagttgcaaatgaagtaaatttattttctaataatttcgtggcaaatattgacatttttaaaccaaaaattttgtcaaaaaaaattttggtggatgaatttttaagaaaatttttctaaaaaatttttaggtcgattcttaggggtgtattttttggttttttggcatttttgttaataaattttactaaaaatgtcgaaatagtgaaaattagtaacaaaaagccaaaaaagtgaattttcacttttaagtgacaaaactccaaaatagtgatttccagtgacgaaaaatgacgtccaaattaaaaattttaacgccgaaatgcgttttttgagctcctttcttcaaatcaattgagcaaaaaaaaagttttttcactagaaatc

SEQ ID NO: 16619 - DNA, 2446 bp, Heterodera glycines
  misc_feature (105)..(105): n is a, c, g, or t
gtcatgttcgtattatttttctgcataaatgttaatttgttgaattaattgccatctttttatttaccaactgggatttagattaaaaaataggtacatgattantagagctccttatgagctttttttgtgtaataccacataaattaactaattaagaaaaaaaaatcgcgttcaaaaatatttaagagagaaatttaatacatttattttgccatttaattcgatgacgtctacagttgcaaagccaaaggagcgtcagttccaagtctgttttattaaaaaaaaaactaatttttttctagggcagtccaaatttaaaagagggtagtgatcgtacccttcgtggtgagaattcgaactcagctatatagctcggggtgtaccccaaaaattggataaatttttctgggacgaggtcggggtgccctataccaacttaataaaaattgagaaaacttggaaaaaaatttatttggtggctgggcgaaaaaatgggctccatgaaaaaacggggctgttcgttatgcctccaacaaaacaatcatttttaaaggttgtgccggtgccggcggtgtttactcgtggccgttgggagtgcattgactacaaagacacgggcgccaacccttggccatgtccaccgttgcccatcgacagcaatcggagcgaccaacagttgaccatggtttggtttttaaattttttgtttaaaataaggggcttcacccccagggcttgggtgggggtaccgatggaaaaaatatgttcagtcaatttcgatttttttaaaatttacccccttgggaggggcaggtacgtacgagtgcccgccggaatcaggacttcggtaatgagtcgtgattttcgctctatctaaatagaaactgctgttgcccgagcggcgttttccttcaataaaaaactacgactcagaaaacccaaaaatggcaaaaaaaaaataatattttttttcataaaacctctcgttttttgcgaaaaccgaaaatccttagcccctcctccctcagtaaaatcacatatattttcttccatccaaaaaaacagaatgctccccctccgccgtcgtttcttgtgccatcctcctccgtatccacctgttgttcgcccagcactttcatcggcagcggagtctctgccgtcgtccccacttttccgcctccatcggcggcgagcaacgccgcttcaacggtcgccggtgccacaacgccggcggcgactgctgtgacggcagcgactgcaattggcggtggtgttgccacggtcgctgtgacgagcggcggcggcagtggcgcaccaacgaccaccgcttcggtgccgcaggcgtcgtcggcattttccaatggcggcggcacggcgacaatgactgcggcaattccctccacattgttcgccgcggtgggcactccgtccgtgtcatcgtcatcttccgcctttttgggttggcaaatgggggcagcagtttccccccccccaatttttccataagcagcatatcttttataaattttttaaaaaacttatcaattcgtcatagaaattttttaaaaaatcgctagaaaaaatttcattgttcttgtaattttcgcataaaatttttcgatttttgaaagatacctaatcaattttttttttacaaaaaatatgaggggggggacgaaacgggggcctaatgcacccggcaaattgctgaggaaggagagatttgaactgaccaatttgaaaaaactttatggatcaactcgtttctatcattttttaaaatcaatgttttctatcttttttaacagttttttcgggaaaacgatacctgctggggggatgtacgtatttcacgtaaaaagtttcttatataaatgtgaaaattcttaagggttacaaaaactgtaagagaagattcaaaattttacgaaaaacccgttacgttattttctttaaaaaattacttaaattttccagagagtgttgcgcatccgtcggccacccctctgtcgtcgtccgaggccggcacgccgatcaccgaattggcgccgccattgatcggcactgtttctgcaacgggcacaatgtcggcaccacaataccaacaacagcaatcggtgttaaaaaaaaaaaattgttgtttgcttataaaaaaaattcgattttcatgtcgaaaaaattttatttgggttcattgtcattaaaatttgcaacaaaaaaaatttcctttttagtcccctccaaatttttcggccaacaccagtgtgccgcattttgacatttctccggcgcattctgtgccgacaacgcttggcactgagtttgtgccatcgtgcaacatttcggcaccggataggtaaacacgtcaaaaaataaaatttttgtttagcaaattttaaataattttcatcgactgtcgtcgaaaattcttttcccgattgat

SEQ ID NO: 16620 - DNA, 2976 bp, Heterodera glycines
ctatgtctaattcatgtgcacatttttgtatttgctttgtgtattttttatcgtttggattaagttttaatgaattccttcgtaaacttattatatcacataatccagaattatttgtccaaaattttattcacaattttccaataaaataattatttccgtttttattcagtaaattttagtgggatggaaaggggattgattggatagtgggaaggtaaacattgactaccactcggtacccggcaccgactatttaccgagagaaactttccgcgtttgcataaaatggtcaactgtgattggctgaaaaggttaatccctccctctcatactggcgaacccttttcctttccactgcagatttggtgaaggttgattggctgaaagacaatttcctttttttttcaaatatgacctctttatttgatatatgagtggaagggcgatgattggcggaatgaactgtcatttcctctccgataatcattcaataataatgatgagtaaatatgaaattttatctataaaagaattatcgtatccgcaatattctggtttaaaaataagaaaattatgcattttattcacaatgaagattttttaaataaaatttattcttaagaaaaatgaaaaattcttcttcttctcctccctccaaacgttctcgccgtttttttatagaagagttacttcgtgaaccatataatgagctttcacttccaaaaaaagctccaaaagattacatcaaaaagctggattcggaaatcgaacatgtgccaaagttcaaattggtgaaaaacaaatcgcgttttattatcaaagacatccctgctgaccctgaggcactcctaatgggcgtcttccaacattgtatggatgaagcaattattgacagccgtcaaagtggagttgaaccgactcatctcggatgtattgtttctagccagaacctttcttccgacatttggatccccatttggcagcttactcctgacaccattaacacaatactaaatcgcttcaacgacgttgcacagagcaaaaaacaggatggtgtgacgctgtggggtgaaccatttactgttacagtaacaacacttaaccgtaatgctctaccggcgaagcgtcagctgaaagggggagcagcccggaaattagcaccagttcaccacaatattcatccaaattgtcttattaaagttaaaaatttataatgtcttaattaaaaataaattttagatccaaaattttgatgatgacaattactgtttattttacgctatccaagcaaccctggttcgatcaattggtgacttggatcgtcgtcgctttcatgattacgtcaatggaaacagtgaaatgagaggaaaacttaaaaatgatgctttggaaatgatgaatgctgttaacgcaccagctggtcaaccaaattacgatgcggaagtatatgtgccaagaattgtggactggtggaatggggaaaaattcgtgggccaatggaaattcaaaacatttctcttcggatcagcaggccattacaagcctttattcaaatatggaccagaggactatgttgtgccgatcatcctttacttcgaagagggacattttaatggtgtgcagaaaagtggcaatttgttcggcaaaccatattgtctaagttgtgaaaagacctacgatcggccaaaacgtcacattgtcaattgcaaagcccgctgcattaaatggtaataaacaattttaacaatgaattaattatttttaagctcccaaatgggtccaatatttccatgcaaaccaaataatggattccgacaaaaatgcaaagattgcaataaattattcttcaacaactcatgctatcagtatcatctttcatcggaattttgcaaaatgagcaaagaatgcaaatattgtggtgtggtttgggatttgcgtaataatacccaaaatggaagagaggttttaaataaaaactacatttctcaataatcaaattattatttagggtcacaaatgcaatgagcgatggtgcgaaaattgtcaaattttccacgaattcaaacgggggtgtttcattcgtccgctggagttaagcccaaagaacgaagcacggggatggagattagtcattttcgaccttgagacaatgcaacacgaaccagtggatccacaaatccctgagcgacggaaacaccaagtcaattttgtcaccgcaaaagttgcttgtcctgactgcatttcaaatggacaatggaaagaaagtttgctcggaaaaaaatgcaatatttgtggctaccatcggacgattacattcagccaaatgccatttaatgggacaactgtagatcgacaagtaattgaccgacatcccctggtctccttcgtcaaatggattctatacaatttgccaaaacaatacgacaccattgcatattcacattttggaggacgatttgacatggttttggttttccgagaattattcatggaagggctaaatccgtcaatgatcaaaaacggcaacagattactcgaaatgaaagtaataaaaatatttttaataatatttatttttataatttttaggtaaaaagtcggaagaaattaaatccaaatatatcattccgagattcttggaatttggttcctggcccattagcctcactggtcccaatgtttggcttggacgttcaagacaagccgttctttccacatttggcaaacaggccggaaaattacggctgtcaaatatttccgacgaaatcaaactatttggccggtgggatgaatcctgagaagcgtaaagaatttgacatttggtatgctcaaaaccaaaatcagccgtttctgcttgatgaagcattagccaggtattttttataattttttgaaataaccaaattttcagttattgtaaaaatgacgtggatattttgatggctggccttatcgccttcagaactgaatttt

SEQ ID NO: 16621 - DNA, 1595 bp, Heterodera glycines
ccccttccccccctggggggtttcaaaaaaaaaatggacttttatctaaaccaaaaaattgtcgcaaaatttatatttaaaacaaaacgaggagtgtccgtcgcgtacattcagctcactttcgctcatcatttcatagaatggggcaggcgttttggagtcctccgccaaaatttcgtagcccaaagtgccggcgccgggggtcggcgattcggcgccgttcagcaaaacactttcgttgtcctccgcctcctgttgcagttcgtcagcagtaccaccaccaatcggcctcggctgttgtccggcggaagaagtacagggctctcaaaaaaggaaattccatgttgagacagcgaatttttgcaacaaaaaaaaagtggcactattccagttcaaatcataaccataaaaatttagcgaatggccatattttcaattagcatgcaaaatttgaaaattaattaatttggctgcagaaaaattatgatttcgtcaaaattggggcaattacattccatttgatttgatttttttaattttaaggtaattttagtagataataaaaacgaatctatgtggtcctaaaaaaaaaatttttttttttcccttttttttggtcaaaattttttttttgtttttacacataatgatgaacattaagtattaatagcacaatcatggtgaataaaaagtatattcacgatttttaaccaaaaaaatttttacaaaacaaaaggttcccccctatggtttttgataaaattcaaaatctatcactttataagtagcgccaaatttgcttaacaggcccaaataattgccatattcgtgatcagcgacctttaaaacccccgggtacttggtttcaggactttttaaacaaaaaaaaattttgaccaaaaaaaagttgaaaaaattttcaaaaaggacaacttttacactagcgccaaaatgccattttttgcaaaaaaattccactgacgagctattgcttcatcttcgtctgcttcttcatggagaatgatgtcgttgttgttgtccccgtccaaagtgatcagattggcctgcggtcggatgacacgaaatttggccacaaaactttcatgcattttggccaacgcattgcagcagcacatcgatgatgacgaacaagaagaagccgtggattgttgctgtctggccattattttggcccaataatgttaaaaaaggcaaatagcttaaattatggggtatttaagtatttgttatttgtccgaagattttttgaaaaaaaaaatcacattattttaaatcattggcgtaatatataaatgccaatgttttcaaaaagaaaacaaaatgtcttaactgtgaccaatagggactccatttttaggcacaaaaatctcgaataggcagaaaaatggacaaataaacatttttattaacactttttatgtagttagaaaacacaaaaaattagtcaaaaaaaatatataataattttggttacatttcaattgtaaatgaaattattaaatgtcttacaaaggaggggtcggcatttttgagaaaattttatgggctctattttttttattacttttgctttt

SEQ ID NO: 16622 - DNA, 1063 bp, Heterodera glycines
  misc_feature (1048)..(1048): n is a, c, g, or t
tccgccactttttcaattttttcgacaaaacatgatataactttgtttaaagtcaaccaaattttacattcttggtatcattcgatagccaagctttttctctataagcctgccaaattttaaaaaatttggtcaactttagaaaaagttgtgggaaactaaatactatttctgccataacttatataaaatttgataattttatttgaacttttgcaggcttatagagaaaaagcttggctatcgaatggtacgaagaatgtaaaatttgattgcttttatgcaaagttatgccatgttttgccaaaaaattcgctaaaaatggcggattttacgaaacgacctagcaccaccaagcggaaaatgcggttttcatgcttatctgagcgtaataaatgcgcaaaattttaggcatttacctaaaattcccattccctaatcatcaacccggacccaaattcgagcaaaaagtcgaaagttcacatgtttgagttttgcattttcgaatctgatcccattggttggacaacatttagggtgcacatatttctatgaaaatatggacaaaatctccaaaaaatagaaaaaagattctttcccatcaatccaaaattttagcttcactgttcactaataaataagtttccatttgttttctgaattcgttaattatttgtggttttttgtcactaaaaatcccagttttactgataattgtaagtttgaaattaaaaaaatttaaagtaactgatttttgtaaacttttatcaaacaaaaaaaatttttttttattcgaaaccaatttattttcacaatttttttttaatcataaattcgtaaaagtattgaaaattattattttttcttcggtccgcaccgaataacaacaaaaaaactaacattttccatgacgtaatttctccacgaaatagcagctcgcctgatcagctcgatcactttcgctaaccgatcaatgtctgtctcaataaattgtctgattaatatagaccgactaaaaaggcaaaaattaaggatttttatagagtanaacacgtaaaactta

SEQ ID NO: 16623 - DNA, 1586 bp, Heterodera glycines
  misc_feature (60)..(63): n is a, c, g, or t
  misc_feature (72)..(72): n is a, c, g, or t
  misc_feature (94)..(96): n is a, c, g, or t
  misc_feature (99)..(99): n is a, c, g, or t
  misc_feature (106)..(108): n is a, c, g, or t
  misc_feature (110)..(110): n is a, c, g, or t
  misc_feature (123)..(123): n is a, c, g, or t
  misc_feature (126)..(129): n is a, c, g, or t
  misc_feature (133)..(135): n is a, c, g, or t
  misc_feature (142)..(147): n is a, c, g, or t
  misc_feature (156)..(156): n is a, c, g, or t
aaatttgaaaggtcgatccttaagggtcatttttttctctaacgtgggccccgctaagannnnaccgaaggnccggcctattccgaggagcaannnacnaacagannncncatcaaaaagggnaannnnggannnagggaannnnnngaatgagcncttaaattttgacccagcggttttatgaaacgacccaatagatacataacttgtttgtttaaccaaggtcattttttccattagtcctaattttgcatcataatatttaatgttaatttcagttttcttttattcaaatttgataatggcagatgatgaagattatgatgggggagaaatggacggcgatgagtttatggaggaagagcccatagaagaccttgatgcggaacaccaagcgggagaagaagaggaaggcgcggagaatgtccaagttattaatgtaacctattattttacatattatttaaattttggttttcaaggtttctgacaaagttgcatcgtccaaccgagtgacaactccttttatgactaagtacgaacgtgcaagagttcttgggacaagggcgctgcagatagctatgggtgcaccagttatggtcgaaattgaaggcgaatcggaccctttggaaattgcgcgtaaggagctcaaggtgaataaatattccaatttcaataatagcgaggtaccagttaatctaacctaacatttaggaccagaagattcccataatcattcgtcgttacttacctgatggttcattcgaagactggggcattgatgaattgcacattacggattggtgaaaatgattaaccgcgtaattggcattttttctatttatgtttaatgaatttttgattcactaatattttctgcttattttgaccgatttttaattgacgttaataccttatttaaactccattatgcgtttatcaatcagacacttttctagaggtgttttgtcaatgtctattcttcagaaactttctcctgtaaacatcgactctaaaggcgtttttaagtacattctcataaaggtttttttctgtgaagattgaagcaaaatgcgaatttaggcttctgatggcgcaactgaaagatttttggttcgtggttatggtcgttgtaaatttcacgcggatattttggaggaagtgcaggcaagcgaaggagagaaggccattgaattttcttgtgttggcggaggccggataaaacatgagccggaagccaaacgtatcttcgtctacggatattcccaggtgcagaattctcaaaaagatttttatcggttgtttgaggggtttggccgtgctgaccatgcgaaatctgtcgaaatcctgagggaacgttatccaaactacacaatcgaatggtccaacgaaggatattagggcagtaaatctagtatacaatattgtaacgttttttgttttctatatttaaaaataaaattgggttctcggaatgtatgaaattttgtctgttaaagtgatcccgtcttttaacttcgatcttttttatccgcatcttatttttttaacatcagaatgcgtttttatggtcaaaagtcgcgtcg

SEQ ID NO: 16624 - DNA, 1304 bp, Heterodera glycines
caatcatatcttagtaaagaacaaataaaaaacgctcatgtgaccaaattgtctcaatttccgggccaagcgatggaagcgcttggagcaattattttggactgtaagaaaccaccgaaaatactgcagaaagaagcggatgatgtaagttaataggacgacataatttagaaaggacttcagttgtcaaacaaattggaaatgcgacatttcccggccaaccctaaagaagtgcaaatggcgcgtaaacagataatgcatgaaatgttcgaagagaacccagcactgttgtaccaatgggaggacactaaacaacggcccaccctcagccgaatgtttgacaaagaggcacagaaacggttagcagcgactcgctacaattggaaaccgctcaaattcgacacaaaagaggcggccgttgtttatgcgctttcgcggttttttgttaacagagaaaggcatttataaatgtttttcatttactctagattcggtgggtattttgcagaaatgcggcgagtgttttcggaatttgatcggaatggatttgagcccgagacggtgctcgattatggcagtggaagtggggcagctttctgggcggcctttgaaagatggggtaaatcaaaaggctatgctcaatcacattaaaaaatcattttgcaggtaacaaagttcgtgaatattctctcatggaccaagactatgtgattcgacaattgtcaatggatttgcttagggtctaaaaaaaatttctctaaaatttctttgtccaattcagggaaagaattatacaggagcgggcgaaatgatcactcaaaatgtgttttttcgcaaggatctttttccctctccgcagcatacttatgacttggtcattttgcaccgaactctcatcgaaattcaatcggaagaggagcgaatggaattgatcgaaaagctttggaagagaacaaaaaggtatttaaaaaacaatcctcacaatcatttaataataatttttcaacgctaatgatataattactagacaaaaaaacaaaattattcccttgaaattggaaaatcttttccaattaggttaggtgtttttattttttcttgaatttgtctcggcgacattttgttttgtccttctccaccgtgcacgacgccccgaatctttttttcctcttttttttttgctcttcacagttgaattttttatgtatttatttttactcgaaaaggcatttcattgttttttccggaaatgcatttagatttaggggggtggtggactcgcatatgccggatgctttgaagca

SEQ ID NO: 16625 - DNA, 1955 bp, Heterodera glycines
  misc_feature (1868)..(1868): n is a, c, g, or t
cctggcaggtcatataaaatctaaaaaattttatttaaactaaaactacctccgcccacgtggcttattaaatctcattattttcgtcctcgccctcaaagtttccttcgccgccgatgcctatcattatgattattttttaaaatttcttttaattgttttttttttgtttttgcttagtaatttgagtggaattcgttgaaattggtaaaaaaattttaaaatatatttttgactaaacggcgcaaatgtccgctgcgcaaaagacgcaacacgataacatatgcttttgaaaactgtttgttgtgtttttcttttctttataaatatctaacattttcaacaaataaataaatattgaaaattaattctttcattttcaaaagaaggaaatgaattagttaataattggcatttcgtagtcctttggcatcatcaagctaaaattcaaaaaatgtataaattgttttttgtcgggtttaaattaaattttattaaaacaacctgtaattaattttatttttaataatttttataaatgcataacaaaatttgcgggttaactaacctgcatttgcgcgatgtgccaattgcggcgcggcaatgtccgcatgatttggcacaattctgtgccatccaatgcgcgttgcgtgcacattcgccactgcttgatgacacattatattttggcattatgtttcgtgggtaattagatgaatgccatcgattaaagatatgatgagcagaaatatgagaagcatgacgggttttatggaaattggcccaacgttcgcattgcgaatgccgatctttgcaaactgaaatttaaaaaacatattcaaacgaattcaaaatttttgaaatcattttttgatatatttaagtgataaaaaaagtttttttcataaattgaaatttttttctatgctcgaattttattttttggcatttaatcttttactctaaaaacttttttaaattcttttaaaatgtaaacacaaatccgtattcgtaaataaattttcataataataacaattcagatttttaatttaatttgataatttagatcactgccctggccttagttgacaaaaatttccggtattggggaaaaattcctaactaaatttgtcaggtattgcttaaaaattcaaaaaatgtcgaggatggaattttcgtaaatagatgacaaaatataagaaatttttatcatgcaataaaattgggaacaggaactaaccattggctttacaaatttgtgctggttttaagagggtttttaggacctaaatcaaaaccccaaaaatgggtgtacgagatcataaattatatatggccaatgttttaagattaaaaactctgtctatagcaccgactttggcctgtcggatcttgctggtattggttccactcgtccgggtgcggttggcatccgtcaaattggcacgagcacggacaccacgtgttcatgtaacgcggcgctgtccaacacgcgcccctggtggtccactgtgtacaacactcgtggttatcgtagcagaaacgtccgcttggtggacgaggcttttttggtaattaattgggaatttaggtcaccctttcacaaattttgtttttgacaatttgggattatgttaagaaaataaaaaattcataactttcaactcttgagttgagaaattcatgactttttttaatagttctcgattttgtaaaacatttcttaagttgaaacatttttcataaaaacatatccaaatctagtttttttgttagtttttttaatacttttaaattttaataaatgctttattagtttgaacaatggaaataaaatattaaattttaatagctctttactgtgncgacggagttgtggtatccaaatatacacaatgtttaacggcaaagtgaaaagaaactgatcgactgtattaaaatataattttaac

SEQ ID NO: 16626 - DNA, 2613 bp, Heterodera glycines
  misc_feature (33)..(33): n is a, c, g, or t
atcgcctcctggcataatttttgcacaacatancggtcttcccctggtagtgtcacagaaaagataactaaataaaagtttattccattattattattattatttttattaatttaaataataaaaattaaaatatgaataaaagaattttatttgataacagtgttcccagcttatttttcaaaataaactaattcttcaacttatagattttgaccaataaattaggttttttcataaaatttgtacaatgagatatttattaggaaaattttaatgtttttaacaaaatttatggtgaaattcagtagttttttttacaaatcagtgcatttaaatttctaagactgtaaacaatctaacacagtaccaagttaaaaaaaaattaagccacctactgctgggaatacagttcaatgggattaaaatgtataattgtttttacggtgatccacattgaccggctccattgcatgatggtcttggcgcataagtgtacaaattgtccgtgtacgcattgcttagaccatctaaaatgaaaattactttttttcatttaaatttgataaattaatttctaattttaatttacctctgtttaaaacaaccgggtcctggaagggtcgcattattgcacttagacgataattttcagagccagaacactgtaatgtgaaactttgagaaacaacgtataaatgcataagtgaaatattaggctcaccgatcaaaaatttcgggttcaggaccaaaacaagatagattcattcgacagaaccttacacgaaaatttttcaaaaaattgaatcaaaatcttttcgctattacccaatcatttttaatcgcctaaattcccactgatcgctgatcatttattaaagcgttgaatagaaaaattttaaagttacttaaaaactcactgggacaatttgggaatcaggtggaaattgcgtttcacgctgcgctcggctttgccatttgagtctccattgttcccaaatcttaaaaatgaagggattttaattatgttttaatttattatttaataattatctaattaaaaactgttcccaccaaatccataaaactgtgatgaagaaaaaagagaggatcttgtgctgcagtgttcaatgccaactaaaacccaaaatttttaataaatcgaacaaataaatttttaataattttttaaaaaatttagcagataaaatttgaataattaaaaagatttcagcaagacaatttatctaaataatgattgtattttaaattaattaatcaatattgttgctttgacttaccatgtccccacccacccaagtgtgaacatcactgtgaatgatttcgatcatgttcgctgggtttaaatttggcaatgtgcatccgccatttattggcttaaaatattatttatttatttttagtttttaaattaataatttaactctatctggaaaggagaatatatgctccaaattcgggttagagagtaatgcgtcaatactaaaattggaaaaaaaaattatttaaaattaattatactttaattataattcatccaggaagtaaaattgtttatggttatcttattttcgccctctaaataaacaaatttagagtttttgcatcggagtatttcaatttttattaagtttgacaatttattctacttttttggtattttgtcaatatttgttgcgttaaaaaaaatcgtttttcaataatttaatttacggcctaaattatttgaaatataattaaccaactcttcttctttcaataattgaccatctgcatctggtgtcctttgtatgaaagttccactaatctgtgtacaaaacaaataattaaagttaataaattatcataattttaaattttacagtgatccaattagcaaattcgccattaacaatttgaccaaaatcgtttgttgtgcccataaacatactgctccacataacggagtcaagcttaaataatgaaaaaataaaatttaattaattaaaaaatccactggatttggcagtcgtccgtctaatgacgagtcccaatatgggatggccacggtcgggtcaatggctcgaagtgcaatttccaatcttaaataataaattcattagaaattttttggtatgacaagtcaccactttcattaatgatgtaatatttaaaaataattaaataggaatttttgaatttacattaaatcggtttatttaaatacttcgcaaaaagtttcccgcattacaaaggcggcgaaaataatcgataaacaataatggctttagttatttataaatatttgaaaatttgagtcaaaatccgaagatcttttgctaacttatttaccgtttcagatattcacggtgccacaataagaatgttggcccgctatgggcggatggcatcattcttgggtccgaatgaagagctgacaaacgatcatattcataggagccaaacccacgcttcagctgctgcatagcggcatgcttgaaaattttaaaattggaattaaaagcattttctttaggtttttaaattaattgctttcatgccatcctaaaattattgaagtttttcactattattccaatgaagtaccattaa

SEQ ID NO: 16627 - DNA, 2143 bp, Heterodera glycines
aattcattccatcgggaccagagcgtttgggcccccgacttttgggccccggggtcgtttgggccccgacccaaaaatagaaaaatgtgcttttttaaaaattaagattctaaaaactaagcctgagggatccctcgccacttggcataagttaggtttaattagcattcgctcattttttacaattttacttattccaactcctattattttttaatagttaaccaatttgatgtacattctgatttggacatttttcagaaatggctaacccaattgcaaccaaaatgttgtgttttgctaacacgcaaacaagataaatttatttcgaagtcaacgtcgattactttctggtgctcacgcaaaatattgatgaatttccatattgttgggtgtccttgtccgatcgcatgttgcaacatgcgatggtacgcttcggcgaagttgtttgtgcggtcggtgccgctcattgtgcgctcatacacactccattcttcaggacgaaacaatggacgagtgcgtgtgccattgttgcgaagtcgcccaacgtagttgattacaaacctttaaagtcaataatgaaattgaaaaaaaattaaactcaacaaaccaatcgagaacgccctcaagttcacccggcagatgatcttctagggctgccagcgccggtgtaaggtcctaaagcggcacaaacgccagcgaagtgaccattttggcgaattgtgcaaaggctgcgtcagttttgaacgctaaatttgagaatttcaaaagtaataaaaaaatttcttacgtgagtttgctcgtcggtaagacatgctttcatgttgcgcaccaaatggaataggcaaaagttgattgaacattgtggatgtttggcacggagggcgttgaccatcgcctgctcgaaggcaattgtctaatcgcgaagcaatcgcttagaaaaagcttctaaacatgttaagctttcgaatgatatcaacaatgttggatttggattacatagaaaaaagttatagccaaaaacatgctggcgccgaaacgccagcgccgaaacgccagcgccgaaacgccggcgccgaaacgcagtggacccgttcggagtggacccatcaacaaataactaatcaataaaagtattcgtgtcgaaacttaataatattaaatatcaacacatccaacacaaaaaacaaaaagtaaaattgtcttacgaaggccacttttacaccttcgctaaatgagttctgatgggatgacaaaattttggagatgcgaattcaaaaaatcaatttcacattattttggagtttctccggggaatttctcgcaactatcgaatgaacccgtgattttttgttttattgtccaaattaccttatgaacccgtgaatttctgttaatttttacattttttattgttaaaattattgttgaatttatttttaaaatgtttattttacatttttatgctgaaatttaaaaaagttgtttttactgtgatttttcatttttctgtacttggggcccaaacgaccctggggcccaaaaacgagggcccaaaaacgggggcccaaacgcccccgactctccctgggattttcatccccatcttccagttccaagtcaaatatgagaaaaaaaaaataccaggtcccatttaggcacgaaaaacctggattttctggataatattttagaatttgtgattactagggctgggatttttatgtggtaaaaatcctgaaatatgtaataaaatatgtgctaaaaaaactcaaaatatgtgctaaaaaccaaaaaaaggcctaaatatgtgttaaaaaatgcaaaaatatgtgctaaaaattggaaaaaccaagtgtatttacgcaaaaaaaaatcatatttaatatcagtctttatcaatttcgtgagaacaaatgcaaatcagatgccgctgttccgttgtcaaactaatacttggtgaaagcaccgttgacaaaagataatttttccctcagttgaataagttccttccggggacttttgaaatccagtgacgatttaacacagcgtttgatttgggctgctttaggcatttaaatatataaagaaattttccaatgctttagaaaccgaaagtaagcaatttttaggggcattttca

SEQ ID NO: 16628 - DNA, 414 bp, Heterodera glycines
ttctaatattcattgctttcgcatatttcctttattctttcaaatgctatttaccagttgttgttgttcatccatcaagataggttaaacgggaattatttattattatttaatttgaagatttttattctgttggtttaaatttataaattataattttacaatatagaatattaataattatttatatttttttatacaaaagataagtaattaaatatcatatttaattaaattttataaaaaaacttaatgcttaaattttctatttctaaataaaatgtgtttctactttattctgataattcttgcagaatatattccaattcgattttcgacgcactaaacaaattttttttttatgatttgaaaagctggagttgcgtaaaaaatgtttgtttcttttttatattt

SEQ ID NO: 16629 - DNA, 2243 bp, Heterodera glycines
  misc_feature (2168)..(2168): n is a, c, g, or t
  misc_feature (2221)..(2221): n is a, c, g, or t
ataatattttgctatttttttgttgttctcagcacgttttgtcatttcaaattaaagatcgttgtaattatatggttggggaataaactggcgattcagaacaatattgaaccgggtttggacattctctataggcaacaatttttaggtgttcgagaaaggaatagtcacaatccgcaatctctctctttaactgctttaattgatcagttaaagattttttcttcttcttaattttttgcttcaaatctctaatttcttgttggataggatcaaagatcacttacacctcatcactgttattgacttttcccctccccctttctctgtcttacattatttccattgtctccctctctgcctatctcctccacatttctctgaccccgcgtctttataagggtgcccattccctcactcatggctctccgctccattcattcgcattggacatttatttattattttgttctcctccgccgctgcactcctccgacctcaccattttgtgcatttatttttatttgtttattaataaattgttgatacacaacaattttggcgcagtcagcagcagcagataaattctgcacatcatcaagccaaatcaaggctaattctgcaaaatcttcaagccaaatcaaggcatattctgcacaacctccaagccaaatcaaggcataattcagcaagcctaattttggcaattcaaaagcctgggcggctttcatcggacatcgacaaaaactgatcacctgggtggtgtaagttccgctgggtgcggtttctcatcaacaaaaactgatcacctggggggtgtaaagttccgctgggtgcggtttaatcaacaatcaaaatggacgcacaacaacttcagcaaattttggacgcggctctaaaaaaatcagccgaagtttttgccgccgcactcaacattcaaaatcaaaacccaaacccagggtcatccacaacggcatcacttgcggcatcaatcaatgtccacctcgaaaaattcaattataatccagaggttggacagacttacgacgcttggctgaatcgatatggcaaaatcgttcaacaagacggcgcttcgctcccagagcagtccaaagtccaacttttggtcggaaaattagacgaggaggaatacaaacggtatgttgacagcattgcaccaaaagccacagaacaattcaactggctcgaaaccgtggcaaatctgaaaaagatttttggtgagacgaggtcgctcttcctccgccgtttcgattgttttcaaattcgccaatgccaaaaccaagacctttcgagtcttttggcactaatcaattcatcgtgtgaaaatgccgaattggatttgaagaaagaagagctaaagtgcatgattctcatcatctctttacgcgacgaattttcggatttgaaacagcgatgtctccagcgaatggaagaagcccgaaccaatgggaaaagcatcaccctacaggaattgggcgaagaatgcaaaaagtaccaaattttgaaggaaagcacattggcactcagcacaaaacagtacaatgccaatgccattcgtgccaagccacaacaagtaaaggacaaggcagacgcaacaaagcaatatgccaaaccaaaagcggttccaaaaccgtatgagagcaagcacaaattgccaaaccgtccatgccaatcatgcggaagcacaaatcattggcgctccgattgtgggcacagagatgccaaatgcccaaaatgtggtaaaatcggacatctcggcaaagtttgccgaagcaattcttcaattcgccacatccaaacggtgaatacaactgaaaggcatgcacaaatcaacacagtcatcatcgacttaaattgcatggaaatcaaagcagaccatccaaaatggtggaaaatactaatcaaagtgaatggcgcagattatccaatgcatgtcgattccggtgcacaaatcacattgttcacaatccaaacatggattcaaatgggcaaaccgcctttgacgtcagcaaatattcgcgtcaaaaattgcaatgaccaaacatttgcaattaatggacaattcatgtgcaaagtgcaatacatggatcgtccaccaatgaaattgttggcatatgtgagccccgaaatcagtcataatttattgngcatgccatggatagaagctttggagggtgatcccaaagagattatgcatccnaatcttcatcaaaaaatcaata

SEQ ID NO: 16630 - DNA, 1921 bp, Heterodera glycines
accgacccactcaacggactgccaagcagtgcggcctgcgccccgaggaggcgttgcgccttcggacgtaacgaaattcctccagtgcctccaaaatcgttcctccgttcggcacgggaggcgatgcaggacgtcacttcggtcagtttcgcctccctttttagctttgaagattgaaatccctttttaagctcatccttttggcagcagctgtcatttcccttgtgctttccttttacaaaccgccgaatcgagaagaaatcaacgcaatttcatcttcgcacctcgcaacgacaacgccgaacagtgccgaggacgaacaaagcagcggaataacagaacaacacgcgggatggatcgaaggggcggccattctaatcgcagtcagtgggaaggacggcggagggggggggggacccggaaaggaatggaaaggcggaggaggggggaacgcggaagggcgcgggagagggcggaggggggggggggaccggaaaggaatggaaaggcggaaaggatggagggcgggggggggggaatttgtcatgacgggaagaggacgggaagagggaggcgacacgaagcggacggacataggctgatgaatggccaattcggcactttcgcatccgcccaatggccacggatactcattagagtaaataccgctgacttactcttttaggttattgtcgtcgttttggtcactgcgcttaatgactggagcaaagtaaggaacagaacattaattaaaaatgctttaggctttcttcccaatgctttcgttgttcaggagaagcagttccgcggtttgcagtccaaaatcgaaacggaacataaattctccgtaattcgcgacggaagggcgatggacattgtgatcagtgaggtagggaaggaaggacacagcagcgaaacgcattgtttgtctgttattcattttgttttcgattgtcgttggcgacatcgcccgggtgaaatacggcgaccttttgcccaccgatggcattttgctccaaagcaacgacctcaaaatcgacgagtccacgctgacgggcgagtcggatcacatccgaaaacaccccgagacggatccgatccttttgtccggtctgcggcgccctcccgcctttttgtcttacagtcaatttaggcactcatgcgatggaaggcagcggaaggatggtggtcacggcggtgggcatgcactcgcaaacgggcattataatgttggagatgggccatgggtttgcacttcaattcggtcttcaggagtctgttgggagtgactaaaagtggcacgacggaagcccaaacgagcaattcgagcggacagaacacgcaaaattcagtgtccagtgtcacgaaaagtgccaaccgaaacggacaacgtacggcaggcactttctttgcaatgccaacccctgactttcagctttgaacggcaatttgttgaagtgcgtcgccaatggccaaatgacttccgccgctttgtccgccgatgtgccgccgccaaacggcggggcgacgacggcacacgcggcggtggaggacaatttgaagagcaaatcggtgctgcagggaaaggcgagtcaccgcgccgcgctcccttcccccaccccccccccccgcccatcgtttagctgtccaatttggccgttcaaattggttacattcggttcggtggttgctgctgccaccgttttggtgctaattgtcaaattttcgcttcataaatacggcgagtgatttgttcacttttttaccgattcgcttctttttcagtgtggggccccgaggaaaaaaaacatttcgaggccaaagacattgccaacttcgtcgatttcatcatcatcggcgtcactgtgctggtgatcgccgtccccgagggattgcccttggtcattactctcgcgttgac

SEQ ID NO: 16631 - DNA, 1828 bp, Heterodera glycines
tggatttttcgctttttgaccgttcgtttgccttttaggtgtgccttgcttggctttgtgctcgacttgggccaaagttacgaggaattccgtcgcaaattccccgaagagtctttgctcaaagtttgcctctgctcacttccctttccttcatccccccccccgttcctcaggtgttcactttcaattccgttcgcaagtcaatgatgactgtcattcggcgaacggacggccgtggctttcgcttatacgccaaaggggcctctgaaataattctgtccaggtccgctgattaatgcctcactttggccaaatggtgcttgttcaggtgcacttacattttgggccccgaggggcgtgtgacgtcttttggggagagacagcaaagcgaagtgattcaatcggtgatcgaaccgatggcatcggacggactccgaacgttcgtccgttttgttgacagttcttattgtaagcatctgctactgtttagcatcgctttggcctacaaagattatgtcgtcgagaaaggagaagcgaacgaagtgcgcttttcattttgaatttcgccctttggcattgtgccattcccttgacattccgttttcttcagattccgctcgaaggagccgatgtgaattgggatgacgagcagattctgcgagagggaatgacggccatttgcgtgttaggcattcaggacccggttaggacggaagtgccggatgccatttcgaaatgccaacgcgcgggaataaccgtacgaatggtgagtgatttttgaccagtcttgctaatttagtaaacaatatgtaaaatgcgcctaaggtcaccggggacaacataaacacggcacgttcaatcgcaacacaatgcggcattttgaggcccggggaggactttttggcattggagggcaaggagttcaacgcacgcatcagagactcggatggggttgtggaccagcggaagttggaccaaatttggcccaaactgcgggttttggccagagcacagccaaccgacaaatttgtgctagtcaaaggcatcattgagtccaaatgcacgaagaacaggtcatcaatgattggtgggctgaaaatgagtcaaacgctgcagggaagtggtggcagtgaccggcgacggcacaaacgacgcgccggcactgaaaaaagcggacgttggctttgccatgggaattgccggcactgacgtggccaaagaggcgtcggacatcattttgacggacgacaatttcacttcgttcgaccatcaattcgcatttatttattgtctgctcgttttagcattgtgaaggcggtgatgtggggccgcaatgtttacgactccatcgccaagtttctgcagtttcaactgactgtgaacgttgtcgctgtgaccattgcctttgtcggcgcgtgtgccaccaaagattcgcccctaagggtgtgccgtgccgtcgtcccttgccctcgtcctcatttttgctactttaggccgtccaaatgttgtgggtgaatttgatcatggacactttggcctctttggcgttggccaccgaaatgccaaccgaagatttgctcaagaggaaaccgtacggccgaacaaagtctttgatttcgcggaccatggtgaagaacatcatcgggcacggcatttaccagttggccgtcctcttcggacttctcttttttggtcattgaattttgcctcttgtgccattgagtccattttaggagagaagttcatccccgggttggagaaggaaaaggcgcgcgaattgccgcacgaagcggggccgacgatgcatttcaccatcattttcaacact

SEQ ID NO: 16632 - DNA, 3091 bp, Heterodera glycines
  misc_feature (3043)..(3043): n is a, c, g, or t
agtcgatctttaggggtgtatttttcgcttttttttcccaccacagttgttaaaatttccaaaaaatggccaaaatatcccttagccctactcattaatccaatgcaaaaatatttattttttttactgcattaataagacacaccgagttcaatggttggaccacatatgctttgatctcgtcgtcgtccatttgctgcgcaattgccgcccaattgcgcaacggcacttcaaatgccattttttggcattcgtcgcgcgcctcgcggtcaaatgccgcgtcgaccatcagcaaatgcttgacgtcacgggccaactgttcatttgtgtgattcaatttggcatgaatgtgcagcggatgcacttcattgaataagtcttgaaaatggcgaaattttttgtcaagaaaaatttgtgggttttgtcgagtttcgcgcactcgaaaatattacaaatattttcctacggtacaatgtcggcaaaataataaataacacgatgatgctaattagaaacgccggcgaaattaatttttgaacaactttaatggactactgtatttgatactaattgtaaggcaatcaactcgttctcggccaactattcttagttttcaattcgtttttttagttgaaaaacttataatcgagtcaaagcactaaaatttaagatgttttttgattaagaatagtttttatgtcagttttcgtgattttggatgacaacaaataaacttttttttttaattagtacgttaatttgtaagttaaaaacagattaatttttttcatcgatttgaactcgatttgtagttttttcaaaaaaaacaagttggaataataaaacgaatcgagacaaaatgagaatttgaagtttcttttactatttttgcttgctaagattttcatatgaagggtgaagaggattgatgccatttatttgaataaatttaatgccatttaaacccataattttttttttaattcgacttcaatttgatgaataagggatacgatttttaggttctaaaacccaaaaataggtgctaaaaatggaaaataagtgccaaaaaattctaatttaggggtgtaaaagcgtaaaattttatccaaaaagcaacaaaattaagccaaatcagtcaatcaattcattgatattttcaaacattggtttgctttattaaaagaaatttcaaaaaatccacgtccaggctgggatccaggcctcgagtgcctggatctttcatggaccttgattttcctgggtttttgtcaaggaaatcctgatctaacatggaatccaggtccaggtccagttttgaggtttttttcaaaatgtcgagcactagaaaaccctaaaaatcgtatccctattaatgccaaatcccctattttaggcttttcctcccactcacttgtgatgcctttgtcctcatttgtcgaatgatttctcacccaaaggcgcaactgatcacagttccattcgcaccgttttgtcctctcccaattgatcaacagctcgtgcaacgcccgcgggttgtgccgttcgttcattttgatgtgaatgtaaacggcaaatgtgaagggctcgttgctttccgccttgttgatcagttgattgatttcacttaaatttggaaataatttttttaattaatatttatttatatagtaataaaaaaaatgctataaatttggtaatttttatacaaaattttggatttttaaaaagttaaataattttaatacatttattctacattttaaataattttattttattttttttacgaaattttttactttattatatttaatgaaaatattcgcatttttatacgaatatttaattaaatattattttttttattaattaattattcttttattttaattaaatattatgttctattaacatataagttattaatttttatacagaattttaaaagttaaataatttttaataaattttttatattttacattttaagttttcgttttgttgctctgaattgttcaattctttcattcaattgggcaacatattgttgctgaatttcttcttcttctaattgtttggcattatttaatagtaatatctcttcatccatggcattctaattaaatttttaaagcaacattaaaaaaatttaaaatttaaaatttaaaaaataataattcgaaatgatttatttacaaaaacaaattgaatttaaacaaaggtgttctaattaaatttttaaaaatgcattaataattaaaatataattaaaaattaataaatcataattcttaaagagaaatattatttgctaaataattaatttcaaaaacaaaatgaatttaaacaaataattgacgtaaattacttttaaaaaatggggttaaaaaaaattaggaaaatttaaaaaaaagttagaaaatatttatttacgaaaatttattttattaaatttatttttgccatttttttttactttgaccaatttcaatgcttgagtacaatacaatgccaatttcaacacctccttcagcttcaacatttggtcagggctttgtgctctgacaacctcaagcgcaagacgcactgtgtactcattggccttttttgggtgaaaaaattcaaaattttaggccaaaatttaatgcgtatttttagtgaaatatttctatgatttaaaagtttatgagaaaaaggcacgaatgtggaaaaatgccataaaatattagtaaatgtaatttttgactttaagaaaattccagaaaagctgtcgaataaatttaaatttgaaaatttatttttatgaatttttttaaagaaaaacatgcacataaaattttagaatgaattcggaaaggcaaaaattgataagaattttacttttcaaaaatgcatcaaaggattattaacaaatttttagccgaaatgggaattttttgaagttttttgaagaaagaaataaggccaaaatgggagctagggattaatcttctaaaatttgtatttaattaaatttgcttccccccctttttcagggtcncttcaaacctttataagacgtgtcgccattgcgccttttcccttaaag

SEQ ID NO: 16633 - DNA, 1802 bp, Heterodera glycines
  misc_feature (97)..(98): n is a, c, g, or t
  misc_feature (104)..(104): n is a, c, g, or t
  misc_feature (215)..(215): n is a, c, g, or t
ttttatcaaagttataccatcacacgaaatgcttcaatggatgatgtgaaggatttgaagctgcacaaaagcactcaaattattttgatcggattgnnccagcnaaccggacaaagtgtgaccagtagggaaagcagcggcacggatttgtcattggacgatttggtcaaaaatgcaaaaaataacaataatttaaattgttgtttctttaaatntagaatggaacaattggccgccttttgggctcagtcgctgaacagtcaatcaatggaagttgggcgaaatcaattcattttattccgccgtctgatagatttatggatgtttttttccaaatacgaaacccgcctttttcaagactgatcagcagcgaaacggatttggcgccatatcaaaacaatccgaataatgcaagaaatagaggaataataaaaattataagcgaaattaaataattattagtaaaattaaataaaaattcatcaaaaacgggttcattaaacaataccaaaataactgaaaaaattatttatagacaaaattgacgagaacaagatgcgatttgatgggaaaagaatgtgagccgactcgcgaactcttacggaagattcggaaaatttcgaagtgctgctccccgtctaatgctgctggcccatgcatttgtaaacttccgaaacccgatccggtaattcatcttttttgtactttattaatgatacaaattatatttctaattgcacttgtagagtgaattcgcggcacccccgcatcattataattggaatgaatctccttcgctcaaatacggtaacagccaatcggaggacccattggattggacgggcgatgttttatatacggaagagcaggcgcaacgtttgcatgacagatacaaaagcggtacttaccgtatcattaaaacaaaaaataccactttaattggctaattaactatttacgtcttttaaattaagcatgcgcacagtgttacccaccagaaaagaagaaatggagaaggaaaagacaggcccagccaaatttgagcaaatggaccaaatttccaattgctattcgtttcaacagaacatgtatgtatatcaaaaagaaaaatttacagaattagtttactaattttcagtgggcgagccgactccacctcaatttattgacgctgtcgaacaagggataaaattcatcatgttggtgaattttgcatgttaaagttaagtgataaaagtggcttctaagggacaagacttgcctaaaatttaccacggatctgagccatgggccggaggaaggcatcgaaattaacaacgaaactggtaactactgtggtctttcttggattggacgacgcacttgggaaaaatggcaaataatttccatttcatgtaccgatgttagtttgagttttttttcttgcttgtattttttaaatttattcattccagccaggaactgtttgccatgagtttttacatgcgattggcctcaatcatgagcaacagcgggatgatgcgcgtaaatacagcaaactgaatccagaagaacggaatgtagttttaaaaattattaatttatggacatataataattaaagcaatggaatgaggcatatgataaaacggataattatgaccttccctacgattttttctccataatgcattatcctgctacgaaaaaaaatgggttggtaaattttggttaatttgaaataaaattcgattttaattattttaattaagagggaaaagttattgactttcattttagctattacgacatgattgcattga

SEQ ID NO: 16634 - DNA, 3012 bp, Heterodera glycines
  misc_feature (2882)..(2882): n is a, c, g, or t
  misc_feature (2895)..(2895): n is a, c, g, or t
  misc_feature (2939)..(2939): n is a, c, g, or t
  misc_feature (2951)..(2951): n is a, c, g, or t
agatgaaaaattttcgctattagtttatttattggtcgatttatgaaatcattggcttcataatataaataaattaaataattaattgctataaaagtataaattccacttattggagaatgttatttagtttttgaattttactcaatttcaattaaatttcactttccactaatgattcaagtgaattaatccgttttttgttttatggcacggcatatcccattgcgtgtttcccattttttttttcaattttggtgccaacgctgaagcactttaattaattcgtgggtaaaaggaaatgaatgctccgttaaatgagaattaataatttaaatgaatgacaaaaataattaatatcttgtaaaataatggaaatattattacaaaaaataaccaaatgaattcgcagaaatggattttccatttctagtaaacaatccgttttaattacccaaaactgctaatgacgtgcttaaagtaccacaatttgttaactatttctttataattatttgcaaaaaaaatgtttccaaaaactacattttcattccttttggctttctgaattgtgccatttttatttttattttttaatctacattattttaattaggtataaatgataattataattaatattttaatgtgccaatttggaatgtataaataattttatattaagaatccaataaattttcctgcttccaacccacataaaagtaaaataatttatattgattttaatagaaaacatgtattttaaaaaggctctacccgtatttcgtaaacaaaaactcaggaaaaccaaggcccaggaaaacccaggatgaaaaaaattcctgaactatggtccgtaaaacccaggacgggatcaatgaccctcgtttatttctagttttaaagcctgcacccgaattttgtatagaaaaattcaggtaaatccagtcacagtaaaaagtcagggtgccaaaaaaatcatgaacttcacgaattttttgccaaatattttttgcgtaaaaaacaaactcgatgtttatctggcatatggcaacaggaaatttgtcgtagtgatctgtgtcaattaaaaaggtgtgtaatttaacttcattatgtaatttgggaacaattaattaattgcatgctaattgttacaaaatgccaaactcggccctttcaataaaaaaagataatattttccgtcaaaaaaaaagatcaattatgaagcaaataatgttaaattttttattaaaaaataatcaatcaaaaatggagctctcattaatcgcgaaatatggcaaattataggaatattagttataatatatattttttatttatattttatatgtcataaataaaaatattttaataaaataaatatcatcgtttttacataatatttttatttttatttctgatttagaagataatccatgaaattgactcataataataataataattttaggcaaagtatcattacaagaatgaaattgtgccaaatattcattttaattatatttttgatcgtcctaattaatattaattatgttggatcagaaaagaaaaaattgcgacaaaaaacatttgatgaaatatttggagaaaaatgggaagaaaaagaagaaaatcaacgaaatgaactcaaaaaacgagaaataattagaacattcaacaaaataaaagagaaaataaagcaaaaagggagaaaatattcaacaaaagaatgggctaaaattaactcaaaaatagcgaagaaattggggacaaatcgccaatatatttataaatggatcaaagaatttggtcttcaaaaaaagaaatgctacaaattaagaactgatgaagaaaaaactgaaattgtgcaaaaatttattgaaatgaaaaatagatataagcaaaaaagaaagttttcagaaaaagaatggaaacaaaattatgccgaaatttgtaagaaaattggagttggctatggcacaattaaaaaatggaagaaacaatttggaattcactgtataataacggagaaagaaaaaaatggaaaaaatgaatatttattggcaaacaaaaatagaaaatccgaaaatgagtgagaaagaaattgcaaagatgttgaaaattgatagaaatagtataagtaattggaagaaacaagttgagatggaataatggacgattattaattcggaaaaatttaaaaaaattttaataggcctatttccgataaagttactcacattttacaatttatatatgtcgatttgttagaaggttataataaaataatatttagcgccatttttttaattatatttattatgaataattataatttttaattttttgaaattgatatttttattttttcgatattcaaaaacaaaagattataaaacaacaaaagcaaaaaaaaaaaatttttgaatttcataatttttgtcataatgtcacttttatgagaattttttaatccaggaaaaatcgtaccaatttatataaaaatttattaatatttaatttttgcaaaaatacgataatttaaaaaaaataaacttaataacaaattcgatggatttaagaaaattaaatttattgaggtttttttggccattacttttttgtttctgagataaattttttgaaattttgaagacgaataggcactgtcaaacgctttaaaaatcctgccaagtttatttaattcgtatgacaaataaaaatgtgtatagcatttggcgccaaatgggatggacggttcccccaaattgtttgtattcctaatgagcgttttgtcccagttttgcaccgcttagcatcatttgctaatatgcctttaatccatttaatttttgcccatatcgaaatcttaatctcgacgnaagaaattcctgnatgtcctcgggcacatggtcagtcttaatcagccactaatacgntattgactgtanaaggtgccagaaactgatttatgatatttctcgagctcatggctaatttcagaacccatca

SEQ ID NO: 16635 - DNA, 1216 bp, Heterodera glycines
gagtgaagcggaattgccgagcgtgcgacggctactgaaaaagtatcatagtgcaccgccgggaagtgttgagtcggagcgactattcactgcgcaggatttattttgaatgatctacgacaaaacctatcgcatgaaaatctcgaagagcttatttgtcttcatcataatgttatcctttacaattttgattattgattagactggaaatttttttgaattatctggaactccttgcaattcccccccccccattcagtcttcccaaatttgtatgcatcggaattttaattaattttttatataagaaaaaataaaaaaaagtgtaaaaaatggtttaaaaaataggaaaaaaatgcgcgaccgcgatccgcgattcgcggtaatttttttgcgcgatccgcgatccgcgaccgcggcaaattgaatccgcgatgcgcgatccgcgaccgcgggatttttctgtgcgcgctccacccctgatgtagactctttcagaaaataatttaatatttaaagcaaaaaatatttgtcgtttggatattttatttaatattgcaataattttttttaaaatttcattaaaatagtatctatttcattcaaatattcatttattaattatcacctataattatgaattagtatcaattaattcaaaataaacatttggaaccatgaaaaataaataatttataattatggaaaaaaatttatgttaaaaattcattggttatttatttcttattaaaaattaatagaaaaactagcttaatcaaaaatattatttatatttccaattaagcaatattttttattttacaggaaatcaattgaaaggcgattttaacatcaataaatagccaaaataataatcaaaaattatattttacaagaaaaaataaaatttattatttttttaatttgtgaagaagatgaaattccgcctaatattcattccaattttattttttgtgattgaaatcaatcaaattaaaatagaaaataaaaaactaccgcaaaaatcatttgatgaaatatttggagaaaaatgggaagaaaaagaaggaaaacaacgaaatgaactcaaaaaaagagaaataattgaaaaatattataaaataaaagagaaaataaaggaaaaaggaagaaaatatccaagaaaagaatggaataaaataaacacgaaaatagcgaagaaattggggacaaatcg

SEQ ID NO: 16636 - DNA, 1098 bp, Heterodera glycines
  misc_feature (18)..(18): n is a, c, g, or t
  misc_feature (35)..(35): n is a, c, g, or t
ggtgggtggacaaagttntaatataaaatatgctntaaaaaataattttcaataatttatttctttaggaagagcataaagaatttgcaaatgttacgaaaacttatttcgcttctcttcatgcatttgttcttttgacggacctaaattatgaagagttcgcccttaaattacatttccaaattcaaaacagccaagaaaagtttgctgaatattacacgtaaggcattgtttttgtgcccttttcaatggctttctcagaaacctaaaatcaaaatgtgacaattggaccatcgacaaatggcaaaataaaatggagagaattggcgaaaaaattgtggataaaagtagcaaagaaaaatgcagagaattcgctgtcaaattggacgaacaacggaatcggagccaaaacgaacagtcggaaaacatcgaaccgcccaaacaaagtttgttcacaaagagacgaattggtattaaaacgggacaaattttaatacggattgtaagagttggaaacagatttaacgatgactttttcagcgtcctttcatcgcacctcgtttaaacgatcggtaaaaacttccaaaatatttgctgatcagcgaatcctccgaaatcgcctcatcagcccactcgacgcccaattccgtgctgaactgttccaatttctggactcgcttttcctgcccaatttgttgccctttcccaataaattcgttgctggcccaggcgacttggcccttttggacccttctctgtccgtcgaattcgaccgttgtttttctgattgtgaacaatccgatgagattaaacaattggacattgtcaatgtctatcagttgctcgtctcccatgattccctttattacacttttcctctttcgactctccaagaagccttttgtctattggctaaaccaattgagggtttggagaaagaagcacgctttttgtctgcaattgctcaggcaattagagtttttaatctgcccaacaaatgccattttcagttggaacacatcggagttgtcaaatcgctgcccaatgattttgtccgccttatttatttgattcgtgctatacttaaatgagaggaaa

SEQ ID NO: 16637 - DNA, 1068 bp, Heterodera glycines
tcgcttggattgcctatcggtagcaaataccacaaaagtgttttatgttatttgttttatttgcgtatttaattgtaaaacaaaagatcaagggacgagactgaatttgccaaggaagtggcgatttctgttgctgaaggagaaggggacaaaaagacggactgaagagagagagaagcggaaaagcggcacaattcaatcaaaggtaaagccattggtgggaaggggaaaggctttttcacgatcccatacccaaaagaatttggagacatttttcccctttttttgccttcaattttcactgtacgctttttgtctgtttaaaattcttttcggccagtcgccaacagttcgaaggtgagggaggacagagccatccgacagccaatccaacggacgcttctcctccgcccccgcccaatcacttcacccatttattctcattacagcaatttgtgtgtgtcttccttttttccaaatttcctatagaaattaacgtcttcacagatcagataatccctgttttttgttgcactttcattttatggcataaattctgtcgtttttttaatttgattttcgctgttattcgttttaacgagattttatttcatttttgttcccattatgctaatatcttttgaactttcgtttaatgatggaagaaatcattccaaatctgagagatccgttggtgaaaaatcggatgaaaagtctgtttgcttacagttttctgattttgtctgtccctctcggctcaatgtttctgttgaaaaattgcgtcttcgaatgtgggtgttttcgggacccaaaaaatgccaaattaattgtgcaactttcagccattttcggttggcattcgcgcgactcaatgctttattcggcaattgttgccgttgtgatggttcacctggtgctgttcgtttggatacggacgacttgggaagacgggaaaccgtccgaaaagattgactgactgatcattgatcacttgagggagggaggaaatttccaatgtaaataaacaaaaagtaaatgaacagcaataaaaatctaaaattaattcca

SEQ ID NO: 16638 - DNA, 3517 bp, Heterodera glycines
  misc_feature (48)..(48): n is a, c, g, or t
aaaaaatattctttcttttgattactaaatcaaaaagaatttccgatntaaaattgtgtggaaattggcccaatttttgacaatcattttccccttccctgcgccaaatttttggcaacgaaaaattaaaaactcaaaaaaatatttaactataatttgcttcactactttcccaaacatctcaaaattcccaaaacaataataaaatttattttacttcccttttaaatgcattgtcaaaaataaattccatttttttgatttaactaattaaaaacaatttccgatttaaaattgtctaaagttggcccaatttttacacgcattgccctcccccgcaccgcccaaataattattggatttaatgttgtcgtgttttggcgatgcgctcgctgtgcacatcatttatgttggtggcgccgctgcgtacatcattaacggaataatcattgtccaccacaatcaaaatttgtgttgcccatttgagcgccgttcccggcggtgaaaaggcacgggactgaaacggacagtgctggttcagcagaaaagccatttcagcactatcaactgttaaaatggggcagttcaatttggccatagctaatcccgtacaaatttatgtcccacactaaaacgccgatggccatggacgtagagcttagtaataaaatgtgcccgcgctgaaacggcactatgctaaaaaggacacggtctcagttagtaatatggtaaataaaattggcccatgccaaaatagccataggctaattgcgtacaaaaatgggtcccattgtgaaagtgcccgaggccccgtaataaaatgggcctcgtgctgaagcggaactgcaccaaaatggtggacattgtctcacgtactaatatggtctattctaaactggcccttgccagaatagcttaaccgctaatctcgtcccgtacaaaattacaaaattggcccatgccaaaattgatctatagctaatcctcatcccgtacaaaattggcccgcgctgaaatggctcctcaaaaatcaaacagaaaataaattatgcgtacgtcgacggcggtgtgttgctctgatcagcccccttttacaaaaccaattcataaatattaaaataatgttaatacacacccaaattattggcggaccgtccgtccgtcgtcgccgggcggggtttatcagcagcagcccattttgcccccatctcatcaacatcatccccaaaaccaatcacaaacatttttttgtttctgtcatcagtcgcccccccccccccaggggcgataggccacggaaaattaaaatgtaaaatggcttattgatcggcgctttgtgtttgatgataggtgatgatttaattggcgagaaaaataaccgaaatttttttttgttgatgaaaattctttttaaatgttcatagatctttttcatttaaatcatttaaatgattttaatttcttttctagaaatattttaaataaattaatgatttttttaatgagagtaatttaagcctttttcattagatcatttaaattgtgctaaaataaatgtttaattcaattaattagaacttttggattattttaatggagtttttatcagtaaatttttctggaacttttcttttttgtcagattatttcttttatgtgaatttttgtttggaaagaaaattccttgcgattcactgaatgcttggaatttctactcatatttcaacagaattgatcttcattttcttattaatgctttttaaaagacggatttttttttgttttgaaatttttaatttcttttaattaatttccgtttttaatcaaatgttttaaatggaaaaatttatttaaatgaattatatacctaattatttgtaaaaatttatttcatttttatatattatttcccaaaaattttacgccaattttcgtaccaattccccgcccccctcccatgcccatttgggggtattatcttttcggaggcaaatttgggcgaaaatccgcccaaatcggcggagagttagttgattgtcatcggctaagcattttggatggtcatttgtggtcattttctaacttttttcttattccaataactgaaaaagtatagtttaattattttaaatttacgcaattaaattttcaaaatttttggcgttttcaacgagttacgaatttacgtttttaagcaattttaatgaaaacgaaaatctggaaagcctaggagaaattttagattccgaattttgtacaataaaaataattaaaaaaatatttccacttttcattaaattcccatttttaaaaaattataattaaaaatgaaaacgaaaatttttattgtaaaattagatttttttgaaaatttagcatagtaaaaacagaaaatgttaaaatttcaaaggtctgcatcaaaaaatacgaccaccgattccccgacaatttcacgtcgatcattgcccgaccgacggagttcatttgtgtcaagtcaggtaatgaaataataatgaattgcctaattaaaatactaattaattttgttttcccaataagcttggccacagccgtgccgttgttgtgattcggaaaatcagtgtcccattggcatggcctgtcgaagaatatttcagtgccagaagaggtgattgaaaataattgaatttaaatgtttaaacatgtttttatccttttaaaatccaaataaactcaaaatatgaaaaaaattgtaagaaaaattccataaacattttttaaaataaaaattaaatttaaaaataaaataaaaattaaatttaaaaataaaattatgaatttttagattggagagaattctccttgcaattggcattccgcacttcaaatggaaaggaatatttctcaaaatcaattgagaaaattaacccgtaattttaatttattaattttcaaataaatatttcttttttaaatttagcacttttactgacgtcaattttcccgatgaatttgttttcccaaaccaaggccatgactttgtcattgaagtgagttttaaattaaaaaaatataaatttatttaaataatttaaattaatttatttgcagttaaccgtttactgcaaaaggaccgacaaatcgaggccaaactcatcgctggtacacactttttcgcgctcacttggccgttcgcttggacagtcgtggaaaaagtattttatccgtatttccgaaaataaatccccagggggctttatttttcaacaaccctcagaaggatggttttatttcagcaggggtttagaggggggcattaatttaggggcgggaatgtgtttatttttcaaaccccctaaaaaggggggggggctctaatttagggtggtaaggcaataatttaggggatctatttttcaattcagaaatactgtataataaatggaaattgataaagttctataaattattttaatatatatttattaattaaataatggagaaatttatttcattaagatgatttgtctgttcttaat

SEQ ID NO: 16639 - DNA, 1505 bp, Heterodera glycines
  misc_feature (41)..(41): n is a, c, g, or t
  misc_feature (1429)..(1429): n is a, c, g, or t
  misc_feature (1441)..(1441): n is a, c, g, or t
tcatagtcggttggttggactttgcatttgttcattccttncctttgtttttctgttcctttgtctgtccgttgctgaacccattcggtgtacgcgtacatcggtccgtccaaaagaagagcaccgacaataaatgcaccaatggaaaggccaaacccgcaaacagtgaagccaatcgaattgggaagacgaaggatttttggcaaagaagacactgaaaagccgagtgattggaaagcgaattctaattgtaagtacgcacaaattccgccggcagccaaagtgcccaatgccacgggcgcaccgtaagaagccattttaaagtgcagcatcagttcattacggcgccgttgttgtaactaataaatagggctcggaattacattgaccaaaaatcgtaaaaaacctctaaatggctgattaaggtttaaaaaacgtttagaaaaagacaactataaaattgtttgtaatgtttttgttccccggcctaatcttgaacttacaatcaaatataaaatattacaaatatgtacattcaccatttgttctgcaatttttgtttcttttgattcaaaggcgttggcattgaaacgatttcgaagccaccgattgttaaaaatatgaaatgttgtcgaagtgacgaggccaaaacccagcggaatccccttccaattcatcagaaaacgatcagtaaccgaagccatttctaaatatatacacataaatggaagcaaagcaatgtaaaaaatgtaaagcaaaataaatgaaaaacagcaaattttaatgtgaaatttaaagtaacaatggaaaattaataatatttatccataaaaaatggagacagaaaatgtaaatacataattaaatatttgtcatcggtcggaaatttctttggcgttgtttcagctgctgattgttggttcttttgtcaaccgcgcatttatggccacagcccggcacaggacattcgtcccactgggcgaaccattctcgaatgtgttccaaatggccaccatggccacagccactgcacgtcgtccaaagtccgcgcacccgagtctcgctgaaatgccaattttttttttttgaaaatgtcaaccagttgcctaactcaccaaatacaacagttatagtcgtgaagtcgttggcacgatttgcaccggggactcgctcggagtgctgcgtttttgcaatgcgtacaccaaactttcataaaagtgctctgaatttgaatttagaagcctaataagcactggtgaaagttttataacaattcgatttacttcattacttagctgactaatctttggacgagaacagaatttgacgaaaagggcagcgacacgccacagacgaagcctttgaagcagttcttaacagtttgattttgataacagattcgcaatgctcataaaatttcaccagatangtcatgaaccanagttcaatttgcgattcactggcaagccccgactcgaccacgcgttctcccataagcatacaaa

SEQ ID NO: 16640 - DNA, 1773 bp, Heterodera glycines
cctgaaaacataacaaaattcataaatttgtggatttgtatgaggttttcattttggattagaaatctttttaatatttattggtaaataacacacgaccattgcgcaacagtggtcaagcagtgcctttagagaagggatggggtcgaagaagagcagtgcggcgctgctgcacttttgcaaagtcttcggggaggaccgtcccatccgatcgcctgcaaatgcaaatttcgagtcaaatcagtccgatcgcttgctgccgatcactttcacttagttgttcctcatccaaagaaccttcactttcatcttccgcctcatctccttccccatttccttctttgctgctttgagttccgtcactttcgaaggccgacgacgagtcgtaagggggcaatgaggaggcgaaagagccattcaaaagagggacagtaaaaatttgggggttttggctgctcacccccgaacttttgctggtcattccctcgtccttttccccgtcattttcattcagcacatcgtcgcttgtacggtttcgtcgttttctgctcctttgtttgtgccgcatgcgaagtgtttctgctgttaatgttccatcggagaccaacttgcgtcttcggttgagagatgtgccgtgaaagcgaggtgcaaaagcctcctctctcagctgcgacaaatccacaatgctggagcttacaatcgaactgcacaaaataaacacacaaatccaaaattaacagtgatatgaaaacgtaccgccgaccgatggaatgcgtcgcatccttttccaattgctgatcgccaaactcagtgataccgcccaaattaagctcatcagcaccgaaaaaaggatttgaggcaccgaacccaggggctttgccatggtgttgatgagcaacagcagaaagggagtcggaaatgagcagtggccgatggacggtggggtaaccctggcagaaaattgggataagcaaaaagccaagggatggaaggggcgagcggactttgtccaacaatggcagggcgaccgttcggccatcggctgacagagagtgtccgctgccgtgcataaggcgactccgatgactgaaccgatggtagccgcccttttgatgatctgtaaaaatcaacttttgcttttccctttcctaaattattttaccatttccaagcaaaaaattagacgacaacgaccgtcggaagcgatggaagtgatcggtcgcggccgcactgccggcgacacttttcagcgacgatttgacagcggatgaaaaatggggccgaactgtgacaaattcgttctgagcacagagaagggcgatcactcgccatgtgtaagcaaggcgacttctgacaatgcgaaaccgtttcaaagtttaatcaaattgaaacaccggaagatcgtctcagcaactttggcattgtgttcacagagttgttcgacagtgcctccgacaattttgtaactttaaactttgcattaagcaattatttatttgtaatttttacttctccgcgaaatatgacacggcacgggaagtcatcaaaaaagggtcggaagggaaagcgcagaacaaattactcggcactttacgtcggaacgggtccacaactgaactgctctttcgaagatcagacggaactgaaaaaacataccaaaacgtaacaatttatgaactttttaatgaccagcgacggtaatttcatcgaacggcgaatttgagtccaagaaagactgaattggcgtagagaatgggatggtgggcatcgtca

SEQ ID NO: 16641 - DNA, 740 bp, Heterodera glycines
  misc_feature (33)..(33): n is a, c, g, or t
tctttttatgctttttccctgcttaaattatcncattgagctttaaaaatttattttaataccttcaaataaataatttacatcttttaggtgtgaaattattctccaaaacctttggtgtttatttatttgaatttcgttctttgataatttgggcttcgtttcggactttgactttgtgtatgtattaatccgacatttgccaactttgccggtttgctgaaggtttcaagcccgacccggccctggaagtgacgaccagtaaagagaggcttaatgtatcttcgtcctcatccatttccttcctttttcttagtacttcttccactcctttctttctctcgccttctcacagactcttctctcctgctgttcatcttcctcgtctcgttctgttcctctaacttttttctcctccctgctcctcttcctctctttcccctcttctttttcctccttctcttcctctttcttcgtctccttttccctccatatcattttgttctctcttccctcctcctcctcatcatcctcctctcctctttctctttcttttatcttcctttccatccacgtccatttcccctccttttcgccttcgcctcctcttccgccaatgtttgcttccgtctcctcctcctcctcctcctcctctttcgtatttggttttcctacccatccgtcctgcagcggcaacagcagacgctcgtaaataacgcccaaacggggggggggggggg

SEQ ID NO: 16642 - DNA, 1653 bp, Heterodera glycines
ggagggagggggcagctgaaggattttggaaggccaaattccaattttatgggtatttattggacagaaaacgaagacagaagaagcagaggaggaggagaagaatcagtccattggaaacgcagcgaaaggcgccgcggcatttgagggaaaggcaaacgcaaagggacagcaaaaccaaggcagaaacagcccaaattggaagcggaaaagaaggcctcaggcaagcaatattttgggccctgtacgattggatagttagtcaccattgaaaagagagtctttcccatctccctcaatccgaccgctcggtgattttatcggcacaaaaactattgaactgagaggagggtattatgataagcatgcacattcttgggtgtgctggctttgagtcttggtaaggctggttttcaatccgggttctgacctggtccatctatctaacaaattctgttcctgatcggggcaaattgagcatggcttcttctctcccccccttcctctatttgccttgcataaatttcaacgtaattttgaattttcgatccatgaaagcgacaggacaaaggattgctgttaaattttatcctgcttaattactttctgtccgtttccgattcctttgtcatggctctctcttttcccaaagttttcagcttatactaaaaactaaaagatttgaaaaacgacaaccgctaaaagggccgaaagctgcggaggcgaagcgaattatgctcgagagtcttgtgcttaagttgaagaatgtcttggaagtgatttgactctttccgatcgttgttgcttctaatttagctgttgattttggctctagtgcactttaggcgtccaatgttcagtttctttggccaaactgttttcttacttggccaatgtttacattcttgatatcaaacgaaagcttaaagtcccgggaattcataaatataagaaaagagcaaatattggcaattaaaaaatattaaaaccagaaaacacgaaacgcagctttttcgagtatattcaagaacaattttttgtctgttgtttttagtccaaaatttaggtatacaaaaaattcagacttttaagcttccgtttgataccaagaatgtagggattgattgaacaagaaaaaattatggctaaagaaacttaatattggacgcctcaagtgcactagagccttgatttctgcctgtttctgtcggtttgattttgctgcgttttcggccgatcgacgaatttggcaaaatttgccgattgaaaaacaaaaggcaaagaagaaaaaagatggggcaagtgccattatccgctttttcttcttcttttgctgctgctgatgttatcagtgagtggcgtggcattttccgaccaaaaaaagtgcataaataaaaaagcgaaaagggcaaaaagaaaaaagaaaattaaataatgaaagatatgtatattaaatatcttttgcaacctaaatgatccgagaaatgcgtggtaatggagaatatcaattggcgcaagcgtctcgcgaaggctggtgggaggggagggaagggaggatctccggtacgggcagaaatgtcggaggcgactggagggagggaatggggaggggaagcgaactgaactgaacacaaaggaagcgccgacacacaa

SEQ ID NO: 16643 - DNA, 3889 bp, Heterodera glycines
aaaaaaaaaattttttttttcattttacggattacgtattacggattacgccaaattacggccttttttgacctccgtaatgacggattacggatggccgtaacttaaaaaagtgccgtaattacggattacggatttccgtaattgaaaatcagttacgtccagccctgctgatgggaagggacggggtcattttgccgtccatatttaaaatgtcataattttttcatataaaaaatttaaattttttttcaaattttacagtttagagtttgtcaagcatttttgaatgatacccagccaaatcaataagccatcgggagaataattaatgactagggatgtcaaaaatatgtataaaaagtggtcaaaattcagggttcaattacaaatgctaaaatttaatttagaattccatgtttatttaaattaatttcacactttgttcttatgttacaacaatgacagatgaattgaaaatgactctaaatgtggcgtgattccataaatcagtgcgcatccaattagtgaccagctaggattaacatctttgaaggccaaataaaactgcaaaaataaaatgtcaaaattatggctgtaattaatattttcattcataaaaatagttcgaaaatttattgttattattttatcagtgcttacagtgttatctgttgtgaattttgtaatgcaatatttcagctaaattttcttttttgagaaagcttttatttaaataaatgatttaatcctgggattaaacatagaaagtacatcatatgataaaaaactacttgcctcaaaaaattcaaaacaaatgaaaaatttacccaattaaccaatggaaaatcttttgtgacgtggacaaatacttcctgtgaatgagaccaaaaattgtaagtagaagtcacacgaacttttgaaatatatccaagaactttttgtaacattaacaaaaacgcttgcactttaattctttaatatttaaattcaaacaatggcgcttgttggttggcctcggttttgtatatgtgttgataaaagtaaaattcttaagaacatcattctgaattccgaaccctagacccgaactcgaagaaaaagtcgaaagtcaaaattttcgaaattagcatattactgaaacaaactgaaagtcatcaaccatgtaataaaagatcatttaggccgtttttggatcaaaaatgctaaattcgaatatccatgtttttcgtgcctacttagacagggattttttccgatatgcctatcgtctttctcattttccttctcgtcctccttaaaagattatgtctaaaaatgacttttttgtgattaagagccaatattttaaagaaaatttaaaattttttgttagcgtcgaatggttttttgagaaaaataatccgtttccagaaattttttgtttctaatatgaatatttaaataaaacaatcagttcataaattttctttataaaaatttagaaccaaaaagccgcgagtcgctgtcgcgcagtaaaaaaacccgtggtcgcgggtcgcgcatcacgaatcaagtatccgttgcggtcgcgctccacccctgatgctcccagcccttcgccttcgaccagataatgtaaaaattggtaaaaaaataaagctgattgtttctttttaaatttcattaaaaattacatttatttttttgaataactttatttttcgattagttttatcaaaaaaatttattatattcaggataatccttataaggatatattttgattcaattttaatcaaaaaataaaataatatatattagatttaagaatttagaaaattacttcttcttaattaatacattttatttcattttacttatgcttattaaaggaaaaaagttttgagaaaaaaactagtaacaagcattttaaaaaattacttttttcaattagtcaatgtgccggttattatctactacaattttttgtttacttggcaaaatgaatgtcatgaaaaaatcaaaaaaataaatcatttcaaatcggattaaaataggatggcggcacatgtgccaatggttgccgccaaaaacaaaaaaaaaaccccaacaacaccagctaaaagccaaataatccatcaagtcaaattgagacattttggccattataggcattcgtgccactcaaccacacaagccagcgtaaagttttaaccgaaacaaaaataaataacaaatataaaataacaaatatagagttacgtaataaaaaggcggaaattcgtcaatgaagacgaattcttaaaatttacgccattttctttagacaaatctaaccgccctgttcccgacagaaattgtacttatattccacacattaactaaaaaaatattttgccccagcggatggcacggatttataagacaatgtcctttaagtgcacatataaaaggaagataaaaacgattttgccgcatgcagtttaaaaatattaaaatttattttatatttaaatacaattaattaataaattcatgtagtgctgattaatcagaatttattggatttcttaattaatttattaccatgagagtgaattagtgctgagtgctgtgttaaaaagtttatttatttcaatttattatcaaaatctatttcaatcagcattttaagtttaccaattattaacaaatattaaaaaaaactttctgaatcacttatatttttttttcaaatttttccattttctttttcttcaacgtcactttttctttgccaaaaacatgaacaaggattttttgttcaaaaatattcccaagaaatttgtgacataatgccaaaaaaatatgaaatgaatgccaaaataattccttccattttcatgcatggcgtaatccgaattcccatttcgtgtcaccccgcgtgccgacgatgagtgctggtgggttggtgagaagggcatgatgctaaaaagggcacaaaacctaattgagctgaagaccgtgaaaaattgagttggcattatgtgccaaattttgcggaatttttgtttccttccgggtttgttttcagcatttttttagctgattttatgtttaaggattttttggacttctgaatttatttttattttttcacttgttttttctgccttcataattggaatatttcaccataattttttgtaaaaacaaattttcgaattatgaaatttaattgattttttaataatttaccaccaaaaaaaagttttgtgcaaactttcaaacattgttgtatcattcgtaaataaactatttttgctttatttatattatgcttaacgcccacgtattctctctctctctcattttttgctttttatggcccgaggcgctaaactaaaattggacaaatattctcttttctttttcaaggacacttgcccaaaaatgcggtttaacgttttgtgtgaaatattaaacgagctttttgtgtgggcgccgtgccattgacggagggcattcatgcgcaaaaactaatcaagccaatttgtagggggaaaagcggacgaccaaaagcgaaatgcataattctgtcctatggacttttgtgtagttcgcagagaaagtccctgcacatttccgacttgaccaacatcagccaatgaatggatggccacctgccacgaggaaataaattattaattagctaatttgattacgtgccactatttggttcaaatatttttgaaaattagataatttattaattttaaagagcattttgcgagtgatattatattctattgtaaaatttaacatattcccatcattttcttatcattaatgctaattgattcgtaatatattaattagatcgcaatttcacatacgatgactgtgtaaaaagtgtaacaattagaaa

SEQ ID NO: 16644 - DNA, 2957 bp, Heterodera glycines
  misc_feature (27)..(27): n is a, c, g, or t
agtgataatgatgagaaacgcctaaancttatgaagcaatcaataaataaatcctctatcatattaaaaaatatatttacatttatcaaataacattctgctcatatatttgaaaaagtttctataatttaatatataataagttgaacaaaaataatatggtggcacaataatttccgtcacagaattagcaaaagcatttcgtgtcgaatacgtggaacggcgcagaatactaggcatgttccaacctttttgtaggacgacaatattaatttaaaaaagatttgattaaaacaaatatttattaatttaaatgataatcgttttatatattcttattaattacttgttatttttaatgattttttatatttctcatcatcaattatattaattaatttattttctctaattctttataaaaaatgatgaataaatttaaaaaatgattggatttaaaaaaaaattatatattttatacgcatttaactgaccgcgagaagaaaatattaaagaaaaaaaattctttcaaatttagttttcttttataattttctctttgatttatttgcattttaagaatacgatgggacataaataaaatgctattatataataaaaagaaaaatttattaaataaatacataaattaaaaacagaaaatttcaggtttattattcattattctttaatttcaaaaaattagcaaacattatttttaatggattggaaaaaagttaaagagtaattagtattttctattataaataataaaaaaattcaacaaaattagggaatcattcgctaaaaaaaaaattatgaaaatattgatataaaaagcgaaaaaaagcaggctcaaaagaatggttataaagttataagtttaaataaaatttatgaaaaaaagttttaaaaaatagaaacgaaaattaaccggcacaaaacctacgaattccttagagcggaaaacacgaagaaaacctctagaaataaaaaaaattaaaaatgttttctttttgagtaaacatttatttttaaattatgaataagaaaaataataaataatcagaaaaataaatgcaattttattaaaacaataaatatattaataataaataaatgataaatcattttgccaaaaactaaaatattttttattaatctgttattattctaaccaaatattttgctttaaattaaagttttttccataaaagtttttattcgttacctattgtaagcagggctgggcgtaattacggattcggtttatggattatgggttgcggatttttgcgatttcatgtaacttttaacattaaagaaaaatttagaaaatgcagcattttgttttaagtgctaaaaagttgcattaaatcgaattttttttatctttttaatttgcagattaatttcttcatatacagcaaaaaaattttatcataaagtgacaaaatttgaggctttttgaatttcgttttccctgtaaatatttttttttcaaaaaataaataagacgggcttttcttttcatcataaattataagtatatgaatttttaaaaaagttgcgtttccatcccgttctgcttcccacacacacaaaaaatgccacattttctaaaagccctgtatcattcgccactgacaccttaaaataagatgtcaccttcttctcaaccgtgcaagaacattcccctttacgactgaagtacatgcctaaacaaacggataaatttttaatttataatgcaaaccctgtattccgcatattttgaaatttctaaaaaaatagtaaattaaaattgtatcaatagtttggtcaaaaccttcactttaaaaagaactttgcatttaatatttattataaaaaatcatgagaataatgcttgtaatttaaaaattcttccagtttattctcagcaatcacacggcgtgaagtgtcgaaaagtgaaggcggaagtctatagagtaggtcccatgatcgaaccaaatctctaaaaaattttgaaattttgttttcttttttgtttcctcctatctacacgtttgttgtcaattaaaaaatcaacagggttcaaaagtagctctctgccccaggctttgcccattgctcttagcataggcgtacctttttccgagtcgtaaaaatcttaaatttctcacaatcttacagaaaaagaagaaagagatgcggcgatatgttgcaataaatcagaaaagcggctttcatagtctctatgtacagcaattttataatttgatgactcaattaacaacgcctccacttttttctggttttcggccagaaaaactcttccttttcgagagccttctcgaaatatttttggaacgagaacatcacatcttaactaaaaaattaataaagatcaaattcgaatcaataattattgaatgaacaaaaaattaaaaaaagaaaaaatgaaaaattatttgacaggaaaagaataagtcaataattaaagatcggattaggtgatccattgatcccgatccgtggattgtaatccttttttggggagttttgtcgtctttttttggttatggtaaatgaattttttggagcataaattttttgaagaatgaattaaaaaagtggtttggatcacatatagagcaagcgagtctataaacatgaaaaataaaaaataaataaataaaataagtaaacagaaaatcgaagtgattaatcaattctactgcataattaatttgttcttacaaattagcgttagaaattgatatggactaaaaagcccgaaacatggactaagaagctcaaaaatgacctaattttaaatttaaaaatgcataattttattgtgttcagttgtataaaaaacacctccaagtttaaaaatttcaaaaaaattacattaaaaaaagaagagctctacaaaaaataatgaaaatatttattaaaaaagataaatgacg

SEQ ID NO: 16645 - DNA, 3047 bp, Heterodera glycines
  misc_feature (34)..(34): n is a, c, g, or t
  misc_feature (2979)..(2979): n is a, c, g, or t
  misc_feature (2997)..(2997): n is a, c, g, or t
gtacgacggcttcaggcctggtggaggattcttngaccgtatgtcgccggtcgcattggaaacaaccagtgttgagcggggcggcgagcgtgggagttcccggagccaagaaaggggcgacagtcggtggtggtggtggtggcacatcgtcaaagcgggcggagaagagattggcgaggcgggcggaggagaaggaaatgaggcaggtgtatgccgcacatttggcaaagaagaaaaggagagcggaggagaaaggtgtgttgacggattcgtgcttatgagtttgactctttgaacctaaagaaaccggcacggacccaacggtgactgaacagcagagcagttccggagggggccagcaggtgaatgaaggggaaaagggcgttattgaaaagccgaagtcccgtcgcgggagcattgctgggtgaatgatcatagtgatcaatgccgtgatcatattgatctcaatttgtctttatgactgcttatcatattgataaactttcactcttgtgcttgaatctaccttactcttgctttctttttccgattacattggctcgtttccttatgtacgacttagaatagatctggtcaaccccggggggttcgacaaggcgtcggtgttaggttattgggcaatggcttcggagtaagaagcccggctagtcttaacggataggccgggtttgtctagcggaattgactcatccgctagttaggggcggttggggaggttactccgaaagtcatgctgagatagcctgtgctgtggcgccgaagctatgagaatcttatctcctagccagatcgaaagtgcaatgagacccgtagatatcaaccccgaggtattgaataaatgcccgggagggaccagtagagtgggtacctgctggtcctgggtagggtaagtgatcggtggtttttccgcagaggcggtgctacaccaggtcgaacgccagaaccgtactgcatagaataatatggaaaaagttttgataagcaacccgctcgagctttcaagcgttcataactgtgcatgcgatttaaccccaaaagacctctttaggtctgttggtcccggcacgaatggtcagcgtgggaagggtgtcggtgaacatcggtgccccacaagtgactgtgctggtaaagacccccctcagcgggggttgcaaaaagggaacttaagctgtaaacgttggactcctagtgaagagaaggcagtctttgaagaatggtcgcggttggaggcacaaaccaggctcgatggtagtgcggcccggggtagctgcgccataaataaaagacagtttctcgttcactgggatggcgtgaaagagtcacggtcctcggcagaaggtgtgcctacttaccccgaaaggagtgagagggcatatttcgagaggatcagactcttgcgaaagaagcgcggatgggaatgggattgtgctaatgaccgaatagtcacaggccaacccgaagtaccaggccgcggatcgcgaacgcgagtgatagccgcgaaggctgatttgagtgtaaggagaaagctggtgaaggggaaatgcataaccccgccccaccgagatggtacggaagaccaggagagtgacgacgaggaggttgcaataaccgtacctgtcgacattatccaggtggaagaacccgagtgtacaggtgtaaccgagggccaaataccaggtgaccctacggggaacccggaaaaagaagccgcgggggagccagcacagaggagcgtaccaattagtgggataatcagcgatggtgaacggaagtacctgaaggtacgattttggagtgcctataaaaaggcccaggggtcagtgggaaacagacccgctctaaagatcgaaccgagtaaggtcaaccgtgcccagtgggaagtactggactcctgtgttgctgcggtactcaagaggagggaaacctccaaagggtgccggggttgtatcctccggacattgaacgtcgctgtatatgcggcgggacaagtgctggcggaaggcgaccgggaacgaaggcaagcgatcagacgtcagtcgatggaatggttgcttcgccaaaagtccgagatcagcaacatccgtagacacattggttggattactgatgagttaaaacggaggaggacaggaaagaacccaactttaaggcagttaaggaattttcagtggctccaaaggcgttaccaagtcttagggaaacccgtgagggagactagggacttggaaacccaacgggagaaacttgttgttcgtcttcatatggccctagacagagtgtcggtaactacgcgacgtagcgaacgaactcaacaacgattgttgcctatgcggagaaaactggaggaaccaatgggtgactcaaagttggatcctgcacaggcgcgagagttctgggctggtctaattggaaagcggaaggaattcgagagaattccagagcttgaagattgggcagaagaaacgaagagcaaggtcccaagtgatcaaactttggacgaagaccgaaaagacctatttgcctggaagaaaatactgggaaaagccagaccattgaaagcgccaggaccggatggtgtgcctaacttgctttggaaaaggctaccgtccgcaaaccaagcactttttaagtggttaatgggaattaagcgtaagcaattacgcgttcccaactggttcaccaggggaagggtggtactccttccgaaagggggagatccgatggacccggccaattaccgacccatagcgtgtttaaatacacaatataagctagtaactgggatggtaacggcatggatatcggaccacttgaccaagcactcaattttgccttcggaacagcgagctctggtggctggcacttggggttgtacccatgctatggtgatagacagagtaataacgtcgtatgcgaaggcatccgggatcccgctttatgtaggattcgtggactttngcaaagcgtttgactcangtagtcaaccttggctaagactgcccttaaggtggccagagtccataagc

SEQ ID NO: 16646 - DNA, 2898 bp, Heterodera glycines
aactcttcctgctgatgaaagcagagattgtgtcaaaaaattgacagaataagcatttcaactcactgatgaaaaaagccttggtgttctaaatgaatcattaaaacaattagcgattttttttttaattttgggaaaatttttttaaaaattttaattttttaaataggtcatcatcgtcagccggccccgttgcaattcccgcccaacggtttgccaattcagcccgtatttgtgtcaagaggcaacaacaaccaataccagcaccagcagcagtacaactttggctgtccaagtcggttttgtattgttttgttctctttacaatctgtctgtaaattaaaaaataaaaataaaattttattttaataataattaatctcaacattttaacaaataacggaaatatgcaaattaattaactattaaaaataaatttttggcttttaagataattctgaaaatggggattaatttatttgggaattatttcaagccctttcgaaaattaaattttttttcacaaattttcacctctcaaacttattcaaaaaatgttcaaaattaaaaatatctttgtattatatataattgttgcaaatagatggcatttgttcacgaattggtgcccaactgaacaccttcaacaaccataatgacgacgatacagtaacccagccaccgtgtgctgctcgaaagagttccgacccatgcgccccgcgcattggtacggtaacccgcgttgattaaattacagtattcaaattggatgccattttttttgttgttgaaaattttggcaatttataacagggcattttttaggaaattcatcgattaaaaatcaaattttttgtacaaatttaaggcgaatcaaccgatcgcgaaaagaacaacaatctgtggacagaatggacggaatggacacagtaaaaaaatgcaataaaattataattaaaaacaaataaaaatcaaaattaaaatgtgtttgatttgtcattttttgccagttgttcccgcagttgtggtggaggaaaacagatgaaacgacggtcatgcaaaagtggtgttgatgaccaatgtgttgggccaccaattgaatcgcgtccatgtaatgatgaacaatgccctaccgtaagtgaacttctttgactgtgattacagtatgccataaaaaaaataaatcaattatacaataaattttatagctacaatatgtcatatgcattttcatttcaatttgtttatacataactaactaacaatgcattgtgatactgtatgcttttgtgtttatacgctctggttctttacagtacgcttaataattatattgtaatcaaaaatatggcaaaataatcactcaaaaaataccattggtttagagtttttctttaaaataaaaataattgagcaaataattaagtggtcaaattggggctcgtggactgagtgttcagcgacttgtggcactggcacacaacgaagtgaaattttatttagaatttggtcgagactctcgaacattgaagttcattaattaataaattaatgaaggagtgcgtgagtgcgagtctcctcggcacaatgccaatgctgcaatttgtccaattggctctggtgttgaacatcgtgaatgcgaattacgaagctgtcccgagtggtcccaatgggaaccatggtcggcatgttcaaagagttgcggtgccggtgaatcggtacaacatttattggacgattctgccttgctactcttaaacggcccaataagcttgacccgtcaaagcgtcgaaggctaaattttgaaaaaaaatttttgcaggatcgatcatttttaataggctaaattctcaaacattcaaagaaatataaaataaaatacaatacaatataaaaatcaatttacaaacttttctccctaaaattcatcaaaaatttcgaaaaaaacgctagaaaaatttacaaaatctttttcttgtaattttcttataaaaaaatttctgagattttttgttgaaatttccaagtttgaagaaaaatcggcgggaaatgacggggggggggaatgaagttgcacccagttataatcaattatgtcacaaggttcgtcgtcgacagtgccgtaatgctgcgtcgaaggatgagtgccaaggcggcgacgtggagcgcttgctgtgcaacactcaattatgtccggcatggaccacatggacagagtggtcagcgtgctcaaacagttgtggcaccggtggcacacagtcgcgcaaacggtgggcacaaatgcctgttctgctgggggctcgaaaattttcaagaaacccggaattcaaatttcctgttaattaagataataatgtgaatttgtctcctccccccccttccgtcacccatttttcgaaaaattatttttattttatgtttttaagacaaaaaaaaaaattcttgaaaaatttgggtgtcgcaagaaagaatttctgatcaaaaaaattttccagagaatgtcgttatgctggagagttaagcaacgagtgcacaggcgcggccaaagatgaaaagcaatgcaaacagttggaagcatgtccaagctgggccgaatggggcgaatggtgtgcctatgacgtcactcaaaaaccacaaaaaaaaacaaatttgcctttgcttaaaagcaatcaaaattttaattctcgatatcattcaatagctctaagggttttctatagtcttgcaaaatttcattaagttttaaaaaagttatggcatgaaaacccatgtttatgtgtcctttgggttatacttttttttttttaatttttcgaaattttaaaatttagctgattaaaaaaggttattttaaactttaaaaaggatattaaggactactcaaaatttggttacttt

SEQ ID NO: 16647 - DNA, 805 bp, Heterodera glycines
  misc_feature (16)..(16): n is a, c, g, or t
  misc_feature (26)..(26): n is a, c, g, or t
  misc_feature (67)..(67): n is a, c, g, or t
  misc_feature (75)..(75): n is a, c, g, or t
aaaaaatcttagaaanattttcatanaattaaagaaaaaattttttaaagaattttccgcgattttntcacattntacatatgatgagattactaaatttgttcaatttttcttgaagtttcccttatgaaaaaattctaatatttttgtacaatttaaatattaaattgaaaaagtggaagtcattcgccgattgaatgaaatgcaaaatatgcacataaaaagtgaaaaatatgtacatgaatttttccaaattgagtgtataatttttcaaaatttctttaaattcgctaaacgcaaagtaaaactttcaaaaatgactaaaatatggtattaaaatcattttagaagaaaaaaacacgatacagcttaaattttacaaaaaatcaacctgaaaagcaaaatttcgcttttttgcttattttggacataattaatcaatttttaagaaaattttaattagtcaatattttcgacaaaattttgctaaaaaatgtctttttcggaaattttttcggtctttaggggtcaaaaaggccaatttacctgataggggccgttctaataggggtattttgaaaaaatgcccaaacatacacataaaatatgcacaaatatgcacataaatcgcgaaatatgcacaaatatgcatatggaagtacggcctagaagcttctaatcaagctaaaaacatgtttttcatgtgcgtttcagacatcccacacatcccacagtccaggaaaaaaatatgcatatgcatataattctatgccctattaatgaggattgactcaaaaaaattaaa

SEQ ID NO: 16648 - DNA, 1140 bp, Heterodera glycines
tttccaaaaaaatttttaaaatttttttttgaagatggccccaatcgaatagagcatcaaaaacggttggctggaaagtggtgtccctttttccccgaaaaaatctgttaaaaatactaaaattcaaaaacctcaaaaatgatgagggggcctagctcgaaaatttctgaaaatttcagaaattttaaaaaatggacaagatagagctcgccgagctgtacaaaaagttcagcggcgccaacacgctcagcacaatgcccagcgagttattcccaaaaaaccgaaaaaccgaaaaaatggaaaaaaatttttgcgaatttttgcaggccagggctttgatcctagggcctcgcccaagaagaaaaaaatttcccaaacattccaacttagtcgcctcccagcagacgtttttggctccggcttccctgaaaaaagttttggcccaaaaactgcatgcatttttccccaaaaagccatttcagcgccgctggcgctcagttggcctccggaacggaatgcctatagttttcctggatgcgcctcaaaaagttgcttaagcaatgccacactcccgagccccttccgccagcggttcccgagattttagttttagcaatgaaactcactgtttctttagttatatataaactagcgtgtcgcggcgcagtaattgctcggtgtagacagtatacttttggtatatatgggcggacgctgacatgagcgcttcgcgcaaaggacttcgttgctagtgcatgcgcggttttgaaatgaatttatggatgtgataagggattttggtctacaggcatcgcgagtacgcattcataattttctggaggactttcggccgcttcgcggcctcaaagggcgctccgcacttatcttttttcaaaattttaaaggcgacatttgaagcttcgcggcctcagacgggcgcttttgcgtccgtttcacatgcgtggctccccacccttcctgcgatattggacactgatcgcgtgcctttcactgatctgtgccgaaatgaacacaatgtgatttttagcgcctgggaaaggggggggggtcattaagtcggacaaaacaaatcaaaaaatcattagttagcattccatcgattcaaagttaccccacctt

SEQ ID NO: 16649 - DNA, 817 bp, Heterodera glycines
gggaacattcggccgcttcgcggcaaaaggacgggcgcttcgcgcccgttttttaattttttgggggacattcggccgcttcgcggcctcaggacgggcgcttcgcgcccgtcttttaattttgttgtgaacatttggccgcttcgtggcctcagaacgggcgcttcgcgccatttttaatttttttggggacattcggccgcttcgcggcctcaggacgggcgcttcgcgcccgttttttaataaattaaaaaataataaacacggcctgggtccgaacatgccgccccacccctcagaatccccaatcacacagggattctgaggtcttaacgatgtcaaaagtaaaatctgatcacgtattcgtgatcagcggcccaaataacccctaaaatcatatttttggaagatttttggtgaaaaaaattttccactcaaaaatcatggtcacaccccagtggtcccaaattccaaaatcacttttatttctataacttttttcaaaaaagtgataaaaagctaaaataaaatttataaaatagagcaaaaaattgcggattttttgagtatattatttttataaaatacttttttagaagggagttctgaatttttttctgaaaaatcgaatttttccagaaattctggaataacttttttatttaggaagttagaaattccaaataaatttcataaaattctcctaattttttgctatttttcaaactttattccactaaatttgaccaaaaacgaagagagttatgaattttcaaaatttcactggattttccggggctcaaattttgacgatttt

SEQ ID NO: 16650 - DNA, 1308 bp, Heterodera glycines
agcgatggatgatttgaataaagcgcattgtaatggacgaaagtttttgccattttacggccattgggtcgcaatgccaaaagaatttgctggctaataaaagtcttaaataaattagaattagaaaacggttgaaaaatgaaaaggaaaaataaacacacataataaatcccttcgctgtgccgaaggtacaaattcctcattagcgatgcttcgtgagtttcatccaattggagaacattttcaacgatctcaattaggggtttgttagatatttcatgctgtttttaatcacttgaatgctcttccgatgcattggtcgcgcattgaaagttctgatcaaatcaacaatattaacgtcgactttctaaaaatgcttcgagagactgacttttgaggcatatgccttttttctgcgcattagttccgatatattaagcttaaaaacacattttccacttggtttgaagcttctacgaacttttattatgccttttttggcgttttttccgaataagtttagttttacgtgttttgcttcctaaaattcttaataaaaaaatcttaaatgtctattttcgtgccttttaatgcctttttttcaattttttggtgcctattatagtgactttttcgtgatttttggtccctttttagtcggtctctaacgattactttattttttttaatttaatttaatttttatttaaataaatctttttaataataattttcggcatattttttcgtttacttttccctcgtcgtccattaacaaaaggcgcttttcctctgacgccgttcgattgtcactaaaaactgataaaactcgggcgccaatcgcaacgccatcgctcccgtaatttttgttgtccaaccacaaaaagtcgccctcaattaacgttaatgtaaaaatgtacttatttatttttaaagttgaaatacttttttaatttggagtgtccattccatttttagttggttttttgaaaatttataatatttttattattgaataaataatgtgacgctaaataattaaaatgatcaaacgatggattgggtcagatgggtcagaagcaaagcgaagtgatcggcgagggcgtacaaagaagaaaagtgatcaacagagggaatgcgagtgatttgatcttgatcagaacagagataggcgacacggggggggggaatttgggtcaaatcgcagagcattttcaatgggcgacggatgggcgaccaccggcgattttggtgctataacgaagaaaggaagaaaaggaaggaatgtaaaggaagtggggggggggg

SEQ ID NO: 16651 - DNA, 1327 bp, Heterodera glycines
gggaagagaggaaattgagaggggcggtaaaaatcaaaagccattcaaaaggccaacaatttgactaattgcgatgcaaaacaagcagaggatgggacttaggaaatatgaatcatacgctctataaccgataatatcaaaatgattagattgacaatagaaaaattaagatatatattagttgttaattttttgcataaatttccaatttttattaagttattttttattaattttatagtaaaatttttcctaaaacagattttttatgaaaatctttccgtcctcatgggtcagaagggcggttttaataaaaatagccctttaatagaatttacataaataaatatgctcaaaaatgccaatatatggacaaatacatattaaatgagttctagattttttgtgcattttatgctgtttcttgtgcaagaaaaagagaattataagccctagcaattggtaaataattgattgacgcattagaaacaattaataagggcgaagacccacaaaaaattggcatttttaaaaatgaattcaatcaaaattggttgggtaatttaatttgctgctggtattttcctttagctagtctctgagtggggttttcccagtttttcgtaccctttttcataactgtttcgcacaaaacaattcgcatcccaaaaataaatattaattgggtacggtatccaatatacgtttgtccccatatatccaacggtttgtctacgggagtgagtattcctgattttatttcgttttttctgattagcaattttccgtctttgcacagcaaccgttgagcgtacagcaacggcgacactcgcatccggtgcagctcttcaagggctctccaagcatatttttgtttttttctttctcctttgttcatgaagattgaaatatttgtttttgtgtctccgcctgaagaagtggcaaaaaagtcggggacaattgctaaaattggcacatataaaattaggcaaaatgatcatgtttaatgaatcgcgcccattggcaccgccgaacccctcaagcgcgaaagcactaagaattgaatcccaaatgccccacgaccgttcgttgatcgattcctcgatcagtttgtattgatcaattaatcaccgtttgttggtcccaccttgcttttgctgttgcacctgctgctgatgatgccttttctgtgtttgttgtgccaacattaaatgctgtctttgatcatcgcttttgccgccgttgtccgtcgtaaataattctttcccaaaaacatatctacctaattatattaaaatctgaattttcccaaatcactttggcattt

SEQ ID NO: 16652 - DNA, 1736 bp, Heterodera glycines
  misc_feature (1732)..(1732): n is a, c, g, or t
gcgtgtcgcggcgcagtaattgctcggtgtagacagtatacttttggtatatatgggcggacgctgacatgagcgcttcgcgcaaaggactttgttgctagtgcgtgcgcgattttcaaatgaatttatggatgtgataagggattttcggtctacaggcatcgcgaggacgcattcataattttgtggaggactttcggccgcttcgcggactcaaagggcgctccgcgccttttttatatttaaggtttaactcggccgcctcgcggcctcaaagggcgctccacgccctttttatatttaaggtttaattcggccgcttctcggcctcaggacggcgattcgcgccattttcataattttatgggatcattcggccgcttcgcggcctcaggacgagcgcttcgcgcccatttcataattttatgggatcattcggccgcttcgcggccggctgttaagcctcaggacgggcgcttcgcgcccgttttttaatttttttggggacattcggccgcttcgcggcctcatgacggtcgcttcgcgcccgttttttaagaacattcggccgcttcgcggcctcaggacgagcgcttcgcgcccatttcataattttattaagaacattcggccgcttcgcggactcataacgggcgcttcgcgccagtttttaattttgttaagaacattcggccgcttcgcggcctcaagacggtcgcttcgcgcccgtttttaattttattaagaacattcggccgcttcgcggcctcaggacgggcgcttcgcgccagtttttaaaatttagttggggccagacgggcgcttcacgcctttttttcaaattttgttgggcttgggcgggcgcttcgcgaccgttttttaaatttgtttgggccagacgggcgcttcgcgcccgttttttaaatttgtttgggccagacgggcgcttcgcgcccgtttttaaaatttagttggggccagacgggcgcttcacgcccgtttttaaatttttttgggcttgggcgggcgcttcgcgcccgttttttaaatttagttggggccagacgggcgcttcacgcccgtttttcaaattttgttggggccagacgggcgcttcgcgcccgtttgatcgttttttaaatttgtttgggctagacgggcgcttcgcgcccgttttttaggggtacaacagtgattagaagaggtacaatttgtaaattcattaaattaaaatgaaaatattttttaacaactttaattaaaaaaatacatgaaattctatcaattaaaaaataattaatttaaacttataaaatgtattcatcaaaaaaaaattaatttaaatataattttttatttattaactcaacaaaatattttaaattaattaaaatcattgaaaataacgtaaaaatacacagaaaaataatgttacaccgtccggatccgaacctgccccctcccccctcaaaatgatgcctcagaatccccaatcacacagggattctgaggtcttgacgatgtcaaaagtaaaatctgatcacgtattcgtgatcagcgtcataaaatagccctaatgacatgtttttggaagatttttggtgaaaaaaattttccacccaaaaatcctggtcacccccctttggtcccgaatcccaaaatcacttttatttttgtatctttttttaaaaatgtgatagaaatgccaaataaaatttatataatagagcanaaaa

SEQ ID NO: 16653 - DNA, 2749 bp, Heterodera glycines
aaaaaaaaactcaaaaattccgacttttcatcaaaaatttcggaagtcggaattccgatgccccaaaaattttcggaagtcggaattccgatgccccaaaaattttcggaattcggaccccaaaaatgtcggaagtcggaatttttcaaaaaaaaatataataaattttttaaaaaatatttaataggctaaatttttaaatttttaaccatgtaaaaggtaatttcaaactgtttttagtttatttctatattttttaaaaagatcaaaatattttaagtaattttacattattttggattttttttttgggaaagttacacctttttttgcggcgcgctttatccaaagagaatttgagaaactgtggggaaggaagggtccggcggtgccgatatgcgccgccgggaaaaattttgtaatttttaatgtaaattgtcaacaaattttgtccaaaaaatggaaaatttagcgattttgagcaaattttcaagaaaattaagtttttttttgagtccggcggtgccgataggtgccgtcggaaaaaaaattgaaaatttctatgcaatttattaacataaattgtacaaaaattgctaattttttgaaaaaaaaaactcagaaaaattccgacttttcatcaaaaatttcggaagtcggaattccgatgccccaaaaattttcggaagtcggaattccgatgccccaaaaattttcggaattcggaccccaaaaatgtcggaagtcggaatttttcaaaaaaaaatataataaattttttaaaaaatatttaataggctaaatttttaaatttttaaccatgtaaaaggtaatttcaaactgtttttagtttatttctatattttttaaaaagatcaaaatattttaagtaattttacattattttggattttttttttgggaaagttacacctttttttgcggcgcgctttatccaaagagaatttgagaaactgtggggaaggaagggtccggcggtgccgatatgcgccgccgggaaaaattttgtaatttttaatgtaaattgttaacaaattttgtccaaaaaatggaaaatttagcgattttgagcaaattttcaagaaaattaagttttttttgagtccggcggtgccgataggtgccgtcggaaaaaaaattgaaaatttctatgcaatttattaacataaattgtacaaaaattgctaattttttgaaaaaaaaaaactcaaaaaaattccgaaaaattccgacttttcatcaaaaatttcggaagtcggaattccgaggccccaaaaatttcggaagtcggaattccgaggccccaaaaatgtcggaagtcggaactcggaattccgtgccatccctgatgggtacgcgccagtgtcagacaattgctcataacgccaaatagcgcatttggcgtaaatttttgcgcgttaattcaaaatttacactggaaaatgccttttttgcattttttattttgatctgccataactcgcttcattcccaactaaactgaacaaagttggtatctaaaaaaagtttttgaaaaggagaatctttttctaagcgaatgttaagtaatttgtcatctcagaaaaaagttgtgggaatttcaaacttttatcatgttataactcaagtcctaggcagctctttctaaccaaaatgctaaatttattcttttttctattgattctaaatgttcaaagtgattttgtacccttataaccaaaattattagaattttcgaatttggtgttttttcatgtgttagagacatgaaaatagtacgccaaaaggagaggaaaagaaatgattaattttgtttgagttaaaattttggatcggagcgtaaaaaaataaaactcgagcgttaaaaatgtgcagaattttttgctctataggtatgcaaaatttgatgtggatttaacaaacagaaaaaaagttcaacaggatgaagtaaatgttgttttttacctaattaaaatgaagagatagtacgccaaagcgaaagaaattacaaagaaaaagagaaacgacgagatagtactaggcttttctctgcacagtggggcgtacccatagtgaagccaacgacagacagaagagaaaaggtacggcagctgataattaggttcggaattatatgctctagccattgttttgatatttttaaagtattacataatttttggcatttttttcgattgttaaaagccatttgggtcatttttaaggcatattttatgcatatttggcattttttttattcttcccattagtttcgatatattaagcataaaaaacacagtttccactttgtttgaggcttttctacgctgacttttattatgctttttttttttgcctttttcgggattttcttgcctttcctgtttttttttctctccagcgtttaaatttccaaataacactggagaaaaaaaacgttggcccgatcagcaaaaaaaaggtctgaagaaaaaagatttgagcgttcgaaatttgttttttgaataacttaagatcggagcgtaaaaaacaaagtcaagcttcaaaaatttcgtaatttttttctcaaaaagtatggaagatttagtctaaatagaactggtagaaaaaatgtgtttattgagaagtaaattcagtttttccctattaacggagacaaagaaatattacgccaaaatgagatatttttctttgcactctcaatttattggtttatctccccattttt

SEQ ID NO: 16654 - DNA, 1851 bp, Heterodera glycines
atttgattttcttggcatttgttggcaatataattcgtcatttttggaagaaagtgaaggatgagcaagggaacgggaagagggaagaaagaatttcctgaaaatttgtatttatattttcttaggaaattttgttaaatttcaaaattttcgatgcatgggataaaaaaaatatgaaattttagccaaatttggccattttgagtctatttaaaaaaatatgcaaaaatagggaccgccgtttttgtttcatgatatggacaacaaattgctaaatatggacataaatttttccaaattgagggtgtattttttcaaaaatagctaaatttagtattaaaaatattttgaagaaaaaaaaacacgatatttttctaaaccaaattaagagaattggcagaaatttcaatattttatattcaatttttttcttttaaacaaaaaatcataaaacgactagctaattactagctttatttcttttttgtttttgattttcaaaaagtctataattaaattatttaattgcttttatgatacaattatgccgtctgattattgcactaattataccctttctaatgaggtattttataataaaattacaaaattggcacagaaattgcgcagcggctctctgctcgaactaagcagcaataaaaagaatggcacgcgccaacgaaagcacggctttgccccgtcactgatgttgtcccaacaacaaaatgtttgtcgaccatttgtcagcccccaacccgtggcaatggttggcacttcgtccctggactcattccccaccgaaactgttgttggcgctggtggcactttgtgccggaagcgatcctcatcacatccatcaagtacggtccctgatcggttgtcaatcttggcatatgctattatcattttattactgtatgtattcgtcggattctgttttatgtattacagtactcagtgcacaatcaatatttacccggggttggctaaacaaaaaatttttttgttttggcgtgggacaatcgaccatttttcgggcggcggagggttggcggtactcagtgtccgcattagtgatggtgttcgagaatctcggatttgagtctcggagatccaaattaacggtcttttgctctcgtatatcattattaatccgcatagttgcatagttaatttggcgcttattttcttctttttttttgttaaaggcacaacaaagtgctgtgaaaatttgttgcttatgttgtccgaggatgatgaagacaaagtggaggatgaattggatgaagcaatatctgcacaacatcatcatcataatcagcagctaaatgcggcacaacaaaagcataacaatgggacaatgacgacggcggtggcgccaaagctgtcgcaatgccggcacgacggcacaaagctttttgttcaaaatcatcaggctaatactgttgaggacgaagatgactacgattatgatgatgatgacgacgaagattatgaggacagaataattgttgagccaatgttcaggtgctgtgttcaatgcatgaaactgatctgataggggagggggtcttcttcttggacctgttgacccgactaatgggcctcaataccaacatggcacaagggcgtaggcagggggagctgagggggctaaagcaccccccccccccgaaaaccaaaaaagtaaaaatttttttgaaattttaagcaattttcttaacataattgcattaaaacataaaaaagactttcccggcggcgcctatcggcaccgccggacccctattttaccatatttttgaaaaatggagaacaaaatagcaaaaatagtcattttttggtgaaaaa

SEQ ID NO: 16655 - DNA, 891 bp, Heterodera glycines
  misc_feature (98)..(98): n is a, c, g, or t
  misc_feature (885)..(885): n is a, c, g, or t
aaattggcccctcaagactaaaccacaaatactacggtcatcccaggactgggccaattgagggtctcacgactcagcttatcccttcgtcattcatntaagtaagattcttcaaataacattaaatttgaaaatcttaatgagaatggttggtgtacggtagacacagtgtcgccgctggataaattttttgaaattttctttaattttcacttttttttcctcctaaacattggttttataaattaaataaaatattgaaaaaaacataaaattgtttttttaagaaaacgttccatctctttggatgagacgaaaaccgctattgccgccgcttctttcgatgaaaccgattcgaatgaaactgatcagcgccatctgttgccgaggacacacagccgacagcaccacaacattctccgatcaaacccataccttggtgatcagggaaattgcgggacataaatattgtccaagatgcaattaacactgatttttggatatgggataatattgcttttatctcgagactctcgagagcattttatccatgatgcttttcaattatttttttttttgtagtttttgctcatgcaccaaaagcgtcaccgtcgtccaatgcgaacagtgtgcgtagaccaaggctggtgcagcgtgccgaaagccaacagcaccatcctaccggggtaagttagttggagtgaacaatgaccagtataaattttactaccagcagcagggccaaggttttacccgaatcccgaaaccctccattttttctaaaatccatgcttacactgatcactagggacgtgaattttagtgaataaaagtttgaattttgctaaaaggtgatttttgtaattcggtttagcgttctcaganatagct

SEQ ID NO: 16656 - DNA, 964 bp, Heterodera glycines
agttcgggaaaatttgtttgccttaaattcaatgttttaacatggatgagtgaaattttagatgttagacttgtgacgaagaaaatttcaaaaatatttatttggagcagacaacccattaggagtttcgtaattttttttatttataattttaaccccaaaatgcgaaaaaattttagtacccaccagaattagtttaaccaataacgaaatgagagaatgatgatcggttgccaaaagtatcaccaccacgtatttctactaatttgattatactaattaattgattggttcttagtttaaagtatcaaggtggtaaaggaatttaggggtttaccaaatttgaaaatttaaaattctaatgatagaaaatttaatgaaaaattggtgtgaattaggaagccggcgattcggcaaataaaatttcgcgaattatcgcataaaatggcaaataaaaaagtttctgttgtatagggttggagctggatttcaataaaagttgaaaagattccatttatcccgcgacgaaagcactgcccctcggcggagggcattttattggcgtggcgaaaatgcgcaatgaaaaatcgtcaaatttttcgggggctttccttagaagagcaggaaaatccaatccatcccatccatttatcggataatcccattttcatcatcattatcgtccatcattttccggggcgaccccacaaaatctgatgaggatgaatggtgatcattattcatttttggctgatgattgattcgacgacaatttgtcggaaaatgaaagaaagcacagggaatgaatgatgataattgggcagaaaatgggcataattaatggcccagaaataattatatataaaaattaaaattgagaaatggcaaaaaaatttttttaaatgagaacactttgttcggattatctgttatttaggggagcagttttattttttttaatctc

SEQ ID NO: 16657 - DNA, 2184 bp, Heterodera glycines
aaaattgaactgcgggattttgaataccctaacaacgggattcatttttaaaatttgatgacggaatttttgaaaaatgccaacaacggaatttcattttcaaaattagacgtgggattttttggaaatctaaagcacaaacccctaaaggaaatcctaattaatattttggtaatatataaggtggcgtttttaacaaaatcccaattcctatgacctctcaaaattgtcactctcagccgccgcttatcccaaaattgcaattgttgggtcggtcggataaaagagtaatattcgcacaattggccctcctatatgcgtacattttgtttgttgatgaagaattcatcataattcagcgtgggtggaggaattcggcggtgatttatgatgaagaaaaattgggacagccatttaggatttggtaaatccgcggagataaatgtgcgagggattccgagcgtaatttgtgggtgggaaaatggaaatgttctggatttttagtggaacggacggattttatttatttagtttagctaatttcgctttttaggaaagttttttttaattttaaactgaatattgaaaaatcccaaggttgtttgaaatttagatgtgaaaatttagcttttttttttaaatttcaccaaattatgagaatagtgcaaatttttcaaattttccaatatataggaaattttttgtgttattgattagttaattttaataaatttttaaaaagccttttttatcagcttacgtattattaattaaattaatttttaaaattcactgttattaattattaattgtaataatttttaaaaagcatattttaacagcttacgggtaattaattaaattaatttttaaaaattaatttttttcgaaatgcttcggaaggcgtataattttgaactgaaaatgtccttcgtcaaatttaaccttggacgaaggggaaatcagcaccaccatcagcagcaccaatcagtcagcagccagcagatcgatgcatatcgcacatttttggaacaaatttatttatgtacgctccaaagcattttatgggagaaaaaaggcacagccgcaaaaaaaaaatgttggagagaagtgaaaaaaatggacttttttataagggcaaaaataaggacaaagggcacacacataatgccagagaaatatgttgtgttggagaaattggcataaagtaaaaaataaaaataatttggaattaaaacgaaaaaaagaagaacaatgacaatgatcgatcattaaggattattgaagataattaatttacacctattggttgtgaaggagcatgtgaaaatgataaatacaaggatatccatgagccaaaatgatcagaacaaatacaagggctgtgactgatcagaaattgaccaggacgagaaaaggtacagtgacttcagaattgatcaggcccaggacaaggaaagcgactgatcagcaattgatcaagaccagaccaatcagattagcaacggagagaaaactgatcaaaaaaataaagattcggcgggggtacacaaaagttggacagacaattggaaacagaaaaaggaaagggcattatggcacgacgacagatggcggcggcgggggatggatgaatttgatggggcaacatttgtacaaaaaaaaacattccccgggggggggggaaagaataattagcgaaaatgtgttagtgaaggtcatcccattcaattcattcgttcgtccattcatttctatctgtcctcttaccttttttttgttggggctatggaaaatgaaaaatgcgcatgaatttgtgtgaccgccgcgtaacatcaaaaaggaggggatggatgagttttgaaaagtttggttttggaataaattatccaagctttggagagaagcctcaagaacgaaaaatgaaaaattgccgaaaatgtcgggttaaatttttcaaaatttcctgaaaagttctaagaaaaaaattttcaataaattttggttaattatttaaaatttcataattttccataaattttggttagttatttaaaatttcatgaaaataaattttccataaattttggttaattattaaaaaatttcccggaaaaccaaaattttccataaatttcgttgaaattattataaatttcctgaaaaccttagcaattttccctt

SEQ ID NO: 16658 - DNA, 911 bp, Heterodera glycines
attttccggtcccgtacttttggcccagctttttctttaccggagcgggatttttaagatttccggtcccgtaattttggcccagcgcaattctttaccggagcgggatttttaagatttccggtcccgtacttttggcccagcgcaattcttcaccggagcgggatttttaagatttccggtcccgtacttttggcccagcgcaattcttcaccagagcggaatttttaagatttccggtcccgtacttttggcccagcgcaattcttcaccggagcggaaatattaattttccggtcccgtacttttggcccagcgcaattctttaccagaacggaatttttaagatttccggtcccgtacttttggcccagcgcaattcttcacctgagcggaaatattaattttccggtcccgtacttttagccaagcgcaattctttactggcgcgggatttttaagatttccggtcccgtacttttggcccagcgcaattcttcaccggagcggaaatattaattttccggtcccgtacttttagccaagcgcaattctttaccggagcgggatttttaagatttccggtcccgtacttttggcccagcgcaattcttcaccggagcggaaatattaattttccggtcccgtacttttggcccagcgcaattctttactggcgcgggatttttaagatttccggtcccgtacttttggcccagcgcaattctttaccggagcgggatttttaagatttccggtcccgtacttttggcccagcgcaattcttcaccagaacggaatttttaagatttccggtcccgtacttttggcccagcgcaattcttcaccggagcggaaatattaattttccggtcccgtacttatagcctagcgcaatgctttactggcgc

SEQ ID NO: 16659 - DNA, 2394 bp, Heterodera glycines
caattcttcaccagaacggaatttttaagatttccgcttcccgtactttggcccagcgcaattcttcaccggagcggaaatattaattttccggtcccgtacttttagccaagcgcaattctttactggcgcgggatttttaagatttccggtcccgtacttttggcccagcgcaattcttcaccggagcggaaatattaattttccggtcccgtacttttagccaagcgcaattctttaccggagcgggatttttaagatttccggtcccgtacttttggcccagcgcaattcttcaccggagcggaaatattaattttccggtcccgtacttttggcccagcgcaattctttactggcgcgggatttttaagatttccggtcccgtacttttggcccagcgcaattctttaccggagcgggatttttaagatttccggtcccgtacttttggcccagcgcaattctttaccggagcgggatttttaagatttccggtcccgtacttttggcccagcgcaattcttcaccagaacagaatttttaagatttccggtcccgtacttttggcccagcgcaattcttcaccggagcggaaatattaattttccggtcccgtacttttggcccagcgcaattcttcaccagaacggaatttttaagatttccggtcccgtacttttggcccagcgcaattctttaccggagcgggatttttaagatttccggtcccgtacttttggcccagcgcaattcttcaccagaacggaatttttaagatttccggtcccgtacttttggcccagcgcaattctttactggcgcgggatttttaagatttccggtcccgtaccttagacccagcgcaattctttaccggagcgggatttccggtcccgctcgcgctcccggaaagtttcgcaatcccgctaccgtcaattttctcatcaaatgtaggagtaaaaatgcactggttgaatcgaatttttaggttaattatttttaagtgaaaatctgacaaaattttcgattccttccacaaaaatattttagaaataccactaaatttcggcttatatttttatattttttcttccattaaattattgaccatcgagctgtgatttgtgcttatttttgatttggtacaaaattacaagaaatggtaatttttagccttaaaatttataattgcatatttttggcgcaaaacggtggatgttcacaaatctctaatttttagattaaaattggacctaaaaagctagaaattatttcggattaaaattttttaatctcagttctatttcatatttttgtttttagtttcattaatttttgaattattcctgctcacaccaggacttcccttcaaaattgaccggatttttcgggatattatgcggcgattttcgactctctttcttctccattctctctctcgatcgctcgttcatttctctttctctaatgcttccgccaccaatgttgccattttcctcacccccgcccattaactcaactgctctgatcagatttaaggggagagatttgggatttgagtcagttgttgatcacttcacctttttgatcactcaccaatttcccttggcttttctttaacttctggtcaataaagtgctttgttattggcttagaaaaaggggggcagcaatttgggagagggatgcgccttcccacatctcaggctctgcctgaaatgctgggaggacccaacattcctcgcgtatttccccgcatattacgggaatcccggcaatgctcgcggaaaagttttggactcccgtcccggcttgcgcatattttttacgggtctttaattaaagaaaaaattagaaaaaaaaactttgcctcgggaagacccgaatgaaaaagcgctaagacatggacagattggcaaatgctgaacagatccgccttttcggtcttaattgtgaaagtgaaacaattaaaggcatttgtattttgtgaaataatttatttatttatacagatttaattgtttttcatgagttctttacttttattaatgggcgaatgaatgggagttcggccaaaacaaaatgttcactgagcgaaatttgaaaagggtcggggccatgggctctttctatcaaaatagtaattaaattagcaattaattttccaaattgcgttcgaccataaaatcgcatcgcttcgtcccatgtggccaattctttgtttgcgtacggaaggcaaagcattcggctgaacagctcaaccccccagaaatttcttctcgtgctgctgcgccaattaaaaagggttttttgaggaaagaataacactaaaaaatatagattttttattaaaaacctaaaaaaattccaaattttgggcaaaaaaaaattc

SEQ ID NO: 16660 - DNA, 5148 bp, Heterodera glycines
agtcccccaaaaagcactccccactctctccgatcacccaatcacattccccgatcatcaaaaaataagcccggagaggcatcgccagacttttatattttcctgtcgttggccacaacagttgttggcccctcgggtgcatttggccaattgttccaaattgaacaaaaaaaaaagtggcccaaaaaatggcagggggaaagcattgatcatctcatctcatccatcaccagcagcagaggaggggaggacggcttcaaaagttcaaaaaatcaaagttttattaaatatgaaaacaaaaatattttttttagcaatttccaacaaaattttcttttaaaaatcgaaaatctttttaaaaattattttaaagcacagatttttctgaaattacttcattttcaagctgttgtcttctctgtttttttattttattttacattataataaatatttatttaattaaatattaaatttttgaaatttaaattgaaaaattgattttctcttgtcggtttgtaagatctcttcttttttgaataaaaattagatacgatttcagcccggaaattgggtaaaaaaatattttttttaagtcaaatcattttaaataaattcaaaagtttatttaaaaacattttttttttgatatattttaattgaaaaaccaaatttggcgttttgttcattacctaactctttgaagtcttcccgccctgatcagtttcaattttgaagccaaattttgcccatccagtcagctgattacggcggactgaggagaggacattgatccgatccgatccggcttctgctgctgccgctgatcagatcggatgatcaaaacggcagccaatcaatgcccatttgatcagagcagcaacagtctgatcaaaatttgtcccgctatttccgatcgcatttttatgaaattcgagaaacattgtctcgactgagctttcgcccagagtttcgattcgatcacttcaaacccaaaaattctgctgatcaaaatgcatacctctgctgatcaattttttttttgccgatagcgcattttcattttggcatttctcgagtccaacgcaaatttgtgccgagttcccaaaatttcgagagttttttccaatgcctttattcccgccgcccccgaaaatttgaaaaaaaattcgaatttaaaattttcagaaagaaaaatcttagaaaatttttaaaaattcaagaaaagctacaaattttcaaaacttttgcctcatccaatgccgtcggacactgtggagatggccgaactgatgtctgctgaggatggccaacctcagcagaccaatggcacggtgccaacaacagaaacggtggagcgaaaaaattttaaaaataatttcggcggcaatttttggtattttgccctaaattaattcaattttttcttctcttaggttccaaaggccaagaaacggctcagtgtccattcaattttggtcgaacgcgacgaatggtcatcctgggccgacttcatcatgtcctgtgttggatatgtacgttgaaaaatttgggaaaaattcatttaaaaatttgtggtaattagggctgaaaatttaaaataaatgttttacccatatttttttctggatttaaaaaaatattttcaacttttaattactattttacaaatggcatttagcatttgtttaacccatatttcgcaatttttcaggctatttaagcgaataaaacaaaaaaaaaaccaaattttttttttcgaaaattgactcctaagaaatggatttttttttaaaaataattaataaaataatttttttttacatattttatgtacattttgccattttcttacatacaattcaaagccctagtaaaaaatttaataattttttttatgaaggcaattggacttggcaatgtgtggcgttttccgtacctttgctaccaaaacggaggcggcgcatttttggtgggtttttaaaaaaataaaaaatttttaatcaaacgcctccttcattctctaaaaatttctatggcacttaaattttcgaaaatttttccagattttttttaaatgaattttaatttggcatccttttcaaaatttttaattttccaagggccctaattgtttttttttacaaattttccgaggccttcccgcaaatttttccaatttttccaaattttccgattccctacatcattgccattttgttctgcggtgttccgctgttcattctggaaacttcttggggacagctcgtctccgtcggcggattgggaatgtcctggaaaattttccagttttttttggtttttataaaaattttcaggttcaaaatttgcccaattttcaagggggttggcattgcggcggttgtgatggcattttggtcagagaatttgttttggttaattatttaattaaaattaatttttcaacaatattttaaatctttttgaccattcttcaggcttgaatataaataagtaaataaatatatatatatataaaatggtggaaaaataataataaaaataaaaataatttttaattaaaaaaatttatttaaatttgtttaaaaatgtttgtattcattattaaaacaaaattttaagaaattaaaatattattttataaaatttatttcaatatttaaataaaattatatttaattcatttttattcttttatatttctttttagctaaaaatttaagtattcattctttattaaaacaaaactttaagaaattaagtatatatatttttaaattttttatttaatttaaattacataattttcaattatttaaataattttaatttaaacattattttccaccaaatttataaagaattttaatcattttttattctttatattctatttttatttaaaattttaatatacaagaactaaaatattattttaatatttatttaacataaaattacatttttttaaattattaaattattttattttattttaaattttcatcaaattaatttttattccataaaaaatcaaaaaaaaaattgtttaggctcaacatttattacattgttgtgctcagctgggccatgtcctaccttttccattccctacggatggactcaaatgtgccgtggcgaacatgcgacaattagtaaaatcaaaaattaaactatgggataaaattaattcaaaaatagcgcaaaaattagagacaaatcgtaaaaaaaaaatttatgaatggattaacgaatttggtggtcttcaaggaaaatattcaaccaaagaatggaatcaaaattatgaagaaatttgcaagaaaattggagttggcaatttcataattaataaatggaagaaacaatttgtgaagttagcaagaaaataataacgaaagaagaaaaaatagtaaaattgaaaataattttaaatcattttgtgatgccagaaggaacggagtgtgggagaaagtgggataaaggacctgagagaacctctaaaagaggcgcccgtagctcagttggttagagcacggcacggattgctggggtcgtgggttcgagtcccaccgggcgagttaccttttatgttctacaatttaaaaatcagttggaattcccctcggtgccgatcagaatatgacccccgtgttgtgtgaatcgaatcggacaattgctggctattttatgttaaggtgaaggcatgaatgaaaaatatttattttattaaaaataatttaaaaatttacaattttaatttaaaataattaaaatttatattttctaatttttatttttatttccaatatttaatttggtcattaaatatttttatcaatttatttttttcattattaattttcatttaaactccttgtggacctctggatccaggcctccgttttcctgtccaggcccagctttttttggcaacctagtttttttttggcctagactttcttagttttttttggcctagactttcttagttttttttggcctagactttcttagttttttttggcctagactttcttagttttttttggcctagactttcttagttttttttggcctagactttcttagttttttttggcctagactttcttagttttttttggcctagactttcttagttttttttggcctagactttcttagttttttttggcctagactttcttagttttttttggcctagactttcttagtttttttttggcctagactttcttagttttttttggcctagactttcttagttttttttggcctagactttcttagttttttttggcctagactttcttagttttttttggcctagactttcttagttttttttggcctagactttcttagttttttttggcctagactttcttagttttttttggcctagactttcttagttttttttggcctagactttcttagttttttttggcccaaaatttcaaatcgctaattattttaaaaaaaattatttgccctttttaataacatattttttaaagtaagtttcttttaaaatattttaaaatggtttatcttaaatttatttcttttccatttgaaattaaaaatttttgttttcaattaaaaatatcatttttttcatttttaaatataaattaaaatttttcaattaaaatttctcagattttgacggacgaccatctgaatgagtacagaaaacagttcttcatcggcccaaaagtgaacttcaccatttgcaccgaagctgacctcagcgtccgttcgccggtcaaagaattttgggagtaatttaatttttaattaattaattatttttaaataataattttatacatttttattaatagtcatcgcgtattgggcatcagtgaaggcattgaacatgtgggttttaaaaaattcaatgtttattctaaaaaaagaattttctgtatttttttttgctaaaaattttttttttttttttttaaatccaaaagaaatttttttacaaaattttcattttgaaaaatccaatttccgaaaatttttattaaaaattttcatttgaatttaatgggactgtctttttttgaaaaatattttctttaaattctcctagggggttttgttttttcaaaatcttttgaaaattattccgaa

SEQ ID NO: 16661 - DNA, 3340 bp, Heterodera glycines
  misc_feature (3269)..(3269): n is a, c, g, or t
  misc_feature (3305)..(3305): n is a, c, g, or t
taggaatttgccacacattaatgaaaacagaaaaggtgaataaaatggagcttttaaagtttctttgcagtttttcaaaagaatgcttggtataccgtcaatagaagtattgtttttatccttaagtttacataatgaaaaataattttcagcatgagttatagtaaaaaaaatccatacttttttccagatattttttggaaccagtgggttcgggttcaatgttttgaatagtgaaaactgagaagaaaaattaaaaactgtaaatacttaacagtttctcgaatattatatttggtggtttttttagaattaatgtgttaattaatgattttgagttttgaatatttgctactttcattcctttttaaaggttttgtaaaatttttatcttctaactctcctggaccattttccttaaaattttaaaaaattaacccaagaattctgaagtgtttacacatttcaatttgttaataaaaagtataattttaggccagactaaagtatataaattggaatttttgaatgtgataccaaaatataaaaattttaaatactattgttttattttattatcttttgagtccctaaaagtttttaattaattcctctggatcgtttcttcaattatgacaagatgcaggctgtcagcatattatattcatgttcaatttcaattctttaactcagattgtgtttgattttaattaatataataatagatttatactagaaagcataatatgtctattttatttctttcaacttactataaattaaaataatttaaaataactttttgattagctttatatatatttttttcttctttttagtttaaaatctcattattatgccatagattagggaaaagttaattatcatttttatatgtagagtatttttctataggttttttgaagtatttaaattcgtacggcaaattaaagcgaaaatatccaagtttaagcggaaaaaagatgaaagttaattttatagatccatttaaacttttattcttttaaataaaagataataatattaattatttcttcaatttatgtgtttgttcaacaaatattaatattattaacagttttatctcttgctaattgcataaattattgcttttttgcttaattgaccagcatacgttttttttaatagcgctccttttgaaaatattttgaatctgagtactcgcgtgatattaaggaaaatctcattgtcttaattttgttactgataattcttgttctacgttccgtcttattctaattttccaagttttcgacagttatttcgttttttattataaatttctgaatatttttcatttgtgaataaaaaataaacatatatattaatagcgatgaatttttattttgatctttaaaatttttgttaaacttttataaattttttatttccgttagtgaaaactcaaattgatttttcttttaattatctttgttttaattggttccgttcaactttctctgccgcatgtcgtcgctgcggggtaataaagctacgcccgcacattgtaaaattatttgtaggtacgcggactccacattgacctggtaatgaatgtcctattatatttttttgtaagccattgggtttattattatttgttcagattttatcatactttaaaattgagtataatataatttttctcacatttcatactctaatataaattagtaaaatatttttttatttattaaattttttctataacattttcaattttatttgactaattaataagacgtgtttatgtttttacaaattagctagttttaccctttattaatttaaattctttctaaaattatattttcaattttattgcctattgataaaagatgtttatgttttgagtagttacccatgcagattttgggggttaattttcagccccgccatttcagtcccaatggaaagggacttttcagtaccaaatttaaactttaaaaaacacctaataataattatatataaatcactgaagggtgaaaaaatacctaaaaaaggaaaaaaatatttctaaaaccaaaacatattaaagtattttgaatttatagaccaaatatcaataataacttttacatattaaattattttgcacacaaccaataccaataataacttttacatattaaattattttgcacacaaccagccaataccaataataacttttacatattaaattattttacatttatagaccaacctataacttttacatattaaattatttttcacacttggcctaacaattttcattggcagtttaccatattcaaacaattttccgtagaataaatgaccaatccactcaaagtaataaattttgaataataaattatttttgcactcgcataactgcaattcaactaagaattatgcatattaaatgacatttttctcactataaaaaccctagcatattcacacaaattctctcttactccattcatttgacaattcaaaatctcgtactgcactcatctttccacttttgaaagaacttcatattgtgttttactgtcacaacattttttccagttctgagctacccctgctcactatttaaattattaaaaataaaattaatacgcaatataaattataaatcaaaaatttccaatcttataatgaagcgatcttcaaatacccaagcttcttcctcattcaaaaaatctcaaaccaataaatgtattcgtaaaattgaccaatttacttccaaaagtattaaacatcatttcatccgctcaaaatcaaaatttgttattgatgaaattgataaatgtaccgaccccgctgcggagctccgttcatgtgtgcaccattcgatcgaggaagcaattttagatggacaaaacatccttggaggagcaaataaggtaggtatcataatttcctcggaacttttagaccagggtgatatcatactgccaataactccgattacgtcaaatgtcgtcgacgcagtgtttaatcaattttgtaaagtggagcagagcaaggccaaatacgtcagcctttacggtgccccttttgttgtaaccgtcactgtcctgaatactgatggtttaccccgccgacgaacgaccaaaggaaatgcccctccaattcactcttcacaatcccacatcttcaaaattaacaacaatgacaactactgtcttttttatgccttggaactgatgcggtactattcgctctacaaacgtggaattattacgcgngacaaatggagatggactaacaacaccaaactactngtctccacaaaaaagtcactttactccgtgatgct

SEQ ID NO: 16662 - DNA, 987 bp, Heterodera glycines
ttctgctcttctcccctcctctctctctcactcatttcctctcttttctcctcagtctttctccctcttttttttcattctatctttcttgctctctcacttcaaaccgttctttcattctctcctcttctctctctctttttatgctttcctctttctcacctctttctctctctatcgtttcctctcttctctcctctctctatctcttaatgctttcctctttctcacctctctatcctgtcctctcttctctcctcctctctctttctcccttctctctctctctctatctctctatctcctttcctctctcttatctcctcccctctctctctctttcttttcctctcttctcttctctctctctctctctcttgtcctttaaattctatagttccttctttctctgtattcgtaagtatctatttatctttttttttattatttctctctctctctctctctctctctcacacacacactctctctctctctcccactctctttctctctctcacacactctctctctctcctctctcaatctctctctctctctctcacacaactctctctctcaatctctctctttctcactttctttctctttttctttttactttcattctttcatacataatattttgattcattatttgtttaaaaaaattaagcttttctctcaaaaattttaataaaaaaaacaaaacaatataataattaaaaaatgtacaatttgaattaaattttgtttgtggattagaattttaatgttaaatagtagtatttaattaatttaatttgaaaaagataaaagtaaataaataaaaagaaaaaagtgatgaaaaatctcaaattttattattgcataattttcttaaatttatttacaaaaagtttttattggcattttgtttattttcgcgttaatttgaatcgatattttttgtgacggaatgacacgacccaaatactatatttagat

SEQ ID NO: 16663 - DNA, 1247 bp, Heterodera glycines
taacagagaaaaagcttggctatttaatggtactaagaatgtaaaatatgattgccattaagcaaagttatgccatgttttgtcgaaaaaattgctaaaaattttgaattagcgggatttttggcgtaatgatgacaggttctgtgattgaaataacaggtttctgattagagaccggaaatttcaaatttgcggatcccgctgcgggattggaactcaaatttttttgcgggacgggatcccgcgggattaatcccgcatttaaaatttgcgggatcccgtgcgggattgcgggattttggaaaatcaaaaaaatttcaattaaattcaaagaatttccaaaaatcaaaaaatgctgaaaaataaatttttaagggctgacgggatgcattaaaagaggctgatgggtcgactaagatttttcgattggatccgacggtaaaaagttgatcggaaatcaaattattaacggttcataaatttgactatttttttcttttcaaaaccacttttttgcgctgcaatttttcaaaaaactaggaacagggggtccggcggtccttatcagggatggcattccgaggccccaaaaattttcggaagtgtcggaaatcggatttccgaccccaaaaacgtcggaaatcggaaatttttcaaaaaatatacaatataataaaaaaatttctaaatattttaataggctaaattttttaattttaaccaagtaaaaggtatttcacaaatgtttttagtatattcgcttgaaaaaattgttcaattatttttccgacttttcatcaaaaatttcggaagtcggaattccgaccccaaaaatgtcggaaaccggaagtcttaccgtgctatacctggtgcctatcgacatctgcgagaaattttatgaaatttaatgcgatttgttagcagattttgtctaaaattgaccaaatgacgcagtttttgactcaatttctacaggattattaagtaaaagcctatccggcggtgccgataggcgccgccgggaaaatttcacaaattttgaatgaaatttgtgatgaaaaatgagttaactttaattaaatttattatttaatttatttaaaaatatttggcattctgtcttggaaaattttcaaaaaaatcaataaaatcccgcataatcccgcacaaaaaatcaaatttgcggatcccgctgcgggattggactcaaaatgctttgcgggacgggatcccgcgggataatcccg

SEQ ID NO: 16664 - DNA, 442 bp, Heterodera glycines
agtcgctattttgaaaattatatgtaagtatctaggcaattgacaaaaaataatgccatcatttttttatatttgaactaaaacctggtaattctaaaatattacccaggcaatccaggtttttcgtgcaaaacctggattatttagttttttccaaataacattccacggtcccaatttttgcatcagaatttaaatgtgcgatgagcgaagggacgaatttttgacaagcaaagaaagaaattggttttgcgagatgggttgagaaaagagggagagaaaaggcggttggaccctccgccgaaggcccatggcaaagaattgatgggagggcgggggggggggggtgtgggaagaacagaaaagtactaaaaaggtggtagattcactttataaaataattaattacccaaaaggtttttacaaccacatattgctaatc

SEQ ID NO: 16665 - DNA, 1506 bp, Heterodera glycines
tttcaaacatccatcaaatgtaaaaaataaaatcacttgctttttaaagaaaaaaaaataattagaaaatttttaaaaaccaaaatcccaaagatatattattggaaaataaaaaaaaaagttgttggtttaattttaccgttattctgagcctggtcattgatgcggtaatttaggtaattaatttagaaaatattcgattgaaaagaatgagagagaaattccatttttgcattatttattcataaagggcgatttgatgaatcatttggcggatgatttgcatgtcattcacaatgcagcaggacagcgacaggaatcattttctgctgtccttttaattacatttgatatttgagaatgaaaatattggggaggggtcgggggaaagaccgagggaggaggggggggggggagtgagcagtgttatgccagtaataagggaggaaaatgagacgaggaaaaggagggggtggggttaaatggaacgaaagacagagagagaaagagggaaattcggaataaatttgggggggggggaaagtatgggaaggtaaaagatgctgacaatattggggcatgggcaaacgaatcaaaagcaaaagtgatcggtgggagaaatgaccttgaaaagaggcgcagagtgcgaaataaaacaaataatagcaaaaatatgggggagagacacattcaaagcaacgccccaattggcattggagaaaagccgggtcagaattagggtcaaatggggcaaccgagaaaaagcggccagcaacagggaaaatgccgcaacacgacaatgccaccaaatcatatcaagtggataactttaaactgaaaaataatatacatcgcatggcattatgaaaaaggagagatagtgagggctaaagcacagagaaaagaaaattaagactcactagtgattaattgaattcgccggaaaaatttttgaaaaattttatgcaatttgctataagattttgtctaaaaatgactaagattttggagctaatatttaaaaataattagcaatttttggggcgggcggtgccgataagcgccgccgaggaaaattttttttcttcagaattttaacgaattttgttaaaaaatagccaaatttttagcatttcctcttttcccctttgctagcctcccccgcccctttatgaatgttaatatgtaatactacaaattaccaagaataagtcagattaaatcgaaatatgggtagccttttaataaaaatagaaaaaaaattcattttataaaaaataatcttgcaagaaatcgtctcgaaaaataatcaaaaaagccagttacggatcaaaattacggaaaaatcccaaaaatccgtaacccgtaatccgtactacgcagaacgaaactgtaaatttttccagagctcacttcagtctttttgccagttcttgtttgagtcttcataatttcgtcaaatttctttttgtattcggaatttttgtgcttgtcgcttttaagatg

SEQ ID NO: 16666 - DNA, 549 bp, Heterodera glycines
gcccgtcctgaggccgcgaagcggccgaatgttctcaacaaaattaaaagacgggcgcaaagcgcccgtcttgaggccgcgaagcggccgaatgttcccacaaaattaaaaaacgggcgcgaagcgcccgttcttcggccgcgaagcggccgaatgttcccaacaaatttaaaaacgggcgcgaagcgcccgtcccaaggccacgaagctgctgaaaattcccaacaaattaaaaacgtacgcgaagcgcccgtcctgaggccgcgaagcggcccaatgtcttcaacaaaattaaaaaacgggcgcgaagcgcccgtcctgaggccgcgaagcggccgattgggggggtgggttgtaaagacaaatttattaatagacccctgcgaaaaatgttaacaataattgaaccgataaaaacatttcccacattgaatctcattctcaagattcagtcctcaaaatcctgcgcataaacattctaggtaaatattgttgatatcgaaatgaatcaaagtcgaaaacactgaagtatcttcatattttggcaaa

SEQ ID NO: 16667 - DNA, 1350 bp, Heterodera glycines
aaaaacgggcgcgaagcgcccgtcctgaggccgcgaagcggccgaatgtcccccgcaaaattaaaaaacgggcgcaaggcccgtctgaggccgcaaagcggccgaatgcacttgctcatcacttatcaaacgcgcatgcactagcaacgaagtcctttgcgcgaagcgctcatgtcagcgcccgcccctatataccaaaagtatactgtctacaccgagcaatcactgcgccacacgctagtttctactatatatagagaaaaggtgcaactcgtagaaaaaattataagtccccgtggtttgcccggaggctcctgaaagtgcggcattgcttaagcaactttttgaggcgcatctgggaaaaataaggatttttcggtccggcggccagttgagcgccagcggcgctgaaacggccaaataaaaaaaatcgtcgcggttttcgggctgtaacttttctcagggaaccgggagcggaaaaagtccgctgagagggcacaccccagacatgttggctacaactttgtcactgatcactttttgatcagatcaaatgccgagcctgtagaaattggcgactgaacggcgctcaaaatgccggttttggcttttcgtgaataactcgctgggggttaagcggagcgggttggcgccgcttgagcatttgtgtagtttttaaagctgcatccgatggcgttttcagattttgaaaattttcaaaatttttcgagctaggccccctcgaaaatttttcgtttttgaattttattattttttgcagatttttcccaggaaaacggagaccactttcaagcaaccgtttttcgagctctatcgattggtggcatttttgaaaaaatttcaaaattttccggaaatagaaaaattttccggaattgagctccccatttccgtttgaggcttataactcgtcaggcgttgattttagcggaaatttgtcttagagcatttttgtagagaattttaagctctatctaatgtgctttatctcatgtttttaccatgagtttaaaaaaagttataaaattaattgtgattttgaaactcaaaaccataggggggaccccatggttttgcatttcgtgagaaatttttttgctcctaaattagccaaaatgcatttttatggcataatttgaggtgctgaacacgaatatacgctttattttgcgtttcagactttttggaaggtggttaaaattttttgaaaaatcgtcaaaatttgagccccggaaaatccagtgaaatttcgaaaattcataaatctcttcgtttttggtcaaatttagtggaataaagctttaaaaatagagaaaaattgggagaatt

SEQ ID NO: 16668 - DNA, 1862 bp, Heterodera glycines
ctttttggcctgtttaaaaaggaattaaaaatttttaaaaattttattcatctccctttttgatagaaaaagcatcagagtgcctaaactagcatgtaaataaaatttggtgcgtttcagagcattttgtgaaaaaaatatttatgaattaattatgcaaaaaacaaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtgggccttcgcccccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttccctttttgatactaaagcatcagagtgctaaaattaagttgtaaataaaatttggtgcgctttagagcactttctgaaaaaaatatttatgaaacaaaaaaaatcgattttttcaagtgtccgtttggggtactcaaacatttatggggagcaaaaatccaacgcagaattaaagtacaggctatagggaagctattcccgagggattcggtctccccataaatctgggcgcatcggttcggggggaatgacatttcgaaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattattaaaaatttttagatttttattcatctccctttttgatagtgaaagcatctgagtgcctaaaataacttgtaaataaaatttggtgcgtttcagagcagtttgtgaaaaaatatttatgaattaattttgctaaaaaaataaaatagtgaagctttaaaaattaataaaaaattttaaattcagaattactggagttagcatcatagcagtgcttttccttgtctttttgatgccctcgcaaaatctggttcgcttctga

SEQ ID NO: 16669 - DNA, 887 bp, Heterodera glycines
tggagtttgttccgaaattttgttgttttttgtttgttttttgttaaattttttgaatttttcttttaaaatttgccggaaatgaaataaaaatgataaaaattttgtgtttatatttactgttataaatagagctgggatttttatgtgcttcctgaaagatgcaataaatatatgctaaaaatgcttgaaacttatatgctaaatagcaacaaaaaatgccaaaatatgtgcgaaaatatatgcctaaaattggaacaatcaaatgtatttatccataaaaatcccagaaaaatctcattattcaactttttcgcccgcacaattgaaaatcaaatacatttggaggtattcgggggtaattggtcctttttcccactagtcaaaattttggcgaggtcaatcagtttgtttttcggcgtttattttccaatttgcttgcatttttcttacagtttttctcaaaaatcgcgaaatatggacataaaattaccaagatatggatataaattttccgaattgaagggtaaattttccaaaacttcttcaagttacttaaattttattaaaatacatctataaatggctaatatggtattgaaaattattttagaagaaaaaatcacgataaagctaaatttactaatttttagcaaaaaatcaacccgaaaagcgaaattttcgcttttttgcttaatttgccataaatttatcaatttttaagaaaattgaaatttattcaatattctcgtgaaaattttgcttaaaacgatttttttttgaaattttccggttttgggggtccaaaaggccaatttagctgatgggggtcggtctaattgagggtttttggaaaaatcccaaaatatggacaaaaatgagaaaat

SEQ ID NO: 16670 - DNA, 3038 bp, Heterodera glycines
  misc_feature (26)..(26): n is a, c, g, or t
  misc_feature (2763)..(2763): n is a, c, g, or t
  misc_feature (2952)..(2952): n is a, c, g, or t
  misc_feature (2962)..(2962): n is a, c, g, or t
  misc_feature (2987)..(2987): n is a, c, g, or t
cattttcctgcaaaattatttaaaantctgaaaaagttgcttactttcccagcaaaaaaaaaactttttgttgtgccgcaaaatcctcttaaaaaacgtgccaatgtaattaacaatgtcttggacaaaatattgtataaatttggaagaaattgttcaaatttgtaaaaaataaaataaattctaattttttttatttagaatagagtgcgccgggaccgggaattttgggcaaaaccaggaccgggacttgccgggacctgagaagccgggaccgggacctcgatttttgttcgggaccgggaccaaccgggaaatttctgttggagcgacccacaattcaaataattgtttatcattgggtccgttctttgaccgaccaaatattgatttgttcccctctcccatccaattccttccactcatgtccccaattcattccattccaatttgccttcgcattgttttccctcctatttttgctccattcctccgaccaaatatgtgtattttatttttccattttcttcaataaaaatattttattgtgttgtccaccggcacaacataattggcgacgcccgaactcaaccaaattacaagcaattctcgtgttgaattgcttgtttgggaaattaaaaaatctcgtgttgatttttaaatttcgcggaaatcatcaaaaaaccaatcacttatcttgtgtgcggttctgccgtgtgcaatttaaaatcatcaaacaaatcgtcaataaaaattcgtcaaattaccgacggatcaaacattggcagaaatccttcaacagctgaccaattccatcaaacaacagcagcaacaaatatccaccaccactcaaccaagtcaaatttgcactttgccggacattcatcaattttcggcagacatttctgaagaatttgaggagtggatggagcgttttcagtttgcgctggaatgcaatgcgccaaatatggaggacatgtcaaaggtcaagttactgatgacaaaattgtccccggccgcattcagcgaatacaaacgctactgcttgcccaacgaaattaccaaattcaatttttcaaatacaaaggatcgcctgctgaaattattttcgcatccaccgtccgtagcaatcaatcgctacgaatgtcttagagccagcagagaggacggcgaagaattcggaccatttgtgaaccgattaaaagcactgctcagaaagtttcgtttttcggaattaaatgaggagcaattcaagtgtttggttctacttacgtcgctcaaatcaccgagtgatgcacgacttcgccagcacatccttgctaggctaacggctgaagacgcgaaatccagcaaaacagcaaaattattcgatgccattgtcgatgatttgaatacgctgttaaagacggaggctgaagcgaaaatcctggagcggccaaatttcaaaatcaatgctgtccagaacaacgatggccaatcatctccaaatgacgcagcaaaaggcaataaatccgacaaaaatcgcaaattttcggacacctcggatggaaaattcctcccaacaattgttttcgttgcggagagttgcactgggcgcaaaattgcccaaataaaaatcaaatgtgcagcaaatgcaacaagagggggcacatcaaacaacaatgcgacaaaatccaggcctaccatcaaaataagaggaaaattcttcctaaaatcaacatggtaaatctgcctgcggctttcaaaaatcaaggcaaattttcgaagcttttgaaagcgaaaattttggtaaatggaaagccaatcaaattcaaactggacagcgcagcggatgtcaatgtcatcaataaagctgcattcaaggcaatcggccaacgaaaaattcaatattgtccagaggaggcacaattatttgatggcacacgtttcaaattcattggccgtggaatcgccaacttccaattcaatgggacctaagcgtaacaacaattttatgtggccaaaaatggaacaccaaatattttgggtgtggctacgttggaccaaaattggtttcctggaagaaatgaagcgcctgatcagtgccccgaatcccaatcaaattttctccgaaatcccggccaaaattaaagtcaaatttcaacggtcaagtgcgaaaataagaggggagggagccgtcagcagtaaaaatttcgacaaatttcgccctgtccttcgcacaccgactgtcacggccacggaaaatatctcaaatcaccggaaattcggcaccaaatatcaatttacactgccgcactacctttttttctttgtgttcaattccctaccatgaaattgatttattttaacgttttttcgattaaatctttaaatttaaatataaaaatatatttttcgctttctcgcctttgttgggcttctccttctcgcattttgcgcgaaaagcatgaaatttatgcacttttaatagttggggttagaggagtgaaaaatatgttgaaaattgagaaaaaacaaatttattgaaatttaatttaatttacctcttcattcgagaaaattgaatatgtgattgcttactggttatgcttcactctttgcttcggcttttgcattggttcaattccctcgtggaacattaattgcttttttcaagaatatttttaaagttattgaaaatttcaatataaatttatattgaaaattgttggagatatgcatttaaatttaataaatttgctatttttttatctatattatttngatcaatcgtccctcctccccctcccccccattttggcattatttccggttcctttgggtgtgccgtgcctttatccattattttgcttacggcttacaaattagcgataagaagccatccccataaattccgttttatggtggcccacaatgtcataaaattataaaaaccaaaataataaaaattanatatttcttnatttatattttggataataaatccntttgaaatcatgaaattgatagagcacaaaatgtcaatcatcattaaacct

SEQ ID NO: 16671 - DNA, 2253 bp, Heterodera glycines
aaaattggaaaatgtaaactcgcctcctttacgtctccgtcccccaccaaaaaagtacgcatccgccccttttcgccgtgctcaacaaatgcttcatccgatccgccaaattgcctgattttgatgacgacatgtaaaaaacgcaaagaaaaaatttcgtttaaaattttttttgctaaaaaatacagaaaatttaaaaaagccaattcgtacttaaacaagaaatctgagagtgcaggtaagtaaaacattagacagattgttcattacaaattgggggtcgtccgtttgggagaccaacatggacggtaaattttcaaaaataaggttttaactctttctactacatatttttcggaaaatcctcaaaaaattgtcaaattctgctacgaatcgaattaaaatttagaaaaaataatataaagaaaaagagacgaaaagaaagttaagaaaagaaaaagacacaaaggaagtacagaaaaagaagaaattagagggagggagggaaggtgtgaaataatgcactgtctgactgtctttctatgcggggcagcggcggaggatggaaagggcagacagtgaacagacgcgtgccgctgcggaaaattcataatttttaaaaattaacttttgtgttagaacccgcacagaatgacattttatggtctttcaatgatttgtgactaatttttagcattatattctattttagagcaaaagtgagaattaaaaaaaaaaaaaaattaacttttcgactttttgttcgaattcgtgtccggggttcggaattagccaatttgttaattatgcacatttgatcagtgaatgaaaagtttagcacggactcgacaataatccgttgcttttccgcttcaccgtgcgtttacaaatggacgtgaaatccatgcacctttttgcgcccattttggaggtgttcttgacaaactttggcaaattccttgctgaccaccgccgtttggcctcctgagtccggtaaaaaaaaatttccgggagcgggatcgggagttcaaaattttccgggagcgggagcgggatcgggaatcccgtgaaaatcccgctcccgttaaaatcccgcagaaattttacgagagtcccgggcgggagcgggagtaattcgaaaatttaattaaaaactaacaaaaatatttttaatgcacaaatttgaaggaaaatccttttattaaagaaaaaatagataaaaaaatttataaaggagaaatttgaaataaaaaaatcacatttatgggtcgaaaatcagtattttttcaaattgcttcaaataaaattttttaataatttatttgttgactccctttattaattttaacaattttttgcggcttattttttgaaaaaactttttggtgaccagggaggaagagggagccggcggtgccgataggcgccgccgagaaaaaattgatatttgaatacaatacagtgtcagattatgtccaaaaatagccaatttttgaaaatttgaggcattttttaagaaaattaaggattttaagattccggcggtgccgataggcgccgccgggaaaatttttttgaaattttgactatatatttaacagattttcaatgaaaaatcattatttttaccaatgaaactcaattcttaccagtgcatttttactcccgtttttgggtaaaaatttccgggagcgggagcgggatcgggagttcaaaattttccgggacgggagtcccgaacgggaatcccgtaaaaatcccgctcccgttaaaaatcccgttcaccgaaaaaagcgggagtcgggagcgggaatcccgtaaaatcccgcgggagtcccgatcccgccggactctagtgttgaacatgtttatatctatatttaaaatggaaacattggaacatataattaatgaaatcaaattgagctatattatgaaataaatgtgtacagtgtacacaatagagaaaggcaaaacaactttttcttatgaaaaaaattgtttcatctgggatcaacctttaaggggtcggggtcgttttcgtatgggccgttttcgtacgagcacaagtttttgactataacttttttctttgccaaccaaatccaacattgttggtgtcattcgatagccctatgtatcctctattagcctgcaaaatttcgaaaaatttcattaaggttcaaaaaagttatggccagaggaattcaaaaaaccaaattttccaacttttttggctcgcactttttttga

SEQ ID NO: 16672 - DNA, 1447 bp, Heterodera glycines
  misc_feature (24)..(24): n is a, c, g, or t
aaagcgacgaaggataagcatcantctgctgatcatcccgttgttccatctccatctctccactttttattccgtctaatcatcactcatcgcttccctttcactattttctcccctttctcttcctcttctcctcatgtttcttgtttctctttcccttccctttccctcttttcccctcttttctctttccattccctaaattatcgttccgtttatactttttgattgttttgtttcgtcctcaaaacaaacaatttgttccgaaaaatgcaaaatgtgcggtccgtcgtttgtcggcggaagaaaccttccaattaatgtccgaccgtccgttccgtttttcccttggggggtctttttttcccttgtaacttttactttctttccgcagcgaaaataataaagaataagcctctctttcttttctatttcctctttgtcgttgactctttgtctcttcctttttctccttttccttcactccgtctctttttctttcccttttcctctttctcttgtttctttttcctttctcaattctcctccatttgttgctttctcttccttactaattactaatccgactaattggattaattgcggtttatggcgcaaaatatttttgtaaggtcattcattcgtcgaacgacggacgaacgacactttcgttgtgtccattcgctttttcaaaataaccgcccgcgggaaggctaatcctcgccgcatgtcaaagcgaattagccaagcaacggaaaaaaagacaaaacattacggtaatgggaggggaaaaagggaaaagggaaatgaggggagtgaccgccacgggcggcactttcactggcatttgcgcactttacaacgcaaatgaacagttaaagcagtgaacggtgtgcgagaaaattattgacacacaataaaaggggggggggggggtaattaagaaaaattggaaaaaataattaaggaaatgattttgaaagtgaaaaagacaatcagcaggcaaacaagggatgagaaattgaggagattttaatggaaagagtggccaaaaagaaattaatcaatccatgaaaagaatgaatgattcattgtgaacattatgccaacaattacgaaacacccaattgtttcttcaatttttggtaggatttgttgagggaaaactgataaaaaaatcggcggaatgaattaatcaaacgaattgttgagaaagggtgtccatggtgctgctggtcaagttcatcactgctgctgaagagaatccaaccgcaatttgttcggctcaatttcaaattccctcggaatttcccccccccccccgccaaatcgacctaaattaattttcaaattactcatcacacgcgggaaactccatttatcattcatttcctttccggttcattcattatttgcgtgaaaatggcgtataatgagaaaattgatg

SEQ ID NO: 16673 - DNA, 1512 bp, Heterodera glycines
ggggggggacgccgggggttcagagaatggaattgatcagacagacactgatcagcggacgagcagaagggaagaagcttgatcagaatggaatgggaggggaagatgcgccaatttggtgatgcagtgataaacagacaaattgtgcgaatgcgaatgtcgcgacatcgctttcacatcatccatcaaacgccccccccccccgcgggcaattggcggtcaattcgcaaaattaaaacaaattattacttaaaatgtttaaaacgctgaattttgtttaaaattaaaaaacaaatcaatcacttttattactgcgctaataattttgaatttcttatgcaaattcaaatgaaattaagtgtaaatgcgacggttgcgcaaacaccgccgccttttggacgtcgcaatttgcaaccaccgaatgaaagaaagaatgaatgaatggtccattctgaaatgttcagctctttatttgtttgtccatttacggcaaataaatgaaaagattaattgaaaacactaaaaaatatattaaaaggcatttttataattaaatgatgctcactaattaattcattaattagtgtttctaattgttgtccaatttatgggttaagtgtcaaaggaaaagggaagagaaacgaaggaaagaaagaaagaaccattcgcaacagcactcaaaagtgaacgaatttgaggaacataagtgatgactgacttaataatgcatttgaatggatgagagatgagctttttgaaaccatcggaagaaatatcccgaaatgggaaaatgaaacatttaaaaggaaaagcgaaaggaaaagcaaaacaaataaaagggaagggagagaaaatgaaaggaataaaaaacaattaattaaaattaattggttaagaggttcgggatgggaagggaagagaagagaaaggtgctgtgatccgtcgccgatcagtttcagtaatgaatcagtcaatcagtggttttgcgggggggggggggggagggaattgcgcgagattcgccgggggcgaaggccttccccaaggaggaggaggatgttccgctgctgtaccccgccgcactccctctgtccctctgctgatatcagccattgactgtcacgtattctgtgcccaattactcatccccccgggggctgatgacagtgtcagccgattgtgtctcagcggagtgaaggcggccgccggggtcacttttgtggggcttttttttgtctccgcggggcattttggccctcccgtgggctgttcacgtgcgttttgttgtgatgcttttgcttaaaaaagtgaacggatgtcggcccattcggtagctgattaaagtgattgatggctgagaagagaaattggaattatttaccaatcgtttcttcaaatgataataaattaattaaattgtaatatttgatggaatttctcaaagcaaaaaaaaacttcgaaatgccaacgaaagtgtgaaaatttggaaaggaaatgaatgaatgtttctct

SEQ ID NO: 16674 - DNA, 2069 bp, Heterodera glycines
  misc_feature (9)..(10): n is a, c, g, or t
  misc_feature (26)..(26): n is a, c, g, or t
ttgcatgcnnctgcaggtccacaaanttctttcaaaaatgtccaaattgtgagtctctgttttgggtcggcgcggcaaaatcaaattccaacttggcattggacgagtcccggttttagggaccttgccaagaaaaatgtgtttgagggatctgccaaactttaaagattgtgtcaaactttgaacaatgtgccaaattcttctagtctcgaaagcggctcttaactttgatattttgttttgtcatttatcagcaaatcacaacacacacactcaaaaaattcaccacgaaaatgatttgtagttgttaaggaatgaggtgttttttttaatcaatcattgtagttgacatcatcatcaagcgaaatgaaaaaaaattgtttgatcaaaattttatgttgtctaagacacactgacacaatgaaaatcatttggaagacagcaaaagtttgaaagaaaaaaacaccggcaagatggtggtgaaaagtgtttgaatgaaagttggtgctgatcaatcaaaatagaagaaactgatcagcgccgtgatcagccgggcacatcccatcattgacgaagtgatcagtagccagatgcttgctgcttagcgggctcggctgccggcgctggcgccggttgctcggccgcgggttgctcagctggcgcaggcgctgccgcctcagccgcaggtgcagcagccgcttcaccaccaccaccaccgcctgctgcgggagccggagcggcagcctctggaaaaaaaaggctaaaatttcaaattcgattcgtgccacctccgccagctgctgcgcctccttcagcgccaccaccagcggccttggcttcatcgccatagctgttttggttgcgctttcgtcggtaaccggacgcttgctgtttcgcgggctcggccgccggcgctggcgccggttgttccgccgcgggttgctccgctggtgcgggcgcaggcgctgccgcctcagccgcgggcgcagcttctgagaaaggaatttaaattttatttaaatactgttaatttaaatttgtttgaaaagcatgcctcctccaccagatggggcaggcgctgcagcttcgcctccggcagcgccagctgctccttcggcaccaccagccttggcgcctgcctcatcgccatagctgttttgtccgcgcttttgcacttaattaaaattaaaatatttaaaaaaaaattaaaatttgctaagattttcgtacagcttctcgcgtaaattgcgctgacacacaacaacacaattagcaatttcattttgttgttgttgctgattattaagcttagtgctgctgtgttgttgtcccttttgggtggtttacgctttaaatttatttaaaaaatgaattttatttattagtattttttagtattatttatttatttgttgatttgtggcgtatgtcggctccggccaaccccttaaataggcgctaggcgccccgatggccttgtttgggcaagaggagatggaggcgcagtggtggcgtgtgttacagtcccaagcgcgccaccagttgtgcccccagggcgggtgtcattttgattgaacctctcgattagagaggggtccacccgcgccccgggggcaccataggggggcgggaccggccctgcccaactgtgcaccagcaaaatacaggtagaaaaagtttggaggacgatgacgggaggggctggggggacgacgacgaacgacgacgacaccgtgatggaacgaagttggtgattccccgccccctcccgggaagggatgggttaaggggggggggggggtggaaaactcgaatgatataataatagtcggcactgtgagtgtgtggtatgattcatggaagtgtgtaagacaatttgaaaatttgatttatgtttgatgctgagtaaaaagaaagctataaggtgtttagcccccgcccatcgaagtgggctgaggaagcgggactccaaaatgcccacggtgcataaaacgccatcaacattttcggcaaaattcttacaacaaaatgtgtgttgtctatccccgtctctctctctctctctctct

SEQ ID NO: 16675 - DNA, 1649 bp, Heterodera glycines
gatatcatttatatcagccctaattcattcaagttcacatgaattagtcccaattgcctccggcaacaatggcagacacaaatgccggtggcgtttcataacactaccgaattgacgacatactgtagctaatgataacaaagccctgattgatgaaacagagagcgttagaaagagagggagagagttagctaacatagaaaagagctagagagaaagagacagagacagagaaataagcatagaggcagaaagatttagtgaaaaattgattgaccacaaattgattgtaaaatatataaaatatgaaacggcagacggaagcagttggcgaaaatggccgtcggcggacgggcaatcaatcgctggcggcggcggtcggccctgcgccgatgtgccaaaaaagtgataatcgcttctcaattgaaacaaaacagtggcggccgcctctttaatgctgagaaaaggagagggtagaagtcaccccattccccgcctaattagctaattagggcgtgctaattattgcttttcctcggccccccctttcttcaatcatcattttgttgctaattatgcactactttctcgtcatacatttttcttgcccaagggccgacacaacaaacatttcggcaatttggctagacactctcttttgtttgtcctccttctcctcctccaaattgtttttggcgatggtttcccttgccctgagggcacaatcatcgtcatcatcagccattaattgattcatcatttttaaaaaacgccactccaattttttttcctttttgtgtgtagttgtgcgcgaagcgagcgaaaaattggtaggtaaatgagggccattaggcaaatttaaaaaaaaatttttgaggggggggggaggctaccaaattttttttggaaccataacaaccaaacaaataaacaaacaattattattaatgggagcaatttgggcacgtacacataactttgctgtgctgttctttgccgctgctgggctgtttgttggttggaattggtgttgttgtaatgtgtgacaggacaatttttttaaatgtgtgaacacacaaaaattggagtaaaattggagaataaggaaagagagatgcaaaaggcaaaacaaaagtaataataaattgagagagaaatgggaaaaaactccaaattcttttgaaaattaaaaaaaaaaattttgggccacaaagctaaaagagtgaaaatgtgaaaaatgggtttcagagggggaaagcatagtaaaaaaaatatatatatatatatagaccgaaatttgaagaaaaaaaaagccgaactcagacctggcccggatttacgaaatggacccggacaggtacaaaattctgtttttaacaggtttcggatcctgaaaaaattaaattgttctttgaatcaaatttcgaaccccagactcccccctccctccgctctcccgatttctaaagcattttgtgagttagttctacagcatatttttggatgaggcaaattaaatagatgttttattaatggatatattatatgtgaaagaaaaatgggtgatggatgaccttggaaaaaacaaatacaaatacatatattatgtataatgcacacaaaaggcgaaacggacgaatgaataatca

SEQ ID NO: 16676 - DNA, 3770 bp, Heterodera glycines
  misc_feature (34)..(34): n is a, c, g, or t
cagtcggctcgcggcataaatcgggatgcccttntttggatccaaaaatagccactaaaggcttgtggtccgtttgcagaataaattttcggccgtacaccatgcggtgaaatttttgaacggcgaatacaatggccagtgcctctttttcaatttggctgtaattttgctgcgctggtgtcagtgtgcatgcggcgtgttcgaccactttttccttttgtccgggaatgtgtggcttaatgtggcgccgattccatccttggacgcatctgctgatacgacgattgggcgtgccggctcgtagtgggtcagcaatagatcggatgtcatcatttcttttgctttttcaaaagcattttgctgttcgtaagtccaattccaagctacgtccttttggaggagtcggtcgagcggtgcacgcaactcacgcatgcatttgacaaatctgccataataattcaaagcgcctaaaaatgatcggagagtgcttttgtcgatcggtgcgtgcattttccgaattgcgtctgaacgcgacgggtcaggacgaatgccgtttgctgacacaatatgcccaaggaacaaaagttcgggctgcaaaaatttgcatttgtccagttggatgcgaagaccgtactcttttatgcgcccaaaaagtataaagtgcggaaatgtgttggtccagggttttcgttgcgatcaatccatcgtcaagatacgcgaaaacaccagggatgccagcacaaatttggtccatcaaatgctgaaatattgccggtgccgatttgactccgaacggcaggcgttggcattggaaaagccctcgatgtgtgttgatcgcacacaattgcttggattcttcatccatttccatttgcaaatacgcatcgcgtaaatccaaatttgagaaaaattttgcgccattcagtgaggcgtaaatgtcgtctggccttggcagtgggtggcggttcaattccaatgcattgttgaggccggtcgagaagtcgatgcaatcaatcggcttaattgcgccaatttgaagaagacggtccaattcggcattcacagcttccatggcgccgtgtggaatggggcgagctcggcaaaatacaggctttgcatcagaccgcaaaatgagatgcgcctttgcctttgagcagtgtcccagtccttcttcaaagacttccgggaaatcgttttggagtgccgctttaagcgttgacacatcattgatcgatttgtttggcggcttcactgccgaaaaattgtcaatcacttttgtcgcctgatcagccgatttgctggacggaaataaaatttggcgggggatgacctccaaagcttcgatccacggcaatcccagcaaattgtgtccgacttctccgctcacataggcgatgagagtttgcggtggtttgtcggagaattggacagtgaatatgaatttgccgagcaaagcgaatggctggtcattgcagtttttggcatcgatgtcagctggagacagatccgggcttcctaactcctgccacgtttgcaaagaaataattgtggcttgagcgccggtgtcgccattcatggaagtttgccttccattaatcaaaatgcacaatttccaccatcgtccttgagtcgtgccgacatgcaggcaatttgcgtcgactttgacagtgtggaatgacctgtggttgttcggtggtgcctttgtcttctttgaccggcaaattgttgaaatgtgcccttttttgttgcacttaaagcaagtggcacccttgaatgtgcagtcggagcgccagtggtcggttttgccacatgatccacacggaagcgttggttgaccacgcgttggctttccgcttgaattggcatttggagtttgcctttgattggagccgccgctttgtctttgcgctgggtcggtccattgccgtggccttgtgcgaatggcgtttgtggcaattggtgggttgaccagcgaaagggcgctctccttgacaagctgaattgtccgaagttcctcctcaattttcttgagcgaaatgttggtgccgtttttctgcgcgtcctccaacattttcaatgccttttgtcgcaaatcatggtgttcatcgttgagtgcgatgaccaaaataatgcacttgagctgctcctttgtcagactcaggtcggcattttcacataatgcgttgatctgcgcaattagtgatgagatgtcttgcccttgttgctgtcgaattttgaaacactcgtagcgacggacgaacagcgagcgggtttcagcaaaaaggcttttgaggtgcgaaatggtgtcattccaattcacttggtccggctgtgtggggctgatcgtgtcccggtatttgttgtactcctcctctccaagtttgccgagaaggagtcgcacttttgaggcctcaggcagagtgcttccgtcgtcctcgatcaattttccgtaccgtttgaaccagcattcaaaagttgtgccgacctccggattgtaatggaacgttgaaaggcgagcatcgatggagcttgccaaattggcattgctcaaatttgccggtgtggcgttttgcggtgcggcatttgtgaccatttgctggagagcatttagcaattgttgaagctgttgcgcgtccatggtccaatggcttataaatccctttaatttgccgaaatcggagaaatgatgtgccgtaaaattggcttgaaatagacgataaccgtgcctcgagatttggcaaaaatcggttcttgtcgaagatgaaaccgtgccttgagatacggcaaagattcggtttatgtcgcacaaattgttgataaaccgtgccgtaagatatggcaaagatgcggtttagttgcacagattgttgataaaccgtgccgtaaaatatggcaaagatcggtttatgatgaatcaccacaagcaatatcagcacgagataaagcttggaaaataaacgctgtcgttgagttgctgactgcgccaaaatttgttatgtccgaagataacaaattaaataagtttatttgccgaagaaaataaaataataaaaatgcagagaaataaattgggaggtcaaaattggtgggcacaataaccaactgaatgaggggaatgggagggggaagatggcgaagtggcgtggggtcatacacctaatcaataattacttccttctctaacaggtgaagaataaaaatttttaaaaaatttttccttatattttggttatttcgttcaactttcggtggggtgcttggaacagtggaatcatgcgcacccgtccgatatggtccaccagcgggacgtggttgctcataacaaacattcttgtccaggacaaaatttatgccaaaattggcgattttgatccgtaccatttcatttattcggtgatgtcaatcaaacgcttttcacaaactgtttaaaaacactaaattattaacgacttgaaaatacgacgtgtgattagaatttgggattgggacgaattgttgctgttgttctgatcacttctgattattgagaaatgagcaaaaaaattaattattttactaatgtgacacttaaaaattgtataattttattttatattatgtgattgtctttacccttcaggcatacataattcccatgacaatctaaattacagttgtagccaaagtaaaaataaccacgatttaggtcggatgagattatcttagtcaaaaaactgtacagtatgccagagaatgtgctaaaaaaccggtgtgtttgacgaataaaatga

SEQ ID NO: 16677 - DNA, 402 bp, Heterodera glycines
tgatcgcagaatgatttacataaaaatgggtgaaatttcgcttaaaaatagctaaaatggaatgtagatcaaaaaattacttcgttgtttattcgaacgaattataaaaataatttccagcccaagttatatgaataaaaataactactatttatcaaaattactcaaatacatttatttatccaattaagaatgaagcaagaaatgcagcattgtgacgaggtgccgctatactatgattattaaaattaatgatgatgattagcgggattgagtgatggggaaaattgaggggagatgcataataagcagcgcttccagctgtgtatggttgggagggggggggggggggagggatgaggaaaggggagagattttgggcgaacgggacggggatgaaaa

SEQ ID NO: 16678 - DNA, 2298 bp, Heterodera glycines
atcccccccccccccctcccccgcgggggacgaatcgacggaccaacgcccccccccccctccccgccccttttcgctccgtttgaacccctccctcgcgccccagcccaaatctcgatgctgttatgtgcgggaccactactgaaattgcgttaaatattatgccaattaatgttgtatgaaaatactacaaatttaatgaattattaaatttcaattttaaattataaatatttaggtaaactaattattgaagtgttaacaattaaggaatgcaaaggagagctaaaaattgcaattgaagaaccaaagaaagccgagaaagtgatgctttttcaaatttacggtctttaggcaaaaaattacgcctgaaaaaatgaaaattattcgtaacatgaatattttagcgcaaagattttatttggcattctgagaaacttttgccgtttaaaaatgtcaaaaacagagcagtagcagatgcatccacatctctatgtattcaaaattggtgtttattgttgtgaattgaaaggccgaaaaattccctcccccccccctaaggggcacaaaagctacgacggcgcggctatggtccgaccaaattcagccccgagggcatcattttcttcgtcttcattttgctcgtcttttcggccgcccccgagggcgcagatgtgccgccgctgcagcagcagcacaaaatgcgattaccattattattgttttggttgttgttgttgcacatgcacacacattgaggggggggggggagagaaagtgaaaagtattagggataaaattaaaattaatttatttttatttttaatatttaccaccccttctctgaagaataagcggctcttatgtagtttatgccccaatattttttatatttttcatacaaagaattaaaacttataggttttcagggtcactcaccacgaattcggtatctaatccaacccattcataaaaaatgtgaattttaaaaattggcatttgatttttcgtttaaatacgggtttgggaatcaaattgggctaaatggatgtggaatcgttatgaatttgaaagaaacaaataaatttttttaaaatgaggatggaattacgtgggtggaaaggttaaattctgttaaagaaaaaaaaggttttctaattttgagtcacaatggttttttacactaaaaatgaccttatttagaaacaacaaatctcgacttagctgcagtcaagcagcaataatctgctaaataaatagccacgctcccatacttcagtggtcaagccaaaaaaatgaataaaatttggggcggcggtggatggcattttgttggtcaccacggcacggcaggtggggatcggcaccggcaccaaaatgagtgcttttttggacgggggggggggagggcagcacagcagcagctgaaatggactcataattggcacattttgttttgttgccaagggatgagcaagagagtgcctgctaataagtggtagtcccaaagacggacggacggacagtgccaatgcttggctgactgactgaagctaaatgaatcggggcaatacaaaatgtttggttgaacctctctcctattttggggggtggcattttgtggcatggaatgaatgactgctaattgtgccgtgccaaaattgttttttaattaatttgaagtgattttcatcgtggcataatgttttgccaagtaaacaatagattaatttgtactaatattaagtaggctataccacgtattttacagtatttttgttagggatttatgccattgggagcagttaagccgtgatgaaggggagaaataaatgttataaaataataaagaaaaaaaatttaattttaaaaaattcattaattcggcatggcattgcatttttaaaatggcttaaatatcaaaattggcataagctttttgcctgtgggcatgggtggccctcttccacccgtcagcaattcatcatttccgatgaatgggccaaatgcgtcccacggggctggaaactttggccaaatttgtttcccaagaggggtaggcaccagccaaaagtccacccatcataaaagcgtggaaaagataggaaaaggaaaggccaaaaagcgaaagatttaatcgatggcaaaaaataaacaaaattaacaattaatctctttaatacatttgcatttaaaatttgacgttaatgaaaagatacatttatttttaaaatttagaatataataataacccaaataataaatggaataacaaatatttataaaaaaaattacaaa

SEQ ID NO: 16679 - DNA, 1874 bp, Heterodera glycines
  misc_feature (1640)..(1640): n is a, c, g, or t
tttggaattttttaaaaattctttattttttggcaattttttggcccttgggaaatccacgggctaatattggaaaattcatatctagcctaagggttgactaattttgagcaaataaagctttaaaaatagagaaaaatcaggagaattttatgggatttatttaggttttctaacatcaacatgaaaaaagttattccagaaattctggaaattttagatttttcagaaaaaaattcgtaactgccttctgaaaagctatttgagaaaagtaaaatactacaaaaatccgcaatttttttctctataatataaattttatatttatttgggacttctatcttccaaaataaaaaagttattccagaatttctggaaaaattcgatttttcagaaaaaaattcctaactccattctgaaaaagtattttataaaaataatatacacaaaaaatccgcaattttttgctctattttataaattttaatttagcttattatcaattttttgaaaaaagttatagaaataaaagtgattttggcattcgggaccaaaggggtgtgaccatgatttttgagtggaaaaattttttctccaaaaatcctccaaaaacatgtctttaggggttatttgggccgctgatcacgaatatgtaatcagattttactttagacatggttaagacctcagaatccctgtgtgattaaaattaaaaaacgggcgcgaagcgcccgtcctgaggccgcgaagcggccgaatgtcccccaaaaaattacaaaacgggcgcgaagcgcccgtcctgaggccgcgaagcggttgaacgtctcccaaaaaattacaaaacgggcgcgaagcgcccgtcctgaggccgtgaaacggacgaatgttctcaaaaaattaaaagacgggcgcgaagcgcccatcctgaggccgtgaaacaaacgaatgttctcaaaaaatttaaaaacgggcgcgaagctcccgtcctgaggccgcgaagcggccgaattcccctcaaaaaattaaaaaaacgggcgcgagcgcccgtcctgaggctgcgtgaattgctaaattacatcactttctagcgacgcggcgaagccgcgtcccatagcgcgatagcgctttaaaacttcacactaatgcaattaatgtttgtctgtttaaaataacaaatgagcatgtccattttctcttcatccaaaacccaacggcccacgccgcccccgtcaattcccacacgctagttactatatatgttatattgacaaggagtttcgttgctaaaaccattttctcccggccgaaggccgggagcgccctgaaagtagtggaagggtcttacaactttttgaggagcatccgggaaaaataagggttttccggtccggtggccaactgagtcccggcggctaatttctcacttttgcttgcatttgaaggcccctaactttttttgtaaaactcgaatcaaaaagtgcccgttgtgagggcactccgccaaagtgtcctctaaatgctggtattttttaaaattttttttgagcaaacccctggcctgcaaaaaatggcaactgaagcgtgctcaaaaagtacacttcagtaccaggtgaataccgcgccagggtttgatctgagcnggggggtggtcagcgaacttattgtagagctttcaaagctcgattttttgaaattttaaaatttcgaaaattttcaaaatttttcgagttaggcctaaaaaacggtttttcgggtttttgaattttaggattttttaacgatttttccagagaaacggagaccacttccaaaacatagtttttcgagctctatcgactggtatttttttcggaaaaatttcgattttttcccgg

SEQ ID NO: 16680 - DNA, 3900 bp, Heterodera glycines
atggtccattttttgtccgtcggatgtccgtgcggacttccggaattgaagagctgagatcctttctaaacattagctgtattttctcaaaaaacaaaagaagtcgtactcgacactttcactgctaatcgtggacagttctgatgaattatgcttcttctgaagtttctgttggctactgttgctgttactcgctttcgacaccgatttgggcgttctgctgggtgaagaggtcgactcatcccgaactaacgaattctgttgttttttctttgctgacaaatttcgcgacggcatttctcagatttaaataagttaaagtaaggcgtttttaaaaaaaaattgattgtgattttattgtgcttaagaaaattacgcataattttattcagtcaataaaatatctacagaagggcattagccacttactctgaagatcggtgaatacaaaaatggagaatatatggagatcacacatgaaaataaagtcagatcacaacaacgacatagtgataaataaatatataaataaaaatatttttctcatgcaatgtaaatatttttattgtatttaggggctttaacccattttatgactttgtttttaaaactacatatggaagatgatgccgtaattttagaatcaagattgttccattgttttattgttctattaataaatgagttttcggttttgttggttttgtgtttagatattaatctaatacaattaaatcttaatctttttgagaaagtgtaaagtttttgagggtctaaatgagtatgacagttgattattttaaaagcagtggtaagatcaataacttttctacgggtttcaagtctgtcaagtttaaaaagttctagtcttttattatatgagatgtatggaagattacattttttaagagctatcctggtaaaatatttttgacatctttcaattctgttaagtgcatttactgacttaggattccaaatttcagtggcatattctaataaggatctaatatatgttttataaaccaatgaccatattcttattgttttggatttaattaatttaaagagaattttatacggaaaaaggtattttttattaaatatgtaatatgttcggtgaatttaagttcattatcaataatgactcctaggtcacgcactgacttggcttcactaattgtaaaatttccaattttgtagggacacttggggttattagtccccaaataaagaacatatgttttatctattgaaaatttaataccccattcttcagaccactttaaaacattgataagtgccaggtccataatttttctttcagtatccgatttataaataacatatattttggtatcatccgcaaaaagcttaattccaattttagacggaatgtaagacggtaaatcattaatataaatcaaaaacaggagtggaccaagaacagagccttggggaacaccagaatttattttaaaaattttagaatatttttcattaattttaacttgaaaagttctttctgttagaaaatctttaatccaatttaaaacttttcccctaattccaattcggtgaagtttatataaaagtagattatgagggactttatcaaaggctttttgcaaatctagatataacgcatcaatgttttttctatccctgataccatcataccagtcttcaagggtagaaataagattagtgatagtagatcttttatttacaaagccaaattgaaattcagaaattaaattattttcagtcaaaaatacataaattcggtcaactaagattttttcaaaaattttgcataaagaaaaagtaagtgaaatagtctataatttttaacatggcttttattttcctttttatgtacaggaaggataatagaatgtttccaaatttttagtaatttaccggtgttaaaagatagttttgaaagatcagttataggccaacaagaggaagaaaagagattttaagtatttgattgttaataaaatcaggagccgtattattttttccatacaaacgattaagtttttcaaaaatatcagaaacatcaaaagttatatcagagcgacaaacttgaaattgatcccctcctgggtgaggagaagaggagataatatcatttgaaaaggtacgagaaaaaatttcgcaaaatattgtgctttttcaaaatcatcgaaaataaaaccacttcagtttcgaagggtggaatagaagtgctggaaatattgtattttttaataattttataaagattaatcggatttgcagaaaagaattttctttgtctgttttcgtaaaaattttttaacttggattttaatatgaagaactaaggaatcataaatgggtttaaatttaacaggatatttttttattttgcaccaaatataagctttttcttttattgatgatctaagtgctaaggggaaattaggagtgtctatttttgacaaaagtagtttttggaataaaatgttccaaagcattttgaatttcattagtaaaacattatatttattcaatgttttgaaaatacaatcctttagtttaattgaagatattaaatcatgatttgtaaaaaggcaaagatcaagaatttaatttccccttgtttatcctataattttagtgttaagtgaaaatttattaaaaaggtcaagaaaagttattcctagactggtatgaatataggtatattgttgacccaagttatatctttgctgtcaatgttaaagtctcctacgataattgtattgtttgttatatacttttctagaaacaaaaaaagagattttgaaggttttaatttgatacttgggggtcgatatagacacataatagttatattttttgtattttttagtttaacgataaaaatttcgcccaacttttgaaatagtttgtgtaaaatatggttcaattgctttattaattaacagggaagttcctccccctttacatttttgtcttatagcggaaaataaaacgtaattttttcgtttataaattggtctgagaaaattaatttttcattattagtaagccaagtttcgcacagacccaggatcattattcagcacttaactcattaattttatttttactcgagcgggcattgataagcaacccgttacagaattaggattatttatattggcataagaaaagttttgaaaggaggtatttgtcatttgtttagagtcagaggaaacaatgacaggtggaagtttaagggaaagcaataaatttttgttaggtgaaaatgaattgaaatcacgcccctaaacctcgttacaggtgttggaaattaggcgttttatgagagcaggctaggtgtagttgggaagaaagagcgattgtttttggcactgttggcatcatttcggagaatcactttcgaagcgtagatcgtttcatttcgtttcctcttgcattcctcatgcagaacatgctttgccgaacgaaagttcctcgagggacaacgacgggcgaacattcatgcgttcattcttggtttgcaaacgtacgccgaactgtcgtgacatgctttttccactttgtgagtacatcgcgctggaaatgacgagcgggaagcatcacttttaagaatcgattgcagcaccgtttgtgctgggtttttgaaagagtttcccattcatatacagttaccgaggaaacttggatgcccagctcatccaaaacctgttcgaccattgcattgtctcctgggcccgggcacttggttttgtcgcattgctttcaggcactcctccgatgacgaaactcctctgtctttccaggtcgtgcggtgtgagcaagtcgtttgtcattgatcgaagtagtgttagctgtgtaaaacaaacaaggagttgcgcttga

SEQ ID NO: 16681 - DNA, 1261 bp, Heterodera glycines
ggattcgagtcgttggcaccaatgtcccgttggaacctcccacgggaattaggcgcaaacataaaatcgctggtgaaactgtgactttccacgtaaagtcctgaaaattaaaaagcaaaaacgcattatttggtcaaatcggagttcacctgtcgcgagactgaaccaatttgggtacgattgggtggggaacacgggcctaagtgagagggcctccattccattctgaggcaacggaatgaaaatggaaaaactcggtcaaacctcgagaagtgtctttgctccgggcttcattctcgcgttggtctgattgaacagattcgcgccataccctcaaccaattaattaatgattcgttaatgggtcgtacacggcggacggggggtctgtctttcctttcaccccccccccccccgccccttctctctgtccctttctctccctctcttctctctgtccctttctctccctctcttctctctgtccatctccctatcaccccttatcttccccctcccccttttcacgttctctatctctctctttctacttttagcctatctctctctctccctctctttcttcccacacctcatactttcttccctctctctccttccccgtatctctccgccccccccccttttcttccctcgttatctcgccccctcctctctctctctttccctttatctctccctcccgcgcacttaccgtccaccaaaagcaaaatcagattctgccctgcgggttccttctggtaattgcaataacaaagctccaaaaagaagaggaaaacagcaaaagcaaagaaaaaagacaatcgccgcatcggaacaaacgccgcgactgaaaagaaaattaagcgaatggcgaaagaaaggaaaagggccaatggtcgacagaaaaagacatgtccgaagaagtttaaattgatgaggtgacatcgttttggtgttgtgtaacatcccaacccccgggggaattaaattcgaccgaatgggccaaagggaagcgaagggaagggacggacggatcagcagccgaaagccaacacacagcagcggcgcccccgccaccctcaaatcacttcgcccaagggctgctgcctcttctccccattccgccggctttcgtcggatgttttggccctaggcaattgcccttcccaacggaccttttgggtattaatccccccccccccattcttccgcatgaaccaaacaatcgccgtttgaaagacgaatggaggggggggggg

SEQ ID NO: 16682 - DNA, 2323 bp, Heterodera glycines
  misc_feature (12)..(12): n is a, c, g, or t
tgctcgcgctgntttcctctcgatattttctcgcgttgccgctctttcgggactgaccaattcagaaagcctcaaaaaagttacgcagaattaatttgagtaaaatgagttagggttcgctatacaaaggttttttgttgttcggcttgaattttaggaataggaaaaaataaatgtgcttttctaattagaactatcgagtcatttcataattattatcctacgaattctatttaaaaaaatattttgcatttgatatcattagaattagaatacagagctgaattaattgaagctttataggcaaaaatgaaaaatttgataaagttattgttttaaattttccattttattggtttttaaagtcaaacacaatcggtctaaaacccgataaaattatttataagtttttccgagaagcgcgcatcaaaatatagctgacccattaggctttagaagaacatcaattatgtcgagaaatagttgataattcaaaagtttgccaattataatcgaagtggaaatatttatgaaacgaccaaataattaaaatgagagagcctagcatatgttttcagggagcaggtcgttgtttcctcccgaaaaatttttaaaaaatttttttcaaacctagaaaaaatttttttttttaaatttattcggggggggggggggaatgaagtgcaccctgttttcatgccaatagctatttccaatcggttgcattaattttcattgtcacctcaaaatatgcgcttccgccttggcaagagtgtacttccgattctcttcttttgtgtcttcagcggtgagttttccatttccattgacagcatttgaaccatcggagcttctggtggaaaataaacggaaagccctttctttcacagtcctaaatatgagttgatttggtaatagtttatgtgtgttattttgaaaagagacaacaaaccctccgcatttgagtccgagtgcgattaacgccgctttgagtcggtcggcgcctaattcctccaattcctcggggctgttgaagttggacacatcgatctctgcggacggttgcgcgaactttttcattgcgccgcttggcttttcgttggaccacccaatcactttgccttccttcaatttttcttcaaaatcctttaaacgtatacaatttaagtccatgattaatttttgtgtccttttattaatttactttgtccacacgatccaattccataacaatgtcaatgagtggcttggcccgggaaatgaaatccctcagatattcctccagagaaaggacatatgttttgtaggcacccgtcttcttcgttttttctctggaaagttcgtggagatggtcgaacttcgaaaggtatgaaatataatcaacacgctaaatgggaaacacgttaatacaatagttaaatgttgaattcactactcacagtgacttccttcaggttaacatattgctcgtgcaaagaatggaggtccaaaaactttccgtatccctcctcatccgtgaaacggaccatctccttttctaatcggtcggggtcctggatgaaattggccatctcttgaaactcaattgtcagtgttcgagcagtgtcgtttgggttttttcgatgaacatccttcaacgtttttaaacgagaataaaactcggcgaattcatttggaccgccaatggattggacttctttgctgcgttccccgtgttcgtctttgtaggcattgattagcttttccgtagccaattggtttctcttaacacacagttttgacattacctattaagaattaaaccacaaattacctcaatcaaccgttttatgcgttgatcggaattaattctttcgcgttgctaaaaaaagttccaattactaaatttataattttcaaaaaaaaatttttggaaaataaatttgttttataggttttcggggtcgggaaaaccgattctagcatctgttttgacccaattcgaacccctaacccggattcgaacaaaaaagtcaaattccatttttcaaaaaaattcatattttatgcacaaaatcgcttcaattatttaaaattggttaaatggatgtcagaattggttttcccgacccggaaaacccctaaaaatcaattgtgagcaatgaacgtgaattttggtgaaaagaattttcgactttttttcgaatccgggttcgggttcgaattgggtcaaaacagatgccagaatcggttttcccgatcccgaaaaccctaaaacaagtttattccaaaaatttttttttgaaatctgcacacagataacagacaagtaccaaagaacatt

SEQ ID NO: 16683 - DNA, 1288 bp, Heterodera glycines
agcagggctgcacgcaactggatttgcaattacggaaatccgtaatccgtaattacggcgattttctcagttacggaaatccgtaatccgtaattacgggggtccaaaaaccccgtaatttcccgtaatccgcaatccgtaatccgtaatttttaaaaatcaatttttgtcagaattttagaaaaaaaattttaaatagtgattaataaaaatcaaaaaactgattttcttgatggagtttcttcattttttatttaaattttacaaataatttataattttgtgtctgatcaaatcattctttttgaatttatgggttgatttttgaaaattttttaaaagtctgatcattataatcggatttatgtatatgtatataattatttcaacattttaatagccagaaaaaaattacgggtggggggaatccgaagaatttttttggttaaaatttatttagtgttatttaaaaaagttcagcgccggacagcaaaaacaggaattgtaaccatttttagccaaaaaagactactttttgccattttgtagtcaaaatttaaaaaaataaggtaaaatcgagtaaatcgtggtccggcggtgccgataggtgccgccgggcaaattttttttttaattttaatgattttattaagaaaaatcgacaaaaaaaatttaaaagtcccaatttttcctgtaaaaatttttaatttttcatttcgggcgggggagggggggggggggggaattcctcccctcacctggctaaggttttatgaattttcataaaatgcgtgaaaaataggtgtgacaaaaaagtgatgcctctattttctaggcgaactacccaaatagccttaacaacaacaaataaaaaattatacatttattttaattcttaaataaatcgaaatacgggtagccctttaaataaaaaatagaaaaatttttttttataaaaataatcttacaagaaatcgtctcgaaaaaataatccaaaagtcaaattacggatcaaaattacggaaaaatcccaaaaatccgtaacccgtaatccgtaactcccaaaaccccgtaatttccgtaatccgcaatccgtaatccgtaattgcgtgcagccctgatcaccactgtcgaaaactaacagcaccaggattgagcggtaccagtactggtactgaaaaaagcgtacaaatgagtaccggtttttccagccaaaaagtaccggtttttcaacccgaaaattaccggtaccggtttttttacaattacctgttaccgctcaactcta

SEQ ID NO: 16684 - DNA, 1761 bp, Heterodera glycines
ggaagaatccggaggagatcatcgagctgatgagcaggttggacgaccaaggtgggcctttttacggaacaaaaaatcatttgccaattaatctgtgcatttgtccgttcagagttcgacccgcaaagggaactgtcgctgaatgtcatccaagaaaagaggcacaaactgcgcggttcattcttccaggttgattttttagaacaaaattcaacggcggattttagggtttattttcattgacttacattttaatggatttacaagttcattttatatggaaaacattgccaatagctaattgaataatttaaataaattatccctttttcatttacgcaggtagtcaatttgtacaagcaggaaaaggatgacaagcgagtgaaaaacttggagaaaatgctggttgaatatgaagtggaacgtgccaagaaggaggagaacttccgtaagttctattcatttttagcaaaaataaattgcaaaaaatggattttttcagaaatttctcttttattttattggaatttcaattttttaaattacatttgtttttgctctttaggtgcccaacttttctcggaaaatgccaattttgaggaaattccgttgccgttgggtgcgcctggcgctatggacgctgccaaaacacccttttctttgccgctgccgaccggcattacccctggggacgtgccgctgccgtcgggtgtccaactgcaggcggcgatgcgggccggcattttgaagaagacgggcgcgacggcaccgtcacaaaaacggcacaaacatccgccaggcgagccttccattcttttttcgtaaattcaatttgttgttttgaatggcgctttttcaggccctccgccccggtctgccgcctccgctcgccgtcgccgcttcttctgacagcgacggggaagacgcggcgagtgagcgcaggcgcgtcgtccgtttcagcggcgacgagcgcatgcaacagaaaagacgacgagaaaaagatggagacgcagagggagacgacgacgaagaggcggccgaggaggaggaggaggactacgcaccggtggagagtgagtcaacgggggccaccattcacttttttgagtcccggcaaaaaatatgccattttcagtccccgacagcatgctgtctaccgacacgatgcccccgccccaacatcagccggtgtacgccagggcagcgccgccggtgatgccgccgccatcctcccaaatgccgtcgatgggcgctggtggagttgggcgggcaccgctaccgcccggcatggcaccgccgcctcccggttaccccccaggtaaatggtgttggctaaatcgaattaatccgcgcaaatgctactttccccattaggttactacgcgtcgaatgtgccgccggaagtgcatgcgcaagcgatgcgcacggggcgaatgccaccgccgcccaattcgtcgttttcgatggccgcgcaacagcagcagcaacagtccaagactgggctcatctcctacacacacgctgaaccgcacccctccgctgtcatttcagccgccccacaggtgaaaaacgcaggatttatcggaacccgtcagttgggccccggcacgtttgggcccagcggttttttggctataactttttgatttgtcatccaaatcaaacattgttggtatctttcgaaagctgcaaatgtcctctattagcctgaaaattttgaaaaattatgtaaaggttcaaaaaaattatgccagaacaact

SEQ ID NO: 16685 - DNA, 2437 bp, Heterodera glycines
tgctgtaactttttcccggaccaaaacaagttttaactttcaaatatgcatagtatttttcgaaaaactgaaaaaaagccaacacaaaaattcgatggatgagcagggaaaatttgtcgggagtattattcaccccgaattttaatcttaattattaatctgattttttccactcagcaggaaatgttgcctgttttaaatataaaaaatgtatttgttattaaataatttttattccaaaaaaacctttaaattaagaatattcatttttgtttttctttatttttcactttaaaattaccaaaattttgcttttgaatttgtgccgtcgcttcgttatgcattgaaatgaatctgttgtaattgtctcattaattgttttttattacgtttttctttatcattgtaataaattcaacgatatatgcacattttaatgacaaaatcaatgtcgactttaataaattttataacaaaaaaaacatttttctattaaaaggattagcctaaatcgattaatattttttcttattaaaatgaatttacctttttcgtcgttttttgtgtgtccattaatttgtctgttttttgtaaacaaacgttctgtcgcattaaaatttatcaaataaataataatcggggaaaaaataaacaaaaatatatattttttgttgttgccgatatccgctaattcatcggcattggggcagtgtctccaactgttgtatttcggcacattttcaaccagctaaaaacactgccactttgccaaagaaagcgatcggcataaaaaaaggataaaacataataataatgttggattaagcctaaaattaatgaacaaaaaagaaaaatgaaataaattaaattaaaattaataatactttaaaaataaaattgtaggtttgtgaaaatatatgttttaagattgaaatggattgtggaaaggagaattaatctaactaaataaaagaatttgaaaaatatcaatcattcttctcaatcgagaatgtacaataaataatgaaatatataaattattgcagccatatattattaaataaattttttataagttgctaaaatcaataaattttataaaacgaataattgtaatatgtgatttattttttcacaattctccattttggataaataatatatacagcattgcttttaaagttttaatttgtcgcttttcgttttgtgagtgccgccatccccaaattattcgctcattttcccgtcaaatgcgtttttttaatagaaaaacaattaatttttttgccctcccaaaaagcctttttcgcgtcatcattttattaatttaaatatttatgcattatgatgaacataaaaatgcacattaaaattaaaatttgcttgtgaaatggcgggacggtggaggagaagaggacggaggcacagaacggcgcccgcctcaaataaagaagaaagagaacggttggttatgcggcggcgcctgcgtctgtcacacgcatcccccggggcggtggccccttttgcttttgccattccccccccccctcccccctctcccttttatctcgttctcatctgccctctcttttctctcttactttctcaattttctcagtctttttccctttttctttcccttttctctgctcttaccctctctcctccctctctcgtctgtctccctttctttctttcccttttctctgtctctctctttctctctcctctgtgccctttctcttctccctatcttttctttgtgtgccttttgcctcacgttgtcacgttgattccctcctctccatcatatggctaacgtcagcaaagaaaaaaaatttttttttaattttctctatgtttctgccgccgttaaatttcgacgttcattttttctctcttcggcacgcttcaccactctctgaccctttttttcctctcttttacctataccttttctttctctccctctctctttctttcttcccgtgtctctcaattcaacacattctttcctccattctcgtccaaattgctgcctctttgtccctcatttcgccgccgttctgtcggtcgttgttcgtcggcgttagcaaatgttaaattgaggcggcgaacacatctgtgaagaatgagtgcggcaagtggtttatgttcttttctcgtgcttcccaatccgtaaatatttatttgtaaataattgacgagagtcttttgactctctctttctctaaatgttttccgaacattaatgacataattaatcaattgttctccccgagtcagttgttccccccctcccccaatttagagtgttgaattcggggccattcttggaatgcgaaaatattcaatgtatctatctatctatcaatggcttaggctgctgatgctcgagaccgaaaatatcaaatgatttgaccccagagattctcga

SEQ ID NO: 16686 - DNA, 867 bp, Heterodera glycines
tcactaattgcctctccgatcactaattaactctcgcatttcacttgtttggttctacaatctcttttcccctttggacacttttctgactccctgctcttctactgatcactcttttataactcactattattcattgactctctttctctcttctgatcactttctgttcctctccccccccctgtctgatcagtgagtgttttttttgtttttgtctgtcccttcatttttctgccattttccttctcctccctcttcagttactctctcgtgttggtcgacgttgagctgatccgtcgtcaacagcagcagcttttgctcagtcgcaagcgcaatttgtcgctgcagcagcgccgcgtgtccgcctcgtgcgccgcgggcaaaacgcaaccgcagcccaagcggagcatcgccgccgcaatcgcagtttcgggcgccgcttccgcctttcttctgaccggcggaattgcggcggaaaaacagcgaaagtgggcgagaaattttagagttttttaaattgatttttaaaattttgggtattttaaaacaaaaattggaaaataatggaatgattttgaaatttagcgagaaaataattgaggaaatggaaaagatttaacagctgattggattaatgtttgcctttggaaatgttgcgtcatccctccgatccctcgggcacatttttttcttgacatttccttttttaaatggtccgttccgcctttaaaacatttgccaaattatccggaccgcatggtcaattcaaatcaaatcatgacttttctccggggattcattcgtttccaaattagtttttgtctcccaccccaaaatccaattcgaattcacatgccgtccaaa

SEQ ID NO: 16687 - DNA, 1757 bp, Heterodera glycines
ccccccccaaaggaatgggataaagtcccctctgtgtccccccctttttttcttttcgggggttttccactcaatttcgctttttccgtccaaaataagtgaattaagtgctttttggaccgggcagaagagccccgcgtcaccgcactgaatggccctcttggaaagcgaaatcccactattctcgtatttatgggggagggggcggggaggacaaagggggcagtgccatccccgacacggggaaagacgaatggacagtgccatccccggggacagtgccatccccgaccggggaaagacgaagggacagtgccatcccagaaccgactttccaatcccaccagtgtaatcccttcccatccaatccccgactttctccctcttctccccgtccgtgccgctgttccttcaccgctccatacccccccccccccccgccacctttcttttgtcctttcccgaacacctttcttcccccttctttctcggcacctttccctcttccccgaatgggccatttgcccttcttccaaggcacgacatttggcactgaatgagaagatgtgctttcctggcacagaaattggaaagggtgggccggtgggaagaacaaagaagggaaaagcgggtgccgtgccgttgtccgttcggccgttcatttgttggaccattgtgccgttcttgtgcatggagggggggggggggagcgatggttccaaatttgtatctttcccaccccagaggcgaactcaaacattttttaaatatttttagttccttaagcacgccattcagtcacttttcttaaagccaaagtgcccttctctccgcttctctgttcgttatgccaaattcagatgtttttttcttaaattttaaatttttgtatttttcattaaaatttacctgaattcagtgggctttatttagcaattttggttgatattttggttttttcaattaaaatcaaaatcgaattccctttttcaataagcaactcaactcaattcgtgccgttaaatttggcattttcaaaacatggcatcctaattaattttatttgtcttttttctctaataaaaatattattaatatatattttcgtttcgaacaaaggcgttttttctctcttttttggtgccgcttggcacgacaaattgcacttcaatttatttttattttggcacgtgccatgtcagttttttacatgaaaatttgttcatcaattttaattttctgctgcttcattatttgacgggagatccttcaaaataaaacaaaaacaaacaaacaaaaaaacagcagaattcatttgtcacgcgtaaaatgaaaattaaaaaaaggatttaatttaattccaatgggggagggttctttaattagtgttaaaagtgccctcttcagacgctttgctttggccggcatttcggtgccaatcatcgccgccccgccgccgccttccaacggcattctgccaaagacttcgtccacctccatcacttgtgccaacaataacaacaacttcgtatagccaagaacagaaacagacaacggcacatttcatcaccttctactgattggcccccttaaattgttctccaatctaacaaattagcacatttgtccgacacttggcaggtgatcgatcactgatgactgatcatggccattggccaatatttgctacttttctcttctttttctctaccctttctttgtcgtctctaattgcgcattatttcttccctttccat

SEQ ID NO: 16688 - DNA, 3055 bp, Heterodera glycines
gaatagacccccaaaaattttcagaaaattttttaaaaggcatttgatcactgatttaattatgatcggtcggtcatttcttattaattcacaatttgtcatctcctctcccaatcgatggcaaagcgaatggcaaatttttctcctcctaacaacactgcccccaaaaaatttctgtctgaccttgaccaactacaaatccccaaagaaattgacactgacaactccattcccgactacgccaagttgcttattaagcagcttcactcccttttaagcaccgcctcggccctaattcattgtcaggttgcggctgtggacgcggtcgaagaggaaagacgactgagaactgtcgttgtgacaaatgtgcccgaaagtaaatcggacaaagcggcggagagagcccgggaggaccatgccattgtggaccacatgttgaatgccacggacgtcgaccaggcaccaattgtcttccgtgtcggcaaaaggatggacggtagaccgcgccctctcaaaatggaattccccagcaaacatgcagcgagacatatcatccgcatgcgtggaaaggtgcaagccttgaatggtctccacaatgtccgcatccgcgaaagcatgaccaaagaacaactgtctgagcggcggaaattgatcgaagaatgcgggaagaaaaggcaggcggacaatggtgattgggtgatatatgccaatcaagttgtgctgagacaagacattgaccaaattcgaaaaaatttttaaattgtccaaccaaatcacttcaaattacccataattattacacaaaggtacaaaaatttttccggtcagtaaaaaatttttacaaaaaaattaatcatccaaattttttaataaaaaataaagggaatgttaaatgctgtctagtaaacataaggtcaataatgaataaaatcgatgaaatagcacttattttagaaaccgaaaaaattgacatccttttaattactgagacttggaccaaagacggggaagaaatcaatttttgcccttgggtaaaagatcattacaattatattttttcatcaaggaaatcaaaaacttgtgggggcggttgtggtattctaatcagaaaagaaattggattttttacaaaattttcggattcaaaatttaattctgaaatcttagttattcagctgcaaaatttacagtgtatcagatttgttttggtgtatagaccacccaaaacaacactcaagcaaacagaaaatttgtttaaatttttgcaaaaattttttaatgaaaatacagtgactttaggagattttaatttaccgaataaggatttggtatggaaaaatgggcatccctattcaatgagtaaatgtggtgaaatattttgtgactttttcaatagattttcttatgttttggccacgaatgagccaacaaggattaactcctggctagatttgatttttacggccaatgaaaaaattattactgattgtactgttaaaggaggcatattttcatcggatcatttaacacaatttttcacattaattactcctaaaacaaaaccgaaaacaaagatcgtaaactttcgttggttttgtccatcgaatgtgttacattttaatatagtcatagcatcaaggctaaatgccttgtcatatgaatgctttagcataaatcaaaaatattccgcctttaacagtatgttgttagaaattttaaatgagtgtattccaataaagcgtttaaccaagaatgatttgactcctaaatacccacaacatttattagcatccatcaaagaaaaggctaaattattcaggcaagctaaaactgacccatccaaaaaagcactatacgatagcatttcttgaaaggggccaatgacagcgcaatggccaaaggaacggctgagagagtcgtcgtcgaccttcgttaaatgaatcaacggaatgattgttaaattaaattaccattttgaaacattgccgaagtgaatcttccaaattgaaattgtaataggcactgtgacagctgaccaaactgaggggcgaatggcgaagttgggcgaggagagagtcgaaactgaaaggggcggtgggggggggggaaggggcgaaggagacgaacattgcgggacagccccgtgccatcacgaacattttctccaaaagtgcgaaatttccgcccgtctcacaaagaatggcatttatccgttcggccgaaaatgtctcctaaaaatgagtggtttcttttttgacattacaacaatgtcttggcactttaatgccgtaattcagcgccatctgtgccaactcttcgccggagcaattgtcggacggcacttcaaatgtttgtatattctccaacccattaaaaagtgttctgctggtgctggtggccaaaattttgcacatttttccctaaattggttaaccattggaaacgcaacaaaaccgttcaactcactttgatttgatcgaagaatttgacactatcggccatttgcactccgtcgacgatcagaagggtttttgcctaaaataaaaacgatttgggaagaaatttgaacaattttgcaaacaaagttatcgttgagcagagagtgcagagaatgggcgacggacgaaagttcgccgcttttgccagccgattgcgagcatccgaaaaaagcatcgcactgaaatgaaaaggcactcaaaaggagtgaaattgcgtctcgcgcctcgtccatttgcgaaaagttcgtcggagagtttagtgaagccgccagcaaaagagtgtcggccgccaattgactcaattccgccggatgaaagcgtcggtcaaagagttattagataacagtgattagataatgtttatttaatatagtattagaattggttttgcttagacaaatctgttgttctttgggttcctcagatcagtacgaacacaattcaaagtaagtcattccttttaatttcataattaatcttttctacaaaataattgttcataacacaatcgtactacctagcgggggatgcgccgaaggcgctgacccccgctagtt

SEQ ID NO: 16689 - DNA, 1062 bp, Heterodera glycines
tacatttcattcattcattcattcattcacattcatttgtcctgtgtatggatggatttgttgtgtttcttggcgaagtggcgcactcaaatcgcttcagcgctttgttcagtttaaaattgttcaagaaatatgccatttttgggtaaaaacggggccggcattttaaatcgattttagttaaattttgtggcattaaaattaataaaaaattaaatttaaatatttttttatatgggcgaaggtcaaaagatgtgtcacaccacaatgaacgagcattctttcttccgccaatcagcccaataacaaatttccattcgcaacgcaattttatgggtccattcattcattcggtggtcgctgaaaaatcgggccgagcccatcaaatgtttacgcatttggccttgggcggtttcacgccgctctttggtccgttcggaattttctcgttccttttcttccttttttttatcaaaacaaatataaaacagcacacttttaaatgatttgaaatttattaaattcctaatgccgattttccgaaatcattcgagtcactcccattaattgtcctctattaattactattcatcattcacttatttgttagctaaaaaattccatattactttcaaaaaaattacaaataaaaaaattaatccaattttttcgaaatgaaatttttgtttgaaattttaaacttctaaaaagcagtgcaaaatgactaaaagcgaagtacttttgttggggtaccgtacctcagcacagcgctaccgtagatatctgttttttaacccaatttcaaatttatttattattgttttcttttctacaataaattttcttgttttttcctccgtgccctcttccccctctttttgccactcgtccatcccaatccgtccgtatttgtcccattgccggctcgtcgtcataaaccggttcccctcccccccccctccgcccccaatttgctctccgatttccttgcttcgcctgcggggattattttccgaatcgtgtgaggtgtgggcgattgctgtgaggggtgagcagagaccc

SEQ ID NO: 16690 - DNA, 2040 bp, Heterodera glycines
  misc_feature (1452)..(1452): n is a, c, g, or t
atattcaaggtcaaaaatcgggattcaagaacaaattttggatttattggccgagacatagccattttttataataaattttggtttttcactttccaaaatattgcgacaatttgttgcttttcatttcccccatttttgaactgtctccccaccccccccccccataaattccacgcttttcctcccccccccccccaatccgacaaaatcaatccgcttttctacactttcttcgcgagaatgtcgtttcgttcgttcgttcgtcttcagacattcccgagaaaaattaagggggaaaaatagggagcagaaggggtgggggggggggaaggagtatttgtttgtttgtttgttcttgacgaaaagattcattttcagtcgatggattgcctttttctatttttattggcctaagaatgttttgtattattacaatgagagaatcagtaattatattgggacagacaatcaattatctatggataattattctctgatcaagattctaatcagtttgatcgggaatttcataattaaactctttcattttcttacgctaatatcccaagtttgaaaaaaactgctctaattaccttccaaatttttttttctatttctaattagttccttataaatgaattagcccataaaaaatatttatgaaaataattaatgttttagaagagagataatttaatgatttaatcgattcaaatcgtaattaagtgataaatggaatattttattggccattatcatggccatagtttttgtttgcttaacccttcttcttctgactgcaattctctcttcattatgacaagaaattttggcttcgtttctttctgatcagtcaaaatgccgacaattcgattgatcgatcatttcccctaatcatttctaaatactcttaattgttaatgcttacttatcagtccaattatttcttgaatatttttaaattcttatttttgccttattttgtctgatcttcccaattttcccattctcaggccgttggtcgtcgactgatcattcccgcaattccctcccaaaatgtcttcggaatacgaaacgaccaccgaatatcgttcgaccattcagccgaggtcggcacacacgcaaagtcgccagtccagcgccgctttcccctccggcggcggcacgggcggcggaggtgggcaaaaatgaaaaacaattttaaaaataaaattataaaaatgtcatccaaaatcatgaaaaatgaaaaacaaaaattaaacaaaaatcctgcaaaatttcaaatgcaaaatctcgggttcatttgcgaacaccagctgaagtactttcaaaacaccacttgatctcgaccatcatttccttggtgttttcttcccaaatttttcgcttcgccaatacccgaaagggaaagggaaattgccgtgccccgatgtttttgccccccccccnccatttggtctctgagttggtcattggtttgtgctcgtcataaaattgccatttgccaagtgttcctccgctgcttttccacacgctgccatattcaattatcattgtttgtttgtttttttgttgtgctcgaatatatgtcgcgctgttttgaacccatcgccggcggtgctctaaaaatggtagggaattcgacggcgaggcgatcgccccgaggcgccccctaattggatcatcagcagcagcacattccgtccgtccgtcccttcgtccactcttcgccgtcgtcgtcgttttgtttgtccctccgccgccaatcggccgcccccccgtccaattcattcattacacaaaagagcagcgcgcaaatgaggaattaattaatttgaggagccaaaaggctgccgacgactcgtccacccattcattcgttcattcattcgtccatttgtcaccgcagtttttgctgatggggcgggcaaacccccaaaaattgcgctggggaggcaattaatgaatgtaatggtggggtgaatcactcgcgcaattgggggggcactgaggagaaaggcgacggctaatcaaaag

SEQ ID NO: 16691 - DNA, 2394 bp, Heterodera glycines
  misc_feature (15)..(15): n is a, c, g, or t
cagatgttaaaatcnagtcaaagagagagatttttgaacctgctaaggtaaaaatattttaaataaagacataaaaattaatttgagttttaattgccaacatgctaacatttccaaataaaagtaattcaagtttaaattgcaaatacggtattttttttcatacttcacacaaatcaattagtcagattttctaatttcgtaatagtttggaattcgccaaaagcaataaaaccgttgatttggggccgaacgatgacccgtgattataagtcaggcgccgactggtgatcacaaggggtcgcctgggtaaatttcgagggaaaagcagagttcgcgagtaattaatgagcaaagaataagaaaaatcttcccgggtgatcacgagaaaataacaaaattggaacaattaaaagaaatgaaaaagctttgaagcaattaattagctaattatcggccgatatcacattaatgacaaagactaaaaaatgatgaaagattaaagttttaatgggccctcgaaagccctaggcattcatttgtactgtggaataactaattggcgaaaaattcgacaaattgctcctcttgtcgaaaatcacatattagaaaataataataaaaattaaataatttctaaattaatttttttaaattatcagcaatacagtaattttgttctaccgtaacattttataatttagacatttcaaatttgtcaaattctctcaataaaccgttcaaacattcattgccgtgcactgcgaagttttgctgcaactcatcgaaagctgtttgtgccgagaaagcgttgaattgttcccgtcgctgctactgcgctggtcgaagtcgtgaattggtggacacaaatcgccggaggaattgcgacaaggacacacaggccaattgtgcaggtggaattttctgaccaaattcacacaaagttgagcaaacggaaaaatttaaataattggacggttacacctgtaaattgagtgtaaatttttccggtgaattaaaaaaaaaatcacaaaagggaaacaaaattgaatcgacttcggaatattcccgaccctttaaaaataaggaactaagtaggcaagaaagagataagagaaggcttgaaagggagaaaaagttgcaaagtgagaaaattagtgacgaaaaagggcaaaaaatcgaaaataaaatggcttttcacaaatttctccgtgaatttaatatgctggcgacagcatcgaactggcatccaccggactgcgtctgtcttttgccattatttttagaaggggaaaccaaggagatctatcagaatatcccggcaaataaaaagaataattggcgttccttaacggaggaattggccacaatgaccaaaaaattggatggcccgatgtgggcgcgaaaaatgttggcaaaaattaagatgggcacagaaagtgtaacggaatacgccaacaaaataagagaaatggtggaaattgcttctccggacccgcattacagtaaggaagcaagagaaagtgaaacaattcatatatttcatggcgacccttggcggcttccagttcacccagcagcagcagagaagcgaaaatgaagagagaggataaagctggcactggaagtgatcgaatctgcaaccttcagccgagcagcagctgacgcagagaagaagaagaatggacgaggacgtccataagagaggcccggaatgagatagagaagaagaagcttccccgagaggaagattaatggatcaattgaggcaacaattgatcctatatgatcgagcaaagtgggaagctggagagggcagggtcggtagttcagctggtagaacactggtccggaaagccagagacgccggttcaaagccggcccgccccatagtttttccctcaaaggcttccccgctcgttcatatatttcaatggcatcggagaagtgggagaagcggaaggaacgggggagggagagggccgcaaaggaaagcatgggagaggatcaccgaaatacactaatgatcaacctcaatttcttttccaaattgatcatcactttgtcctggtcagagtgatcgcgtcatttgtctgaccgccgcttctccccgtgcgtccactgtcactgcgattcgtctccaaattgacggtgcagtgcgacttttgccggccgaaatttgagtacagaacggatccggaggtgcgcgacgtgcagccgcgcactgcttacgaaagcggagggcgaaagttgatcgttacggtaaaatcgaaatacggtagggaatgaacgccttcccaatgtttggctttggcagggctcccatttggattcggtgctgtcccctaaaattgtttctgctctccgcccccaccgttccgtccgcttcacctg

SEQ ID NO: 16692 - DNA, 1185 bp, Heterodera glycines
  misc_feature (119)..(119): n is a, c, g, or t
cagtgaaagaaaatataaagaatgaaaacttacaatcaatttatataataatctataaaaataaacaaatatagcttttgccaaattatataatcacaaatatgaaaaaacagcatttnaaggaggcccaacctcagaaaaaacattatatggcgctcctgcgcgaatagtcaaacacatatatcatatccataacttttttgtaattcagaattactttataaaaattaataaaatttaaaaaaagaattaaaataaaaatcataaagcataaaaagaattaattggcagtaaaacatcactattataagaaattattaaaataaagatcgagatttcggtcaaacgaataaatacgaaaatttcaaaattaataattttcgtaatcataataaaatttataaaatttgttgtaaaaaaattatttcattattttttaatttaaatgataataaataaattattattctgatagattaattcataataatcttttaattttaccattattttcgtggtataattaggaaataaaataaaccattgtaattgctttacttaaaatgaaacacactagtaatttgattgattaaatattaatttttaatttttacggatatattttctataccatataaatcataaatagttttttataatcatatatattgaccggattataaaacgtaaatgtatttagttatttataagcagataatcaaaaaacatttataaaaaataaaaattaatgaaatcaaaattaactaaattattctatttataataaaatctttgatttttcacctaatttaaaaaagttaaatttaatacctaattaaaaatatattgtactatccatacctgctgcaagaaatcaaaaccctcattccgcaaggaataataaatataatgctaaatcagcttaagcgcaacacaaagtaatgaattaaatattatataaaacattaaataacaaatataaaatgcacaccaacaatactgaactgatacaggtccagcaatagagacaagcctgcccatttagtgcgtaaaaaacataattatttcgcattaaaaatcatttaaatttatttgtttaaagtaaactaatacaaatttaagtgtgttaatttaattttaagggttggattataaaaaaatttattgaaataaaccatcagtaaa

SEQ ID NO: 16693 - DNA, 1000 bp, Heterodera glycines
ctttccaaaagagccatatgctgatcatctccaaacactttttcccatatttgttgtgaatttttaaagttcacgtcaataggtcgcattccatgcacccggctcggtgatttattaataccattaacaatttgatcaattacgtccacccaatttagggtttttgtttgggcaaagtagcgatacacccgatttttgatttgtcgtattgcgcgctcggctaatgctgctttcttctcagaatgtgtgctctcatatttctcaacttcctcttcatcgaaaagttttttcagctgctgatttctgaattctgtacccttgtcggagaaaattctgtgtggtttcattggcatcgttgaaaacacttctttaaagccgtctaccatgtcatcagccttcttggtacgaagaggtgtcacaaaaatccgcttcgaaagaatatcaattaccaccattaaataccgatttcccctgttgtgtcgagaaagggtttgaaagtcagccaaatcgacctgacagtcggtcataaaaccggcagccgttgttctagcgcgcggaaaattgatgcgtcttggacgcatcaatgtgtaggtgcgatgcccctccagataatgttttacatcatttttacgaattttatttccaagttcctttttggcttccaaccacaatcggtcgacaccggcaaacgcagcaggggattttgggtcattttagagccgttctaacaccttttctattgatttgtccatttctttggtcggagacgttggcttttggttggaatttccgtttctactgctgacagagccgtcgacttccgcttgactcccctcgttggaaacggaagtgtcaagccttcttgttccctgcctctcgcctgcctcattcctctgagcttttgggatttttgatttaattctggcgtttgctctgcttgtggcaatctccgtttgggtgcccttggtggtactgggtggagccgtccatgttcgcaaaa

SEQ ID NO: 16694 - DNA, 3081 bp, Heterodera glycines
  misc_feature (3072)..(3072): n is a, c, g, or t
atgagttgtcgcttagctccctcttcccatgaggaataatactcatttgctttccttttttgacccctatttacagcttggtgggatggagaggctggtactaatggcatttcctcatcgtcatggtaatggtgatgaggccgacgctgtctgcgattttgtgaaacgggaggatgtgatctttctgatccaaaatcaaaaaattgttcgtcttcatcactttcatccccttttttgattagtgccttcatccctttggtaatttctatttttgctggttgattttggtggtcatttctcaggtggagataacgagacaattctttgttataattaatattttttgctgtcacattctccctctttctttttgttctttccagcgcatgcttaacaaaatccaagtttatgtttcccgaatcactgcttgttaagccatgataaatttcttcgggtacgagaataaattttgaagccatgataaaatgatcaattgtcgctctttgagcttgaatttatagcagagcgtgccaaatcaataagaataggagttagcagagctgcaaaaactcctccgagcccacttccagtttgaaccaggaccttccgtgcccctctttcggtccttcgacgagcaagacttcgaacaaaattagtttaaggtaacaaacgttttctttgacgagttgttaatttaaaatgtgaacaaagaatgtttaaagctatttcaattaatgttaacaattgatcggcatttgcacgttttaaaatttctctcctttttttcatcgatttggttttggcaagtaaacgaattaaatcaaaatttttatgtactattgctccaattttacaaaaggccatttttggaatgaaaatgatcttttttccttcttcttcatcgtctttaaatatcccactccttagtcgcaacagggggttagaagcagcgtgcatatcaacgaggagataaccatacggtttattggtcgcaatacggtaggccgaaaggaaataatccaacttccctggaaaaagttgaactccaatgttccgaatcgccaatgcggaatttggagctcgcattaacaccaaatattgggcattttgtctcgcaactttaattcttcgttcaaacaaattttgggtgacaaaaacaactgcaaaattctgatggtgagactttttggtgaatagagcactaagatatgattcatcgatcgaaagcaaaagatcgtcaagaataaacaataatggttttggtagacggttaatcaaatcctcaggaggcactcccgggtacacattcacaacgcatttttggagtgttggaacaatacttgacatttcaccaaatgcataaagcagtgaagcaggtctagggctaattaactccgaagattcagcaataaatcttattaaaaatgtgcttttcccactccctgatggtccggcgataatcatgccaaaaggcatttttaatttagttctttattggaataaaattgattaccaatcatattgaattttaacacaacacaacgaatttaataacttaaatagtttttttattctttacgactaattgacgcaatggctgctgcttcttcatcttctgcttccttcttcccctttttcttcggcttcttcttatgtgaaatgtccaagcatgttgtggcagcggagacactttcaagaaattcgtcaagaatttctttgtccgtttgctgcttatctttttcaataggaatttgctgcttttgttcgttattgctcatccccatggtagcggcagaaatagccgaagcaaattttgaagaatctttctttggttgttttgagttaggttcatgtttgttctgttcgtcactcatccccattgtggatgcagaaatcggtgaaaagaaatcggaggcccttggttggtgttgttttggtttcggtttgggcttgaggtgatcaccaacaattcccatagtagctgctgcaatcggagaaaagaaatcggaggcattagtctgcggttgtggaagcgcttttttctctttgttttcgtcgacttccatccccgcggttgccaccgaaagagcatcaaaaaattccttggcttctccgtgcttcttttgagaaacatccaatcctgtaatagctgccgtgatagactcaaaaaactgttgtgtagtttggtcttctgtttctccatccttttcctttggctttagttgaggcggaggcggtgggggcggtaaattgtagacgggagtctcggtctgagtacaaacattggagcggaaaccgtggtcgacattaaaaactcgacctttgttacgaatatgaatattattttaaagaaaagacatataatattttaaaaccttgaaaaatgtatagcccggcaactcataaacatagtcaaatggcacgaatcgaggactaattttgaaacgagtacaccaaattgttactccttcttttgaaatgcaccattccgtctcgcactcagtggccttgcattctcgatacttgccaacgatgtcaaatggaattgttctagcaccgcaatcctctcgctgatcagtgtaatgccattggtcgtatgactgatctctacagccggcaaaatgttgtccatgataaattttatcgttataattaatactcattttttagatgaatgagtttgaccataaatttcgacttttatataccttcccccaccccatgcccattaccccgtctttattcactacagatattttctccatattataaaatggtccctcatgtttgtcgttcttgagtgatggaccaagccaacgagaaagtaggtcatcgctcgagaacggaaaacattttgggatgatatcactccagcgttattcttatttgtttttcctctcttttctacctttttttcttaatttagcaatggcacgacaaatgagccttcctctgtttaaacgcaccaaaccgactgtaagacattttcacgttgagagggtacataatattttaatatttttttcaatctttctagtgaagaatatttcagttgattctttttgaaaccanaacattcag

SEQ ID NO: 16695 - DNA, 3416 bp, Heterodera glycines
gtcaatcaatggtggcaacttgtacaatttctcctcccccccgcttatttcttgagacgaatctcggtatcgaccttttcgagcatcactattattccagtggccgtgctataaaattatagatcccatttataagtatactcaaataggcatgggttgggaaaaaattgtttgaaaatttcaagaaaaaaggtcagttaaaaattaaattttttttagttgatcaaaatgccaaaaaatgcggccaaaattaaaccaaacagacaccaatttttgcagcttttcagttctgtcatccgacaatccgtggcagttgtcccagctcagctgcatgtttgctgtccccagtcagccaacaatttgtttgctgcgaaccgggggccagcgccgaggatgatgataaggagggtaaagtaaatcaaaattttgaaaaaatttttttatttaaattaaaattttttataatttttttggcaacaaaacttatttaacctagccaaatataccctgaaaagttattacattatgctttatgcttataattttttaaatacacaaaacaaaatacaagaaacagatttaaattaatatttaaaaataaataaaattaaaaatatattatattgatttttcagatattcagattaaaacatttttaaattttaattaagtttccatgtaaattttaactagaattaatgtaaaaaacagatttaatgcgccaccatttgcggcacgggcgtcgccaccgcgcgcggcaccgcgaccatggccgccagagcgcacgctccgtgtccatgcggtcactgtcctgtccaagtccggacgaccgtattgagctgttgggcaacgggaacccgagacactgtaccattgacgggcgcgtgccctgcggcgatgggtaaaggaaaaattctaaaaacagaaaaaatttttagcgcctgccataaaaaaaaattattttctgctaaaattcaactcttagaaatttctgtcaattcgaggccaaaaatttgtctgaaattttgcgtattaaagtaatacaaatggatacagtagcaagaaattttatacatacaataccggtaaatacagtatttacaatcaaaaaatttaatacaggttcatttgtgaacagtccgtggaaaatccacgcattggggtgtgttgcagtgcacaacggacaccaaataggctcatctttcaacaagcgcaacagcgacagttgccgccagtgtcgcgcggtcgcgccgactcatacggtagcgactacagtgacaacgtcgattacggtaaccgtggcggcgaacgtccgtcaccctcgtcgtcgccattgttggagttgcccgcgccgcgacggacaccaaattcaagcagtagcagcagaagcagcaacagggacgagcccacctaccgttgcccatccggtgctcaagtgcccgtgctaataaatgtaaaccctcgacatttgaggcccaattttgagaaaagtctacggatttaaaccgtatactgtagccaacattagggtatggtcgacaaaagccatgagttacggtacaagtataatctcactaaaataatacaaatgttaattttaaaacaaaaacgatttgatttcatgagttgtttcaccgctaggactcaaaaaattctcacaaaggggctatactgtgataaattatttcaaaaattccgtaagattttgtccaaaatcttaatttttaagggccaaaatgtattctgcgacttgggcgcccagcgttgtccaagtggcagcagttgcgtttcggcactgaacgccttcggcatgatgatctgttgtcgcaatgcgcggcaatctttgccagtaaaaataaataaattcaaaagggtggttttgtaattggattccatgacaatactcttgataaacactcattgattcttcaaaaaaagtcttgacatcaaaaattaaaatggaaataaacaggcaatttcttaattttattttgaaaaatataaaaattaagacattctttttcttccaccaaaattcatgtccttgaaaacaatgatttccacatgtccttgaaagtcccaaattaacaataatccctttagcaattagaacaaattaattttttcttttttttccaaaaaataatgattaagctatgccctgtcggaatgcagccggagccttcagcgattggctacgtgccgtgcgatttacttgcgcccggccaatgcagcgaagggtaagcacggggaatgattccagattttccggaagcccaaaaaattagaatttttcacaaattcccacaacttttgactcaaatttgccaaaaaaaaataaatagtctctgatcactttttaaacatttccgatcactgtaaaatgccaaccgccacaggtatcagtgcgtgcattcgcgtgacgatccggagatgagcatttgttgcagtcggttgcgcaaccaaccgccatctgctgcggcagcgcccatctgccccaatcaggcaaaattttcagtccctttctccatcgcgttcagttggcccatttctgacgggacagaattttttttttttcaataaaccgaagttggcaattttttcagcaaattttattgcgagacgggtcaagcccgcgctactgctccccacggcagggcatcagcgcgtgtccaaatgggtaccaatgcgatgagtcaattggccaaccgaatgtgtaaattcaaaaaaacaaaattggcattttaatacagtatgtgccaaatttgaaaaataaaacgtctccacaggttcgtatgctgttccatcccttcgttggccatgtgcccgcaaggcttcgtctcctcgttggacctgcgcacacaaagcccggtcagctgataagaccagtgtagttatcactactatatcaggaaaataccgtataaagcaaaagtgtatgatattgcctaaaaactgattttgtatcatcatactgtattgatggtgatcgatagcttaatggaatgccctattgtattacttactacatccagtgattcccagggtgtgcattttgaaatttttggtaaaaattttcaaaaaatttttaagtttaggtatttttgagaattccaatcttatggggctcaaaaggttcgccttaatatatattggcgtggctctaaaagaggctgtgatttttttaaattctgaaaatgccacagattcggtgctccccaatggacgtgtccatgtgcccggctgaggcgcaatgcctgcaggcaacaaatcgcgccagcgaatttttgtgctgtgaaagcaccgagccagggtagggaggaaggctaggagagggggattagctttttataaatttttttcaaaatctttttagccgtgtctgtccagtcccaggccaagctgctttgttaaag

SEQ ID NO: 16696 - DNA, 1847 bp, Heterodera glycines
  misc_feature (1786)..(1786): n is a, c, g, or t
  misc_feature (1808)..(1808): n is a, c, g, or t
  misc_feature (1816)..(1817): n is a, c, g, or t
  misc_feature (1823)..(1823): n is a, c, g, or t
atgtatactgcttaaatgggcatttgcaaattagcaccctccctctattagaatacggtatgtaaaagatttggtagtaattttcaaaatgtgaaaagaatttattgaaattttttaaatgcatatttttaaaaatttttgcattttttttgggaagtctcaaatttttattgtgtaatgattcgccacttaatttatataaagaacatacccaaacatttgatgtctgaaacaaaggcattacggtaataccgtagcaaccaaatggatacgattggatttaacgctgacggcacaaattggggaattgaagaaaacaaattgtaatattgtagccaactcgagtgtgttgagtcaattttgaatagaataattgcaagcaaaaacagaaccgacaaataaatcattagcggcatcgatgcctaaaaaataaaatatttaaattttatttaaattttgcctatattttacttggacaatcagcgttcgagagatttgcttgttcatttcgatcatttgctggtttggaccataagatgcgtttctcaaattccagaaaaaataagataaacattttaaatatttaaaatatttttaccttaatttcattttattcttcaaaaatttttcaatatgataagccaaagtgaaaattatcaagtacgaaattgtgcacacgatgataatgtatgccagactaattttttgacgaatatcctaaattatataattaaaattgataataataataataatttgttcatagtgctgtgcattgtacggagtgagttaatttctgtttttcgcattttttgtcgcatatttttgaattttttattcaaattttctgcccatatttttgtgtttccgtccgcacaaccaaccgcaggcatatttatttttttacattaaacgaatatccggctaaaataatttgatcgtcgtcgagattaatgccgagaatttccgcgacggatttctcgtccattgttgcgtgttctacaggcggaaaatagctgatgcacaaattggcgcaatgcgcaaatggaaacaaaagcatcagaaaaaggaggcaaaaatatttggtggacgaaacatttttatcccttgaaagtgcaaatttcttattttataaattaatttaaaaataataattaattaatgtaccggataatgaccaaataacgaaaaataaattgcgacacatagccaaacattgacacatagaccaggaaaacccagcaaacgaatgccaataaattccaaattcgattttgcaccccttttatggtgatcaatccgtacacaattacttccgtttcgccccgttccgacacaaaattgtactaagaataatacatttttaatattaaaatggaaataattataaaaaattaattgaaaaaaataaaaaaataataatataccgggatgaataaaaatgtcattataagcaataaaatatcaatcaaacatgtttgcaatagaacctaaatatttattggaattattgaccaataaaagttaatatttataaatagtaaaatcactttgctataaataagcattggctttggagtatgccgataaattaaacgaatcaaaatgccattaaacaaaatgccaaaaccgcacgtgaaccaacagaataggttgattataaatccaaatatggcactcattgggaaatttttgtgatgaaattttgttctttaaattgaaataaatgaataattttaatattcacagaaataaaatagagttaagtcaagtgaataactttaangcacatttttaatacatcattnaatgcttnntatgangcttttataaatggtttcattttt

SEQ ID NO: 16697 - DNA, 2208 bp, Heterodera glycines
ttttatcccttaaaagtgcaaattttttattttataaattattttaaaaataataattaattaatgtaccggataatgaccaaataacgaaaaataaattgcgacacatagccaaacattgacacatagaccaggaaaacccagcaaacgaatgccaataaattccaaattcgattttgcaccccttttatggtgatcaatccgtacacaattacttccgtttcgccccgttccgacacaaaattgtactaagaataatacatttttaatattaaaatggaaaaattataaaaaattaattgaaaaaaataaaaaaaaaatataccgggatgaataaaaatgtcattataagcaataaaatatcaatcaaacatgtttgcaatagaacctaaatatttattggaattattgaccaataaaagttaatatttataaatagtaaaatcactttgctataaataagcattggctttggagtgtgccgataaattaaacgaatcaaaatgccattaaacaaaatgccaaaaccgcacgtgaaccaacagaataggttgattataaatccaaatatggcactcattgggaaatttttgtgatgaaattttgttctttaaattgaaataaatgaataattttaatattcacagaaataaaatagagttaagtcaagtgaataactttaagcaacatttttaatacatcattaaatgcttttaatgaggcttttataaatggtttcatttttgtgttgttcagaaaagaactccattaattataaattgacttgtcatttgcatcacgcacttatccttattaggaactaaattatctcttttcattcttgatattataatatttaatttataaaaatttaaaaggaaataattagatgaaaaaaaaattattttcaaaataggtaaattaaaatttttttaaatattaagcggcctttttaacctctgctgaagaccgagaaattttcaaaaacatagaaattggagcaacaaaaaattgaaaattctctaaaaaagcctttaaaaaaatattttgaactatatggactaattagctgtataaaaaacgtcttagtgagctgctttctgaaatttgaaaaatttccttattattttaataaatattaaataacaataaaaaaagaaaaaggaaaatttccataatttagaaaagtgaaatcatacgcctctttgtaaaaaataactttttgcatgttttcaacgcatatgctttgaataaaggggcttctgacaaagaattttgcttttgtttttttagattttctgaaagaagccataaaatgaataattttttgctgatgctgttgaaaatttttatgattcgaatgttcggcttgaaggaaagaaatccggaatgagcaagataaacgaaatttcttgaattttgttaagtgcccaaagttttttgccttatgtttgctttggttctagtgctgttgatgatcgaaaatcccgaaactaagattttttcaaaaattttgcaccattattggaaattttgaaatcctgtaattgcatttgttgtttttattttttttatgtctgataaaatttaattaatccgggtaccattatttgcgttgttatgtttttcatcaaattataaatatttaggaatagagtgctttgcaaaatcggagaataattaatatttaaaaaattatttgaaaactttttgaaaaaaatttgcgtttataatttatattagtaattcgcttattattttagttttgataatatttatttttatgtttaaaggtcaaatttagtttattagcccaattgagcttttttaaagttcgtccattgatactttattaggttcagctcatttgtcagcatattttttcctaccttagccctaattaactacaataattaaaggaggcggggctctattcgtaaacgttaaaataaatgtataaaaaccatgtatttaaattaaaaatgcaatattatgagaatttcttaaaaatcaaaataattgattcgctttaatgatttctttgttaagaaataaaattatttttgattatttaatgctattacaattattattttcataaacttttttttcttatttcagctttttacaacatccgagattcaattcataatttctaatatgcgcaaaggattttatttttcatttggttttactgcaacatttacg

SEQ ID NO: 16698 - DNA, 3520 bp, Heterodera glycines
atattatcaaaaaaatattttaatctctgcagagatctttatgctctgagatgaattccatcgcttcctcctccgatttgtccactgaaagtgatttctctcactgccccgagggcatttattcagaagagcaacgtgcctacagagtgtatgccaatgcgccgataaggtaacccttagggggagagggggggggggctttgacttaaattaaaatgaaatattaaaatttatccatatcaccgcttctttcccttcccatccctcacaatcagctttttcggcattttgtccaatttgtttaacattgccattttctgcgattgcgaaatgcgacaacaactcgtcaaccactttttgctcgctttgtctgtgtcaggtcaattaagtggtggaagtgattaattattattccctaattaatcaattgttgtgccaattgaaattgccgtgcaaagattccttttcagatttgctccttttgctgtgcaacttcttcttcctcgtcctccccgttctcatcgctgaaattgactcattcttttggaacaatttgttcacttacatcataaggttctgtgtttctgtctctcgtccgttctttgtttttgtcatttcttttctgaattgtccattttccttaaggtattcctaccctctcgcgcttaccgttcagacgagtggtacggtatccctcccccaaggcattaattaccgtatttgattttttttaaggcgtttatttgactgttctggtcagtgttcatcgctttctcggtgtttgtcatcccttcaaagtttttaataataaaaaaataaataaacaaattctaaaaatgtaaaaaggctaagcgttgggtgtcacggaaggccgtcgaatgggccatcgtcggctccgtgctgttcagcttttccgtgaacattccgacttggctcgagttgggcgtggtcccgtgttattccacccgtttcaacagaacgtccaggcaaaaaacagcaataaatgcccaagtaatgaatgcctttccccgcctgccattcagccaaattcaattggctcctttccacgacatctcttacattctgatcaaaaagtgcctggtctacacccttctgatgttcatcgtgccgttctccactctgatcacagtcaattggaaaatggtcggatttctttcctctacttttttaaatttatgaatttcaaatcatcgttaggtctgtgcgcttaggtccagcactcggctgaggaccaaacacaccctttcgtccagcaaaccgtcgaacagcgagtggttgggacgaccaaacgcttttaatttgcaaatgtttcagcaacatcgcaaggcaactccatctgctgaagagcacgaggtgaaatgaatgaatggtgaatgaatggattgatgtgaacattctccacactttcgcagatattccgaagtgttcaaagtgatcagcaaaattaattactcgaggtaaacggacaaacaattattaaattgtaatttacaaataagaaacatttgtttatttaaagtaattactaatatttaaatcttcctatcggagggtttgccgttctcaaaactccaaaatattggcgccatctgtggtgtccttactttagggccaccgaaactaaaatggaggggaggaaaattccgaaaaggaccccaaaagggcggtaaaaatggctccatgttggtttgggtcataaattgaaccattcgcccatttcgttcagtttgctgaggccttcttcggaattgttcaagtcgcgcttcacgaactccaccagagaccgttccatcactctgatgcttttggccatcgtcggcctttttttggtgtgcaacggattggcctttctgaacagcattgtcgagtcgatgattctgttcgccgatgacacaaaagtaaaaacaattgacttgttttataaaaaataataattaattatcataattgtactgtactcttagcaatctctgcaaaatacggtggaattgttgaggaattcaagcgaaggagctgaggagcagaaatttgtgcagaatgatgcgaaggaagagatgtggtggatggaactgatggtcaaatggttcgaatgttcggtggaggtaaccccaaaaagcgaagaatgtccgccgatcactgatcagtccacccgtcactttgaggtgtccaatgtgctgatcactttgaattcctccacctcgactttgatatatttggtgttcagttcgaaataccgaatgattgttaaatcaatcgttggcctccaaaagcgggacagagtgggcatattcgatttaagaatatccaaatttatttgaaattgctattttcagtttaatcggatcgcttttaccaccgctctcgctgcccgacgagcgatggaactttcactgattcctgaggtattcgatgtgcctcttaaagagactaattccaaaatcaggaggtcgaaaaccggagccggcaaagtcgaaagcgtacgaccacactgacatcgacggtaaccgcggcacggacccgcgaagggtcgacagcagcgagtttaaaatcgaaccggcacgattcaatgcactcgcagttgcagtacaggctagtgacagagggggagcagttcaaatgagaggaagggaaacggaagagacaaaaatattcgattttcccggaaatgtttaaataaagccgaaattcacgacgaaaattgagtcatttacaaagatctttttttagaacttccacagcgccacagaaattgcctaaaatgatgagcttttgtagtgggcttcagctgtcgtctattggcgatgccaatagcgcaaattcggcgacggccgtgccaatgtcagcagcgagtcacagacgaacgatgtttaaagggcttcaaaaggggtccaaggagcttttccggtcacagggaacactgaacagatcgatgacaaattcagaatcgaatttgaggtgaaagagaaattttgaaaaaatgggaaaaaatttcagattaatggacgagcaggaaaagcccgagaagagttcagcagaagatgagaggaaaaagaaaatcggggaaacgatggaaatggcggaggcaccgcggcaaaattgttataatttatagtttttatttgttttaaattttatgctttcaatgcttaataaaaatatttataaaacgttgattttgattcaatactagagatcgacctggacctggatccaggcctggatttttcctggatccaggtccaggccatttttcggcaacctggatttttcctggacctggattttcctggatttttgtccaggaaatcagggtccaggtcaaatgtgaaaaaaatccaggtccaggtccaggcaaaacaggaaaaaacctggattttcctggacaaaattttagaatttattttttaagtgaccgatgtttttttcagttttcaaaacagataaataaatttaaaacacattattattattaattagatatttagatatatctaagcaa

SEQ ID NO: 16699 - DNA, 2298 bp, Heterodera glycines
  misc_feature (149)..(149): n is a, c, g, or t
aaaaaaattgtcggaatttcaaacttttatcatgtattaactcaagtcctaggcagctcttctaaccaaaatgctaaatttatcttttttctattgattctaaatgctcaaagtgatttgttcctttacaaccaaaatttattagcatntacgaatttgatgttttttgtgtgttagagatgtgaaaatagtacgccaaaaagagagaaaaagaaatgcatttgtatgttttattttgttacttttgaactaacagatagaatcaaaaaataacagatgaatcgatgcagaatttttttctctatcgatatgcaaaatttggtgtggatttaacaagtaggaaaaaagttaaacaggatgaagtgaatgttgttttttacataattaaaatgaagagatagtacgctaaagagagagaaattacaaagaaaagagaaacgacgagatagtactaggcttttctctgcacagtgtgcttgacccatagtgcaagcagaaacaatgactaattgtgttttcaactaacaaaaatatttatgtagcacgaaaactaaaacattataggctctactgcattttacgcgtccaatcgacttttacgcgtccaatcgacttttacgcgtccaatcacagtttgcgcgtccaatcaaaagtttacgcgtccaatcacagtttacgcgtccaatcaaaagtttacgcgtccaatcaaaaatttatgtgtccaatcaattattataaattatttaattatttaaaatattggcattaaatgcttaaatgtcaaaatgaagactttgattaatacagcgaaaagatgattagacagggtattgaatacgtatttcttcgagaatttgctgaaaaattttttcgttattgttagatctccgaaacatattgaagtcatttgttggccaaattgttaataaaaaatcacaaaaaattttgatatcagaggttatcgaaaccaaaataagcacgcacaaattagtctctctattattaaattttataacaattgattgaatgcgtatatacctatcgatactttggtaataagtgatcaatgacggattacgtttttaatatttaaattattatttatttttgcaatggttggtaccttatgtcaaaaggatgttcgaattaggaaaattttgattggacacataaatttttgattggacgcgtaaacttttgattggacgcgtaaactgtgattggacgcgtaaaagtcgattggacgcgcaaactgtgattggacgcgtaaaagtcgattggacgcgtaaacttttgattggacgcgcaaactgtgattggacgcgtaaaagtcgattggacgcgtaaaatgcagtagagccattcttttatctggggccttatgctcgtctcgcggtttagagctaaaccacggttaacgcaagttaaccgtggtttatttccaaccggtatgctcatctaaccgtggtttaatctttcttaaggaatcttaaccacaactcgagttgtggttaacgtaaatttatttaataatttaaatagtaaaataaataaataaattttttctagggtaattttacatgcagaaaaagaatctgacttttatttttgtttatgatacaaattattgacggattagtgttattttgtcacaaaaatatacccacgtataaaccgataaaatagctttttataaaaggcgacaaaattgctgctgtttatgccatgttgcataacaacgtaattgtttgtaatgcactattaccaataaattttggctcaattacagttcacgcggccataaataaaataatttgacaattttaatgcagaaaaattttcttgaagcatccaaattaaacattctttgtacattctatagccccaagagtcctctattattctgcaaaattttaaaaagttttgctttgtttaaaaaaagttatggccaaaaattttaaaaaaacaattttggatttaatttgttttcggcgtttttttttaataaatctaggccaatattcataatattaatagaatttaattattataataatttatttaaattttttgaatattaattatttttaaaattcaaaatgaattcccttaaccacggttgagttaaccatggtttacttaacggtggttaaagacgagcataccggttaaggtcggtcgttaaccacggttaacgaaaccgtggttaatgcgttaaccgtggtttactaaaccgcgagacgagcataaggcccctgattttaagaaaaaatttagaattttattccaaaaagggag

SEQ ID NO: 16700 - DNA, 3076 bp, Heterodera glycines
tcgttaaaagtgttaaagatttgccccaacgaggcggacatttgcattccgtcccgccccaattaactcaatttaacaatgcatcaacacatttttgccattttcttctttgtgcttcgcattctgtttggcagtgattgacttcaacgtaaaaacaatgccaaatcttcccgagggaagtcattcattaaatttacaaaaactcaaagtacacaaattcaaaattttgggcacgaaaaagttgtaattaacagaaaatgatcccctggaggctaattatattgcccggtgaccttttcttcccatcgtaaataagtagtaaaagccctcaaccaattattgtttggtgttttcgtagagcccataatttgccacgcattttcactcaggttaccgttaatttactttctttcacattcctttctaaatatctcaaggttggtccaccgataacatatttttcatctccaatttcttaattgactaaatccatgctgccgtccaacaataccactttggccattttgctgttaattgtgcaagtatggtttttatctttattttctgatttattataatttcccagtgtgccatgcttttccaccagtccatggttagcggtgttccccatcgttcaaaaacaactgaaaatgaactcactcttggatcatacccaatggccaaacggccatactttcgtgagcctcttcgattcggcaaacgtttttctggcggatcaaatggcggcggaggatttttgatcaacccgtttctctacgaagcataccgaagcgaaaatccatttgaaaaatgaaaaacgaaggaataaaattccacaaccaaaaaccaacgacgttctagtgaaaatgctgataatgagcaattgtagaccgtttcattttgttccctttttggcacgtcgtgaaaatcccttaataaattcgtttatttggcatatttcctctccagtggtccgccatcccctggattccttcctaatggacttggaggagtgacaaattcaaattcctgtggaagttgagatgacaatgaagcagcggtggttcccatttcttgcagtcaaaacacttttgggattaccaatttcacacatcactgagtaaatattttccaccatcaccaaatgccatgtcagattagaaagtgcaactgagcatacgacccgaatcgctggaagggaaaattcgaatgggcggtcagaaacggccgctgtatattatgtcaatttggcgaacattagccgatttaagtgcattatgtccgagaaggcgcaatttgagtggctgcatttaaaagtgccagtcaagaagaaaactcgccactcaattcccaatgcaaacatttgttatgtcgaaactgaaagtgctctcctcctccgccgacttttcttcgttcctttttttggcccttctcttcggtttgatttttaaatattacaaatttcgttgtgtgacatggtgttccgtattctttttcagatttctccttctctcagcccaccattcaacaaaaatccatccaggaattgttgaacacgccgacgttcttaccaactgccgagaaacacgactacttcgtcgccccttttctacaacagcagaaacaacgttggctgtccgtccgacccttccaagaattcagaagaagtccccaaacggccgaccttggactcctgttgcaatatttggacaacaaacggaatgctccgtcgctaatggaagatgagggaaatgggagacacggcataagcgggtcccctctgggcacaatgcgattcggcaagcgaacgttcaactcgccattgggcacaatgcgattcggcaagagggaatacaacaaatctccgcttggcacaatgcgatttgggtgagaaaagtgacgacagaatgggggaagaagaaaagagagagaaaggaccaaccgcagaacgaatgcaataaccaacgatgataatgtgtatttgaacaccatttgcaacaagaaagtttcaccacgtttaatagaaaagaggcaactcacgcgtttgacgactccttccacgggcaagtcattaacgccgacctcactggccaaataaatgtgctcgtccgcagtcacacaataacgggcaggacgaagtccgtttctgtccaaaatggcaccaatgaaacggccatcgctaaaggccaaaagtgctgaaaattcgtagtgatttccattaaacaaaaaagggcgttggagaacgcacccgggccatcccaaggctccatttgcattgctgcccaccggtagaagatgcgtttttcatgactaaagtaggaatgagtgtgtccattggtcaaccaattgcccacctcatgtcctcgtctttctcccatgcctccggcaccatcgtcatcgcagcttcgggcaacgtccgattgcctgctctgacgagaaattcgagcacattgtcaaaacaccctaaacaattccatcgtgagaggccaattcattgaagtcacagccaatgaatggctcctcacccgaatcggtcatttcattttccaccacagggtataacttgttcaattcctccttgtactccctgcttcgcattgtcccctccctggccttcataaagttgatgtttcctgaaatcagtgtaaataaagctgttacaaatacaatgatatgggaagaggaatgtaaagaatatggcaattttaaaagaatttgctgaattttcctttgtgccgtgcccacctctcagtgtgttgatttcaccattgtgcgccaccattctgttcggttgggccctgctccaactggggtaagtatttgtggagaagcgggaatggaccatggccaaatgggtgacaaagtcggggttgctcaggtcggcaaagtagcgaaagagctgatgggaggtaaattggccctgaaaattacgttattagaataagataaaatgataaaaagtcaattttggtgagtctccgcagtgttttgttttcttgtccccctccgttttgtgactttgaaacgatcgtcgaagcggacattgagacgacgtagcaggacaaagcctgctgaa

SEQ ID NO: 16701 - DNA, 733 bp, Heterodera glycines
tagtcaaaaaataaataaaagaaaataattacattatcgaattctattaattatcaaaaacagtcactcggaattgcccgcacgagaaaaaattgtcttttattttttaaagagtccctccctgctttacaagatgagaaaataggcacaattttttgaaaatattaaattttatgaacgtaattaaaatgtcaattatttacatattagtggacataggctatacaacggctattgatttgtcctttgacgaagacggggaaaaaagaaggaaaggggaaaggaatgaaatgtgagcagaggtaaagcaaaaaggggagaagcggaagaaggagtttagcaaaacgtttatgaaatatgaggtaaggcgaaaagattatttatcgatatcagaattaaacgttgttacataagagcgaccacaacacaatgaatgaatgaacgattgattgataatgagaatggtgagcatttaaatgagttgggaagcgaacggcggattgattttatcatttatcaacacttatgcccttaatgagaagggggagcgattaaaacacccctcgggggttataaaatggttggtcaattggtaaatattatttatgtacggaggacacatgcacattgtgtttgaatattttggacaattcgattaaaaaaagggtgcattaattccattgctctattgttactttcttattttgttgacagaaacggaatatttaaagaa

SEQ ID NO: 16702 - DNA, 1859 bp, Heterodera glycines
  misc_feature (1057)..(1057): n is a, c, g, or t
tccgacccgccatactccgctggcactgtgacccccctcctgccttgttgaccaagcaatcgccaaaaatcgcgaagctttgtgaattcattttgacggtcaatttcatcagcaaaaggggccaattccttttgagcgagtcgaaagaccaattgacgaagctaacggaaggaatggagaaactatcagaaaaaagtccgaacacctgtcgttgttcctcgtccaaaccgaacaattggtcatcgatgggataaaaagtggagagagaggaacggacgaaggaaaggggcgaggggaaaacacttcggacgacacgggggaagaagcagcgcataataatgtaaggaaaaagcggtgatcagccaaaatgccgaaagtgggtgggattggtaagaaacaaagtttcacatattttgaggaacaaaaggaatgaaaaagcatttgttaaaatcagctgacttaacaggaaatgccattcatttaccataaaaggaagaaaatgaaatcgattagtgaaaaataatggaaaatggaaatgagcagagagagagagaggacagtgagaaagtggacgaggaatgaatgaagagataaaaacagcaaaatgatcggatggggggggagacgatcaatggacgtgggacgaacgcacgaagaaaaacggagggttaaatggctgaagaacgcactttctttccacaaaataattttttttatttttaccttcccttcttttcctcctttccctttccctctcttttccttcttttttctcttttcctccctttccattttctctaggctttgctgcttccaatgtctttcgtttctcctcttccgtctccgtccgttgtccatcgccaccgtcaaagtccatggcccgccgttccaatggcaatggcaaataaaatcgtggaggaccaatttggcgctgttcttgacaaactgagacacgtcgaagaaaaggaagccaattcgcccgatttactcggtcacttgggtcggcgccatcccctcaaaatgcctttcccccccactcaaaatgcctttccccccnccactcaaaatgcctttccttctcctccctctgaccccatttgaattgccttggcattatttcccttcaggcgccgtcctcgccgagtctgtccacgccctggcgcccgtcccgcccttcagagcatcggtcaaagatggatacgctgtgatcggtcggtttagcagcagcacaattaaacccatgtcgattaagcctatgatggggtgggagcacggcgagttatcgcagcacacacagccaaaatatcagaaggacgctcggcagagaatgcaattggcacgggcgaatgcgtacgaataaccaccggggcaatgggtctgcgcggggctcacttttaatggccttcattaacaaattagtcgctttaagtgcctcggggagctgatgcgattgtgcaagtggaggacacgcgcgtgttgcagcacaatgtgagggcgaattttccaaaaaaattagcgaattgcccaattaattacggaacagaagcgcaccctttaggaagaggaagagctgacggtggacataatgaaggagcctcgggaaggacaggacattcggtgagaaagggaagcaccgatcgggcgaatcgaagtgccacagagagaggggaagcgacgtggcggagggccaacttctgctcggacacggcacggtactaaacgcggcagaaatcggggcgatcgcactgagcggcaggaaaaaagtgggcgacggcacagaggtcgaacaattgacgaagccgacattcgcaggtgctcatctacgaaaggaaagtgcgcgtgtccgtcatttccacggg

SEQ ID NO: 16703 - DNA, 1731 bp, Heterodera glycines
ccccccccactcaaaagccttcccccccactcaaaatgcctttccccccactcaaaatgcctttccccccactcaaaatgcctttccttctcctccctctgaccccatttgaattgccttggcattatttcccttcaggcgccgtcctcgccgagtctgtccacgccctggcgcccgtcccgcccttcagagcatcggtcaaagatggatacgctgtgatcggtcggtttagcagcagcacaattaaacccatgtcgattaagcctatgatggggtgggagcacggcgagttatcgcagcacacacagccaaaatatcagaaggacgctcggcagagaatgaaattggcacgggcgaatgcgtacgaataaccaccggggcaatgggtctgcgcggggctaatggccttcattaacaaattagtcgctttaagtgcctcggggagctgatgcgattgtgcaagtggaggacacgcgcgtgttgcagcacaatgtgagggcgaattttccaaaaaaattagcgaattgcccaattaataacggaacagaggcgcaccctttaggaagaggaagagctgacggtggacataatgaaggagcctcgggaaggacaggacattcggtgagaaagggaagcaccgatcgggcgaatcgaagtgccacagagagaggggaagcgacgtggcggagggccaacttctgctcggacacggcacggtactaaacgcggcagaaatcggggcgatcgcactgagcggcaggaaaaaagtgggcgacggcacagaggtcgaacaattgacgaagccgacattcgcaggtgctcatctacgaaaggaaagtgcgcgtgtccgtcatttccacgggcgatgaactcgtcgacttttactcgtcggcggacgatcactcgcccccccggcacggagcagtgacggacaccaatcggcccgtgctgctttcgctgcttcgctccaacggattttgccccgttgactttggcattgtccacgacaagtctctctttctctctctgcttctttctctcattttgcactgtctttaaaccctttcagcctttttgcattgattgactctgttcgaaaagcgctgactcatacgaatattttggtggtcaccggcggagtgtcaatgggcgaaaaggtaacccacggcggagtggggggggggggacattttgcgccaatttgccggaaatggtagtgccatcgaatgcttacgcatcttaggatctgctgaaggaagtgctgtccgatcatctcggcctttccatccatttcggtcgcgtgttcgttaagcccggcctccccgccacttttgcctccggccatctctccgcctccccttcgtccaacccccccaaattcgtcttcgcactccccggcaatcccatctccgccttcgtcgcggcccatctttttgcgttgccccaattgcgtcggattgccgggatggactcccactgggaaaatgcccggcttcgagttaaagttggtcggacctttcatggacgaattgaccacaaataaacccatccccatcacataaattcctcagctcgcccaccccattggccctctcgactctcgacccgaatatcgccgcgctcgcctcgtccgcctttcctccgccgacggattgcctttcgccgagtgcgtcggcggaaaccaatgctcttatcgcctcgcttccgcactctccgctaacattctttgga

SEQ ID NO: 16704 - DNA, 3013 bp, Heterodera glycines
gaaaaattattttcgttatttttaaattaataaatttgcgttaaaaaggaagaaaattcaatttatataaattaatttaatttaatttcatataaaaaataattaaatgaaaattataaaataatttaatgtgataaaaataattaatttaacaaataaaaccggaaatttttatttgcaatttatatacatttgaaatgttttatattatatatataatttaacgaaatttgttcatggaatttttataaaacgatttagaattacggtaaaaaaattaatatttttactttctttttcctcaatgcataaattagttcataaatttaatcgattttgccaacctggtattccgccaaagcctggctcgcctttcacaccgaggaagccaggtgcaccaggtaaacccggtaggccaccaacacccttttctcctggggaaccaggctggccaggttgcctaattaaatccatttttaattattttaaatttcaaataatttttttaattacccgtccagcccgggcagtccaggcgttcccggaaagccagcttctccttttatgccagggaagccgggagaccccggtggcccgttgaatgcgatgccagcctcaccctttggcccggtgaggccgggcgcgccaggccaccctgcctcgcccttggagcctggcattccaggcggaccgggatttcctggaaaataaatttaaatcttaattttaattttcaaaaagaaacaaataaataatgtattattattgttaatcatagagaatggaaagtccataactttctcttaataattagctaaattaagagaaaattgacggacttttttaaatggaccaaacaaattttctaaatatctattaattttctcatgtgaaatatatggaaaatcttattaaattagtctatttctaagcaactaaaatatgtatgaattgttttccttaattagccaataagagtaaattggtggattttttaattggaccaattaaacctatggatgaattctcatttctagaattttcaaaaaaaaattacctggaaatccttgttgtccttccattcctggcggtccttcgaggccattctgtcccggaaatccatgctcgcccttttgtccttttagccctggcatgccggataagccatcattgccttaattggtttaaaaaaattaattgtttttttattgaaaattccagaaaatccatgcctggaaatcctggaagaccaggctctcccttggcaccgggaagccctgggagaccgtcttggccaggtcgtccaggtggtgccacaagtggcaatggtcctaaattgtttgaaattttaaaaaaaatctgctgcatcacaggccactgtctcaccaggagaccccttttccccctttagcccaggcattccatggagtccggcatcgcccttttctcccggcacgccaggctggcccgggaagccgtacccgggctcgccactttcacccggcacgccagggagaccatcttggccaggtacaccgggtaggccggtagcgccgggttcaccctgaaatataaaatttttaaaattccataatcaccaccataaatatgaccacccaaaaatagggagaagatatattgtttgatcacatacccgtcaaagtatcaatttttttttacaaaatcctttctcttactaattttttaaattagttttttgaataaaatctcttatatttggtcagaatttatatataattaatgaaattataatttaatccccaaaaaattagagatttttaaactcgttataactttaaagatcggcttaatactttttacacgagcttaaacaaaaagttttcatttagttatagagaaattataaggaaaataaataaaataaaaatcaatcaaaattattcacatatcctgggaactgtacttgaccaaaaaatcttgataccatacaatagttcttgggttgctctactaacatgaaaaaattcaagaaaatttcattattttcaaaaaaactgtgatcaaaaagaaaactttgagcatttaaaaaaagaaagaactttccagcaaactctcaaagaaataattattaaaaccaagcttaagcatccatttttaattgtatcatttacaaagtcaattcttttgtttatttataaaaaagtttatgttttacaaataatttaatgcgtgaaaatcgtttacggacacgaaaaccgctgcagtaaaaccaattacattgtcatcctaaaaatttatctttttccaattgaaaagtgtattaagtccgattcccaattgcttagcaggttttatgtcgctaatttttgaatttttcccttttatttcgaaatattgcttcatctttgataatttgtcctcatcggaatatttattttgtgcttaaaaataaaaattaaaaataatataaaaatttattacttttcaaatattttggcatcaattcctttttccattttcgaaatgtgtcttttccaatgcccaattccatcacaaatttttctgtttgccttggccatataaacttttaaattcatcaattctttcaataaattttttctttttctgctcataaaaactcttttttattatctttaatttaagtttatttaaattcatttcttttttccatttgtatatttttcggcgatttgtgcctaataattttccaattttcgcctcaattttggtgttattttcctattgaaatttccctttttgcttcaagttttcttttattgcttcaaacttttgaatcatttctcttttctgttgatcatttgattcttctttaataattttgatcattttttatattattctgatcattttgcatttgaccaattgattcgctactattttcttcaatttcatttttgttccattcgtcgcgaatatttcatcataatttggtcggattttgccggattcattttcaaaagcaaagaaaaataatctaaatattaaatgc

SEQ ID NO: 16705 - DNA, 1528 bp, Heterodera glycines
  misc_feature (1435)..(1435): n is a, c, g, or t
  misc_feature (1461)..(1461): n is a, c, g, or t
tgttttacgaaactgcaagcccattcataccctaattattttcatagataaacgattaataatttaaatttcattttttagatggataaaattttttaaatttttacatgttttcctagttgtccaggtgtaccaggaaggccaggcagtccttctttgccaggtgggccttgaagtccaggcaaaccagggaagccggcctcacccttggggccagggtatccaggagggccaggtcgcagcaccagctgagtcggttcacccctgaaagattggcattaaaaaaattttaattttgaaaaaagaatggcactttgtgccaggcagcccgggaatgccgtcaaagcccggtgcgccgggtggcccgggcggcccaattggtccaggcaatccgtcatcgccagggtcgccagctgggccagccatgccgggatggccacgatcgccttaattagcacaatttaaaatttgtagggccaaagatggtcagatatataagtaactcggttgaaaattgcatgatttctcaataccccgcccccttagggtttatagtttcaaccttggaaaatacaaaaaaaaaataataataattttttttcgagaattttataattttgcaaaaagtgtagcaaagctaatttgtgcagtgataaataaagtttcatattttcaatcgagattgagacgaaattgggatttttcggaaaaaaacaaagattttgaattttaatcctattttgaaatttttttttgtaataaacatttttctctcagctttggtttgaagttgaagccttttttaataatttaatttgttggtcttttgggcggacatccgtcttaattaccaaatatattttccataaaatatttgggagaaaaaaccagctgaaaatttatttgggggaatagcccacttttctccttatgccaagaattttcatgcaaaatttaaataattcttaaattcaatattaattgaccttgagggccgggaaagccagggaagccggcattgcccttctcgcccttagcacccggtgcgcaaattgaacatccaccgccccgatcgcccttggtgccaggaatgccaggcaaaccgggcgcaccatccctgccgtcataaccctgcaaaatttgtttcattataaaaatgaaaaaattattgaatttttacatgttcacacctttggcccttgtggcccagaaatgcctggcgggccgggcaaaccgttcaacgaatcgcccggaggtccttaattaggtaattaattgttttttcaaagtcaatgtttttaaaattaaattttgcttttgctttgcctcttagtccggccaagcctgattcgccctttcgtccaggaataccgtcaattccaggctgtccatctctgccttgaaggcctggtatgctgatgccaggaatgcctanaagtaggggagggaagcctcgtttanaatttataaaaattttgggacttaccccttggcccaggctctcctttggagccgaccagggccgggc

SEQ ID NO: 16706 - DNA, 1210 bp, Heterodera glycines
  misc_feature (7)..(7): n is a, c, g, or t
  misc_feature (41)..(41): n is a, c, g, or t
  misc_feature (1161)..(1161): n is a, c, g, or t
agtcatnggtttttgaaaaaataaaaaacatgaaatttatntgccgtttattaatgagtcagacacttatgaattgactaatcttgccaaaggaattgtcaaaagtcctaaaaaatgctaaggccatttataatagtaaaaaaaattcactcactgcccaaatgttcactgtcaaaacatccgggagcctcccttagtgccgtttcttaaaaaatcggggttcccaaagatcgggataaaaaatcatcacaaaaactatagggctgtgcctataaaatccatgccagtaaattttgggaccaattggaattgtttagcatttgtctaactaagtttcatttttgtttatttccttaatttacttccgcatttctttttccaagaattaaatttttagaataatttgggtttacataatactttttttttaaattgataagtaaagaatttataatgaataaaatattatttccgtttatcaaaaatttgaatgaatttaaaattttaatttcgttaatctcttgccttttggtgaatcaaatttaagattaacgaatgatggttccaattccatttgttcgtcgtgatacactaattcatttccaccatcaaatggttgtccttaaaattatcagcatttgaatagatgctaggacttaactcaaaaaccattaaagataaattgtttaaaacaaatcgcattaattttaaaataaaatgcataatttggaaatttaaatttgtttgttgattaacttccaatgtatgctttttattctaatctataaaattttatgtaatttgttaccgttttttgagttgaatgtgtcaagatttggaagatctattaatccatcgatcccatcaaaagtagtctcaatctcaacttcttcatattgtccatcaccatttacaacacattcacacccattaaagacgcaaatccaactaatgatagttataaaaaatgcaaaaaaagaataaagccggtgatgatgatgagccaaaggtggaagtggtggagccattgataactgcttcctcgctgctggtgtctttgtcgctgtcaatttgatcagtttcggcacgctcaatgcttggttgctcgaaactgtaaccaccgtaatggcctcctgtattttgtaatgaaatttgaattanataatgacataccatgcacaaccatttcactggccagcagaagttgtcc

SEQ ID NO: 16707 - DNA, 1278 bp, Heterodera glycines
  misc_feature (1173)..(1173): n is a, c, g, or t
aaatagaaaattaaacctctatctttttgaagtaaattaaggccattcccgctcaaaatggtgcatattcttccatgtcacttcaacttcgaagttataaattgctaattttaaattaatttaattaattttcgcccattttccttcaaaaagtttcgtcgtcctttcaatcaccgcactgattttggcatcgatgcccgaattccaagtgccggacttgtccaatcagaacgcacaagggtaataacaaacagaagaatgccaaacaaaataaaaatatgcgctaatttaatggagaaaacaatttaaaattaaaattcgaaattaattatcaaaatttaaaattccttttccaattttttttgaagcagtcccggcaccatttatccgacttatgcaaaagcgacggggcacaccatttcgacgacaacagtaaaaaatggaaaaacaatggaaacaaaaatttgattgattaattaaaaaataatcgatcaaaaattgcaaatattttttggctaattgaggtgatcaaagacggggaggagcaccgcgtggaaatggttgagcacccggtgttcaattacgtggagaacatttgcggtggcacaaacgctaattaccataattaattaattattaccctttgtttaattaattgctcattccctttttcattcagtgatttatttcactttggaatatttgctgcgcttttgggtggcgccacaaaaagtaaaaaaagaaattggaaaaacaaaagcaattttatgcaataattaattaattaggcaattaaaattctcattcaactaatcactactttaattgtttccaaatttaggcccaatttgtgaaggaatttctgaacgtgatcgatctgttggccatttgtccgttcgtttttgagctgattctcatttttgtaagttcaaaaacacacacaaaaataataaaattgtataaattaaattgaggttggcattcggggggacaatgtgcgcaaagttcggtaaaaaaaagaaaaataaagagagttaattaattaatttaaaaataatttaaatgattaaataatttgctaaatattgatcatagtcaccaaactcaaagtctgaatcgatgtaaaaaggttcgaaatggaggggcacgattgccttttttcaggtgaaaaanggtgccggaattggagtgccaaactcacaattgaccgcactattataaaaagcactcaaaagacattttaaataatttttctagggcaatttgcggagctgatca

SEQ ID NO: 16708 - DNA, 1293 bp, Heterodera glycines
gtaggcttcagcttcggctcaggcttatgcttatttaaaatgtctttttgaagtgctttttgtagtgcgaacgattgagccagctgaagtttggccctcccaatttcggcccctttttttttagtgtgacagtgatcatatttaccaataatttaaaacagtaaattttccgacttttttaaaaatgtaattttcaataatttgaaataataaaaataaaacaatttccgatgggcctttctcaccgttcgccttttgcgcgttcttcgggtggtacgaattgcaaaattgggccgattcagtccaggtttaaagcatcataaattttaaaatcaaaacataaaaagttggcaaaatgtcttttagggctcgcaaattttgccctgacattgcgcaaaagcaaaaaacagatgcaaatggtcgccattgtgcttctcacgggtaacgaaagtgctcaaaataaaagacaaaaaagtaaatattaaaattaaatttatttttaattaaataaaattaaaaatatttttcaaaatttattttcagtgatcgttttcttttcaactttggtctattttctggagaaggacgagcccaacacaacattcacttcaattcccgccgcattttggtggtcagtggtggcggcacattttaaaattgaaaattttgaaaataattttcatttttcgaattgaaaaatgaaaaataatattttttaataaattaaaagaagagatttatttttgttgctgtgccattccacaattttcctgtcctttttcaggtgtttgttctcccaaacgaaatgggtgccgcagacggcgggtgaatttttgtgccaaaaaaggacttttcttattaattgaaacaattttcagccggcaaaattgttggaggcggcgctatcacttgcggggtgctcgtattggcactgccaattgcgattttggtacagagaaattgaaaacgaagactaaaattgggggggggggggtaattttggataattaccctccaaaagagttaattgcttgtactattaatgatgatgtgggcacaggtgaacaacttcatgcaagtggtccgtttgcgggaggaaaaggtgctcaagcagtacgcgtcaattgccaccgccggctgtcaacaacagcaacacaacgccacagggggaggggacagagtgtagtggaggcagagaagcgagaaaggacgaaggacaaagggggagagagagggggagagagagagagggggagagagagagagagggggagagagagagggtgagagaga

SEQ ID NO: 16709 - DNA, 1738 bp, Heterodera glycines
tcatttctcagtgatcataacaacagcaacaattcttctcagtcacaaattgaaatcactcgtcgcattttcaaatcgttggctgtgatcatggcagtgatcttttgcttttggttctcagccaacgagatcaaagataaacgaaaaacgccaaatctgtcgtaatataagtcgtttgtccctgtcatatcattgttgatttgaattattttggcgttttgttttagtttttgtgaccctttattttattttgttttgtttggagtatgtgtgatatatgtgctcttcctaaatttgtaattgattgctgtgtgctgttttattaattggaagtaaaagaaagcagtgaaaagagacggcgatttggttttggatttgggatacaattcccctttcccattggactattctttttcctacgacgtggcgctcctgtacaaaaggtggctcagcagtggcaataaacgacaaatttggacgagcaacaacgattttaaaaggaaaagtaaatccttctgcaatttgtaacaggaaaagcaaatcctggtctctggaaaagggaaacaaatccctactgaatttcttcattggttgtggaccacaaaatcagtaaaacgggaaaactaaatccctcttcatatcaaaaaaaaaaaaaacgcagcttcgaaaaggaaaagccgtaaagtgtgaaacaaatcacgaaaatttgtcagttcggtaaattaactccgtctacaaaactgacttcaaaaccgggaaacgaaaatcccatttcaacatgcaatttcttcgtcaacacaaaatttcgcccgaggaaaattggaaagacaatcgcaactttttggtttcattacaaaatggtggatgcgaaagtgagaaagaacaaaaacaaatttgttctttggaatttctcctcactctggaaaaacttcccgaactaaatggaaatgaaggacgagagcaaatacggacatttttcaaaaaattttcgttagctaccgaagaatggccagaaaaacgccgaatttcagcactcgagtgcaaagtaagtggaaaggcggaacgtgctttcagcgccgctgcagtgaatcggccggcgaaatttgatgcaatacgaagcgaaatggagtcacttttggacgaatgggattgtaccgcaattcaagcattcaacgaattgtgggatggaccaaaacggcgaccaggcgaaaatctggaagaatttgcagaacgtgtttaccaacttgtgctttgtgcatatccaggtttgccattggatttgtacaacgattatgcggcaaaacacttcattcgtgctttggaaaatgccaaagtttcgattgcattggaaatggctcgtcgtccgggtttgagctacgacagcttggtcgcgttggctgtgcgtgcggaaatagcgcaaaaagccgcaaatttaattgcagaggatgaaaacgcacacatagcacgcagctttaaaccaaataaggcggaaaagacgaccaccgattgggaaaaattttacgtccgaccgacaaataaaaacgtctgttataactgccgtaaaattggccacatcgcgcgaaattgtaaggtcgaattcacttggaaaaaatgcggctttgaacaaaataacagcaatatgaattttcaaaaagagaaccaaagaattaggaccgacaatttaacgagagcaaaaattatcccaaaagtctccgcccctaaacgagcaaaggatggc

SEQ ID NO: 16710 - DNA, 800 bp, Heterodera glycines
ccgccgccgcttcacccccgctgattgtgagtgggtgtctgatgtgttcgagagtctcgttctcgaaacactggaaattttaaagcttgaatagaagtaatttttgttttgacaataagttatactccccctcccccactgtctccctctggctttatctctctctctctctccttctccctgcttccttgctttcgcttcctcacacttcctttatcactctttctctccccagtctcataactctccctcttcctttccctccctcatttgctttatctcacttttctcttcatctctttcttgtattctctccccccccccccttccacccctctctctctcttttgttccaccaacacttttactcatctttccccgcatttctgctgctactgctgatgttgtttttctttcctttcgccccgctttgttattggcggccaattgaagaaaattgaattttgcaattgggcggccaccgcccggggggggggaggcggggcggaggaaatgacccggcaaaagggcgacgaccgccggcgaagcggaaaaagcgcgacggaagaaagaaaatgtgtgtactccgtgcgctttaaggtacgtctaaacgcgtaacgcacacacacttccacacacaaaaaaacagcagacgaagggcggggggcgggagacggacggagcaaaaggaggaacaaaaatagggagtggagggggggggggaatggggcaaaagttacaccgcaaagggatgacgggggggggggggggggggttaggaaccaataaaacacgtacat

SEQ ID NO: 16711 - DNA, 2254 bp, Heterodera glycines
  misc_feature (22)..(22): n is a, c, g, or t
  misc_feature (112)..(112): n is a, c, g, or t
  misc_feature (2234)..(2234): n is a, c, g, or t
tagggtcaaaaaattttttaanaattcaataattttataggtttactgatgggggagaaatgcgaagggcagagacaaataaaaattttgttaaaatccattcttgtccacncctcgttctgaaaattcatgggttttcatagcccccgcttggtgtaaaatgccgaattctggaattacacatattcctttgaggttggacagatctcctgtggctggggttcaacaaatttttaggcaggaatttaaaaaaaaatttattccaaatttttgttgggacggggagttttgcccgaagcattttcccattcatttgggcaatttcaccataaaagtaattaattaattaatgatccatcacattttctctgctccttttttgctgcattttttgaatgtgtgcaacaattgacttatgggggcaaagattttgtgttgtaacaaatgaaagtgaggggaaaaaagaagaatgtctgctgactgctgctgctgctggtgattgacggatgaatgcattaattaatgattgaatgagtagggctgggaattatcggtaggggtcaactccgtctggccaactccgtctcagcaatgttcaaaaagctataacttttttctttgttggccaaacttcacaatcatggtatcattcgaaagccctagatgtttagaagatatttataagctatttctcagtgattaatcagctctcaaaaaagttgtcagttgaaaaccgcaaaaaaggcagaattttcgaagttttttatttctatctttttttatagttcgaaattttctgtaatttttagtaggctaatagagcctgtgaagagctttcgaatgatatcaagattgtttgattcggtcaataacttcaagagttatattgactcaaagttggctcagacggagttggcccgttccttggaattatatggaagaaattctaaaaatgtttattggtgaaattttattaactctaggaagaggagctaagttcgataaacttttaaaatttaagcctagaaaataggcatatttaaaatatattttttaaattggattcttattcgtcacactttttcagaatatgtataagcattagagtacaaaaatattacaaaaaaaaaaaaaatattgccgtttctgcaatttgttatctaacggcaaatcttaattggcattaaaacggccacaaaaaggaaaggaaagaaacaaatttaaaaaggttatcttccgctattgccgaagaagcccttccacacgtaaattactcgcgaaatttgccaataaaatcgaccgagcaccgttttttggggtgaatttatttaccgtatttcctaaaatacaacccccccctaaattaaccccctgaaacaaagccccctcccttgagggaaaaataaagccctggggggtactattttaggaaatacggtatttactgttgtggcactcattcattttaaaatggcatcattggggacgacgacaacggaacaaattgcaaaaagacagcccgaaactgtcgcattgcgtgccgcattcgctgaagtgagtttcttttgttctttgacagaaccaacagctcattgtcaaaacagtaggagagtttaatgagaattcggtcggaatttaaaaaaaagaagaaatattgcgattattaatgccgtgaaaatggcatttttagtctcattggtcccctactgggatatgtgccgacgcactcaaaaaattacgccaatcggagaccaattccgatgggctgaagaaatgttggaaaccgtaatcacgagcccaaaaatgtcggaaaacggcattcagcattcagaaaacggcattttcgacaaaccctggaccctaaactcagcttttttttgtcccgtgcttttgggaatagtcaaattttgtaaaaacgtaaactcccgccgcgttacagctccgccaccatgtgcccgcgcatccgtcggaccgaaaaatgagcaaattggaaatactcagaggtcgtccaaaaacggcgggaggggacaattttcaaaaaaaaacatatgcaaaatcaaatttttgtttttttaaaaattttcttttgtctcattgtcagccgcgatacggtacatcagcattctggagtattgtctgggcatgcgacagacgccaattggtgtcaaattgcacaaagaatagagagagaagaaaaagtgatggaagtgattgcaaaaagataaaaacttggnatttagagaattccatgaac

SEQ ID NO: 16712 - DNA, 1260 bp, Heterodera glycines
tttctgatcacgacttcgccaaatggctggcactgttcacgtttggtgactgtgccgttgtcgccgccacagctgccgccgccgcttgttccttttccgtctgccgtgcggcatttgccgtgcctgctccatggcccagcggcgtctgagcatgtcgtactgttggaaggtgaacagcaccttgtccagctcaatctcggtggaaaacaggcgccgttcagcgcgccgaaagcgctccaacgcccggcggtccgcctcggtcatgtaggactgctccacgtcggccatctttggggttttgattttggcaaacgaatgatgggacacaaattcgtgttggaaatgatgtacagtaaggcaatccctcatcaaacgtcattataccgtagactaattacggtctaattgataaacaatagcaccatatcccattgttgttgaacaacagctcgctctaataacgggtcagagacaatcgtaggggacaaattcgtgttggaaaaatgttaatacagtaatgcgatcagcccaccaaaacatcactaccgtatacaagggaggtcttggcgtgggtgggtacgaacaaggaaaatcgaaaatctcagcaaaaatacaaaattttccataaaaatttcgggtgtagcatcgatagaccatcaaaaacaacaagttacaactaaccatagcagagtctaaaaaccccccaaaaaacggcacgaatttgagcaattactagtaattagttcactttgcccagcgcccaacactgaatggcatttcattttggtctttgtttctacctgctgagtgcgcgactcgtcatcaaaggtcgggtcgttggcgatgttgctgaggatcacctccattttcagttggcgatccaacaaagcccttaaagcccaaatcaaattttcggcattttcaacaattctttgtgccgtcgccttcgcaattcccccaaaaacgcactcgtgcttttccctctccaacatgcgtcgtctgatcacgttgttcaacgcctgggtgcagaagctgatcatcgcgttcagcacctgcaccatggacacggtgtagaggaaaaatgtgcgggcgggcgcgaaatcgttggtgcgcgcgagttgctgtaaaaaagtgaacaaaatgccaacattgtggaaagcaaatttgaaaaattggggcgacaattatgattattattggaaaaaagcggacaaaatgcaaacattggaaagctcttgaaaagatgggcacaatttgaag

SEQ ID NO: 16713 - DNA, 3189 bp, Heterodera glycines
  misc_feature (3157)..(3157): n is a, c, g, or t
tttaagctgatcgtcttttgcaaacgcaaaatgagcagactaaactttgtgccaaaattgatgcggttgaaacgaactcatacgaactctttggcaaaagtgaatgtgaaaatccttataaatttttgataatttattatacaatattataaaacaaaaagacacattttattaattgggatacatatgtttcagtttgcactgatcattttgaaccgattttggcacggattggccaattggagaaatgtcgacagaagcaaaatgcacattttgatcaactgaacacctcccaaaaggatcagtgtgaaaaatgggccaaaatggagaacgaaattggtgtgcaatgaatttgcaaataactataaataattatgcgtaataattggcctaattatatgtttaaaagtaaaaataattgctacaaaagtggtaatattttaataataattttgggtttctctcagctgaacacctttcacaactaagaaatgaccacgcgcagcagcaaaaggagttttgttccaaaattgatgaggtgatttttaacacatgcaattaaataataaattaaacagttcgcagccaaagcggatttgaacacaaacccttgtaaaaaaccaaataattgatttcaatcaatgatattacaaactcggattcgtgaatcaactcattttttacccttgaaaaaaatgcgagaatttaactgtttttttctgtttgggcactaattccgaaggattttatttaattatgtattttgttgaaaaatgggttctcgaatttttgtaggaattatttggatttttcgtcgaaacgcgggtaattcagggtgcggatctgttcttatttgtaagaactgttctgattttgggctattgtttttattttgttcttatttcttaaaattattcataaatttagaaatttatagcataaatgttcatattttacaaataaatttttaaaaattttccctgtaagggaaaatgggcaatgattactgtacctaccgtaaccacatttattaggttttaaaaaagatcaatattttttaaaataattcatttattttttagatggtgaggaacggctctcacaattacaaaatgaccataagaaacttccaaaaaatcagtgaattggaaaatcagcaaaaagaacgttcaaaaggcgaggagaaattaaaacctaaacctaattagtttacattaaaattgattgatttttaagccactgcggatcaattttcaaaaattgtggaaaaagtctgtgatttggagaaagaacagaaacagagaatggtaaattaagggtaattttcattaattgagtatttaggcaattttattttaaatttatataaattattattatttcaggcacttttaaatttccgacaaaattgtttggatgtcaaagtttgtcataataatctccaaatcattggcgacaaaaatctcattagtcccccgcctatataggactcttaagaaccaataattaaacttatatagcaagcaggctattctaaatatagggttttgcctaatttattgataaatggggttttactttttgtacgaattcaggtcggtggttttgaattggtcgaagtggggtaatttggtgatcatgaactatttttacgatacctaaattttaattttttttaatgggattacttccgacactaatgaccatatacagtttcgaatattgtaaatattttaactctcctctctttatttctgatcctggattaagaatagttcaaaatgaatgcactataattagcgaccccaaaaatcctccagcatagatgtggcgggcgcttcatggattccaaaaaccccatcgcaaatgtacacgcctaatttttgtcataaaaatattaaacttggaaaatttgtttttttgttacttttctttttttcaaaggcccaagatgagaatcggaagctgaaaaatgaacaaaagaaaatggaggagaaggtggacaaattggaggagcaattgaaaaaaaaatggaggcggtgggatcaatcacttgcaaaaattcaaaaataaaatttttgccacaatattttaatgctttagaataacacttttttataataaaaaaatcctttaatttcagcaaaaggcattccaaaaagaatttaagaaaatggtcatggaacgaattgtaacagttcaaacgaaggttgaagcaatggaaaaggaacatcaacagcaaaatggtaatggaacttatttgttagcaacgattactgtacctgccgtaacattattattactacggtcaactatttttaattgagtttgttttaattttagcaacttcggaccaattttcacaaatgcaaaatgatcaaaagattctattggaaaaaatcagtgaattggagaaagaacagaagcagagaaaggtgaattgggggtaaaaatatttattttataataatatcgttaattgggtcttaaacattttattttaaataattttatatgaattattttaaggcacttttaaattttcggcgaaattattgggatgccaatatttgtcatgagaatctccaaatcattggcaacaaaagtctaactgtgcatttataagggaaattattcaggcattttttatatcaatttactacatgatttcacctaaaaaggtttataaaattccgtctttgctgaacatccgattctgctgaaccaggattcattaaacattttttactatgaaatttcagtcaaaaaattggttaggtataaattttttcaatatcaaattatcataataaatataaaattaaattttgttaaaattgttattcctttattattaattttatttttcagtttgttcaactttggattcgcaatcaaacaacagacaaaattggatggactaatttatgatcacaaaggcacttacttatgcatataaatcagggatgggccaaattgaaaaataaaaagcgaaatgcgaaaagcgaaatttgcgaaactgaaaaatgcgaaatgaaaaaaaaagcgaaatgcgaaaagccaaaatatgcgaaaatgcgaaaagcgaaattttttctacaactttttaatagttaaaatcataaagcaaaaatcattttttaaaatattgttccanaatttaaaaatcaataaaacgcttttttgagg

SEQ ID NO: 16714 - DNA, 1216 bp, Heterodera glycines
tagactttgtgctttcgaatgataccaaaaagataggatttgttcgaacatgaacaaagttattgtataaaaacccgggattgtcaatcgattggactcataaaagtcaaattggactcataaaagtcgattggactcataaaagtcgattggactcataaagtgcattagagccctaaattttactttcattgtcagtccgtgatttgcctttcggcggagtcggcaacagcggaatgggcagttaccatgggaagcatggcttcatgcagctgagtcacgctaaggcagtgctgaagagatccgactaaatgatcagtggattaaagtggcggtagaaaagctgatttgacaaattattagataaacggattacgtaattgaggggttatatgcccaataaatttgttacttattttattattttcatcttcgcattggttagcatcgattgacacattttaatttgaataaagcttggtttggattagctcattgtgattgtatgagaccattgaccggcggcggctctttgttttgttaatccgaattcccccgccccaaaagtgaataatacgtttaaataagcatttgaaagggcgaatttacaaactgctcgttagagaaaagtccattcacagaccaatcaaatcatggggaagtcgtgctattgcggacactgaattggcactgctttttagcgttaaataaacttcactttctttttaagatgcggcgttcgtccattgctttcctccgatttatctcaataattttccaaattatcattttccatttaccgttccatcagtacaaaatttggtgtcacagccaaggcaagtaaaacacaatattttgatgaagagaaatgctctttcagtttcccaagcaatgcaacagaaagtaaatgttggagagatggaaataaacccggaaaagttggacattgttctgcacagtgccgcgctattcgcacttttgaaggtgcgcaaaagcggcgaactttggccaaattctttttttgattttccattttaattgttctctatttccttttctgaatcctttctttgctttgctttgcccaggcgaaggccaattcgctgctccgttcttcgcccgtttttccctctgccgacgcggtgctttacgcgcgttgtgccgcggacgcggtcacttttggcaccaattggccaaaatgtgtcgtgccactgat

SEQ ID NO: 16715 - DNA, 1130 bp, Heterodera glycines
acgggggagggacaaaagcacatccgacggatggaaaaggcccaaatcggagggacaaaaatggacaaaacgccaaaaaagcaaaaaacagagtgccaaaaaggcaaaaaagacaatgaccatcaaagggatggaagcgaattcggtggagcagctgaaaagcataatacggaagagaacagcggacggacaaagggagcggaggaggggacgaagtgccaaaacagcactgatggaaaacattgccaagctgcgcaggatccaacacttcttcgagatggtcgaacactgcaaccgccacttgggccgaatgggcgaggccaactcagagtgagtccgacgccgatcaaatcgatctacagatgctttcactttcccctgctgttcagttttatctcccaattgcctgctaatggtgccggtgatccatcggctgatctctcagtccaatcagttcgctttttgtcccatccctcccaattggactctctggcggatgaattgcagcgcatcctccacaatttcaccttccaatctttgcccatcctttctccacgtattctctcacttctccccgaggccaaaacggcggacgacggaccaaaactgttgtcgccgacgctgttcagctttcacaacgagggcattttctcattgccctctctttttggggtgggcaaagataattaggctaattgatcaatcagcaattccctatcaaatcgaatttaaagattttaataattgtcatgaatgctgagctaacacacaaatcttgtccattcagttgatctctacaaatgagtccgatttggttgagcttttggatttgatcatggatttggccggtgcctcgcgagtgttggacaaaatcgaggctcaaattgcccctcgacagtccattgttgagaaagagctttacccgaatgttttaaaactcgaaaagatggaacggaaatggcaaatggtcagcaaaacgttttcggaagaacaaaaaaggcatttgagagagtttgggtacactctgatgagggacagccaattccgaagtttatacggacgtacgaagaaaggtgaaacaaaaagggagaaccttttgggaaggaaatccgaacagatttaagggtaat

SEQ ID NO: 16716 - DNA, 4029 bp, Heterodera glycines
  misc_feature (3876)..(3876): n is a, c, g, or t
  misc_feature (3928)..(3928): n is a, c, g, or t
tctcgagtctctccggcaatttatggctgagtgttaaatggcttatgaacaattcatttcactcctaatcgattttgtattaaaataatcaattttataaattttaccaaatccaagtacatttatttttggcttaattagagtcaattaattgtttttaattgttttagtcttggcgtgtggcttcacagttcagcaacatttcacttttccaagccattcatctgcgctaccggcaaatgtttggcggagtttgatgctgaaagaaccattgaatgaccatcgcggatgtacagtgtttgcgtgtgccaaaaaagttggatctgtcattcaaaaaatataaagatagatttaaaaatatttaaaaaatgtttaaataaaagcataaatctgtcctaccaacccgaaatttgttgactatattccatgttgtgcagcaaagaatcgagtaaactctggtgctgacgatggcatgtcaagtttgggccagttggtgtgtaaaggcattctttggtctgtccgatcggcacaatacagtcaggctcggcggcacaaagcaatgccatggaattgaattggagattttaatttgaaaagcagaacagggacacccgcagctttaaaccccgaccaatcccggcaccgactcggggtaaaattcatttttataataatggcattttcatttttttaaattagtaatttaaattatgccatttcatcagttgccgcgtctgttccattttctgcagaataacaaagccggcctcgaattgttgcggatcattccctaacaatccgtatgttttgttgggcaaaaaatttgccgccattggcaaatattggtacatccctggcaaattgtgattagttatgcttttgaacttaaaataattttaataattacccgggtgcgtcgcaatgtttttgccgtgaccagtatcttaaaaaacaatttttcaaaaaataaacaattaaaaattgtccatttaaacttactgctcattaattggactgggccaattttcccattttgaagcggcttcaaaattgttgccaaattgtcactgccaaagaaaattgacgtgtccacccaaatgacagtgtcatattccaacaaaacatcctaaaatatttgttagaaactttgcagttttcttttaaaattaccgccatgacaaaaattttccatgcgaaactttttatgtggcgcactcggccagcaaccatttgggaaaaatcgaagtttcgcaattccaaattgcacaccgaattcaactcagccatcttcaaaccaattaaaattaatcttcaattaatttttttgcataatttatgaataaaaaattaccttataaaaaaatataaaattaattaaaatttcttttacccattcgctgtttttcgtcacatttcccaaatcgtaagcaattattttttggttgcatccaaaatgctcttttatgttcgcgattagcatccgaagagatgggaaataattggcactggcggctgtcaaaaagacacattttggatgtccggggaatttgacctgaatttttacaaataaaattatttttataatttttcttaattattaaatattaaaaaatgaatgattcgttttattactaattgcatttgcaataattaatgaaaaataaaaagaaaggtttttgcacaaaacactcaaaatggaatagtaattgaaaatgaaaagaaaaaagttattagaaatgataactgttgaaatggattattaaattaaataaatattacaattaaagagaagtatttttattattttgatgaattattaaaatttaattgtgtattttacctgattgttcgctttgattgcgtatttgtccgacagtttgtaccgctccaaaagccacgcaaatgaacaatcgaactttttgccaagaattgcacacgactcattcagtttcatcgtgtaggccatcttgaatttgaacattttgacatatattggcacttaaatcgtttcttgaatgaccgtaccaaacctagtgatacggtattattgaatttactttttcaccgcagcattgattttccgtctgatgagtggcattcgacctgaacattacttaaaataaaaattaataatgtaaaattactcttcagaggggaagaagcattggccattgacggagttgaatagtacggtaaaaaatgtgaagaaattaataaataataaatacataatacacttaacaaactttatataaacttaatttatcaatgcataatttttacacaaatacaaaataatctattattaattccttattataataaaattataattatttaattgcaaataattgaaatgatttttgttaaatagaaaaaatatatattcagaaattattcatctttaaaaatttgaacaatttgcagttgatttacagcgatgaataagcaaaaaagaagaaaacattttttatgttcattattttaacaatgtgttaatgtcaagatgaaaaagccaaagaatgaaaaaaataattaaaatgtcggaagaaagaatgaaaagatgaataagcacaaaaataaattgaaaagaaatttatacaaaaataaaataagaaacatttttaaattcacctcaatttatgcataacaaatactacaacaaaataaaattttaaaacaaacgaaaaaaaaaattgcaattataaaacaaagttttaaagtttatcagttaaaatttggatttcctcgaaaattggcgagcttcaattgtggaaggttctcgcgcacgttcgttcagcccccaactgtttaacgaaatcaggtgacaggctgatcatagaataaacaattaacgcctaactgcagacaaaaagtttctcaaaaattgagttaaatttttaaataaaaaaatttatgaaagcaaatttataattttaaaatgtttacactgtgaattttcacaaatttatgtccaataaaattattatagtaaattcgaaggcaaattaaatgtctaattttaaaaataaaacgaaaaaaggaaggattttttaatgaaattataatagaaagtttcaaagtttatcagttaaaatttgaattttcctcgaaaattggcgagtttcatttgggaaaggttctcgcgcagaccggatttgaatggacaaaaataaaatccaaaaatgcattaaaaaatggacgaaaaatttcagaatatggatgaaataagcttaaaaacttcaaaatagccaaagtaaagacaaaaaattcgcaaaaaaattttgttctatttttatagttggcatatgtatttagaaaatttgcaaaagtgcaaaaatctgtcctaaaaatgcaggaaacatttttttgagaattatttttctcaattgaaaaattttaaataatttttattaaaaatagaaatgttgaagattaaatgacatttcgagtcgataaaaagtgagatcctacgaattaaaaatgccaactatgaatttttaattatgtctatttttgcatatctcacgcgaaaggacattgtgcgcctgtacaacagggctggacgtaactggattttcaattacggaatacgtcattcgtaattacgtccagccctgctttacaagtgcttccatcagttggactcgcggcgcatggggctgacaaatatgcaatgtgcggacaaacccaaacggtagataggtacaatgtttcttaataatattctttaaaattttttactcgtttaattttcaatttattaaattttataatcttgatattattcgatatccctaagtgttttttatttaatggcctgcaactgggcatcttaaacaaaatatataaattccaaatatacggaaattttanacaattatcattacgcttgcgtaaaaattaaatcctaaataatagtaaattncgaaatgttttacttttacattaccgattgatcgttatagaaaactctaaataaaagataattttcgacaaattattaacacccttccatcagccgctttt

SEQ ID NO: 16717 - DNA, 3230 bp, Heterodera glycines
  misc_feature (2875)..(2875): n is a, c, g, or t
  misc_feature (2899)..(2899): n is a, c, g, or t
  misc_feature (2965)..(2966): n is a, c, g, or t
  misc_feature (2996)..(2996): n is a, c, g, or t
  misc_feature (3019)..(3019): n is a, c, g, or t
aaaggataagagaattttaaagcggaacggattctcgggattaaataaatcctttttttagaacttatcagactcaaaaattttgacccgcatccgtccaatgtttaaaagaaatcagtatacccttgcttggaaagctaagcccattaaaaggagcacaaaattcgctaccgaagacttgacagtgcatctaaagcacaaaaaaaaatgatcaaatccaacccaaaattagttttactgtcttgcttttcgtgaatatcccacataatctaatccatttaatccgctagtcatttttaacaatgcttaggtataacaatgaattttacacatgcacatcaaatacaatggagatgaacgaattttgcgacaagcaagcaaaggtcaaataggtacatacaaacaaacaaattatacataacataggtaatattgaaatggcaaagtgccaacatcatttcggtcacgccatcacatccatccattaattaattcatcattctgcttctgtttgctgatcagtgatcacttggcccgggagaagcggcgtcgagaaaactgaaaaaacaatgatttaataatttttttcgtaccataattttctcaaatcaaatcaaaataaaccgtaattatagttagttggactcaacgtctaattggaaacaaacaaaaataataaaattgttcacccgtcatcaaatccgccgtctctgatcagaaagtgaattggattcggcggattaagcagttcatgctgcacattgtgccagttcctctcatcccattcaattggacaacggctgagccaaaaaccatttgcatattgttcaagtgtcaattgctccccagtcacttcgttgatccgatcaaatggaacaacggagtcaattacagttgaagatttcaagcgaatgcggaaagtcactggcgaagaagcattggaaaatgcctaaaaatgggccgaataaaaacatatatggaaaaagccattaaaaagggggggggggataatccacctttttcagctgttccatcgttgacgaccattgatccaccgatgatttaacatagcatttgagccacttcggcaccccgttcggaagaggcgtgtacaaccatttggccaccgcttggccatccgacgccatggcactgtcatcgggcggaaaagcgagcacaatttcgtcattaaaaacgacatagcgaagagacagacaattgctgagcattgacggggccaattgacggaaacggcgaaaagtgatggtgtccaaaagcatcagatgcatggaatcgcggaacattggccaaatttggagcaaaaagtagtccaaaatgcgatcattgcccgtgctaatgtccaaatagattccacaaatgcccaaaagacggcgaaaacggtggagaaatgcgacaacattttgatcgatgtaactgaaaagtgcagaaaatatgatggtcacacgaatcaaattccaatttcatctatttttacatgatctgaatgcatccggtgaatccgatgacttttttcggcaacggatttcgcgggattggcaatggatttccatcggaattgacaatttgcatttgcttggtgccatttcctacgattttcgagtgaattagcaattgtttgttcaatttccatttgcgcgttttgaaatgttcgtccactctgaggtcaaatcgacggctgataagtgcaattccaaggccaagttgagaaggcgcaaggaaatcgaacaccaaaagccaacaatcggcagagataaagctgaaaaattaaagattttataaaattctcaaattttttaaaataattttttacatttctttgcgagggcgtcgtcgttttttgacatggtccaaaaagaaccaaagaatgctggcacaatcaaccaacagcagaagcacggcacgccaactgaaaaataaattgggtaaatgaatgaatgaaagggaaaagcaaagcgagggaatccaaaagtgaattttagctttttttaaaaatcttttttgaggtagatgaagctctctaagccttgaaaattggttttgaatttttttttctcccaattctgctggtcaaaaattgagcaaaagaaatttggaaaatcagaaaaaagaacagaaacactctaaacgtacagaatttctgaagacatttgtagcaacaaagtgaccggaaattataaggagattgaatgagagaatggaagaaacattgggccgttttatactaaaaattctgccaactcggggccaaaatcacgaaaatgccatcaatagttcaaatttaataaaacaaaacacgaacaaatgtttgtacagaatttttgtgaatgcatgaaatttttttaatttttcaagcagatagcccctccctctgtgctaaagaggtattttcctgcaaaatttcaaagtcactcttctgacaaccacgatctgaagaagaaaatcagcattttaaagcttcgtgattttaaaaaatgataaaaagcaaattgacgatttggagacggataatgattagtagggcgtaaaattatatggatataaaatcacgaaatatggccataaaatatggacaacaaatcgcaaaatatggacataaaatggcaaaatatggacataaaatggcaaaaatatggacataaatttttcaaaattaagggtatactttctcaaaatttttaccgaaaaatcaacccgaaaagcgaaattttcgcttttttgcttatttttgacataaatttatcaattttaagaaaattttgtagcaaattcgaatttcgcccaatttccatttgcgtgtcttgaaatgttcgtccacgtaaatgtcaaagcagcggttgatcaatgcaatttcggngccaaattgggaaggcgtaagaanaatcaacaccaaaagccaacaatcggcgcagataaagctgaaaaatttgaagaatatttaaaattnntttgtgaatttacatttcttttttggtggngcgtcgtcgttttttgacatggncaaaaaataacaaaagaatgatgtcacaatcgaccaacagcagaaaagtgcagcaacaaaatgagagaaaaaatttagggagaacgattgaaaatgagggaggagggaaacggaaaaaaggggaccccttaaaagccagccaaataaataaaataattggtttctttatgattgtattgggaatttttttttttgtggggggggggggggg

SEQ ID NO: 16718 - DNA, 1187 bp, Heterodera glycines
tgacatcctagtgggaactgaaaacggtacgggagattacaaaataagtccccatttgcgcttaaaagggcgataaatgtcaattggagcgatatttttggcatgtagtgctggaatttcagaattctcgaatattgacatcttagtgggaactgaaaacggtacgggagaattacaaaataagtccccatttgcgcttaaaagggcgataaatgtcaattggagcgatatttttggcatgtagtgctggaatttcagaattctcgaatattgacatcttagtgggaactgaaaacggtacgggagaattacaaaataagtccccatttgcgcttaaaagggcgataaatgtcaattggagcgatatttttggcatgtagtgctggaatttcagaattctcgaatattgacatcttagtgggaactgaaaacggtacgggagaattacaaaataagtccccatttgcgcttaaaagggcgataaatgtcaattggagcgatatttttggcatgtagtgctggaatttcagaattctcgaatattgacatcttagtgggaactgaaaacggtacgggagaattacaaaataagtccccatttgcgcttaaaagggcgataaatgtcaattggagcgatatttttggcatgtagtgctggaatttcagaattctcgaatattgacatcttagtgggaactgaaaacggtacgggagaattacaaaataagtccccatttgcgcttaaaagggcgataaatgtcaattggagcgatatttttggcatgtagtgctggaatttcagaattctcgaatattgacatcttagtgggaactgaaaacggtacgggagaattacaaaataagtccccatttgcgcttaaaagggcgataaatgtcaattggagcgatatttttggcatgtagtgctggaatttcagaattctcgaatattgacatcttagtgggaactgaaaacggtacgggagaattacaaaataagtccccatttgcgcttaaaagggcgataaatgtcaattggagcgatatttttggcatgtagtgctggaatttcagaattctcgaatattgacatcttagtgggaactgaaaacggtacgggagaattacaaaataagtccccatttgcgcttaaaagggcgataaatgtcaattggagcgatattttt

SEQ ID NO: 16719 - DNA, 1048 bp, Heterodera glycines
  misc_feature (982)..(982): n is a, c, g, or t
tttgtgatcaccaaatgtttcacgtcaacgggggcaactttttgtgcttgcaatgctaaactaaatccgattcaacattgtgcaaaatggagattgatttgccgacctttgaccagtgcttggccttgccttgggcccccggtgttgaccaacaccgtctcactaccactccctttgaccaaataaacactgattttctgctgatttcgttgtttagcgtcgataacaacagcggagaccaattcactgacaatagaaataccaacttttgaatcgccaaatgcttttgctttgaattttgagtttatgtcgaactaaagcatcttcatttgcgatgagcaaaaaaagaagcaaaattgtatccgtaccaatccaaaagatgccttttcggggaattccgtggaaattcgaaaagatgggccgtggcccgggacgatttcgtcactcccctgccagcagaggaagcgcgagatgagctgtcgatcaggacaaatgctgcactgtttccatggctgatcagacaaccaatcgttttcgaactcaaaaagatcgcctgagggaattttaggaatgaacagaaaaatgggaaggaaaagggataaagcaaccgacaatcgaagtgacccatggcacacatttgtcaccttgctaaatgctttctttttttaaatttaaaattattcgaacaactttttttatttgctgcactttcacaacgatatcccccggggccgaatggccacccaaaagagtcactgaaacaaattcaggcaaatcggcattaattctttctgagccttcggcgagaatcctttccggtgtgattagttgtgcattcggaaataagccgatgttgccgcaatggtcataatgccaatgagtgattaccaaatgggaaatgccatcggcagaaatgcctttggcgcggagagctgaaaaggtcgtgctttagtctaaaattccaatttcttactcttttccnatttttccttttcgtaagcactcgcacaatcgaccaacattttgagcttttccctcccccatttgc

SEQ ID NO: 16720 - DNA, 1538 bp, Heterodera glycines
  misc_feature (107)..(107): n is a, c, g, or t
aatgaagcgaaaggacgacgacgttcgccggagggtcgacggttctgattattgaaatgtgttttttgtgattgtgctttatttggtaaatggcttctcctccgtcnccttttcgcccttacttttccaatttttcgtgcgatttcttccgcactttttgtcgaaattccgtcgtgtagaaagttgacccctccgcgagtcccagcggccgcccacgacgaaggcacaccgctgctgtcgtcgccccaggcgaacaccaacacgcgtcgcccttgcccaatttcaatcgctgcgggcgcgtccgtctccaattcattgcgtccggcgccgacagttcgaatgccgacttggcgcagaacggaaacagtttcggcaagacctgagggattttaaatggatgacagtcaaataaaaacaagaaaatgccaataattccacgaccgactcgcgcccacctttgtggccccagtcgagcacgtggttattggccaacacgcagcaatcgatgcgagcactggtcaaaaagggcacattgtccggatgcattcggtaattaatgcctttgcggggccaactgacaaagcaaaaaagggcaatggacgaagaacactcaaaatcaatcacttgtcttcgctggtggtcactgatgtctccaaattgatgattcggacgagcggcttccattcgtccaaaattggcaaggcatcgccccaggggtagtcgaagtcccttctgcaacggaagaacagaaattcactaagatgtccgcatatttagtcattagcaattgcaattcagtcttttgatcgttaactcatcgaacggtcgcttaattttcatccattagctttagaatgcccacttttgtggcattggccccgagtggcgttcggccaaccgcacgtaatcgttggcatcgttcacaaatccctcgtacaaatgcgactccgatgggtggggaaggatctgatcgacgcctctgccggccatcacatcgccgcagaggaaaaggcgcacgcccaactcaacgaaggccattccgttgcgcatcagccagcaaatggaaagacaaaacagaaaatcccaaggcaattaatcctttgattttccatttgtaaatccacacaaaaaaaaatcaaaaaaaacattggggcgaaatcattcgaaagatttcgaaagtgagcggcgcagtcgatcaatttgctaaatgtgcttgtgtgtgttctcgacttttctcgcctcttttctccataaataatattttgttgttgtttttcccttcgccgtccctttggccaaacgatggcggaagcatcaaagggcggaaaacatcaaaggaaaagaattgattgattcaatcaatcaattaggaatgaaaggggagctcggggcaaaggggtggacaaatggcggaagagagcgcaatgccaacagggacaaatgggcagcggagattttgaaaaattcaaatcgaattcgaatttgggtcaatgcttttcctttgtgtctgttctttttgtcccgtccacacataagca

SEQ ID NO: 16721 - DNA, 1102 bp, Heterodera glycines
  misc_feature (1087)..(1087): n is a, c, g, or t
atgaagctttgcaagaaaagtgatgttgacttctatgcgagggttaattattcacgaatattgaaatttttattgttggagttcatgagccagtttttcaaaacagcaacctggccaatttagaacccgcggaacccatcaatattgacttcaaacatattttaaaactgataaatcgcacgaatcagtgcgctgtatttttaagactgtcaaaagtactacttgcgttcctactattgcttccgtgtgagacttttcttagggaatagaatggtcagcaaccaatttcggacgctttttgcaggtttaacgtataaaagaatgcttttccagcgattgaatataatcacaagcaatttaaattattgcctatgaagctttgcaagaaaagtgatgttgacttctatgcgagggttaattattcacgaatattgaaatttttattgttggagttcatgagccagtttttcaaaacagcagcaacctgaccaatttagaacccgtggaacccatcaatattgacttcaaacatattttaaaactgataaatcgcacgaatcagtgcgctgtatttttaagactgtcaaaagtactacttgcgttcctactattgcttccgtgtgagacttttcttagggaatagaatggtcagcaaccaatttcggacgctttttgcaggtttaacgtataaagaatgcttttccagcgattgaatataatcacaagcaatttaaattattgcctatgaagctttgcaagaaaagtgatgttgacttctatgcgagggttaattattcacgaatattgaaatttttattgttggagttcatgagccagtttttcaaaacagcaacctggccaatttagaacccgcggaacccatcaatattgacttcaaacatattttaaaagtgataaatcgcacgaatcagtgcgctgtatttttaagactgtcaaaagtactacttgcgttcctactattgcttccgtgtgagacttttcttagggaatagaatggtcagcaaccaatttcggacgctttttgcaggtttaacgtataaaagaatgcttttcccagcgattgaantataatcacaagcaa

SEQ ID NO: 16722 - DNA, 1092 bp, Heterodera glycines
  misc_feature (1073)..(1073): n is a, c, g, or t
acaaacgttcatattttgtctaactgataggaggcccgtatttgtctcgtagaattgtttaaaaaatgacattctcattattaccggttcaagcaattatttccgaaagcgctctcaattggacaacaaacgttcatattttgtctaactgataggaggtccagtatttgtcttgtagaattgtttaaaaaatgacattctcattattacctgttcaagcaattatttccgaaagcgctttcaattggacaacaaacgttcatattttgcctaattgataggaggtccagtatttgtctcgtagaattgtttaaaaaatgacattctcattattacctgttcaagcatttatcatttccgaaagcgctctcaattggacaacaaacgttcatattttgtctaactgataggaggccagtatttgtctcgtagaattgtttaaaaaatgacattctcattattaccggttcaagcaattatttccgaaagcgctctcaattggacaacaaacgttcatattttgtctaactgataggaggtccagtatttgtcttgtagaattgtttaaaaaatgacattctcattattacctgttcaagcaattatttccgaaagcgctctcaattggacaacaaacgttcatattttgcctaattgataggaggtccagtatttgtctcgtagaattttttaaaaaaatgactatctctttattacctgttcaagcatttatcatttccgaaagcgctctcaattggacaacaaacgttcatattttgtctaattgataggaggtccagtatttgtctcgtagaatttttttaaaaaatgactatctctttattacctgttcaagcaattatcatttccgaaagcgctctcaattggacaacaaacgttcatattttgtctaactgataggaggccagtatttgtctcgtagaattgtttaaaaaatgacattctcattattaccggttcaagcaattatttccgaaagcgctctcaattggacaacaaacgttcatattttgtctaactgataggaggccagtatttgtctcgtagaattngtttaaaaatgacattctc

SEQ ID NO: 16723 - DNA, 2671 bp, Heterodera glycines
ttattacctggttcaagcaattatcatttccgaaagcgctctcaattggacaacaaacgttcatattttgtctaactgataggaggccagtatttgtctcgtagaattgtttaaaaaatgacattctcattattaccggttcaagcaattatttccgaaagcgctctcaattggacaacaaacgttcatattttgtctaactgataggaggccagtatttgtctcgtagaattgtttaaaaaatgacattctcattattaccggttcaagcaattatttccgaaagcgctctcaattggacaacaaacgttcatattttgtctaactgataggaggtccagtatttgtctcgtagaattgtttaaaaaatgacattctcattattacctgttcaagcaattatcatttccgaaagcgctctcaattggacaacaaacgttcatattttgtctaactgataggaggtccagtatttgtctcgtagaattgtttaaaaaatgatttcctcatttcttttgggataataataatacataaagttctttttttcatttttcgtctttaaacattcgtaattatggagatagattctgcacttctaattccagctaattataaatacacattaaatgggggagggtctgaaaataatttagcattttaagttttgacgaatgtatgaggatttttataaaatcttccagaaccgaacaaaaaactattaaaattttgcaaatagagagaggtcctatgctaaggaatttgtgaattttcagacaatttgaagaccgagtccataagtctcgaattggaccctgtcccgactcggcctacccccatacatgtgaacctaattaggagctatcaataataacactgtaaagaggcaccgatttttcaattttagcctcccatttccattatacatttatataaataatgtccgcctttctgcgctatttgcctatgtttcgccatcgtttgcttttcctcggcggtgcttttgcttcggtcggtgtttgttccacggccgctgttttggtaattataaattttttcttcgattttttgccataattttgttgacaaatagtgccatcaaaatcaaaacgatggtggctctctgctgaatttgtcagtgtgcccaaaattactgagccggtcgctttctgatccgcgagtttttacgacgccgggaaagtcccaaggagaaaatggcggaccaatcgaacaatgaggaggaggacggaggagaaaaaatggcaaagaatggtcaattatttgtcagcaaaaagacaaatagataattaattaactaattaaatagggaaaattaattcggaaaaaaggaaaattaatgaaataattttaacaaatgttcttcgcattgctgatcagttcaagaagcaaatggaggagcatgaattttgtgtattctttcacaataattttaggctgtgaaaagcggaagaatttccgacaaaaaatcattggaaaatctttgcggggagggggcggccggactatctcagagttttgccaagggatgtaattctggggaagggagcaaaaaaagaaaaaattgccacccaaaatccaaatttggcaacaatttttaggccaaggaaaaacaacgaatgaatgcacgagagattggaaaacaacagaaaatgtacaaagaaaggtgaaaaatttaaaattatttatgaaataatttaaacgattcgaaataataattttataaataattgaattaataattagaaagcaaagttaaaaagaatttttcctttttcaaaatatttgaggtgtattcagttgactttaatttcatttttttcagtctgtcaaagttcgcatttgagccaatttgcccaattatttgcgatggcaccgatggaaaagagaaagaaaaaaaggaaacgaaagaaacggaaaaagaggaaaaagaagaaaaaagagagaaaaagaatgaacaatcggaggagaagcagaaaaattcaaccgaaaggcaaaacgaaggacaaaaggaagagacggacagagagaaaaaagcggagaaagaaaaggcaaaaaagggaaaagagaaaaagaaaccccagaggggagggagcaattaaagcaacaaaaaacaatcaaatgacggaatccattttctgggacaagcgagcgacctaagaatttttcatgaatttgaatcagtgaagagagggaatcccattcactcgctttaccgattgaaatattacatttattcttaacacctatatataagcatgcttatgttgatgtgaagtaagaagtgtttttttgacaaatgccaatggttcaggacgtggaaaagcaaagaattgccaaaattttttggacactttgatggaggcactggcgggaatggaaaatggcaaaaattcaatcaaattgccgaagaaagtaataaaaaatatatattgcatgattaatgttgatacattaattgttcaattatttcattttaggtgcctacatttactgaactgctgatgaatggcgttcgaagattttggaaatttttgtgttttttgttcatgaaactttgtccgaaatttttgtatttatatttttttgtgcctatattttctttttttaacatcctgtgaaaggattgaataaacgttttatgcattttatt

SEQ ID NO: 16724 - DNA, 2037 bp, Heterodera glycines
  misc_feature (1986)..(1986): n is a, c, g, or t
atatttatgattttgtggcatttcttaatttttatatttttcattgcttttgaaattgaatccggcataatccgaccaaattttgatgagatattcggcaacgaatgggacaaaaatcaaaatgaagggaaagtgatcagaattgagcaaaatgaacgaaacgagaacttacaatcagcagcagttgatcaaattggtgaagaaatggggacagacccaattgatcaaatgagtgaatattccaatcaaaatgttatgaagaaaagtgatcaaaatacgaaaatgaaaccaaatgatcaacagaaaagagaaacaattcaaagatatgaagcaattaaagaaaagttgaagcaaaaaggaaaattacaaaacaaagacagagtaaaaattgaaaggaaaattggaaaattattaggcgcaagtcgcgacaaaatatataaatggaaaaaaagaaatgaatttaaataaaaaacaaattaaaatattgaaaagaagttttatgaacagaaaaagaaagaattcaatgaacgatttgatgaatttaaaagtttatatggccaaggcaaacagaaagcatttgtgaaggaattgggcattgataaaaagacatttataaattggaaaaaggaattgctgccaaattatcataaaactaagagattttttaaaaaataaaggaatattttgaaattaaagaagcaaatccaaaaattagtgatgtaataattggaagccaaactcttagaaaatggaaaatgaattttaatatttgatttactctaaccgaattgttttcattccaatttttcattctgtgctgtttattttattctttaaaatcttatatttaaaatcttttaattaaaattctgaatttctaaacatttgattcttgagtgcactaattcttgtaaatgaataattaaatttattaaactaaagtttttcatttaaatctttgaaactgggacaaatgcaatgcgttttctgtgaaaaatattttttcaaaaattgcgaataaccaaatttggtaaatttttgaagtttttgagtaaagctatggaaaccagcgccaaaaattctcttttaatacttaaatatctcatatgcttataacctcaaaaaatggttcttgatctcatttcttgggattttttttttttttttttgctataactcaggaaggaaaggattaaaacaaaatctctatttttgaatacaatggaatcaattttaacattgagaaaattggaacagattacgcgcaatgcgcacgcctttgtggtccaagggacggacaatggtgccatttacgagtgcgcgagtcaaaccaacgcgaacatgtcgccgctgatcagtcgggtgacactgcgcgttgactgtaagcgtaattaatttttcctatttgtataatcatttttcaatcccatttaatttggccattttatatgctttaaaaatattaccattttttaatcaaaaattgtcaaaaaatttagaaaatgccaattaaagtcccaaaaatggcacccataaaattgggacattttggatataaaccataatattttaatgatctgggccctggtctttctttcattttttaccgtgattttccccgcattaatccccggctttgcgcctctgttacctaattgtccaattcccctcaaatagaccctccggcaagtgtgttcattttcggcaataccgtaatgcgcaagggcgaggcgatgaccatgtcatgcgtgtcggggtgagtaattaggagaatttaattgaataattcaaacatttcacagtgtttcttcgcccgcttcggtggtcacttggcaattgaacggttcgccaacaaaaattcaaccgcaggagcaaaaaaagcaattgcaggtgtctgacatttacaaatatttgtggatataattaggtggaattaattcctccttcattaccattaattacttttttcatcggttaaatggtaanagggatttgtcaccgagtccaacctaaccatcgattcgagcacgctgctgc

SEQ ID NO: 16725 - DNA, 2127 bp, Heterodera glycines
ttatttaattttaatgaacaatttaacttaattgcaaattttaatcatttcttcagctaaaattacctcctttaattaatcacaaattatcttactcttcgacaaaattaaattcaataaaattgaatagatgagatgtttttaattcgtcatttaacaaagcttctcattcattagcattattatgctgcataaaacgccgtgtccatttaagcgccgccctcccatccgttcatttttgatgccgaaccgaataccgtaccgctggagggcacactgtacaatttgacatgcgaagcaaaggacggacacccttttgccacactcagctggttcagaggggtggaaaaggtcattaactatttgattattaatcaattaaatccaattaaataaattaaattaacaaattctgttgaagaatgttggaaagcaacaaaatatgttgcatcacaagaaaaagattcgctggaaacaggtcaaacaaacattgtcaaaagtgtaaagctgtgatttgtcttttgttgtatttgtgaaaattttaaaaattaaaacctaattttttcggcatattttaagaattttttaaattaatttttgcttcaaaatataattttatttattttattttaatgattgtaatgttttttgttttctgtcggtggtttaaaagaattttgaaggattttggccgagttttttttttagtggcttttcttaaattgaattttactgttaatttttacatttaaatttattttgtgtatttaaattgatgccagaatatcactttatttaagccccccttttagctgaaggaaacacaaaattcgctgcacggcgacagctcgcgaagcaccgtcacacttttgttggaccgggcgatgaaccaccagcaaatccgttgtgaggccgaggtgagtgatgaacagggattccttttttatgtaagaaaaatcgcgaaatatgtaaataaaatatgtataaaaaatgctaaattatgtatgaaatatacaggcctagaatcacattttagtactttaaaaattaatttttggtatctgtttttgaaaaaaaaattgattttttagaggtatatttctcaaaaaaaaatctaaatttcacaagaaatttctataattctcaaaatatgtaaaaaaaaaatgaaaatatatacgaaaaatcgctaaatttttgattttttggggcatttaataaaaaaatttccttaatccttaaaaactgcgaaatatgtctgagaaagtccaactatgtagaaaaatatatacatatgtaatatgtagaaaaacctcgaaatatgtaaataaaatatgacccccaaatatgtactaaaatatgtaaataaaattttaaaataattatgttttggaaaaaaaaattgctcgtaaagggtgaaataggcacaaaataccattaaaataaccttagtcttagaatcacatttttaatattttaaattaattttagtatctccttttaatatgtacaaaaatctgaatttgtgccaaaaagataaaatagagtacgtaaaagtggtttcattccgaaaatttctcgattgtttatgggttttccgttttttcttctgtcactgttaaatcaatggccaaagcaattttgtcctcttctttgttgtaaaagcctttgtccgggtccatcaaatgcttaaaattaaattcaaaatgcatttatttaaattataattaattactcaccgcaaaagaaatgaaatttgggaatccccacgtgttttccattttattgttaaaaattttgccaccgaatttcttcttgaaatcacacactccgctcttttgcgatacaattcgaagggttgccgaacatttgcgactcaaatgcaaatcttaaccaattaactaattatcatcattagggacgggacgtgaccggaaaatgcgtcagtagaaaatgcgtcagtgatgtaaatattttaatattaagttctgtagtattggtattgtaatatagaagtataattctataagaatagcgttcataatttcgaacctcgaacccgaattcgaacaagaagtcgagaatttccgaattagtgtttttcttcaaaatcggtttaatacagggaaa

SEQ ID NO: 16726 - DNA, 3157 bp, Heterodera glycines
  misc_feature (30)..(30): n is a, c, g, or t
ggtcaaacagacgcttttcccgagaacttnttggactaagtgagtcgcgtccagaaaagagagagagaaaggggagcagcggctttcggtggtttgatcggtcggtttgaaggggccttcccgccatggctttaatgctctctctacacgaactccacatcaataagctgctgccgatcagtctcattcttcacccactcacaactctctccttcctcccccccccttttctctctaactctctccccccttttctctctccttcctcctccccccccccccttttcgccctctctctgtcccttttctatctctttcttttcagtgcctttctctcatcgcttttccctcgtttcgctgtgatcctcgtgaaatgagatcaaactcaaaagcttgttgatgattgaattaatttaatttagccccatgaggcagcaaatattactttcctttccaaatttaactgcaacttaaacagcagcaaaaaaggcacttccaatgcccatttaaaagcgtcgacggaattcggactattttatggcggaagggcgacatcaatttggccactaattgtgcccctcggcgagggcattgtgccgggccaattgcctttggcctgcgactgttgcgccactcatccaaatgcttttcttcattttctctctcctctttccattgaccaaccacaaaagtgtctgtccgtttctcttttctcccattttcaccattcgatgatgagtcccttcccctcctttcttccccccccccccggtgtatctgattttgctaatatttctccgattaaaaacatttttctgctcaccattcgccaatcaaatcgcttatttaagctttttttttgctcaattcaatgattttttgagtcaatccgttgtttttttgtttgtttttcaacggaaatggccaccgtttggagcaaattcgcttctcagctcagtaagtgcctttccttctctcttctgttggcttttatttttgtttttttgccatcacttttcgcccttttcaccttttaaaggttcttggctgtcggaaatgccttcggaaaagcgaaggggtcgcgccgagacgaggccaaacggtggggacggagttgcgggggtgcgcaattcgcggtcacttagcgcactcagccgacggcacaatttggtcagaacgtcaaaaagctcggagaatttgcaccgaatcagcctattgtcgacagcgacgacaattggcaatggacaacagagacaaaaggtcgaaaaatggaaggaaaatgaacgaaaatgagaaccaatggacagcgcaaatcatcaaaagataacaatttgtgtttcagccatttttggcacaattcggactcaatgggccaaatgcccattccgaggaggggtcggtgccgtgccaaaacagccgaaagggatcggtcgaaggccaccaaagtccattaacaccggcaaggacgaagacgaggcgatttccattttttggcaaagaaaacgaaacgacggcagcgccggggggagagggcgaaagcggatattcaagcggaagttcgtcgagaaggtgtgcctagtccaaattatgctctgatttgccaataatcactattaccctcctattttctcctctgactgtttcctcaccaatccatactaattgactccccaccatccaattatcgtcctctctattaactaattgcttcaggaaaaagtccaacggtcgcttcgttccttgcgcttcgtcttcctcggcatttttcctcaatttaaacgcgcggcacaaaagcaatgagcggcaaaggcaacaaaattcaaataaaagcacaaaggaaggaaagaaagaaggtgaatgccaatttaccgcactgtttggtaaaagtttctccgttcagccgaaggtacggaaaaatcaaacgcatcgacgccatcggcagagacagcttcaaagcaggacgaattcagcagcggatcggccgaagaacagaagaagcagtaaaggagggaaaagggaaagtaccgtatccccttcccctgttacagtacccccgtatccggggaaattaccgggggggggggggggaaattagacaaatccccaccagcagcagcccttttttgccatttctttcccgcatttgtcctccatcagttggtggttggtccatcactcccatcgtcattatcggcccccctctttttcctctgtgccttacgtcgatgagaatggctgtgacgatgactttacgcagccaatttcggcacaaatagtgcccggcaatgacaacgcacgcaaacgtcggccgtccgcaccaacggaaagtgcaattgtggccaacggtgagcgggtcaattaactaattggcgattaataatttgaataaataatatttggtccgatattccttttttagttcatttgtcacttttccttttctaaccttgattttcttcatattttcctttttagcactcaaagggcgatcggccacaattttcccgggccaacattatttgatctcaccgcccaagcgaactttgggccaaaaacgcacagaatccgccttctctgctttattgtccccgagtgatgtgagtttattgtaaattgattttgaaacatttgatgctttgtcatctttcaggccccattttcttcccttttcccgacgagcatttcatggagtgtccaaaagggccaatgccaatgtccaccccctccggcgccgactggcgatggtaaattcgagaaaaataaattttgaagtggaaaaaccaaacggaacgtaaaaattcaaacaagccggccaaaaactttttccactttggtaccccatcaagtcaaatcctgagacctttcagcagaattggcacaattcgaatcgcaccaccgcaacgtcagcagcagtagaaattcaatgacgaaaaagcggtgatttgggaaaagctgacaattaattaagcaattaatgaatggtaattaagactggtaaatacattgctgaacggccgatggagaacggcggacagagagagcggcagagagagaggggaaaaggcggagaaacgaacgacgacagagagggccaaggacagcgcagggggaagctcaaaagacgtcggagccaatcaacagttccgcctctcggcaa

SEQ ID NO: 16727 - DNA, 2648 bp, Heterodera glycines
  misc_feature (36)..(37): n is a, c, g, or t
tatgcgtcgacaatgatcaggtactcttttccgaannaatggtcggcgtaaatcaatgtgcactctctgccacggtccatttgtcttggccaagattgcaaattcgttttggttggcgcctttgcctcattttggcatggttgacaattttcaacaaattgttcaatttcctggtccattttcggccagtatgcatattcacgagccaactgcttcatccttttcattccaggatgtcctttgtggagcagttgcagaattttggctcggtgttgcgttggaatcacaactctttcagcatacatcaaacaatctttggtgatgctgagttgttccttcctttggtggaaaattctgatttccacattttcgttgccaatattttgtggccagccatttctaatgaatttcatgacctttttgatgttctgatcacttttcgacgactggacaatgtcatcgaatttgatgggaagcttctcgacggttccaatgaaaatcgattctacctccgaatcgaccgaagtatttgcgatgacgcggtcttccgcatcttttcctttggcaattagccgtgaaagtgcatcagcttggccgaagtcgttggtattgacatactcaatgttaaagtcgtatgccaagagaatgagtgaccatcggagcagccgattggcactgcattgccgcactccttttttgttgccgaagatggcgagaagaggcttatgatcagttaggagcgtaaatttacgtccatagatcattttgtgaaatttctgcactgcaaaaattattgctagtgcttccttctcaatttgtgagtagttcttctcggcaggagttaaagcggaagatacatgcgcaatggctttcatcgttccgtccgggaatttgtgcgaaatcactgctccaattccctgatcagaagcatctgctgctactacgatctctttttgagggtcatagtgcgtgagcagcaatttggatgacaaaatttctttgattttgtcaaatgcctttttgcatttgtcgctccaattccattcggtgtccttttttagcaaatcatcaagcggctttctgacgaagcgcatgtttttgatgaattgttggtaatggtttaccattcccaaatatgatcgaagtgaagagacatccgtcggttctggcatctcattgatggcggtgattttgctggggtcgggtctgcgtccgtttttgtcgattatttgtccgagatatttaatttcatcttggaaaaacgaacatttttctcgtttgacgcgaaatccccattcttgaaatcgcgagaacatctttttcaaatgttcagaatgttttttttggtccttgctgacgatgatgatgtcgtctaggtaggctgtcgcgaagtcaaaatctgccaacatttggtccattatcgactggaaaatgccaggagctgttttgatgccaaagggaagtcttttgacttcataatttcctctatgggtggcaatggcacacagctttttcgatgcttcgtccagctccacttgaagatacgcatcccggagatcaatttgtgaaaagtactggcctccatttaaggtggcaaaaatgtcttccggtaatggtaacgggtgctggtggtcttttagcgcattgttgagtccggttgaatagtcgatgcacagtcgagcgttaccatcggcctttttgacgaccaaaatcggtgctgcccattctgtgtgctcaactttgccgatgactcccattttctcccaacgatccaattctccgtcaactgcatttttggcgttgtacgggaccggacgagcctttctgtatattggctgtgcgtcgggtttcaattctaaatgcgctttgacctttgtgcagagtcccaattcatttttaaagacattggtgtactcctgctttagctgactgatttgtttttcggcgtccttatttggcgtgccgtcagctttgttggatttgatcggggcatttttgcctctcgattctttccctgcgctgcaaagatttatcggagagttgattttggctttaatgccatccaacagtccaaatgcatccattgtttggacactcaacagattcatcgatcccttctcggcgacataaaaattttctttaacttttacgccttggaattcgaagtgtccttctccctttccgataaaagatttttctgtcccgtcgaacattctgcctctttcggcacattcccaaatttttggctgtccgatcagtcgataagtttcctcatcgatgacattgatctctgccccggagtcgagaataaacttcacgatccttccgttcagcaggacttttatctttataagagaagcactgttgattgatttgagtgccattccaatgctaagtgttccaactttcttcactttgaagtttttgcggcgccactcttgcactttttcgcattggttctccaaatggccggtgtagtgacatttgggacatttagccgatttgtgcgagcattctctgtgggtgtggttcgttttcccacatctccaacattgaagctgagttgtagttgcgtttggttggccttgcttggattgtggctttggtctctcccttctttgtttgggttcactggattcactgtcctt

SEQ ID NO: 16728 - DNA, 787 bp, Heterodera glycines
cttcctttttttctataatcacatttcattttttcatttcgcccacaaagggggggggggggggggagagcattctccacaatttaattatccccgaattttctttccactgaacgaggacggggaaaaggtccccgaattttttgaaaaatttttttttctcaaaaaaatccttccagagcaattcccgaatatttttaagtactttattttctctaaagatgattttttaaggtgttcattatcctttatcggtgtcaatttattttcagttgcttttccacaccgtttttcaacaaaaaaattctatttatatgtgtcaaaatgtgtaacacatataatttgtttttttatctcattccccgttcccgtgtattccccgtactgcaaaatttgctgctgtccccgaacaatgtgcgccccgccccgtttctgttcctgtccatccaattcgccgtgagcaatttggcgggtggtggtggtgctgttacaacgtcagcagccagcagaagaagaacagcggggacgacggacgccccgccaccggcgcggggacggggcggagtcagcatgactgctacttctaatgctgccggttgccccccgcccgggggggggggaaatgcgtccccgccccagtctccccctcccctcggggaggggtgtatctccgccctctccgtgccctcctcctccaacccattccttcccctcacaaatgcccctcctcttcctcctcctcatcccgtctatcccatctgctgtgctgttcctccctcgatgaccc

SEQ ID NO: 16729 - DNA, 1790 bp, Heterodera glycines
ccctccccccgccccccaattttgtggccgtcgccgttgggcccctccggcggaatttatgagtccgccaaattcaccacaaattccgggaacaaaacgttatgtcttccactcgcggatagcgatatgccttgttgctttaggcttgcttaaaaagccactgatctttgactttttacaaattttaattatttttaaaatctaatttaaatccagttttttttttaaattaatctttccactcataattttattttgtttaatacaactattttttcttgagaccggcgcagtcggattttcgacctttgttcggtttttaatacaaataaccgacaaagaattttaaaatttttttcgcgttttcggcttttatcgaaaccgatcgaccaaatttcctagtccggtctcaaaagtttaaaaatttctttttaagatagactttgaatttaattttgcttgctgttatgttttcatttatttttaatttcatttcccccaacactaatttattaattacattgtaattcacatttttttattcgtttagcagcattttcgcatttaaatcccatcaaattagtcacataaatcagctcgcctcttcaaatgccaaaacatcaatgtgtgccgccgccgccaattttttgatgcgtttttgccaccgacgactgctgcagctgttttttatcctcttcggatgctgctcatcaatggcatttggccgaaaattgccggacctccaatggcactccaacaacacaatgtgggcattttattgaaatttataaattaaaaatttccatttggcattttattgaattaaaaaaaaaattatttaaattaccgtttgctaatgagtgttgtgtgtttttggaaaattccctaatttattttccctgctgcacttttatgaaaataatcgcagtttttgacctcttttggtcatttgtgcgacgataattttttgcacattctgttatttctgatcactgatcaaatttgattcgtccagtaaagctgctaattgatcaaattagcgagcgacatcattttaacgggttcaattggattgattctcttgataatctctatttatctttttgccacggcgagtcaattttggactccaagcgcaaataagttggttttttcgtcttagtggtctgtgcgttagtcaccaaaagtgggggtctcaggttcaagtcctctttgtgtttgtgtataaaattcatttttttaaagcaaataaataaaaaaataataaaaacagaacgccaaaagaacaaatacaaacaataaaaggtaaacattttattttacccttgattttatgaattttttttagcttataacttttccaataatagaccaaataaaaccattttatgctcattttgaagggaaaattctgaagaatatttcttaattagtcaaaagtttaaaaaaattgtttattggcaaaaaaatgaaccatgtgttatcttatatgttagagacatggaaatagtgcgtcaagatgagagaaaaagaaaaaacttcacctagttgaaaaatttttccctatgttcaaattttcttcaaatttcgcataggcccatattttaaccccctttaacgattccaagtttattttgtgaaacttaagtttttaactcgagatcggctcttccatttttacaagggaaaatcccaagaaaattaaaagttttgcaaagttttggcgttctgattagtaaataaaaaataaacttatttgcactgggaggccaaaattgactcgccgtgtt

SEQ ID NO: 16730 - DNA, 1302 bp, Heterodera glycines
ctcgtcccttcttcttcaagcccgtgtccgccttcgacttctcgggcagtgaagagacgagaacattctgaccagagaaaatgaactaagtcaaaatgagcaatcaactagttacccacaactaattagccacaattacccccccccccccaaccctcgccacattcgctctttgcctcacttcggaatgcccccgggcttcgatggtcgtcgtctcgtgccccgggcagcgctcctccgctggcattgtactccgtcgccgtgtgtctcgtcgctctttcacttgtctgatcggatgacttcccttccgggcaccgccattttggtggctttcgtagctaaaaatggcaaatgcttttcccgcgctgtttcgtcctttaccttcccattgcgtcgcgaagtcgccgtgccaatgagctttgctgaatgcgtcggtgcattgagcgtttccaatgcgaatgggcggaacggatcggtcgattgagaagcgtgaaaatggcggggtaagcggcgcaactgacgtagggcatcaaatggacgaagtacatggtgatgacacctgaactggggaggggtacaaagtgaatggatccgattgaggggagaaagcagaaaatcaaaaggaatggcattagccaaatgagcgatcaattagagagacaattggccaattgcattggcattttaaagtgagcaaaacggcacccaacacacactttgctttggactcagccgcaaattgagcagtcgtcggccgaaaatgcccacccaatagggcgtccaacagaccaaataaaccaaagccaacaccaaaactgtgagcacaaccttaagaagggtgacttgacttttgagcgatcgaagggaaaggcaaaaacaaatctatcgaacccttcggatgacagcggtcgacgattgttggctgaaaaatattcgaatctttcgtattcattccgaattggatttgaaacattgtctcaagcattgccccgggcatagtttcgtgccgtttgccgccctcccattgtgtaaatggcaattaattgtacccggaagggcttttccgccccgctaattgccctctctctgtctgtctgtccgtctgtctttctttcccttttctttgcttctcttgccgctctctcaccttctcgatgtccctgtggtgctgctgctctgctgactcgccatcagatgctccttttttcgccacagaaaaaaagggacggaagagtaccaataaagaaagccggcgaagggaatggcgtaagagacaatgcatacgacgatgttgaagacgga

SEQ ID NO: 16731 - DNA, 1715 bp, Heterodera glycines
  misc_feature (34)..(34): n is a, c, g, or t
agggacagacagagaagagaatgatcagagaaanggaagtatcgggtagtgaaaaatggaaaatgagaccaaattgaattgaattggaaaaaaaagtgaccgatgcaaaaaatggactaaaaaggacaaaggaaaaggaagtgccaatgccaaaactcactttttgcgtcttattctcaattcgaatgggcatggacgaaacctaaaaaaagaaaaagggaataattttgcaattttaggaattcagatggaatcattaaatttgaatggggggaggcaattcaacggtaggattgaattttggtgacctcagaataagcgaaaagtggccaaaggaggacgagcaccaaacagagagagacagaaacatggagaaaggccatctgaggggaaaagcaaaattcgaattgtcaaatcactttttgaatgaattgtcgtcataatcctccggatgttttcttcgccctttggcattttgtgtgacctttaaactcgccgcgctttgctgccgacgtttgtctaagcaaacagtggagtaacaggtgcgagagattagcaacactgaagagggggggggggaagaacattttaagccgacaaaggattcattaaagcaattagtccgaaggtcgcaacaatttatgccccccggctatcatttaacatccgatcgatcgatctaccgataataggagcagagaatttgttcatggaatcgaacagcaaataggcagtgcatgccatcgagccgaggcgccaagtgccgcagaaaatttccaaattgagcaaaaccatcgctgaaagaaaggcaaaaagcagcaatttgatgccgaattgacacatggggagaaagaaactgaccacacattgtggccaaatcggacacgcaaagtgccaaaatgtggaaaagaatggattttgggacgcggacattgtgcagccacaggagggggccgaccacgaaaaggacccacgaattggcgaacaggccgatgaggttgcagccgaggtaagtcaaagcgacgtactgacgaaagccccgcaggggaagtgccatttcgacgagggtaaaattggcaacggaaagcgaagggccggcggaggaggagtccaagccgaacttcatcattggggtggggagcagaaacagacagacaaatctgaagcatttgggggcaatcggcgagacaaactttgtttggacagccaaccgaatttacgaaacaaaattaaataattggcaaatccgtggaaaatagggacattagcgtctctcgctaatgaatggtttacaaccaattaattaatccattttctcgaaaaagcaaagagatagagaattgtgggcgatgtctttcttcgaacagcgagcgcatttagtcaaaatgtgagaccaatggtgggaaaagcggtaatttaaggcaaccaatctcagaaaacgaagcccttccgctcttttttggcttatttatcggattttgtcaccttggcattggcattcgatgataaattgattcgcaaagtcagtcaaaggatcgtctctttctttttcctcattttgggcgttttgaaaggttttctttcgagaaaagggccaaagatatgaaaacgaaaaaacgtaacttatttcattttgggaaacaaatgaaaatgagctaatcctttcctggggattaagtgagacaagaaaaagaaacaaaggtgccaaattgaat

SEQ ID NO: 16732 - DNA, 3164 bp, Heterodera glycines
tctacaaaagcttaaaaatatcggtattaatggtaagattcataaatttatcaaaaatttcttaagtgaccgttcattcagagttaaaatctctgagcgtattcaaattcaaaaaacatttatagtgagtggggtgccacaaggtagtgtcttaggcctttgctttttcttatttttattaatgatcttccgaacaatttgcctaagaatgttggtattaagatgtttgccgatgatattaaatttacattgagcataaaaatgataaaaatagagagaatttgtcttccgcgcttgaggcaataaataaatggtcaaaaaataatggcctaaaaatatcaatagaaaaaacaatggtcctttacttgggtgaaaataacacaaaatttatttattttcttgatggcgaaccattgccagaaacaaaatgtgtaagggatttgggcattttaattgatcaaaaactatccctttctaaccatattaataaaattttaaaaaattcatatttttcttgttatcatcagcttctccgagcgttaaaaactcggaggcttgaaacattaatttcggcatataaaagctatatcagaccacagttagaataccacagaaatttggaatacattaaaaaaaaatgtccgcaaaattgaagcagttcaaaaaattttttaaaagaaaagccttcaaaaaatgtgggcttgtccccatgctatgaagaaaggttaaatctttgcggaattaagacattggaaattaggcgccaaattaatgatattacaacaacttttaaaatcctaaaaaaacatacacacctgaaaccatctaacttttttgctgttgctaaacgggctattcgcaaaccttttttattacaaaataggatatatattacaaaaacaaaaaataatttttttaatagggttattaattcatggaatttattaccaaaaattattatggaaataaatgaccccaaaaaattccgagaaattgcaaaaggaataattaagcaataatgcatatttccctattgagaggtgggatttgtttcatttatgtctatttttgtttaatttggcatttattttgtgattggcacttatttttgtgattttcgaccatcattcatgttttattttattttcattttactttgttttcgccactgttagagtgcagcaccttgtggtttgttcgttaaataaatagattattaaaaaattggatgagtttttacaacattttttcttaataattcaatttaatttatcattctttagaaatttattttcattttttaaaaaatgcttcttttatttttataaaataaaacaaactgttatttaagttttccaatttaaactaatgactaagcttaaatatttcttaatgaatttgtaattttgaattaaaatttaattgttgaattcataaaaatttataaaaaatggtatcaaaagatacgcaaccaaaaaaaaaagaaattaatttcgtgagaggggcaccggcgttgccccgataagcacctctggatgcataaattgggaatttttgcccgatttgttagcagattttgttcaagaaatgccttttttatccaaataaaattctaagtaaatttgtgactcagtgccgacaaaaagcggcattttgaacaagatttgttacgaaaataaatgtaatccctttcaatgatatacaaaaatcaaaagagcaaagaactgaaataggcatagctaaataaataattatccattggcatattatgtatcaaatttaaactgtaaaggcaatatccttcacagtgtccccatagggaaaggcatgtcggggaccagcagggcttggaagcgcccgcaaagcgcgattcgcgatacgcggcgtttttttcgagattcgcgtccgcggcaatttgaatccgcgaccgcgggatttttttgcgagacgcgccgcggtttttttaggattgaaatgctgagaaatattcgggcatttttttttgacaaaatctggtagcaaattacactccaaacattgagtgtattcgctgttgccttctgttatttacacatatatatatttattatttaagatttaaatacatttataaagtttgatttataaattttcatttaaaatcactataacttaaatttttttaaaatattttagtttatttattttcgggttattgaaaatctaagtccgcctgctcttgttaaaggtgcaaattatgacaaaaatagtataagaaatgcttttcctgccagatgtttatttgctcgattgtccaaatcagtgcagaaagtaaagtgaattgccgaaacaccggtcttttagagtccaaaattatggatattggaaaaagagcccaaatttcagattttttcgggaggcctctagctatgatccaaattagtcaaattttttgttctcaaaagaattaagccataattacacactaattggtcaggatatctcgagaatcacaagcccaccaaattaacggagttctttggggatcccgtgcccaattcttggtcttgaaaaatttcaccaactctcgaccagccgcccattattaactattgggcattcagaaatagcagatcagcaacttcaaacgaacaaacaagtgcacttgatcagcagatcaatcatttttgtctattcaaatcatttatttattaaaaaagtaacgatatttattgcaaaatatgatcagatcattgatcaaaggggcggcgcctctctctctctctctctctctatctctctctctgatcacagttccgcaattggactgctccacctcctcccgctgctgctacaacttttttgctgcttgttcatgtcgccgatgaccccatagggcggtggttccattgggaaaacggtgctgccggtgccttcgctgcgccacttttgtgccgacgaaagcaacgatgatgatggtgccgcttcgtaacatcccaaacagtcgtacatgtagcagcaggacaccaggatcagcatgccgaccagcaacagcgtgatcacaccaaaatatgtgaacgcaaacacgtacacctggagaagaacagcgaaataaattttggccaattgctacagtaattgcttgagagttacagtaccctattgcattttgcctgaaaacgccc

SEQ ID NO: 16733 - DNA, 1137 bp, Heterodera glycines
  misc_feature (80)..(80): n is a, c, g, or t
ttcaatgataacaaaatcaaagagcaagaactgaatagcctagctaaataaatattatccatggcatatatctatcaatntaaactgtaaggcaatacccttcacagtgtcccataggaaaggcatgtcgggaccagcagggctggaagcgcccgcaaagcgcgatccgcgctacgcggcgttttttccgagattcgcgaccgcggcaatttgaatccgcgaccgcgggattttttgcgcgacgcgccgcggtttttttaggattgaaatgctgagaaatattcgggcatttttttttgacaaaatctggtagcaaattacactccaaacattgagtgtattcgctgttgccttctgttatttacacatatatatatttattatttaagatttaaatacatttctaaagtttgatttataaattttaatttaaaatcactataacttaatttttttttaaatattttagtttatttattttcgggttattgaaaatctaagtccgcctgctcttattaaaggtgcaaattatgacaaaaatagtataagaaatgcttttcctgccagatgtttatttgctcgattgtccaaatcagtgccagaaagtaaagtgaattgccgaaacaccggtcttttagagtccaaaattatggatattggaaaaagagcccaaatttcagattttttcgggaggcctctagctatggtccaaattactcaaattttttgttctcaaaagaattaagccataattacacactaattggtcaggatatctcgagaatcacaagcccaccaaattaacggagttctttggggatcccgtgcccaattcttggtcttgaaaaatttcaccaactctcgaccagccgcccattattaactattgggcattcagaaatagcagatcagcaacttcaaacaagtgcacttgatcagcagatcaatcatttttgtctattcaaatcatttatttattaaaaaagtaacgatatttattgcaaaatatgatcagatcattgatcaaaggggcgccgcctctctctctctctctgatcacagttccgcaattggactgctccacctcctcccgctgctggtcaacttttttgctgcttgttcatgtcgccgatgacc

SEQ ID NO: 16734 - DNA, 1428 bp, Heterodera glycines
actcaccattcaaaagccaattcggtagacaattttaaagactaaaattttgatgctaaacatatgaccaccccaaaatacgtgtaaggtgcaatttgcctgatcgcatattcgctgaaagaaatggattttcgcaccatttgaaagcccattgaatatgctatcgatcggtataatatacttggcatttgctctctgttcaacgccaattattagcactatgtaaacatatgaccatgactgtctgatcatggtaaaacagtgaaattaatacttaaaaatcaaatttatatttaatttaaattttttcaacgacttttccaaatttaacgcacttgaagaatttcgactgttgaaggcaagaattgagcaattggagcaactgcagagaatggagtccgcttcggttgcgagttcggaagtgttcgaacaaaatggaaatggtaggaaaaatatttttattttccagaagaaagaaggggacaaagtccataatttatgaaaattttaattagaatctttaattttttcaaatttaatatataaataaaaaaaatttttccattaatatatttttaaatatcatttaaatcgacagaacaacacgggatggtttacaaaagtgatgactgttgcaatattggaaataatttaaattaaattaaatttgaaaaatacagcagaaaaattgttgggatggcaccgcttgccccagtgaattggaaatcattggtgccaaacgtttgatggtccaatacaaagggaatcgcttaatatgtgtggtaattagcaaaaattaacaatgaatttaaacatttaatttatagaaattttaataacaaaaattaaatattttaattgaaggaagtcactcaatgttcacaaaacgctgcattctgagcacaagttcgtccatttcttacgtcgaagaaatgcatcagtatgaaaatgtaaattatggacaaaaataaaaatatttttctaattattatattaatttttaagtgctcaacgattggacttgcgatcaaagaaatgccattgtacggaagggttagcaattacccaaacagttacgaacatagaagtaacggccttttttgggtcaacgattcctgccaaattcgaagtcaaaatgccaaatttggcatttaattattgcactaaaattcggctaaattcccaatttttcatcaaaaaacagccagttagtcaattgccaattctaatagaattttcattaggccctaggaatttggcaaatgcctaccgtattatctctaattatcacccaggggggggattattgttcaaccttctcaaaaaggggggggggattattagatacgggggataaatggagacgggggattatttttcgactgattttttactgaaaaatttttgaaatttttttgaacaagacgc

SEQ ID NO: 16735 - DNA, 824 bp, Heterodera glycines
aaaaaatcatctggtaggtctcgagttttaacgatgtatagacaagtacaacatatcttgtagaaataggagttagaattcgtcctgtattttttaaatttaatttagaactatccaatttttttttatcccttttttaatataaaatgtattttacgatcttttgtgcacattttcccttctcgtttatgctcaaagataagtgatggatgaggatctaccatcttaactatttccaaattatccaattacatcttttttagttctttagaagtataatgaaatcagctttccttaaaacgaaaataaatatttcagggctcgtatccgtccttggatgccaaggacgtccttggaatttgtctctcttccttcgaaataaaaaatgtccttggatgccaaggacgtccttgaaaatgtgcatttggaaaagtttaaaaacaattcaaagaaatttgataaatttttgtaattttcaacaattttggattaaattatggcattatataaataaaatgcaaatttaattgcccaaagaaagtctcaaaagttggtcattttttagacaaaatctgttaacaaacaacataaaaattacaaaaaattcttccggcgccgccggactcccccccccccccatatcctccaaaatttttaaaaaaaagcacgctgtaaaaaaccttttttataaacaaaaaaaagtcgtcgcatggcttaaaatcgcaaaaattaggcagtttttggtggaaatctgttaacaaattgcattcaacttttcaaaatttttccccggcggcgcctatcggcaccgccggacccccccc

SEQ ID NO: 16736 - DNA, 1828 bp, Heterodera glycines
  misc_feature (1746)..(1746): n is a, c, g, or t
ttttctaatttcttcaaaaaattattacatttcgtctgattttttttttgtcataatgtcaatttttaattgatgtaaagtctaaaagttccaagaaataatcactcaattagaactagagaccggacaagagggtcggtcggtctgtttcggtaaaaaccgaaaaaaaccgaaaccgaagaacaattttcggtttatttaggttttttgattttgtttattttttccccaaaaaagcaataaaccatttttattaacagaaaaatgctctttaatatttatattgaatttttgggagatgtaaaggaatttttttgcttcttctgttttaaagacaaaatgcgttttgggcgccgccgggaaaaattttgaaatttttagtgcgctttgttgacagatttagtccaaaattgacaatattttatatggttttaattataaaattgtgattgaatccccatcgaaaaaaggaataatttttacaaattaggagaaaatcaagcaaaaattagaaacagaaccaagagcacaacccactggaacacgcatatgaaacggaattgaacaacaaatgacccaaaatttataaaaatataagtttaccaaaactaaaaatccttaattttcttaaaaaaatggctcaaaattgcaaaaatttggtcatgttggacaaaatctgttaacaaatcgcattaaaaaagtcgatcggttgtttcggttttttgataaattcggtcaatcggtttcggtttaaaaaccgaaaaaaaccgaaaccgaaaaactcaaaaatttctcagtcgattttttcggttaaaaaccgaaaccggtccgatctctaattagaacagctccctctattaattacatattataatgtaaataatttttcaatgtaaataatttttattaggcacattttgtcccagtaaaaaccttttttttttttgctatttatattttcaactcttaaaatttaatttttatcctcatatatcccacctgcatttttgcattattttgtctatgcgaattcgtgtggccccagcagcagcagaagttggccaaccctgttgggagagttggccggccacacacccaaaagttgccaccatttcccccacccccgggcacggcattttgcctgccgccaaaaggtgagaaaatgccaatgtatcggcgccaccattgaatggcacacctgaaaagcattggtggaccaccgccgacgtggcccaatgggcaaaatatgatgatgatggtgatgaatattttatgggctgactgagtgtgaaaaatgggaagtgaaggcgaaaaggcgccttttccccgcccggggcatttgccatttgatgtttcggcatgcgttttgtgctgaatgaaagcgcccgaggcgttttgatggttcaaacactcaatactcatgtaataatatgttgcctttggcattctatttagtattttttaataggaaaaagtgtgccgcatattaaatttctgcccctggcatttacaagtttttgtttgccgacaagttcctatatctgcgagttaaaatgttcacgccatatttttttaataaatatttatttttcaaaaatttttcgacaaaataatacctaaataattaatttttgtgttaatttttttaaattgcctattttaaattatttttagatatatttaaataacatcattttctatattctcttttgtctcaataactaattttcccaatccccgactaantttttcgcttttttttatatatatagttttaaaggaattagaaaaaatgtattttcatttttattataattttaatcattta

SEQ ID NO: 16737 - DNA, 1064 bp, Heterodera glycines
  misc_feature (923)..(923): n is a, c, g, or t
  misc_feature (932)..(932): n is a, c, g, or t
  misc_feature (935)..(937): n is a, c, g, or t
acactgactgaccttagaacatgtaatccggcatttttactgatcgacgacttaccgctggatcacaaattgcggaaggaatggcgttggcgaagaagaaccgcgtggtaaaggcggccgaagaagttgacctgaacgtgtccatcgcctcgtcgttcttcgaacgcgggttcgaaccctcgcgtctcgtcacttccacgccacggcccagccaacagcgggaggagacaccgcaggaaggtgaatcaattcaatgagaatacattttgtgatttgacatggtggaattggtcttttcagcaagaagcatcgaagacgtgacggaagcagactttgacagtccgtgaatgtgttttgtgccgaaaatgttcattttgttgggatttgcttttcattttatcacattgtaatatatttaaataaagcgccaatttttaaaatgacatcaaaaaggatgttctcatcagttcaatcgctaaaaggacaaagggataggctaattataggtgtggatgggcaaccttccttctgatgctgaacactcggcattggatattttttcattggcttcgtccggtccatcgaattcgccatacttacatagaaagtcaaaaaaaattttatttgagatgatccaattacataaaagcggcacagcaatgcttcgaactgtgcgcacactttgtccatctgtttcctttcttcgcttttatcgtcgtccattttgctgacgattgtgtgacggtaaagcgaagtcgcactcagcgaatggagtcgcttctccaacgcttcgaccgttcgctacgaaattggccaatcccccaattccttttccttcagctcacttcgattccatcgtttgtctctgtcgacgggtcgcagttagccaaatggaccgtacaaaaacggacacccctcagatnaattcctgnggnnntggagggaaaaaatcgaagacatttcatacagttcattcgctgtcaaatgcccatttggactgactctgcgcactttttccgggtgtcgtatcgaatttcgtccacccaatcacgattcagcgaatt

SEQ ID NO: 16738 - DNA, 1391 bp, Heterodera glycines
gaagggacacgagaaaagaagaagcactatgcccgaggggttgtaaataaagagatgccaagaaaagtgtcaacctcaaattttgctttttctttgacacactttttttcaattgtcggattatccctttggcggtgtacttttaaaatttaaaatcatttttgcttcacaatttcacttgatttaatttctttttgattaattgcaattaattttaaatttatcgtacatatgaaaggggtcggggtcactttggcgcgggccattttggcgccgcggcgcgaactttaaagtgttataacttttttcttatccaaccaaataaaataattttgataccattaaataggcctgtgttctttattagcctgcaaaatattagaaaaaataaattctgtttgacaaaagatatagcgtgcggcgccaaaatggccagaaaaagtcagttttttgaggttttttggccataacttttttgtgtttcaattaaattttttgaaattttgcaggctattagggactatcaagcgctttaaaatgatatcaagcttatttaatttgaatgagaaataaaaatgttatagcgtttggcgccaaaatggctggcgccaaagtggccggttccctatgaaaggtctttcaatttttatgtgatagtttaaaatttattttatttcatttttatcacaaaatcaaggttatttcacttttttcagcagtcttcgcatttcttttatcatttttgcacagtttgccccaccatcgaatgctttttcgtgcgtcgacttcgattttgttaaaaaatcacagaaaattgttgttgtccgctatttccaccacaatgcaagccaattcttcgactgcttcttcggcttatctgatcaaccagcccaaatacgcattccttgccgaattgggcatccaacagcaaaacgatggagtatttgacggcacatggaatgcgtcggggaaggaagtcgactcattgtgtccggcgacgaacacaccaattgcgaaagtgcgatttggaacggcggaggtgcccaaacattcaatcccacttgaataagcacgccccttttaggattatgaacgtgtgatcgaagcatcgcgtgccgccagtgccatttggatggaaatgccggcgccaactcggggcgaaattgtgcgccaaattggcgattctcttcgcaaaaacattgacaatttgggcaaattggttggttttccgtacccttcctaaatttcaatccttttttcttccttttccatgcgtttattatgcgtttcttttgaggtttcactcgaaatgggcaaaattttgtcagaaggccgtggcgaagtgcaggagtttgttgacatcgccgattacgcaactggtctttcccgta

SEQ ID NO: 16739 - DNA, 2968 bp, Heterodera glycines
  misc_feature (1917)..(1917): n is a, c, g, or t
acaataccaatattaaaataaaaaatacaaaaattgcctcttggattcatctgatatttcgggaaataccttttaaatactcattgatacggggaaaatgttttgttaataaaatatataaagaaaatttttttgaattattggggcccaaacaatcgcatgtcagggagcggagtcggggcttaaccctagttttaattcataatcgcattcattcctgtttaataggtaattattattttttgtcattttaaaaatattgtggctaaaattatgtacattgccaaaatgcctctctaaataaatcagtcaaaataatgacaatattcactcgaaaatagtcatgccaaaaaaggtcaagctatattccctgtttgtaaaactgccacgtggcattttaaaaaggcactcactttaaattggcatgctgaatctaaatgctaaatggaaatcctacgaaaatgccatgccaaaacagaaatgccaaaaaggcctaactcaaaaacataaattttgaattaaaaaaaacttatgccccactgttggcatatttcattctgtgaaaatatttttaaaagagtcaaaacaaaaaaaattgttttttgtcggaatttcggtaatcttaatgataaactctgaatttatacgctcttttaaaggttatttgacatttatcataattttgaaaagtagacaaaagaatattttttcgattattttttgctcattaatgcttgcaaaatatgccttccgaatagaaaattgaaaattttaatagactcaaaaaaagctggctaaagaaattgaaaataattaccactgagctaggggatagcttagcacattcggacattttaaatttataaattaggctcaaaatccacaaaagtttgtgttgttatttttttacaaattacctaggtcaaaagttcaattttctctctcccggcgacactgttttcggcaccgccgcccttccccctcccatccaattttttggcataataatttcgtcattatggtcttgatcattttatttattttttttgaaattagaaaattaattataaattttgtctatataatgaaattttgtatttttttttcgtctgggagccaaagttcaaatggtgggtgctatggagaccaattatggttaattgataaaaagctttgaaaggtaattcacacaaaacctatagcattaatttcaataaataattttttttgacctaactaattttaatattatattttcatgattccaatcctttgttattaaaaaaaattttataaaccaaaaatcaatttttatctaataaataataagaaaaattttcccaaatttttctgttaatgtttggtctatttttgtattaatttctaaatttttgtcggtttgccgtaattatttttgggaaactgaaaaatttgtggtagttcatttttatcctgcgaaaggattgattgccactgttcaaataaatggatatgaaaagaattgttgcgtaaatgacatgagaccgcgactctcgagcagcaataataataaaattgaccggacatttggacagtggacattgggaccgaaccggacaattggacattacgacagtgaatgacttttttttttatcctttctctctatattccttatccttttctctttctcatccatctctctccgctctccatatcactttcttctttctctctctctatctatcccttctctctgtccctctttcgttttctctctctttcctattttcttattctctatcattttgtctttttctctctcttcatccctttcatcttttttcccttttctctctaactcgctccctcttctctttatttctctattaggaagggatttataaaaactggtctgaattttgttttcattgctanagatattttagtaaataatttgtcatcaactttcgttaatgttgtaaggattattcgacgcatttccctcatttaattacttcccattggccattatccattcaatcacatttatccttttcacacgtttttccttttctcattgtaatggttctccgcccattctcttcgcatttctccttccccagtgatcagtcagtcagtagtgatggaacagacttcaatgattattccgatttgaacgaatgaataaatacatcttaacagtcaatgagtcgtttgggggttcggggcttggtcaaaggcgccttggcctttccccattccctcccaaactccatccgggataaacggtgcatagttggtctgggggcacagtgcgcatccctcactatgtccactattcaattgtccggttctgtccaaccaaatgtcctggagcccaataataataactggaatagtttatggatcattttcagatgtttttcctcatccgtgcaacgaaattttcaattcaacaccgaaatttggtcctccttttcatgataacaatggctcaacagcagaaagcgcatttcacgacttttatggaaagcgtagttttgggaataatatatgcaaatgacagtgtcaaaacggcggagacacagagatgaaatatttttgtgtttaatttttttttttctatttttttgacctaaatttatatatcgtggaatttgccataaattggaatttcactaattttttttttgtgacacaatatgtttaaaaggaagaatacggagtttctgatagttggatttaaaaaaacggcattttggacaccgaaggaaaactggacaccaaattcctaaaataagccaggaattaggttgaaaaataaatttgtgtagggtaaatggattaatgaattaaggcacttagagtaaatcaggcattaaatatgcgcgatgattcatttataaaaaacaaaactatgtgcagactaaaataaaatcttttagccaaacaaaatttttgtttatttattttaatttatttattt

SEQ ID NO: 16740 - DNA, 1329 bp, Heterodera glycines
tatttgctttataagtaaactccacagcaggaattgtataacagattgaattttttgttatttaagctttttttgcgaagtattcttaaaagggtgatggcatttaatgggctagaataggtgagtaattaagagtggatgaatatttgctttatagaaaactacacagcatggaattgtataacagattcgaattttttgttatttaagcttttcttgcgaagtatctttaaagggtgatggcatttaatgggctagaatagcagagtaattaagagtggatgaatatgtgctttatagaaaactacacagcatggaattgtataacagattcgaattttttgttatttaagcttttcttgcgaagtatctttaaagggtgatggcatttaatgggctagaataggtgagtaattaagagtggatgaatatttgctttatagtaaactacacagcatggaattgtataacagattcgaatttttgttatttaagcttttcttgcgaagtatctttaaagggtgatggcatttaatgggctagaataggtgagtaattaagagtggatgaatatgtgttttatagaaaactacacagcatggaattgtataacagattcgaattttttgttatttaagcttttcttgcgaagtatctttaaagggtgatggcatttaatgggctagaatagcagagtaattggagtggatgaatatttgctttatagaaaactacacagcatggaattgtataacagatgcgaattttttgttatttaagcttttcttgcgaagtatctttaaagggtgatggcatttaatgggctagaataggtgagtaattaagagtggatgaatatttgctttatagtaaactacacagcagggatgggccgaggtttcgcttttcgcatttcgcctttcgcattattcgcattttttggcgtttcgcatttcgcttttcgcatttcgctttttggcgcgaaatgcgacttttacacacctaagaattggattaaattcccataaaatttttcaaaattttacctataaattggctaattttcagtgaaaaactgtttataaatgatcaaaatttccaattttttccccggcggcgcctatcggcaccgccgcgcccccaaaactcctattttttcttagaaaatggcccaaaatcgcaaaatttggtaatttgatgaaaaactgttctcagcggcgcgccaaaactcttatttctcattagaaaaatgataaaaatcacaaaatttgatcattttttagtgaaaatctgtcaacaaatttttaatcaaattttcaaaaattttcc

SEQ ID NO: 16741 - DNA, 1383 bp, Heterodera glycines
  misc_feature (1252)..(1252): n is a, c, g, or t
ctcttagagtcgataccaaaaaagtaccataaaaatatgataaaatgaatttataattctcgccacccctcgtcaccgacttgcaatttccacgctcggcgtcttgttcaaaaagtagatgtacagtcgggtggtctccagcagcactttgtccgcactgtatttgatcgaattataccaccaaacgccctgcggagggggggggggattaaataaacaaatggaacattgtaaaaaaacgcaccacagccaccggcaaaatgaccaagaagatgaacacgtacaagccgagcacccaaccgccgtactgctcactgacaatccacttgggcaaagcaatgccaaaggttgtggctgaaaaaacatatttgaataatttcatttattcggttaaatatggaatcggtcgaaggaaaaatttgcgttttgtcatttaggaactaataggcagaccgattcaaaactgtttaacgatccttcaattcattggaattgaccgaccgaaactattaccaatatatttgtacatgccctcaaaaaacggcaatttaggagggggtaaaaaattaaaaatcaaattcaaaatgccaatcaccatcggtcaaagtcgtcacctttgggtccgtccgggttgccgtagaggcgccagttctcgcgcgactcctcatccgtcaatgctttgtacgccttgacaatgccgtcaaaggtcaccgggtcgccgcccttgtccgggtggtgctgcttgctcagctcgcggtacttctttttgatctcgccaacatccgcgtcctgaattgttgttccggttgtcaatcaatttgggtacttccagtcaatgaaaatggtgaattttgataatggctcgcaaaattgttccaataggcaccggcaccatcaaaacacagggcatcccaaggttctcagaaaaatgctattaatttgggtaaaatgactttttttctagtcccaaaaatgcaattttatattcggacgcaaattgaaatgcctcttttatgttaaatgaaaggacaaaccacgtcaagttggagtattttgtacgggtcatacctgaaaagtgaataaaattaggaaaatattaacgaattggatgaacgaactcctcaaatgtctgttccaattgtgaaactttgtaggccaacagaatgaacagtgcccacagaatgagcagaacaaacccttaaatgattagattttagaaaaactaacacattttcaactcaattttaaattnccagtccataaatttgtctttttgagtgcccgattaaatcaaagggtgggggggacctttgttttttcaaatttgaaagatatagcttcgaaatgacaaatttacgggttaaaaattggatgcaaaaacaa

SEQ ID NO: 16742 - DNA, 2467 bp, Heterodera glycines
ttaaaaaacgaattcaaaatgccaatcattgcacgtcaaagtcgtcacctttgggtccgtccgggttgccgtagaggcgccagttctcgcgcgactcctcatccgtcaatgctttgtacgccttgacaatgccgtcaaaggtcaccgggtcgccgcccttgtccgggtggtgctgcttgctcagctcgcggtacttctttttgatctcgccaacatccgcgtcctgaattattgttccggttgtcatttaatttgggtacttccagtcaatgaaaatggtgaattttgataatggctcgcaaaattgttccaataggcaccggcaccatcaaaacacagggcacctcaaggttctcagaaaaatgctattaatttgggtaaaatgattttttttttctaatcccaaaaaatgcaattttatgttcggacgcaaattgaaatgcctctttttgttaaatgaaaggacaaaccacgtcaagttggagtattttgtacgggtcatacctgaaaagtgaataaaattaggaaaatattaacgaattggatgaacgaactcctcaaatgtctgttccaattgtgaaactttgtaggccaacagaatgaacagtgcccacagaatgagcagaacaaacccttaaatgattagattttagaaaaactaacacattttcaactcaatttaaaattccagtccataaattgtctttttgagtgcccgattaaaatcaaagggtggggggacctttgttttttcaaaatttgaaaggatatagcttcgaaatgcacaaatttacgggttaaaatttggatgcaaaaacaaaatggtccaataaatcatttttaagtattaaaaagcaaatgaatgccaatagtatgaaacaacctttgatcacgcatttcgccttctcccacggctttatttgctctttgcgaaaccgcttgaccaggtcgccctcgcaacggcagcccctcttcagcacctccgtcctctttgctgaaatttgaaaactttgtgttactccaagaccttttttcctggatttttgtctaaaaaagtgccaaaatttggaacttttgcatgcgtactgtttgaacttttgaatttggtgtataaatttgagagttaagatttttgcaattttctaattttccacccggatcaaaaaacctgttaatagccctggtttgtgcccagaaaataaggcccacaggtcaaccgaaaattaggtccaggccattttcaataagtctgtcccaaatttttacatttaaaaaaaaattgtatgccataaaaaatgtattttaaaagaacgtacgcagcgatggccacagaaaatgggtgagcgggaaaaggatgacagcaaaaaaggacacaatcacataataaaatgtgttgccgacttcgtcgtattcgaactgagcacggcccattgtgacgaggggaaagacgaagaacaaaaaaggaaataacaaataaaaaacaaacaaaatttacaagacacaaatgtctgaagaggtggaaacacctaaaaggcgaggaattaaatttaaaaaaaaaaccaatgccatcgaaattaggtaccctaatttaaaggtttctgaaattttagatttcgactgtaaatttgaaaacaattcaatgttggtttaattacaaaaaacaaaacttttattataataacttgatttggccaaatttgatgctgatcgagagaataaggcccaaaaattgttgtttttttgttttcttgatcggtattattttcgtttttgggtcggtgttcattcctggtttttgagcaaataataggtttatctaactgttttactgtcgaaagttgccgaattcagtcactgccgaaatctccacgacgcgacccgacaaatataaaaacaagcaaacgcaacgtaaaacaatttgaaaactcaacaaacaaaacgccagaaaaaatatttaaattaaatataaggcccgaaatttaagaacaaaaaacggtaaagcaattaggtacctaattaagcatccaaaaactctttaaacatgaaataatcattaaaatattaaaaattttaaattgactcttaaacccaaattcagtgagttttttttcttccccccccccctcccactctcatgggctcccacggacaatccgtcagtagaaatccgtcaatatggacattccgtcagtagacaatccatcagcaaaagttattatttttaaagcatcagatttatttaattatgtggaaatgataaattgctaaaaaatgaatgttcattgttctacttctgatcactttttgctcaccaaaacgggggtcggtgagaaaatccggggacccttccccgtcccccccccccgggtgcctgcaacaatccaagtataaagtgagcaagcaatgaattattacactgctttgaacggaaggacaatgagaacagtcaacaaattcgattcataat

SEQ ID NO: 16743 - DNA, 871 bp, Heterodera glycines
  misc_feature (58)..(59): n is a, c, g, or t
  misc_feature (69)..(69): n is a, c, g, or t
tatggacaggtctttaatgattaaaaatctatatgtctcttttaggacagagaaaggnnggctcttggncgaggctctatcttgtccctccaagtctctttgatatttctcgtcgaattgttgcagaaaaaatgatggaagaatttttaaaactgccatcacactttcgaattgctttttataataaatattaattgtgtaatttttttttttgccttagttatagtcgaaatttatttttaattgtttagttttctaaaatttattttagtctcgaaaaatgaacacaatccgcgacattaagaatattgaattggtttgtggtagtcgaatttttgtggttcgtgctaaaattgcaagtgttgtgtctacggaatacaatgtaaataaaaccaaatagaaaacatatcttgatttttaggcttgcatctcttgtcgtaaggggaagtgtaactgtggtatggagaaggtaaagtcttcatttttgagattgtcgctcttggatgatacagacgttttggggggtgttgcttttttcggcgtgaaaaatgtagaaaagggtgacggaatggtatgaaaaatgtttaaacacgaaaatttattttttttaggaaaaggttaaaaacttggttgggaccatttgtactttgaaggttaatgtgagtgtgaaagaatatggtggtaagaagggaatttattatgctttgattgatatttatgaaatttgatttgttttgtctataaatgaaatgttaattttttatttaaataaaaatgttttttctaaaactatttctgttgtctttcttggtaattgggggtcagtgttgttgttgcttgtcgaaagaagaaaagcagcagatggatgcca

SEQ ID NO: 16744 - DNA, 2447 bp, Heterodera glycines
  misc_feature (63)..(63): n is a, c, g, or t
  misc_feature (2345)..(2345): n is a, c, g, or t
ttggttattaaatttatatttatttaagtgtgttatttttattgtatataattgtttttaatntagatattccaataatgtctttttaccatgccgcactgcttttcatcgtgttcgccatttttgatggacaatccggggaaacctttgcgtttcaagcggagattgcgcagttgatgtacaatatggacaacgccacgacccaaggtttgtttgacagaattggtgactaattttttacataatttttgtgaaactttttttaaaggcgcatgacatcgaaaacgacccgagcaaagccgataaaacatggaccatcattgacacgggcattgacatgaccaaagccgacctcgtcaacaaccttggaaccatcgccaaatccggaacgaaggcgttcatggaggctcttcaggttttgtttttcgtttggtcaaccccccccccccaatctaaaaaacacttttgctacttaagaccggcattgtcgctttaatgcccgggcattttggcgccggtttctactcggctttctctgtggccgaccgcgtcacatcaaagcacaatgacgacgattgctaccaatgggagagctcagctggtggctcgttcatcattcgcaattgtgccgatcctgaagtcacccgcgggacaaagatcgtcctctacctgaaggaagaccaaacggcatatttgcaggtttgttgtactttggttcaaaaagtgcgtttttgacgctcaaaaattttacatttttctttcgcagtaaatgcgcaattgtcaacaaattatatttttaattaaaaatcatcaaatttttattgagttcaggtgttggtgctggtgttgtgcgtgttcatctgtgaatgcggtgtggggagaaagggcggccaagcaggcggtgaaaggagcagccgcgggcgaccaaacaatgacggcggggggacaagcggcggagcgggacagaaacggggaggaggacgtggcggcggtcgcggtggtggaaaaggcaatggccgcggtggtggacgaaggcggcggcgggcggggagggcgggcgccgcagcacccacaggaggctgatgaggaagaggtgggcaaggatgagaaatcaaatctcatcaatttgaattgaagaaatggtttttttacaatgtgccgtattttcccataaaaaatcgttttatgaatatggttaatttggtaatcggtgagggacggggggggggggggttatcgagggtgctgatcccgaatctcgggttatcgagggtgctgatcacgaatctcgggttatcgagggttctgatcccgaatctggggttatcgaggtgctgatcacaatctgacatctcatttgcaatattttaattgtatctattattttcgcagtacctaacatgctaattctgtaggcatgataacaatgatattgtttagttaatatttaaatataaatttaaaatgtaatagttgttgattatggctcttttgggcatttgttttttacagttaagcgcatacagtaacccacccaccgcatcaatcattcatccccctcctccacagtcgcattgtgttgtggccttgtcgcacactttgtggccaaataacacggaccccctactaaccccgttcgctgctcaatgcagtggcctcattaatgaagaattgatgcggtggggtggggtactgtatacgcttaactgtaaaaaacaaatgcccaaaagagccataatcaacaactattgcattttaaatttatatttaaatattaactaaacaagcttatataactgataaattaagattttattagcatgtttatctctgactaaaaattttttcgtctctctctctttctctctctcaacccaatcccaaattttaattatcgcaaaatttccctattattattggccccagaaataattagtttttttttaaattttatttttaaatatcaaaatggaaaaatgtgccattataacgatcttacacgattgacccatcattggcaaaaagcgcagtgggtggccttgcgcgtgcgttgcgagcggcgcggccgcgttaccccgatcaagtagtcgattcggctcgtctggcagccgagacacttggggcgcacatcgtgcccctcgacctgaaaacatgaaccaaattaaattttatcagaaaatcaatgttttgtgtgtttacccaacgcctctgactgtcctcatctaagcggactagcccagtccacggctcgaggctgtcctcgagctgccgcgcggactgctcgcgcgcagcatccgaatacctcgcccaccagccattttcgcagcacgtgtcacaaattgtgnacacacccgcagttgttgccgcgaacggccacttcgcagtccaacccgtgctcaccatgcacaggaggcactgatcggagaaatttaattctctgatcagtg

SEQ ID NO: 16745 - DNA, 563 bp, Heterodera glycines
ctcttcctcccttttgtcctcctcttcctcccttttgtcctcctcttcctcccttttgtcctcctcttcctcccttttgtcctcctcttcatcccttttgtcctcctcttcctcccttttgtcctcctcttcctcccttttgtcctcctcttcctcccttttgtcctcctcttcctcccttatgtcctcctcttcctcccttttgtcctcctcttcctcccttttgtcctcctcttcatcccttttgtcctcctcttcctcccttttgtcctcctcttcctcccttttgtcctcctcttcctcccttttgtcctcctcttcctcccttttgtcctcctcttcctcccttttgtcctcctcttcatcccttttgtcctcctcttcctcccttttgtcctcctcttcctcccttttgtcctcctcttcatcccttttgtcctcctcttcctcccttttgtcctcctcttcctctcttttgtcctcctctttcatcccttttgtcctccccttcctcccttttgtgctcctcttcctcccttttgtcctcctcttcatcccttttg

SEQ ID NO: 16746 - DNA, 1781 bp, Heterodera glycines
  misc_feature (1718)..(1720): n is a, c, g, or t
gcttcattttttgcccctgtcttctgttcaaactcaaacttcaatttgcactttccatttttttgaaatcgtactgattttttgacaattttcgttttctaacggatttccgtcataaataatcgtaggtgaacaaataaatgaggaatttgacatttcaaattgaggtacagactgatctctttctaaattcaacaattcattttatttgttagttaataaatttgctatttcgaaagcttttgattttaggatatgtgttaggtcttttaaaaaacgcccatttgccgattgaatttttttgtttgggattaaattaaaaatttaaaaaaaattcctaagtttttaaaaaaatttgtcaacaaagaaagaaaaataatgacagaaaaactaataaattcgaaaatttttaaaattttcggttatcgagtcgagaaaatgttttttaatattttattttagttacattaaattgaaaatttattatgcaaaataaatttttaattagaaataggagtaactttattaaataatccattattattattattattattagactcagaaaatttctcgtgtccaaaattctcagcaattggcatttcagaaaagctttgctcattccaaggtgttatgacattatcataaaagaacaaaaaataatgatgacaggctgaaaaattaatctaagaaataaggacaatccttaaaagtaaggacaaaaatacagacaaatcatagaaaaggacaaatggctctcataaacgctttgttcaaatcagaaatggcgaatcgaacgcgccggtgcccacgcttatgccgccctcgtccaccttctccaatttggtgcgcataaagtgcccactttgcacattgtccagcacgtggttgccattcgcgtcacccaacagccaaccgatgatactcagttcggaagtcattcggccgtactgagtctttgtttgttgcgaacggaccatgaaattctattgaaacagcaattaattaattagtcaattaataaaaacataaaacaaatccagcagaattgcttcaattaaataatatgcgtatctcaattcgcacattgtttcataagattttctgtttttcaaaaaccctaattacaaaaaacgtttatttcgactttttcttaattaaaaataagcatttaatgcccaaggaatattcccatcaaaaacaccaaataaaaaaaaggtaaatggcattttttgtataaaaatatgtttaaattgcatttgattctgttttcaaaaatatttattttccccaccccaatttattgacattttaaccttaatcactaatggatgcactcttttcatcaaaatgtgagctgccttttcactggcagtgaatgtgcgcagtttctccctgattttgtccccccaaaaattgtgtccgcccccctccatattcggcttcaacacgtaattgtgcggattttctattgcatcctaaagggacggaagcaattaaattgtctacgattgaaaatgaagtttttcccgtgcctcaattgcccttttggtgtcttcatcgttatcttccaaatcccatagtccggcaaaagtgctgcgcaactcggtaaccatctcctcgtattcaggttctggcagaaatctttccagcatcccaggcttggcaagcagctaaattgacgctcattagcgaataatgagcaacttaatgacatnnntgggtaattgcttatttacaaacattttaaattcaaaaaatttatacaaaattaaaaagtt

SEQ ID NO: 16747 - DNA, 2156 bp, Heterodera glycines
ccgaaaatttacaatagcaaaattgactatgctctctctttgagaaaagcactcaaggttcggagatgttctcttgtgagtgtaattcccccctcttaaaatgtaaatttttgaaacatttacacaatttcaacattaatttgccctgctttgtttgtgtctttctcacttgctcgtccacttcctcctccgccattgttgccaatttcgcggagcggttgttgttgttgctgctgcgacggttcgtcgccggtcgccgccggcaccgcgcggcggcgacagctccgccggtgctgctgacgctgttgctgcggcggtgcaatgaactcggagcgcgtgtccagcagagagtcgtcgaggaactgttgctgctgatgggcaccggcgagaccagtaaccctgtcctgcggaaaagcgtggtagggggtagcgggatcgggactcgaaccctatttgaaattttacaaatttttaatcatcctgagtcaagacctttttccattactgtatcacttcatttttaggctccaattttgaatatactcgtgtttttttaaatttctcggtactgtcgaaatcaatctctgtcaaattcacaatttttctgatactgtcgaactcacttattgtcgaattcactcgaaaaaaagcgaaatagtttactgtcgaaatcacctggcacggacgcaactgggcccttagcactaagacgcaactgacccgttctgacccatagtgtcccctccccccccgacatatcaaacataatattcatacatatattacaattcgctgctagcacaataatttattacaaataaatgtttataaacagataacccaaacaaaaaaactcggtacttgttaattatctgtattcagattttcaaaaaaaagttatgttttggctataacttttttcttttgcatccaaatccaacaaacactattggtatcatttgaaagcttaacatgttttgaagctatttctaagttatcgcttcgcaatcagacaattaccaaaaaagttatacatgaaaattgcgaaaaagtcgaaatttgaaattttttcttaatagaatttttcccaggctaaaaaatctttttgttttttgtaaagctaaaagagcatctgaagagctttcgaatgatacgaatagtgttggatttggatgcaaaagaaaagttatagccaaaaacatactttttttttgaaaatctgagtacaggtaattagcaagtaccaaaaattctttctgctgcttaagacatagtcggactttccaacgcgggtttcactaaatttgaaattaaaaatatgctaaattggtcggaccaacatttgtcttttttcccatggaatggcccaattaagcaactcttcagcatcgatttgtgattcacccaacggtgtatttcattgaacaattcggttgcatcggtcccagctgaaactgacgagtcaacaaatgagacgcgacaaacaaatgggttctagttggttttacgcgtcccatgacatttagtgtccatgttattttagtcgtcctaataaccagaggaaataaaaacgcaagggattcagatatgaaaacggaaaaagacattggttgcattcaacaagcaatgtttgtaaaaatgattactttaaattcccagaaaatattcgaatccgggtttggggttcaaaattgagtctaaagaaggccagattcgtgctaagcgccttggattgcccctgaaaataaatttctcaaaacttatttttaaaaaaaaattttctggaccaataatctttaccactgccaaaatttagttgttaaacctaagatgtcatgaaaattcatacacagacaatttgaacaatggcttagactaggcctaagttttagcttttttcaaagtatataaacaagaacaattagacgcttcggaaggtatagtttccaattgacgattcgaaaaatatttttttgtgacgcgtaaaatgccatgacgcgtattcgaatttttgttcgaatccgggtcaggggttcaaaataggtgtcagaatcgtattctccgaccctgaaaacctataaaacaactttatttcgaaatttttttgaaaattttctttttcaaaaaaggggggctaccatgtacactattaccca

SEQ ID NO: 16748 - DNA, 3102 bp, Heterodera glycines
aggaaatcagcagcaatcgttgggttcatcatttgagactcatttggaggacggcaaactgttcgattggccaacaaaatgaaaaaccgaattttgaagaaaatgtaagccaaacaatggcattgagcaatcttttaagaatttcatggtataacgggtagacgcataaacgtcgaaaagtaaaaaatattgcttttctatggacataaagaccggcaagacccgtgcggattttgctgggtctcagtccgcaatcccgtctttttagaaattgtgggatttacggggattaatcccgcaggatcacgtcccgcaaaaaattgtgagttccaataccgaagcgaggtccgcaattttgaatttccggtctctatgcaggcctgagggctccctcgcctcctcctgttcgttttgccaaggaccccttttaagatagtttaaaaatttctaaaattaatgtgaattttggtcttgctaaaacctctcattgacaagaggccctgctggattaattatattttgcgcattgggatgtttttgtccagcaaatttggcccctttttgcgccaaacatccacagcttggcctttgaaaatggtgatcagttaaacaatttgtgtcgtcttatttcaccaacaatcctctctgatctcaacctgagtctaatcaaagccagcaattttttttaaataataaatgaatataaaaaaataaaaataaatttaaaaaatatagaaaaacataaataaataaaatacaaaattaattgtaaatgtttacaattgattaaatttaaaataattctcaaaaacatgttgctaaaataggtataggtatattaaaattctctccggaccttttgaatttatttatgcataatgaatgcattatttcggcgggcagtgccattgaaaataattattttctcagtaaattttgtatgaaaataagctgaattatatcatacataccaaagtataaacagtagcaagaaaatactatgcaaacggaacaaataagaaaattttgttaatatttttaatttatggtgaatttcgaatgaaaatcggttaaatttaaagaaaaaatgaacaaaaactcggcattccaaacaaaaaatgccatatactctgctatttaagtcacgagctcttaaattgatgacccgacgctgctttcgttggacaatggactgaattgtgagcaaaaatttttgccaaaacattaaaaaatcagaagcgtaaaattaaaatttcttgtctatcacatgacattgatttacctaagaagttcggtttcgtccccgtaaatccatagattaatttgcaaaaatcattaaaattaagcagtaaaaaatatgataataaaaaataagtgcagaagattatacaatttcccacaacattggggtatttatgattttcctccgttttttcgtctttcatagtaagatcaatggcaactgtcactttgtcctcatttttgtcatacaatcctctgctctgatccatcagttccttaattatggtcatttaaaatttaattggggattatttgttttaattggcactcactgcaaatgaaatgaaattggcatatccacaactgttcgattcgttgtaaaaagtatcttcttccgtaaattctcccctcatataatctctcacgccgctcttttgcgagacaattcgaacagttgacgaacattggcaaatccaaccttcatctataaataaatgaaacaatattattgtcaattaatatcatttaatttgcaccttcttttggagcatcgcacacaaggtaaatggccaaccatttttcattgtcagtgcttccatttttcttttcaatctaagaaaatgccgtcgccgaaagggaccgattgactgtaccattacaagaaaaaaaaagaaatcttttggttttttgggttattgccaaaaacactcatcaatttatttgcatatttttcttttttcttgctatgccacaattggtcccttcggcgacggcatttttttttaatctttttgtgtattttactgtccaattgtccacctctgtccaattgtccacctctgtccaattgtccacctctgtcggattgtcctcgctgtcggattctccactgtcggaatgttcgggagcctctttttttgttctaatatatgcccgtattttccaaggaaattctttgatgaacacagttttgcttatacgttcactcccaatgttttcttgcgcaaattttgacaaatttttaatttccaacgcaagtgtccctcttcgtttaatgctgcacttggctttgttccaatcagaaattcgtccatggcttgggaatttcaacgcgtacagcccgggcactccataaggatagcgaaacggatgacacagatatggatgggaattgaactgatacacaccgatcacttcttccattgttaacacaccggatggaactataaatctcaaaatttgttaaatttcccttaataaaaattttatatcattttgggctaaaatatttatatccatcacaaataaaatttttattttaaggtcataccgacggattttgcaaaattctcctcatggatatttggaaaacgaattttgaacagtgccggaccaagtacggaacgccgattttccgctgaccatttcatgccattctgacgacattttttatcggcccaacgaattgcctttaaatttaaaaaaaaaatttaaaaaaagcaagtgcaaaatattaatcaaaatttacagctttccaaatttcaaattcattgcttagtaacaaacgatcactctcgagaagattgcacaacacattctgatcaatttgcaaaaagtcaattgatctgaataatttggcagcattttggcaaatgtaacgaaggcatttgtgggcaaaaccctaaaaaaaataatgttacaaatcaatttgtctttctcacctccaattcaaaaagcagagcctgggcatatgcaaagaaaacattgcgcaatgatgaaacagggatttgcaaagatgcgtcgaccaaatcagggatattgtattttttggctaattagaaattcaataattaataaatt

SEQ ID NO: 16749 - DNA, 2319 bp, Heterodera glycines
  misc_feature (82)..(82): n is a, c, g, or t
  misc_feature (121)..(121): n is a, c, g, or t
agacgatcgttgacagcccagtccgactgctccggcctggtgctggccactaccaacatgaacctaatggaaaagccatctntaataaagatattcaagtaaacaaatccttaaaaagatntaaaaaaagcatccccagttttcaaactaagaaactttgcaagaaaccttaaaaagttttacaaatttttttttcatttttcatagaaatcgtgttgtttgaattttctttttaattttagggtgatggaaacgagctgcccctaaaaattgtggcagccaaataattcgtaaatgaagcaccactgactgacttcctcgactgttccccggttctgaagaggaacgcgttgagcatggcgcgcatgtcctcgctgatctgttccgtgcttcgcttgcgcagaaaagcgtccgcttcgtccacaaagagcaccaaactgacaaaaaatgcaggaaaattattcatttgaaaaacggctaattaatttcaaatggcccaccctttgcgcgacgtttgggcccagtcaaaaattttatgaattgcggacactccgtcacggcccatcggtgccacgtcaccgccggtcattatggcgtagtcgagacccgaatggcgagccaaactctgataaacaatttaaaatattaaaataggggaatgaatttgcatgaccccatagaaaggaggtaaaatttcccaagaaaatgcaacaaaatggtggaccaaccttggcgaacattgtcttccccgtgcctggcggtccgtagaacaacacattgcggaacagtccaaagttacgctttgtgttcctcgtggtgatcgcaatgtcacgcagacgcgactcgaggcttggctaaaacaattctgtagcaaaatttttatttattacaacaaatgaccatttttagaggacattgattcaattaagatttaaaaatagaaaaatgtgggtcggaaagcatcgaaaggcactgcccgtgggggggggggggggtaaatctctccataaagcacggtaaatgatttgcgcactcacattgagcacaatgcccttcagcgggtcctcgcgggcacggaacagtgtccgcacactcgcaattggatgtttgaacagctcgaacagtgtgaggcgggacgtttcacgcaccagggacggcttaccaagccgtgcttccacctgtttggccacaacgccagtgccacgcttggcactgtaccaaccgaccgccagcacagtcagaccaccgaccttttttggaggaaggaggggtcatttaaaaagtggaagtatttataaattgcagttataaatatagttgttactgtatgtaaaattcagatatgggtattgtaaaatagtaaaaataattttataaaagaaatggaattaaaattgaaaactcatagtcaaaaaagtcattctaaatcacattttatctccaaaatcaaaattctaaaagccattacatatacaaaagctcatttttcaacaaaatcggatacaatttcatcaagtcgacaataaaattgaaaattagccctttcaaaattgaaaaaactgaaaaatgagtaattgtttcacattctttttgctagcatttgttaattttttttctatttagataaaaccataaaaaacggaaaacatttttagataaaatacaaatataattaacaaattgggcataaaaaagcactcactgccgccataattttggagcgatcggagagaaactcggacagtccagcgcccacaacgccggcggttgtccgaatctgttccgtgaccgtcttgcgtcgctcctcctcactcgcacgcatcatctccaggttcacgtcacggttgtcgcgtgcggcacgcgccttggcgcgcacgtccgcgtcaatgcgttccaagtcgtatttgtgccgtagcgacagctcatgctcaatggtcgctgcaaaaatttgtggttttttacaaatttttacgaaacttataagcaacatttttcaggggaaaatctaattaaaaaatttctttgacagcaccgtagtgaaacttttttataggttaggttttacgcaatttgttaaaatttttgagggagaaacattggaaatagcattttttggttcaatttcttaccaaatttcgttaaattttgcaaaattgccaccgacaacgcctatcgttaccacggacgacataattcccgcaaaattttcagacccaaaaatgcataaaatttatttttcagtcccccaaaaatgcacaaaattttgtctttctgtcaaaaaatgctacaaaatttggcttatagcgtatataattttaa

SEQ ID NO: 16750 - DNA, 946 bp, Heterodera glycines
aatttttttttttttcatccataggatacccctccaccggataaaatatcgaaaaaaacccaaaaatttgactgattgagtgttgtgctgcacttactgcgcgcgcatgttttgtctcctcaattaacgttttgcgcctttcttcctccgcaacgcgcacattctccgattgcatggccgcaattcgagcctccaattgctggaaaaaaataaatggaaattctgaatttttggacgggtgcatttttcagtgatattgcgactgaccttctgctgcaaatcgtactccttctgcttggtgagttcttgcaatcggctgagctcaagtgccttgaaagagtgaaaaattacacaaggaataggaatcaaaagaggcagggaaacccaaacctaaccaaaattgtaggaatttttgtcgaaaattctagattttctgtgttgattcctctatcattagacgcctctccacttaattttaagcagggaaaaaattgatacacttgaaaaactctccgaatgcatgccataataaaaatagtaaaaaatgcagagaattttgtagcgcaaaaagtaggcatcggccttgaaaaattcctattaaaatttgcccgacctgcttcgcattggtcgacttttccagcgtttttgctgcatgtgccgcccgttccagcgcagttgagtcaaatgtgtaggcactctgtgccccaattttctgctgcttctcatcggcgggcgtgggagggtttcctagaatttgaaaaaaaaacaaaataagccataatccaggcagttttcggttttagtgcagttttaactgaattgtttattcaaaacgcactgttggggtcgtccggaggcgcaggaatcgacgatggctgaggtttgatgccaaaaatccaagacatttcaagacttaggtataacaaatttttctacagtaagaaaa

SEQ ID NO: 16751 - DNA, 1385 bp, Heterodera glycines
  misc_feature (1329)..(1329): n is a, c, g, or t
  misc_feature (1356)..(1356): n is a, c, g, or t
aaggaattttgggggattgggccaaagtaagcttgggccaatgctcgtcccttgccatggatgaagtcatcagtgtcataattggcatcagtgcagccccattcagtcatcaattcattgttcgctgcaaaattttattatttttattttcatatttattttttcatcattttaacatttacaataacttgagaaagcctgatgatgacgctttttttatcaatttgtttaaaaaaattaatatttaataaatgtgacagaattcagcaataagtaaaaatttaattttttttttttttttggaaaaaattaatgaacattgccttgttttatatgtttaatcaaaaagaaaattttttcattattgttaatcataattacttgtagaacaattaagcatatagcaatagcgctgaaattggctgcatgaattgtcggagctttcataataagtgagcaacttggaaaggtacgccttcttgcagaatcggactaaatgaattttcatatttaccagaacaaattttttgaaaaacaagattaaaaaagtcaagaaaaatttaaaaagcaaaaaagtcatttctatgaatgaaataattccattacttaaaataaatcaaacatttatttaaaataatttaatcaatggcaataaataaaaaatttaaatttgttttgtctatttattttagggttaagttcagacccctctggggagagaaagtcgaggattgggaggaaattcccaactaaaatttgtcggaaatggctgggaaatataaaaaaaatgctgcggaacaacccctcataggaagtaaattttttgaaaggtacatatgcctaattttcattctcaaatgaaataatcccaaattgtttaccgggaattggaagcttaatggcagcattggccattagcacaccaattttccccaatttataactgcattctttcctgataatctgtttagattcatttgagttgatgatcaattgttcgggatctagctgaaattcctcaggcgccttgtcggtacatccccattttgtcaaaacattgaattcaagcaaatttttgccggctaaattttcgatttattatgaaattaaaatatattttgaaaatgtataataacataacagtatcttaatattgtgctttaaatgtcaaattttgtggatttttttagtcaaattttgaaaaatttaagaaaaattttgtcatccgacgatgccgataggcgctgccgaaatttttttttgttgcctattttaacgaaatttgttacaaaaactgatacgatttcaaaaaaaaattataataactanattaatattttataattcttccataanttttttttgcattcacaaatttagcttct

SEQ ID NO: 16752 - DNA, 1844 bp, Heterodera glycines
gtcatgattgacattcatcgattttttccaacaaaataatgcattcggatcggaccaagctgtgtattcttcaaaaaggaatccttggtcaaactgcagccccactctgccgtgaagccgataaagccgtcaatggatgaagagactaaacatgtattaattatgaaaaccactttaatttagagtggagctaataacgccattgtttgtatttttccttgagacatttcttaaacccaacgttttattctttaagaaggaaacaaattaaaaaattgattctttattaaaaataaaatttaaagaaaatctttagactgaaaatgttttgaaattaaacctcccgaagaatcaaaattttaaattagctaacgattaaagatttcgcaaattcactcagaaaaagaagtaaaaaatttggaaaaaaattaaatcaaaaagaaattaccgtatcaaatttgttcaaataagtgtttttcgaatttttttttcttgtaaaaatatttataatccacattagttgcattttaaaaaattttgtttttaaattaattaaagcattgaattttgaaaaaaaaattattgatccgattttattggagcataaactcgcagagcaacaaattttcaattttgaatatcaaaattagattaaaaagttgaattattatacttcttttattgtagaagaaatcaaaaattggtataaaagaaaacaaaaaattataattttttaatgtaattgaattgtgcgttcttgcaacatttttgaatttattaattttaattatctttcaagttcaaaatatttattactattattaatttttaaatccacaaatattgccaaaaattcttccatgaaactcaaaatcatcagtgctacatgttttatttacctgtcgtgcagttcagcacgtaacagtggtgctcattgtgttggcatgccttgtccttgtcctctttgtaaatgtcccttacggggtgcgactcgaaccgtgcctttttgcatctgagaaattcgtccgtcgtcgtcgtggttggcgtggtcgttgttgttgaggttgtgcttgtcgttgaggtctaaagaacagagacagtcaagataaagaataagctaattgtaagcggggcctccggcagtttctacaaaaaaaaaatcgaaaacaatttttaacttcaattattttccaagcaaattatttttattaatttttcggtccaaaaataataaatactttattttttgtatttagcatcatttagtaataaatttcaccaaataaagttactttgtaatgcattattttatatacagacctaaaaaatttctcataaatctattggtacgaaattcaatttattttgatggttttgtctctaaattatcaaccctaaacccagccataatttaaaaacagatatttcttactgttaaacaacagacagccttttgagttggtggacaacatccgtttccttctgactgccaccaatgttcgtccggaatacagccaaaaacaccaccacaatgctggcattcaatttccggtgcacaaatttttttctttttcatttcttcagccacaaatgcagaatcatcaaaggatttattttgtctttttttaaattctatttcctaaaaattgttttaaaattattttatttttataactttatcaattttattttagtgtatgtatctacaaattcattccaacgggattatggacaaaaaacactccgtgtttcgagcactttttgtcccaatttatggataggtgtgccctgaaaggggctataacttattcaaaaatgttctaagaaaaattataaatttcccg

SEQ ID NO: 16753 - DNA, 1486 bp, Heterodera glycines
ctcagccccagccaagttttactgcatcgcaacaaacttggtgaccaattgtcattgttaattaactttgtacctccataccctaaccctaacttttcacattgttttttttcttggggcggtctctttgttttcttcccgcccctttgacttaatcaataagtgcccttcccgcttggctttcgctcattattctgtcggatcgatctcgagatcccaacaaatctcccctccagggaacttcacaatgtcactttatattgtccttacagaataaaggatattattattccattgtttaagcactttttaagaattttggactcaataaataaaaatgtgaagaataaccaaaaggtcggaaaagctgctgctcattgtggccaaagcttttgctgccctcaaattggtccattcggtttaattttatttaattttcaattgggaagggaaagcgttgttaaataattttgggcgctagttaaaaagtgacagattttgaattctatcaaaaacaaaattcgaggtcttttaccccaataacccattaaataaattttcatgactatatattaaaaattttgcaaaccaaaagggtctccctcccccttttcttttcactttttgatggaattcaaaatctgtcacttttccctagcgcctaattttgcttttaaaatatttttctttttgggccaattattcaaataaaacaaattttaatgagcgaatgaatgaatattcggcgcagttggaacatcagcggaataattaaacagctgcgacattcacaaaaatatatttgtgggtgttatttcaaactttaaacattttgtatttgaataaaataaattaatccgattttaattcttttaaaaaatcagacaaaactttttaaatggccgccgtcgtcaaataatcatttgaaagaaaaggaaaattacttcaaaatcggagatttttatttcgattctcgttgaattaattcctatttctgttcaagtgagcaaaaagtcagtcgcaaaaaaaagaaaaacaaataaataaaaaaataaacttaaaaatggaaaattaaaataaaatgatttggcaaaaatatcacttttttatctttttgtttcataaaataatatcatttaatttatatggaatttatttgaaaaattgacagcaaaataattgtttttttttattcgggccttattggccggggcttagtccagctgaaaaaatgacaagttaaaaagcatccggaacctgtacctattttctggactttcatacgcctcgcccactgcccaccttcgcacactaaaatttaaaaagttggttcattttattgatgaaaaacagaatgaaatgttacagtatttgaggaaaggatttcggcaaatttaaaattctcacttcatttcaaaaaagaaaagcctcgtttttgcggtcaatgccaatgctttaatcgtcagcctcgtataaatcattgtaa

SEQ ID NO: 16754 - DNA, 989 bp, Heterodera glycines
ttttcgaagatgaaagccgtcgcaatcactaattttttttgttgataaaataggtataaaacatcaacatcaagctcgctcccgagccaactttcggcatgggaacaatcctaaatttgttaacacgggaccgatccacagtcttggcacttgccaatcccgacttcctcggcacaggaccactcccctttcttggcactgggcaaaccttgtaatttttcagataaaacatgctccttacttttaatagtcagtttgagacgccttcccccaatttttccattgactgcgccaaaagtttgttaataattttgtcgagatcgtcgatctgaattcacaatccaattaatcaagatttgttaatttgatcactccgaccattggtaaaattttgagccatttgatttgttttttgagtacaaattcatcaaatgctgctgaaactctcgtcgttccccagcggattttgaggggcaaaaaatgaattaattcgacaattaattcgagtggcaaatttcgtctcatttaaaaataattctgtggaattggctaatggacatggaatgaatgaagagaatgaatggaccacccattatcagttatcaacctcattgacctccattcttgtcgctcgtgccattcgttaattgaccaaattttgagttaacgcattgatttatggcatttttctgtttccattttcaaatctttccgccgactttataatttaaaaattattatttattatacacttttatttttagtataactttattttcttcacatgaattttattatttaaatgaaatcataagaatgaaaatggctattcataaaacggtttttgaaggtcgaatcggtggttttgaccattgccatttggcttttgattctgatcagttggctcctctctctctctgctgatcagctgcctatttccaatgccatcatcaccaaaaagccgaccatgcaaaacaatgagcacattt

SEQ ID NO: 16755 - DNA, 3798 bp, Heterodera glycines
tacgtgtggaatgttccacttagtctgaatggccgggagctcaaaaaaaggctcagccaacttattggactggtaaaaatattttgggaattaatttcatagcgcgttatccaacaggttcgcttcatcgaaacattcgaagcaagtttattaatttataacttaaaaaatgttttgaatttaatgatgaaatgtgtaaagaggattttgaaattcattcattcggaaattcaaaattgggtcattttatttgactgggctgagattttatgtgaatacaattttttcctggattctccatgctctgaataatttaaaaacaattttttctgtttgcgaacaaaaattgaaattttatttacctttttttttgcatatttttgggtttttctatagtatattacatagttcacatttttcttcacattttgaattttaaaatatattcgcaattttttcgtacatttttaattttttacattttttgagtttttgataatttgtagatttttttttattaaatctacccttaaaaatcgatttttcaaaaaggcaccaaatatcaatttttaactaattaggtatttttatggaattgtgttctttctaatttttttttttgtaataaactttttgtccaaaaatcataataaattttttattaaatattttttaggtcttagatatttcgggattattttcttttggatgaaagcattgacaattacattaaatttgaggcatggatcaaaaggtcggacaatgtgctcatcgagttctgttcaatggaatcggttagacgctttgccgtcatgatgagcgagggcagtgttccctttctgtcaagaaaaacggggttccatgatttggctacggtactttcagaattatttgaatttttgccaaataataattgcctatactaaatttgtttcatgtaatttcattaattttgttaattatgtaagtttggtcgccagcaattctttgcacttgtctatcgtgacacgggcgttgacattctgcgcactaatggcatggtcttacatttgttcataaaattcaaaactttcttgaaaatataaaaaatttacatcaagattttggccataaatgacttattggactaaaatttcttcggattgtccttgaaatcatgcataaaaattttagaaatctgaataattttaaggcttgatttgagcatttaacagaaaagcgcatttctttgaacggtgctgggtcgtttgtaagggtatttggtaaagtgttaattttacagatttttcgagaagaactagtacaactttaagcaaaacaattaaatatcctaaattaagttttcttggaatgaataaataactttgtgttctctataagaatattattaattttaaaagtttaacaaaaataaactaaagtttatggtcaagaaagtacaaaaaagcttgatgagtagaatgttttcgttctaacttttctctattattttaaaatttcttgagtttcaaaattttcttgaaagcttacaaattttaaaaatcaaatttttggcggaaagtttttaattatgccaaaatttcaacggtattttctttaaaatactgcataaaattttacttttgttttttgaaagaagaataattctgaagcttttgagcacatatgagaaaaaaatgggcgctttgtaaaaattttacagatttttcgagaagaactcgtactaacttttcttaaacgtaaccaaattaaatattcttaaattaatttaaaactaagtttatggtcaccaaagtaaaaaaaagtttgatgagtcagaatgttttgactataatttttctttattattttaaaatttcagcaaatttcattgggattcaaaaaaattaaaatgatatagaaatattaatttagttgatgagccaattcattttcgtaccccttgccggattcaactaacaaacattgtggcggaagttaactaacgcactagcatcgaaattttcaaaaattaccttattttttgaaatcaagaaattttctgaaattttaatggtttttagcacttatttgtttttgtttaagctggttcttagtttttgttttgttttttaaatgaatgatctaccaatatttcgcaattgactcacttacaaaaaataaaagaaatttcgttttttttttaaattttacactatctttcttcacaaattaatgccaaaatttccagcccccttccgaatggcagctgcaaattcagcggaggaaaaatgcccgtactaatagcaatgccaacgatggcggtaagagaagagtgccatgtgactgtgattttttcttttagaaaaaccgggaaagggaccagaaaagcaagggacgagacttagatttgcaatcgggaactaggacaaacaaaaaaaaagcgattttataaatttaagcgatttaaaattgaaaatttaacttatctcttatacaataagaatagaacattgaacacattgttggcaatttggaagtacaaaaagccaactaattacagtacccactcctaccgtcattttgcgagttgatttgacaagtcaacagactcaagagcggattgtctatgatcggagtgagtgacaatggatgtttttaattattaaatttattaatcagcaaaaaaataataattagataatatcttaattgaaaatcttttaaaatatttattaaaagacaaaaaaaaacgattctttttatggtaaagaagcatttttatcattagcaaatcctcggaacaaaaagcctttcatgaattaaaattctctgtgaaataataagacgaaaatgataaaaatttattaaatattttgagaaaaattatttaagataatatattatttaataaataaaaaatgtaattgaaattgcagccctaataacagcacaagcttatgctttagccgcgacgaattcgtccgcggtggcgccctcggcgcatgggacttcggccgatttgttggcggtgctcgcgcctccccctccaccgccactaaaagcggcaaaacaagaagtggatgtgctaggagggattagagctcgtgaacaaaatactttgtaaagttttttcctattttctccttaaaaatttgtagaattaaattaataaatgataatttttcaaaaaggtaaaagaagaaatcgactaattcgatgccagaagcagagatggctcacgtatgtacaaccactgaatgatttgttggggagtaagcgttgcgaaatgtggacgatttgttaattcttataaatataccgtattttctctaattatcgcccgtctccatttatcccccctttctgaggaggttgaacaataatcccccgtctctatttatccccccggggggataaataaaatttttatctgaaaaattgtatcattttttcaaaaaacaacagtaaaaaatgctaacaaataaaaatttcatccttatctccgactcgatccaactctacatcatcatcatcatcagataggccggcttcttcgtgatcatttcgtccatctttcacagtttcagttgccctaaactcgcgctttttattctgtgggttgacaacgccattggacggaaacgggagacgaaaaattgcggtgcaccccaaaacgtcgtcggccgaaacgtcgtcggaagactttttgaaccataactttgttcactgtaaatcaaattaagaattgttggtgttgttcgatagctctatgtgtttattattaatttgcaaaatctcaaaaattttcgttaagtt

SEQ ID NO: 16756 - DNA, 1904 bp, Heterodera glycines
  misc_feature (29)..(29): n is a, c, g, or t
ttataatttgttggcattatgtatgtttntggtttaccatattttgtaggcaatataatattaagcggatttttcaaaaaacacaaatggaaattgaaattgccgaattcatctcattcatggcaaaatgcacagtacgctggtgctgttacatgacgcgccattgtagtcagaacaactagcgcatgcggtacccttcttatagaccacctcgtccaaccgattgccactgaaacgattaaatttttaaaattaaaaaaatcaatacaaaatcttaggaatatatactataattttataaaataaattatcatttaaatcactttatcgtgtagagaatagttaatttgctattgttgattttgggctttttttccatctggcattgttttattcagcggattttttaaaatttaatataccgtttgattgagaaattttttactgattatttttaaaaatgttataactcttgttttatttgtaaattttttctgatttttaaaattgcccatttcatcgatttttcgggtctttgatcgattttttctgatcacttttggtgcagtatccaaaaagccgaaaatttacaatatcaaatcgaccacgctctatccgataaaaatcttttgaaagtgattttgaaaaattcccttgtacgctagaatttcttgcactcacgttgtgttgtagttgcacacaacccatgtcttccagtcagcgctgggacagcgtgccatggcacagccaatttgagcagtggtggcccaggcttgctgaaagcaacaaacgaagttagagcagtaaaataagtagtggatgaaaatggatataaaacaagattgtaattcgtcttttttttataagatttgtccttatttcatcctatcgtacgggaaaaatttggatttacgaaaaaaatttttgccacccgtaaaaataagcattcattcattttgcctggctccaatgtccgatgcccttgttgaactgttccctgtccagctcaaggctttcctggatgccgtattgctttagctccgcccaccacgtgtcgcaagcttgtttcagcgcatcagctaaaaaacagtgttgatcatgagaaattgtttttttatcaattcggtatccagaaatccatttgatcaaattcattcccgagtaaaggctgtactcaaagacaaacaaaaataactgagactctaagcttaatcttgttgatccagcaaaacccatttgataaacgatttgcaaacacacccgaaccagattttctgaagtccaaatttttccggaaaacactaaaataggtggtaggctttaggctctaaaaaccctaaaaatagtctccaaaaaatggaaaataggctctaaatagtctcaaatttaggggtttaaaatgacaaaattacaaaaaagtaaaaaaattagggaaaacagtatttagctaaataattcttaaaatcaaaaattcttgtcaagaaataaataaattattttgaagatgaatttttgagaaaattttaattacttaagggtgtatttataaaatgttcaggtcgtttcttagtggtgcatttttcatttttattgcatttttgataacaaattttggacaaaacgccaaaataggcaaaaataggttctttcaaaaatttttaggctttttaggctataaaaataaaagcctagaaaaaaggcattaataagtcgaaaagtagcttaacaacagcccaaaaaaacatgtttttcgtgcgtttcaggcaacggggagctcaggaaaaaggcttttgcctaaaaatatcatccctaattatcaaacacgttttcattgcttttaccttccgaaattgacgacgaactcgtcatgtacaaattctcgcccatcccattgcgctgtgatg

SEQ ID NO: 16757 - DNA, 1127 bp, Heterodera glycines
cgtctcatgccctccgtcacatatttttgttggatcaaattactgccagccggcattgtgccggtcaaatttgccgcagttccttgggccagttgtgagcggtaattgttgtgacactcgagcatcaaacccgcggctgtcatcagacagtgccaaaacgaagcatgggatagctaatgaatttctcgaataatttttaaaattttaatgtatattttaatagttaaaagtttcaaaaattaaattaaattaccgatgaatgctgctaaaagcaagcagaaaacgcctttcgaattgaaatatttcatattggaatgaatttaatttggtttattggtggaaatattagaggattatttaatttattatcgatggtgttttaatgaatgatatttgttcactattttttcacgcttaaatacgcaattaaattttattacaacaaaaaaaaattgtttcaataaaatcattttatgaaatttttatttattcaactgaaattcgtaaatggtgatggtttatggtgtcacttttaattatgtaattattatttacccgaaacacggaaacacatcatttttgaccattttcagcacagctttacaaaaaagataaaaaataataagtttaaacagataagcagagaaagcgaaaaacgaaaagaaatgaacgaactgatcaaaagtgtaaacatttaacacatgattacttttaaaaataaaacagtttcttctaacccttacaaatttgcacgggtaaaaatggtgctaggccatttcgtaaaatcggccattttagctattttttcgacaaaatattgtccaatggcattcttgttggtggccgatcatttcgtcactgaggaataatttttaaaaaatgaaatgcattagagggaaaggtattaggcgaaatccctctatgttgatcaggacaacaatttgcgttagattgttgctgaatttgagcagcgagcagcacaagaccccattcgttatctaagagcatgttcataccatttggggcaaaataattgaaattttaaaatatatgtgacattttgccaacattttttaaaaattatttctaagtgacaaaatgatcagtgacgaaatgataggtaacct

SEQ ID NO: 16758 - DNA, 2794 bp, Heterodera glycines
tacatttcgaagtgtttgtgggtaaaattgtctttttttgataaatcatttctataaattgaaagttccagcagagaacttcgaaatccaatgacgaattaatgaattcgagatttcattagtttctacaatcgaagaaaaaattttttaatttgaaaattatgttaataattaggaaaaaagtcgatttttaggggtgtatttttcaattttcttgtatttttattgcaatttttctcaaaaatgccaaaatatgtgcaaaatatgtgccaaaccccaaaatatgtgctaacatattttatgtgacaaaacgccaaaatatgtgtttttatgtttttataagtcgctctaaatcaaaaattgttcggagaaaatgctatttttgggcttctctcgccataactaagccgcaaaaaaaatatgttaaaacataaaaatcctagccctaataatgaatgactagggagtccaaaaatatgcaccaaaaatggcaaaatatgcacataaaaagtgaaaaatatgcacaaatatgcaaaatatgcacatggaaatccatcctagaagcttcaaaccaagctaaaaacatatttttcgtgcgtttcaggcctcccacagtccaggaaaaaatatggatttccatataattggactccctaataatgacaataattaaacgacataataaataacaaaatttaataaaataacaatttatttaaattcggatggtaaactctcccctattaattcaaatgtttattattgaataaatacacaaaaaacaaaatatgcaaaatttgtcaagaataaatccgaggggcttaaaagaaataaaagttaaaacagacaaaaacatttgtaaataatttgtttaaatatttttttcaacaggaaaaactcaaaccaattttgaatcgcgtgaagaaattgacgaattaggccttttgtcaagaattgacggaatgtccaatggaaacgatcaaaatgaccaagagaatgtgctgcaggtattcgtcattaattgtttcatttcattgggacaaaggcaaatttattttttgaaattgccaaattgaagtgatgcccattaattgggcaaaagggctacgaaatggcactgttcattacgctcaataaatcgtaatttgctcaattttctaattggctaatttcccatggcatcggattaatttattattatatttgagacctggatttatggatttacccaatttcaaaataaaacaattaaaaggaaaatatgcccaaagtgtttcagatacttttcgatgctgaccaaatattggccaccagcaaacgaagcggcgaaagtgcgcagagagtggccaatgccattggggccaaaatttttgccacgtcgcacagttttggcgagaattgtgccgttagaattgcgactttgcgaattttgtcgcatttgtgcgccgccggcgaaaaatgggcggtgaaaatgttgcagcagaacatcgaccttaatttgctgaggtacagaaaagaattgtctgcagcctatatgacgaaatttcggaattgtttccaaattttcgctttcattccgggaggggaaattaagcaattgaccgaagttttcaggccttgatttttacttattctttaaatcattggttctcttattttctaacaaaaaatatttccatatttttgcattatgtccatattttaggtccatattttgacattttccaaaaagtctctattagaacggcctccatcagataactttgcgctttaaccactaaaaacgtaaatttttcgaaaaatatttctcagcgaattttctagagagttttacttaaatttattattttctaaaaattgtgtcaaacctttttcctaaaaataataaattttaaaatttatttgtattttttcttccacaataattttttattaccgcattcagccagtttagaggaggttttttttattaaaatttaataaattcaaatttttgaaggttacccctcaatttgaaaaaaaaattatgtccaaattttcgcgtttttatatccacatatttccgagccctaacaataacaatattctaataaatagtgccaaactcctcattcagcagtgattcgcctttctctggtcctctttcccttttagggctctccacgtgcgggaagtttcgccagtcgaacggcacgagtcgctccatttgattggcgcaatgttttcggcactttccgcgcggtccgtttccatcttagtcggctggtggcgctttcggctgtttgccaacaatgcgctgcactttttgatcggtgcggcagcgatcggagaaggcatttcatcggccgaagagttttcgccaaaaaatgcgcaaaactttgaggaggacaaagtgccaaacacagaaaggcattacatttttactcggtttttggtttataaaaacaatttaaattgtttttaaaattattgcccaaatgcctttcagcagaaaatactttgccattgcatcgaccattttgttggagcttttggcccgtttcccccaaatgttcttcgtcttgggcatcggcctcggttggctcagtcggctaatgcacaaatgttttgagacgaacaatgtccaaattggcgcgcatcggagcgcaattattacccaatttgatggactgtccgggggtcataagggagggcgaattgcattttgttggcccaggtaattagcgaattggcataaaaaatcgtgattaaccacactcattattttttggtggttttttgagttttaaaaaag

SEQ ID NO: 16759 - DNA, 2985 bp, Heterodera glycines
tcttcttgagcagatggtggacggtcaggggatcactgtcgaagaaacgcttctcgtctcccgggggaacagtccggcgatgcgatacgctcttcgaatcgttgagatgagaaacgaaaacactttccgatccgttgtatgtgcacgacgctttcattgctttgtgtttgcttgatattctgtgccttaagttccacgaaatcaccatcctgaagaagttggaactgcacgacaacgttttggggctcttttcggctttccgtcatcgccaatacgttggtctgttgcagccgccctttgccgtgcttcaaaataaaattgagcttctgtatcggtgcgtccgcctccaaaaaaattattgtcttgtgttttttcagttttagaaaatccggcggacaaacgcccgtccttttccgagacccactccttggtcaaaaatggaacgaggacgtttccgagtcgtggtctcgtgactttatggtgcagagtggcatttttggcaaggaagccgtgttgtatgtactccatcgagttttggcaggtcgttttattgctttagcaaatagcccatgatttagggatgtttgttttttagggttggactatctcaactctaaattgtttgttcacacaaacatttgtgcctcaagtgtcttcgtggatgaccgttgttctatcaaaattggcgcctttctccacgcacgacgcattcattcaacgcaatgccatataaatattcaccgtagcttttgattttcaggaaatgggaattcactggcgaccccagccgactccccccggaggctttccgcgtcggaagttcctcccaaaacattgtcagaccgaatttcgacacttgggccattgggctttttgtgttggaaatgatcaccagaaagcaattgcaatacacgcgggagcaaatgcgacaagttgccgaacaatttgtacgcttttttaaatttttcgtttgcaatttgaccattcggtcgccttaagagcgacgggtcggagggaccaccgacgctggcggagacggaaccaagcacaattggggcaaacggacagcaggtggtgattggtatttgatggacatcggtaatgattgtcgatttggttgtttttttgcagctgtttgacccgcacatcgattcttttttggcgttgtgtttcactgccgatccctcaaaacggcctaaaccgacagagttgctgaaccattcgttcatgcgaaacaaatgcaacgaaacgaaagcgagaataaacattggaggcgaataattggggacgacacaacttgaagaaggctccccccttttagttgagccaaaaggcgaagtccaatggaattccaaacggagaagcctccgacttgacatgatggcagtgcacagttactacggacagctgaaggagcgcgatttgatgtttgccattctgaacgcgatcaaattggtccgagagggcaccattccgccgattttcatcgaaaaactctctgccgttgtccatgacaaatttgtggcggtcgacgcttcgttggcgttccaacagagcgaagaatggagccgcgacgtgctgaacatttcgaatgccagcccatccccggaggggacaaaacgacttacactcagggaacacaaaacaccgcactgttcaggggaacagatcaacacgggccacaacaacagcagattcccacgggaagaaagggtcggttgtttgaggggggagaggcacctgttgctgagagagtggaaaataggcaaacaacattgttttgtggtttacatttggtttacaatcttatcaccgtttacttgggagcagttccttctaattttcgaggtttttcactgggaaaatattggaatttttcaaagaatttaatattttcttgttttatgcctaggaataccaacgttgtgagatggtgttcttcgtcaaccgaaattggtcaagggaacaccgacaacttttcgttgcttaccaattcgcccgttggttttcccgcggtttgatttggtcggtcctccttttcttcttcaatttattagcgttttctcttccagttttcccgacttggtgagaattgcggacgaacttgacgacattctcattgaccatatgctctgttcggtgccccggccgttctctccctacaaaacttcggctcggaccgccccgcccgactccgttgcgttcatctccggcttacgccggagtttgtacgaccccgactcggtcaaagacccacaaacccacaaattcaacaacatttacgtggaagttgtgctcagtaaaaagctcttacaaaagaagctggtgagttttcggagatggaaaatcatttttcgtttattttaaatatttaaacctttcctttaggacaaattcaaccagctcagagagggcgaccccgtagaacttccgcaaaatgttgatccgctgtgtgcctcggccactttctacgacttgaacctgcggcgactcgacgcgatggaagcggtgcttttgggagagcggagagtgcgcgattgggtgggaagagagcagaggggggaggaagtgggaatggtcatgagtgagtattcaccaaggatttcaacccggaccaacgctttgtcgactcgacaagtccgagcacccaactgaccacacttttgaacgaacgtcgaaggaatccaaatgcgaagttcgactcggagatcagttgggaggcgagcaaccaggcacgacgtgccaagatttgggtttgccattttttgtaaatttcgcaaaggatggacatttcgttcagggggattacacgcgcgacttcatgtaccgttttgcacgataccacgtcccgtacaaggcaaaccgggaaaaccctgattcgtttattcacaatcggattcgagaattgttttagctctctgaggattcttccgaaaaggtttttgacaggccccgaatgcattcgtcaacagaagtgttggccat

SEQ ID NO: 16760 - DNA, 1151 bp, Heterodera glycines
agcttgaggaactgtgcgtccatttccggcagtccgaagcgagttcgccaagtccacccagaattgaggagagccgtgccgacttggaacgattcccaaaactcaagcgttgacggcctctaactttggcatttggtccatctcaccgctttagatataaaaatgacctgtgatcaatgataactgataatggcataacgccttttttaaattttattttgttgatttttcgaaccttaattaaatgtacaaaacttcgtttcttatatttttttataaacatgcaaattaacttccaaaaaactcatgtagggcgaatccttattcgaaatactctatttttgctatattttgacaaacttttttggcactcgaatgaattttgttagccgttagaaaaatactaaataaattatgctaatgttttttgactactttagatcgtttgttgaaagtgacagggacaattaattctatgcttccctcgggtttggtcagggagcttaaggtttggatgactaaattcgtttttaatacttcgaacgaatgcctttttctcccatttgggcctcaacttccgcttgggacacttttggtggacgcgcggcgaaactctcctcgcaattgcaccaaatggccgccgcttttggcgcttttgtggacgcactgcaaacgatcagtgacagtgccaacactgtcaatggtaatttagcaacaaaatgagggacggaattatcagaaaatgccgagctttttgggcacacgcctttttggccgtgataaaaccattttatgaaatgggttctagaagttcctctcgtgtttcaaaagtgcttctccttcgtctgttccgcaggtgtcagccgcgacatcggtgccgcgttgacgcgcttttgcctcagacaacgcgcggtcgaaacggcgattcgcaaatggggcgaaacattgcaaaagcattgtgccgacggtttgggacgaaggggcggcgagtggcgccaaacggtgcgatttcattgcattaaatattcaaaccatggctttgacatttccctaatgttgttcttattatatttcaatggtttcacttttttgaggatcgatcaaagacaaccatttaagttggattgacgctcttcttaaacatttgtttt

SEQ ID NO: 16761 - DNA, 2929 bp, Heterodera glycines
ttttgacaatttcaaaaagacagtcgcttatgtcttgcgctagaacttcgccgagttggtgcccttcttggcttacatcgttttcggtctgccccttccgctcggcaccatcacaatgctttgcatcgatttgggcactgacattgtccgtccgccaaactaattaggagcaaattccacctaattatttacaactaattggagtcaaatccacttaattaatgacagatcccatcgattaccattggctacgaaaaggctgaatcggacattatgaaacggcccccgcggcaaaagacggaacggctggtcaacttcccagtgtttgcgctcgcctactttcaaattggctttatccaaggcacaaattatgcaaaaagtgaaccaattaatcatttcttccgccccaatttttaggaatggccggctttttctcttacttttgggtgatggccgataacggatggatgccaatgcgacgtaagcattattttattttaaaaaattcaaaagtggttttttagtgttctttctacgaaaagaatgggactccgttggcgtaaacaatttggaagacagttatggccaagaatgggtaagacatggccaagtgggtaattaatggccaaggatgggtaagtcatggccaagaatggataagacatggccaagaatggataagacatggccaagaatggataagacatggccaagaatggataagacatggccaagtgggtaattaatggccaaggatgggtaagtcatggccaagaatggataagacatggccaagaatggataagacatggccaagaatggataagacatggccaagtgggtaattaatggccaaggatgggtaagtcatggccaagaatggataagacatggccaagaatggataagacatggccaagaatggataagacatggccaagtgggtaattaatggccaaggatgggtaagtcatggccaagaatggataagacatggccaagaatggataagacatggccaagaatggataagacatggccaagaatggataagacatggccaagtgggtaattaatggccaaggatgcgtaagtcatggccaagaatggataagacatggccaagtacgggtaatcaatggccaagaggggtaattaatggccaagaatggatactttttaattcgcttctttgtcccatgccattttcagacttacgaccagcgcaaagtgctggaggcgacctgccagacagccttcttcatcgccattgtggtcactcagtgggccgaccttctggtcgtgaagacccgtcgcaactctttggtccagcagggcatggacaattggccgctgaacttcgcgctgctcattgagacggccatcgccgtgttcctcgcctatacgccgggcgttagccacggactgaacatgcacggactgaagtggccatggggcggcgaaatgccaaagaaattaatttaaatccccaaaacgaatgaaggttcgcctggtggttccccgctttgccgttcgctttgtatctgttcaattacgatgaaatgcgccgcttttggattcgtcattggcccaacggatgggccaagagggaattgtacttttgaagaagaaaaaagtgggggaaagcaaagcaaagcgagaaaagagcgacgacgattagcgaactcattaaaagcatttaaacgcatagaaaataaaaaacaaataaaaatgtaattaatgaacaaataaaaatggagccaaatagaaatgaacatttaaccaaaaaaatataattatttgaaccattaagattttaattaatgttgtttaaatgattgaaaagaggttggggagagagagggaagagaaagaaagaaataagaagaaatatggggaaggagagacgagcagagaaatgggaaaagggaaaagcattgggatgagaaagggggcggggagcataagggaggggggctgcgcataatgtttgaagtacactgatctcccgcttccatggcacatttttgccatcactttttcgtcgagaatgctttcgcctcaatctctgccccccccccttcttttctaattacctcaataaacatcactgatcatgctcatcgtcagaataaacagtactgccaaaaggcttttgaaatgatcactccagccacgtctctaatgtttgcttttcgattggctctctctcccgccactccccccaaaaaatgccattttctgccaatttatctctcaccaaaatgccaatgccatcgtcgtcatcacaaagcatcacgctcatcatttctttacaaatttatttctacctttaaatttaatttattgctttacagccaatgttcgcaagtgatgaatttgcctccgtgggactcaatttgctgttcaatccgtccctttttctcaacaaatttcgcgaaattgaaccggacaaatttcaatttccaaaattttcgctggtatattttttttaattaaaagttattctttatcttttggtcatttttatttaagccatccaaaggatacgaacagaaaacggagagaatgaaaacgaattggcaacaactcttacaatcagccatttttgcaggtatttggcctaagctgaataaataataaaaataaagaaaaagaaaaaggagaaaaaaaaacaacgggtgaaaaatgaaaaaaaaattgatgaaaaaaaaaaaaaaaaaaaactttaaaaaaaaagtaaaaaaaagggggaatggaaaaaaaaattttgtggaaaaaaaaaaaaaaaaaactttaaaaaaaaaaggaaaaaaaggggggaatttaaaaaaaatttttgggaaaaaaaaaaaaaaaaaattttaaaaaaaaggggaaaaaggggggaaataaaaaaaaaatttttgggaaaaaaaaaaaaaaaaaa

SEQ ID NO: 16762 - DNA, 224 bp, Heterodera glycines
aggagagagtctttagagagagagtgaggcaaagggggagaatgagagagaaaattgatggagagaaagaaaaagagagagactttagagagagagtgagacaaagggggagaatgagagagaaaattgatggagagaaaggtttttagagagactttagagagagagtgagacaaaggtgatatttaaaaggaaaattgatggagagaaagaaaaagagagag

SEQ ID NO: 16763 - DNA, 1028 bp, Heterodera glycines
acactaattttccatcgagagagtctagagctatagcgttaacgagtgaccgcgtcgagagagacgagaataatggccgagagtgaacgcgaaagtcaagaggacgaaagagtgaaagttatttaagtggacattgggagaaattgtgatcatcttttacaacaacaaaaaagaaaagattattgcgttgaaagaaggaatggtcgtgggcggggagggtcgatcagctgacagacaaaatgttagccgagagtattcttgagaccagccaacctatctcttggatttggccaagtttaattatcgcctcgcggcattttgccattgtcttcgattgctcttctgtcctgcgttgtccatcgtcaccttccatttgatcattttgcctctttaatagcctttccatgtcccatcgtccctttaatttccaaattccccccccccccttcgtctgttccagcagaaaaaagctttcaagcggagagtgtgcgcatttgtccgaccgctccgcattgagtccgtccccaaaacgaaaaaagtctccggccaaaaacagcagcaggacctcttccgcccgctcctccacaaatcgcatgactctcgacccttcgcttcgtttcccttcggccgcccgatcggtcctctcgagacgattgatgaggaggacgacgaggacgaatggtcaattgtgttcacaaatcatgcttgttgtactctgctgatgaaggagatgaagccaacccccgccatagctaattgaggacactcattttgtgaaaataaattaattagttttaattaaggagttgaaatcctgccaaaattggctgaatattcccaaatttgttcttgtatttattggtcaccatcattcgctattgaaatgacaacatttgtgccaattataaccatttttctgctgcttccgtcacaaatcgtgccaatgaaaagtgccaaaaagtctttggcctcttcaaacagtaaaaacggtgcccagcaaaaacaactgttactgtacgacttgaatt

SEQ ID NO: 16764 - DNA, 1908 bp, Heterodera glycines
  misc_feature (15)..(15): n is a, c, g, or t
agcaaaataactttnttaatttgttgaccaattatattcgaaggctattaacaagctcatttgctttcctaaaatcactaagatataccgccatgtaaacaaataataaataaaatatttctgactttttttgcggtttcgtgttgcagcttttataaatttttaatcgcttttgggagaaagggaaagacgaaatgccaaggcagcaaaaaaatagacagggaaaaaacgaagggaatattacagaattttactgatttttggtgatcgaaaattaccgacgaaattgataaacggcacatctgagctgatcgcaaaaagaatctttgcccccagcgggtggaaattgggtcaaatgatcatttattatttgtgtgattatatttagcttaatgcatccaccgtggcaatgtttatccgaggcgcaccgcccgaaggcgaaaagggcggcggtaacgacatcaatcagctaaacgcaattcgcgaccggcgacaattgtggcgcaacgcgcgcattccgtacgcattgagcagccaatacagcagctacaggcaaaagcacaaatcaaaatgatggaacaattgagaaattatgcgatgaattttaagcaaaaagaaaacaaaataaaataattattaattaattacatatttttaatttagtcgttcagtgatcgcatcagcaatgcaggaatacggtaatagtgcaaattaatcggaaagctgcttttcctatgtatcgaacttaagcaatgaccccaaagagcacaaaaaaaagaaatttcattagtattattttttgttggttaattgaattcaatgtttgaaatgtgtaaaatttaaaaaaaattgtttcaaagtgatttagcaaaaaacacgtgcatccaatggacgccgaggacagcagtggacaacgattatgtgtacattgtgccggagaggggctgctattcgatggtgccaattgttaaaagtgtcacataatttgaaaaaaatttttgaaaaggtcggaaggaccggcggacggcaaattctttcactgggcaatggatgcattcaaaaaggtgaacggagtgtgccatggcatgctattcatttgctaaattcaaatgcccaatattaaaataatacggcattctttgcggatccattggagcaaaagccaacatcgatttgcttagcatacaccgaagaagggggaattgatttatcatcgatgcttaattaacttaaaccaatctttttaaattttttaattattaactaatgcaaaaagagaagagctgtcgctgacgcatagaaaattttattaaattattatgattttttcggaattgatcaaaaagtaaaaagcattttgtctcattgtcagggataatcatccacgagatgatgcacgccaccggctttttccatgaacagtcgcgcaccgaccgggacaatttcatcaccatcctttggcacaacattctgccgggcatgcaaggtgaattggggaaaagggaaaacaaacgggagctgaattcaaataggcaaaataaaaacgatgtttttttaaggaattcacttctttaaatgattttttaaaatttttaccgtaaagtattgccaatttctgtgaaaattccaaatgaattgaaggacagttcgagaagtacagcgcggccaccattcaaacgttgggcagtgactacgacttcggctcaatgttcggattggcattttaaaagcaaagacaaattgggcgaaaaactctccaattaaaattaattgcaattatttcttgccctcaaatccgtgctgttttttcagcatgcattatggccccaacgcgttcacgcgcaacggactgccgacgattggccacggagaagagcgacgattggccaacggagcggatttagcaaa

SEQ ID NO: 16765 - DNA, 976 bp, Heterodera glycines
aggaggtcaaagtccgaggagaggatcagttgaacatcgttcattcaaaaagtaacaaaaaataacgataaaaaaacatttcgtgaattgaggattttgtcaacgaagtaggcaacccgaaaagctcatatttcagtgtaacgaatgcgggggatcggagggaaatttccgatgggtttgatcagatcacacctcgtccgccccaatggatcactggttcatcgttctcgatgtgctaactgtttccgccggtgcccaatcccttcgttttgccgattccgccagatgcaactgttgtatttggtgataaatacgattgcaatggaggccctgttgttccgttggcgatgaatcgcgcagcaaaatctgtgacagtgcccgccgattcggagggttttagctggtgggctgcgaattggtggtgatgaagactgctaagagaaggaaaagatgccatcgaagaggccaacggctgctgctgtggcccattcagaactccgttcgaaaccacctcaacagataatcctttcattgtcagcccaccaatgattgctaattattaatggtaatctcaattcacgtttgatgctgttatgctgaacggagtgccggctccgtcgggcatctgcgaatggtttagttgagaaagttgttggtagaattgagcctggatggatgctgcctgtgggtgtaaatggttgcttgaagagagtgagctggctgaagtcgttgcctggggaatgcagccagcctaaaaatgcaatcattagccttttataaatgcatttgaaatttgtctacttttgacacaaaatcggcagcattcggccgataggtcgcagctgcggccctctgtgactgctgctgttgttgaagcagactcggcgcattactggcgacagtgcttgtgtttggttgaagccgaccgtgctgctgttgttgctgatcccgagttgtcgatgatttcgctgatgat

SEQ ID NO: 16766 - DNA, 1358 bp, Heterodera glycines
  misc_feature (64)..(64): n is a, c, g, or t
  misc_feature (119)..(119): n is a, c, g, or t
  misc_feature (179)..(179): n is a, c, g, or t
gtagacgagcaaattcacttcatcgctgttaaatgccatcctttttagtcgtcttcacaacttnggcggagtatttctatatagttaatggacgcgaaggaatgccgtacaaagggggngcataagacaaatttacgggttgcaaattcagacgaattctttagaatgtttgttagatntaatagaacaatggaaggtcaaagatgaatgggtcaatggttatgattttgtgagtgattcgatgtgtgacgaatggagagcaaaagaagaatggcgtatttgaatggttgataattataaaaacaatttattgtgaacaaaaattgaatttgtgcggagtaattgagtaatgccctgagctgaaactgcaaaaattaatcggttaaaatttgaaaatattttctaatttaggtcattcattattaagctgctcattaaccttctcatttcaataatatgaagcttgagaaaatacgtagccctaaagttctgttttagaaagcgacggagagtaagtgaagggttcggggagaaaatacccgaagggataaatgtgagacggtccctagacacgacgatggggcagaggagtgaagggatggaggacacgtcctccccagtgtagaaaggctcacaagggaggtttttaacgacgacgacgacgattcgggctgacgaatggagtgcagagagtgtgctgcagatggacagcagcctgacgagcatagatgttgacatggaaaggccgtgcagacgcatgtggcagttgaaggcagcagacagtcagaagggaagagagttgcaaagggagagaagcgaggtgaatctaagggcagagaacaagtgacaatgcctacggaaagtgcagcccatttgagaggcggacttgggctgacgacgccccaggggagcaaaatagcagatgaggacagagaaggaaacgcggaagagaaaggacgggagcagacgacgatagtgaaaagagagtacggaagcaagacgacgagaagaattctgttcgtccgtcgattataagtcggagcggcggcttaagatgaatagagcaggaggatgtgggagaaaggaaaaaggagagaattggggtgggggtgggaaatccattcaacgattgtgctaaggcagagaaggggaagaaaaacggggaccatctcaaaaaatgacaaattaaaatttgggaaatcttacatttcgcctactaaggcaaaataggacatttcgcctataagctaaaaatcggtcattttgcctactgacatttcacctactcgaaatttgcctactaaccgagaatcagacgtttcgcctacggtattcgcatgctgtggaaatattattac

SEQ ID NO: 16767 - DNA, 1467 bp, Heterodera glycines
ataagctaaaaatcggtcattttgcctactgacatttcacctactcgaaaattgcctactaaccgagaatcagacgtttcgcctacggtattcgcatgctgtggaaatattattactagggacgtgaattttaggttttaactattttttttgctcaattgatttgaagaaaggagctcaaaaaacgcatttccgcataaaaatttttcgattctgatgtcattatcggtcactagaaatcactattttgggattttgtcactaaaatagtgaaaattcactattttttcactattttgacatttttgggcaaaattccttaacaaaaatgcaataaaaccaaaaaatacacccctaagaatcgacaaaaaaaaaattcgaaaagcactcctaagaaatgaaaaaaattttctcaaaaaggtattttcgtggcaaaaatttttaattttaaaaatttttttaggtaactattttgggttttttggtcttaaaaatcccagtcctactcatttgcaactgcaatcagtgaataaaaattatttttgctcaatttttggctgaaaattatgtcactattcgtcactatttcggacttttgtcactatttcttcactattttggcatttttactcactattttagttaactattttggcatttttactcactattttagttaactatttcgggatttttcgtcactaaaagtcgcgaccctaattattacaaaaaaaaaaagaattagaaatataaaaggatataaagcagggctcccagatctgaggatttatcctcattttgtggttttttgataggtcaatgagggttttttttgaaatgatgatttgaggatttttgaggcttttggggaaaatcgtcagaatcttttaaattttgataaattttaacataatgtttgacatttatttaatttgaattttggtttttacataatagaatatcaaacggaaatctcacccaaatttagccagaaaattacaatttttcgaaaatccacaaaattatgaattttttaaaatgaaaatctgctaaaaatatggtcaaaattctcaatttttccaacaccggcggtgccggacgctaaaaatccttttttttaatttgctcaaaattgcaaaatttggccatttttgtggacaaatctgttaacaaatcacattaaaaattacaaaaatcttcccggcggcgcctatcggcaccgccggcccccccattccccaagttttttggaaaaagcgccgcaaaaaatcaacttcgatttttcatgctcagaatctcacaaaatgcttatttctaacaaaaaattgctcaaattgatcattgtcaatcaaaaatataacatttgaacattttaaacgttttgaataaatttgtaaaaatgaggctttttgacccaaaatgaggcgtttttgcctgccaaatgaggcttttgaaaattttcatctg

SEQ ID NO: 16768 - DNA, 943 bp, Heterodera glycines
atgcacaatggtaattaatggttttttaaaaattataattaaattaattaatttgtttttttttttaaattttcggtcgaaatgagtgcccctctcttcacattgttcacctgttttttgttcgtcctctgctatttggtcccattgtttttggtcacatttttctacaccaaactgctctcaaaactgtaccaacatgcgcgacaatttaaagtgaaaaaatttgggggagaattttttaatttttaatgaattaattaaaaaatattttattttgggcactatttaaaaattaaaaagcaatggggtgaccctattgatttgcaaaaaagccgaaaattaagaattttttattttatgattttttttgcccaaattaggttgggaaaaaatcagaattgattcaaatttatgccagatttgtgatcagggaccccaaaatccaccagtgaacagattttcatttctaaatctaatcaaaagagtgtcccccctttgttttttttaatataattaaaacattaatcactttataagtagcgcctttatttttttttaattggaaatatttaaaaataaattaaaaataatattcctttaatttatcagaccacaaaattccgttcccaaatcccactgatgaggatttcgttgtacaccttggcggtcgcctgtttctacttcatttgctggaccccgtaatagaaaaaaaatcgcttttaattttaatttcccaatttttagcttttgggtggccacggcatttgccgtttatctggaatatgccggtgaacacaatggtgccgtgccaccaatattcgtctattgcatgtgaataaaaaagaaatttcttagctctttaaaaaaattttttttgtttttttaggtatttcatccatgcacttccgttcacaaattcagccatcaattggattttatatgg

SEQ ID NO: 16769 - DNA, 3163 bp, Heterodera glycines
  misc_feature (3067)..(3067): n is a, c, g, or t
  misc_feature (3078)..(3078): n is a, c, g, or t
  misc_feature (3082)..(3082): n is a, c, g, or t
  misc_feature (3128)..(3128): n is a, c, g, or t
  misc_feature (3144)..(3144): n is a, c, g, or t
ataatttcataattcattttttatttttttttgacaattttaatatattataaatattttctgaaacattaaacttttgtagcctgaaaatttttaaataattttaataaattttctatatattataagggttgctatcgtcgcaaatcgtcttcatgctccatgaatgtgctgaactcgttgaactcctcaactgctgttgatctcgagggtggtggtggtggtggatcaattaaagctgcttatgacttgacacaagaagttctggaaaaagtatcagctgctgtagttgctgaaaaggagcaacaccaacaacagcagcaacaagttgaaggagtacaaagtgaacttaatgaacaacagcaaaaacaacaacaacaacaccaccaacagcagcagcatgaggacacgtcacaggtgttaaattaatttaattaagaggtgggattatccccgttttcagcgtcctcgacaattttcagtttcatattgagggtatatttttcaaaaaaattcataaatttaagctaaaaactaattactaaatttattaatttttaagaaaattgagtacagactttaaaatttccttttagacttaattttagaataaatttccacttttcagaaagctaaaaaattgcttttaaaatttatcggtccttagaagtcaaatgacctctttaatagaggggtccttttttagtggggtttcaaaaaagcaaaattagcgcgtaaaatatgcaaataaatttctttttttttaaatttcagctcccaaattgggccacatcatcgtcagctgaaacagaagccaataatgatcactttccgggtgatgccgatgaggacgaagctgcgattgtacatgagcaaacactgttgctgcacagctcggactcgatggacctgttgttgcgcatcgattgcgaatcgaccacatatctttgaacacattacaaaattgttgcttgtgcagttcgagaatctcatcattttcgagttatgatgatccaagaaaaaaattctgacatttgggagtctcgagcatcactaatttcaaatacatcagcaggcagcaaagggtggcgaaagacgaggcccgaaaaccgaccccccaaaaatatcggaattccgtgccaccatccccatccctggatggcaccttctgtacatatatagttgggaaaacaaaattttggaaagaattggcaaaatttcgacgaatttctttcttcgttttttttttgttgaaaattctaaaataggacagcctccaaaaatatgtcaatgcccatatgtgtaattattagggttataagttgtatgcttttgcatattttttctgcgcatatgctatgaagaaaggggctcaaaaatagcatttctgcattaaaattttttgatttggtgaaggtttttagtgcatataaaagcatattttgggggtttttgagaataagtgcatattttgccatttttacgtttttagagcatatttcggtcatttttgggaaattttcacaagaaaaatgcgaaaaaaacgaaaaatacacccctaaggatcgactttttggaatttaaaaaaaaatacacccttaaaaatcgaaaaaattttttattttgtaagactttggaaaaaaaaatttatgtatatgtaaaatgtaatgttgttttagcatataataaaatttataaatttggaaatttcaatatttttgcaattgtctaaaaaatgctccttagccattgttttggtgttttaaaagtcaattcttaatttatacacaatttttggcattttttgagggctaaaagccatttttggcagttttttaaggcatattttagtgcatatttgggcatttttcgggtttttagggcatatttgggggatttttagtgcatataacttataaccctagtaattatatatattattcatcgccatcctgctgaacacttaaattattttcatttttaatttgctttctttaaatttatttttgtatatgaataaattaaattttttaaacaatcaaatatctaatcaacacaattcatcgcataaaactcaaaaatgatcggacaattctcacattttccaaatgctaaaaattcatttccacataattagacgtcattttcgctgctttgactcgcttcttttgctgcttccgccggtggagaaagaggcctaaaaattcaatgaaatttaattattttcaaaacaaaaaggaaaatctgttaaaataaatggacaagaggaggggggttagaacaaaattgaaaaaaaaaattttttttttgatacgaaaaacaaaaatgttattgggtaaaatttttacgaaaattatattttgtgggataaaaaaacgataatctttctatttaattgaacccttccaacccccagcctggtagattttctatggttttgttgctcacccaatgcaatttttgccttcactaagatgaaaatagacattgttcaatttgttcgcagaatttccatcttttttcttctgctgctgctgttgtttctgaaccgtctccgccgtctccccaacaatagtaattggacatcgcttcaacagccaacaacgagaagagccaatatccgattctttcttcaatgtcagcttttctttagtctgttcgttcaccaattcaaatggttcaattggcatcgtcgtcacgaaaaaagttaagcagacgctgtaactgacagaagtgcgggcacggacaaaaacctaaataaaaatatatgtacaatgtcaaatatgaaatgtgacgacaaaccgacctccttgaaattggtgagccattcaaagtttgtgggtgctgatgtcgtaaagttcaagcaatgcaatgactttggttggccatcttttctcggattgtgcaaccatttggacaacgtttggccggcagaagtcgcatttggtccaccaaaatcattatcagcaagcacatcgggcaacagatcaccaggtaggattgaattcaactgatcaagatcggatagaattgttggcgaaatgagtcgacgcaaattgtccaaatngtcgacattgngaanagccaatggcgaaatgttgtcgcaaaaatggccatatttcagcgancaaacatcccaatcgntttgtatcttcgttttttt

SEQ ID NO: 16770 - DNA, 2952 bp, Heterodera glycines
  misc_feature (2938)..(2938): n is a, c, g, or t
aaagcaaaatggaggagcagagaagtgatcagaactcatgcaagtcggctgagcacaaaagtgatcaaagcaaaagcaaggagcagagaagtgatcagaactcaaggaagtcggctgagcacaaaagtgatcaaagcaaaagcaaggagcagcgaagtgatcagaactcaagcatgtcggctgagcacaaaagtggtcaaagcaaaagcaaaatggaggagcagagaagtgatcaaaactcaagcaagtcggctgagcacaaaagtgatcaaagcaaaagcaaggagcagcgaagtgatcagaactcaagcatgtcggctgagcacaaaagtggtcaaagcaaaagcaaaatggaggagcagagaagtgatcaaaactcaagcaagtcggctgagcacaaaagtgatcaaagcaaaagcaaggagcagcgaagtgatcagaactcaagcatgtcggctgagcacaaaagtggtcaaagcaaaagcaaaatggaggagcagagaagtgatcagaactcaagcaagtcggctgagcacaaaagtgatcaaagcaaaagcaaggagcagcgaagtgatcagaactcaagcatgtcggctgagcacaaaagtggtcaaagcaaaagcaaaatggaggagcagagaagtgatcaaaactcaagcaagtcggctgagcacaaaagtgatcaaagcaaaagcaaggagcagagaagtgatcagaactcaaggaagtcggctgagcacaaaagtgatcaaagcaaaagcaaggagcagagaagtgatcagaacgcaagcaagtcggctgagcacaaaagtgatcaaagcaaaagcaaaatggaggagcagcgaagtgatcagaactcaagcatgtcagctgagcatcgaagtgatcaaagcaaaattgaagaaatgtggagtgatcaacgcaataatcaatttgaagataaacgaaaagatcaaagccatgaggaggagatctattatgagaatcatgactatcggcagtcctatgacgatgaatttgaagaagaaattgacgactacgcgcacaaatcaaatgattacaattttgagccatttgatcagcaggtatttcaatggctatttggtagagactgagccgggccctgtacagatttttaccggaacctgtaaatcggtccggtgattttcgggaaaattccccaatccagtccgactgatttgaaaatattggactcttttttatctggcttgaagcatgatcaatcagttttctacatcttcagaatgaacaaaccgattggtggagtaagcaatgggaaactgatcaaggaggatcggtggactttcaaaatgcatttttgggtcataaatcgcaaaatttcggccttttttggtgtgtctgtgatgccaattgtccatttgcttttgtgtgtacgccaaatggatgccgtaaatcaaaaaaaaatcttttccaattaattaattgaattttattccagaaaattcttcaactttactcaatgtggatggcaaaattggctttgtccactacaaatacggtggacaaaatggagaacattcatcgaattccatgtacctttagcggtttatagaacccatacttttgtaaaaatccggtaccggaattcaggattggcatcaggccagggtaggattaccgcgatttgaatcccgacaccgggactcaattccgattttgccgggacccagatccccggcccttttttcaaaaaagcctcgatcgggaccgagaaaattccggcgggatgccgatccctttcgggctttagcagtttatgtgccaaaaagacttaattttcaaaaataattttttaaattagttttaggtatatcctaaaatgggcaattaatttgattaaaagttttcaatttttattgcctttttttgaattttcagtcactcaatgagcagtgaaatggacgaaaattcgttcttgaaaaattattggactcttcttggcccgtacaatcgcttccatcaaaagcatgaccatttgaagattgtgagtggaattcattattaaatgaggaaaagcatcggtccattcacatttttaaatgctcaatcaaatatttaaaagtgccagcggatcaatttgaataaattgcactgatttgagcattttgtgccaaaaactgactgttattatgaaattcttggttctattccaattcacgctttcgtccctcattttcaagataatctaaattttacctttaaaattcatttttttgaagggcccagcagatggcatcattcaccaattgttcggcactgaaacggccgatcatttccgcctcaaatcatccgtttggcctttctacaaaacactgatcggagaagaccaaggaccactaactgattcaaaacttccactgctggtcatccccgacaatgttgtccttttcacggcaccaaagcctgcgcatcatcggatcacggacaaaaaaccctctactgctgaagaagtgatgccgccggttgaacaacccaatttgttcaaaatgatgataccgttttaaaatttgaaaaggatttgcaactgaaaaagtgtgaacgaaaatgaatttatacgatatttttgagccggtaaatgcgtccactaacacagtatttttcaaataaacttctgctgtagattagtagaaaaggtcaaagtgtgcacgaatcacattatgattcaacaattcagtttttgaaatgtttaaaaaattttaagaaaattcgaaaaagaaaaaacatacagtaattgggtttttgtaaatttgtttcacatataaaatttgaaaaattactaaaaaaaaccgcgtaaaaaaaacaaatttaatgtattccatccactgactcattttgggcgccggacttttcgacagcaaaggacatttcgacagaaatatttaaaagttgaggaggngatttttcgacagt

SEQ ID NO: 16771 - DNA, 1135 bp, Heterodera glycines
  misc_feature (61)..(61): n is a, c, g, or t
  misc_feature (88)..(88): n is a, c, g, or t
aaattcgatgcaattaaaattattaaatccaatttatgccaatctcttttatttatttttngctttaccagtgatcgggatcaattcnatggtgtgacacgtgtttgtcatgaggctggaatttggtggaagaaattttcgccgattttttttaatttaaaaaaattctttgccttaatgtccaggtcacagaatttccagatcaccgggtacacgtggcgcttctcgtcgtcctgctccgcctcgttgatcagctgctcccactccaagttgtgcagctcacggcgctttttcaactctttcatcacctggaaaaatttttgaatttttttttgaaatttttgacacctggaaaagccagtcggccattcggcccgggaactgggacatcagctcgtccgtgcactcgtccaactgcttgcattggcccaaatattccagatgaattttggcgttggacggattctcacagctgcaaaatttagggggaaaatttttttccaactagggggggggggtaggagtgaaaaatttaaaaaaaatttgcataaattttgaatgcccaaccaactcagtttcaaagtcactgcgctttttgcacacacaacgctggcgatagaggtggcacagcgaggcgaacgtttgattgttggagccacagacctcaaaaaatcccaaaatttttttttgaaatttttaaaattttccgttaggcccatttttatgctgtaatatctcttcggtaatactttagctggtgggcccgctttttggaaaaaattttttttcttataaaaagtcgtgaaaacatgtttatgtgggttttcggggtcggggaacccgaatcccacattcattttaaccaatttcgaatcctaggcccgaatttgagcaaaaatttgaaaattcaaattttttaaaaattttcatttttgttcctaaattgatcaaatcaagctaaacttagtaaaaaaaaaccattatcatcaaaaaatggtcattctttagatacgaacataaaatgaattttgaaatttttgaattttcaatttttgtttgaattcgggtcagggattcgaaattggtcaaaatgtttttccaaaagggggcccaccgtctaaattgatcacatctg

SEQ ID NO: 16772 - DNA, 1601 bp, Heterodera glycines
ttaattctctgctgaaaagaatggcaatgaaagaactgtatgtactgcttgaacaagatggattgacctcccgtttttcttcccaaaactttgattttctcatagaattccgaaatcattacaaccacgagggttacatacataaattttcccacttccttccctctatgttaaccgctaatgtactgcttgaatttgatggattgaactccctgtttttctgccaataattttgattttctcatagaatttcaaaaaaaaaaaacccctagggttacttatatacataaatttgccattttctctccctctaggctttgtaaataaaatttctttctccccgtcccccaaaaatgccgtgcctggtcaagcgggtcattgtccagctccgggcacttggtgatgcactcgcacaccgggcgccccttcttgtccaccacgcactccttgccccatccgcacacgtgctgatcacacgggtttggctcggaggctgaaaatttaaaaattttcgaaataatttttgaaaatttaccccgtagctgatccaactgctgttggtcgcgctcttggcgcggttcggcgccgccggcgccggtgccggcggtgcgactttcgtccaactcatccaaaatgctctcaagttcttcgagatcggcctggaaaatttaacggaaaatttaatgagaatttctcaaaaaaaaacctttttggccaacgccaagccgacgacgaacagcagaaacaataggacaaaacgaagcatttttaggctaatttatttacaaaaaaaaatattattttcttttttgtgaatttgtttttatttgcagaaaatttctaaaatttaattttagttaaatcaattttataaaatttaactcttaataaaggataatttttggtatttgatcatcaattatcattttctgatcatcataaattattcaatcgcaactgatactgatcaaactacgaacaatgctataatttagcttagaatttgtattgaaatgatgtataaattttcaatttcgaattaaactctcgagtttcgggaaaatttcggcatctctcaaacatatacaaccctagttttgagtaggccaatataattcatactaattgtaagtgattagacagttgattttttattttcaccaaaaatccaaaaaatcactctccccgatcattttggcactgaaaatttattgctcttaatttcatcctaaaatttgggaggctaattggcggaggataagcatgcagcagcacacaaatcgatgaattggatatgaatttgtgtgaaagctgttttgtgattttgtgtgacgacgattgtttgttggagatttagtccatctccgtccgtccgtccaacaaaatgctttttctcggccgagaaaatggcttttctcggcttttccttcgcttggcctccggcagccacaccaaccaaccaaacaacagctgtcacgatgtgtgatgagaagaaaaagcgattagcattaacatcccatcacattttgtggaggaggataaaaatgccgaggccaaaggctgtggaggcacccgaaaatccgcaaaaattttttctcggg

SEQ ID NO: 16773 - DNA, 2022 bp, Heterodera glycines
ctgcctccctccccaaaatattttaaaaaatcacagatattttgtccagtctatgaccaggtatgtaggtatcagcagatgtcaaaacaaacgccatattgatgatgatcagtgaccttgaaaagcccaaaaatattaatttttaaaatttttcgaggggggggggtagcaaaacaaggagtaccacactgggttaggttcaaggatatattttgtcatccctaaaatttcttgttatcacagtttaacacacttccagaactcaacattagccaagtgtcagaaataacccacaaataaccaccaaaacacgggggaggttaaaggttattctcatgatcgaaccaatttctaaaacaaattaatcggcctacgaatcagaaagttaactatgtattagactagtgtttttcaaatagattatgtatctatgtatataatttttaatattttttccctttaaaattctttattttatttcagtgacgaaacgttcggccaccaactcgtaaagctcttttttcaaaaaatcaacaaattttctcaaaaagcagcaaatcagcatctcatcaaataatcagttttgaccagggctcgcagatgaaaattttcaaaagcctcattcggcaagcaaaaaagcctcattttgggtcaaaaagcctcatttttacaaatttattcaaaacacgtttaaaatgttgtatttttgactgtccgtgactaatttgagcaatttttttatttgaaattagcattttgtgaaaatctgagtatgaaaaatcgaaattgatttttttttttcagcgcttttgccaaaaacttttagggaacaagggggtccggcggcgcctaactttcttttttgaaatgcaataaaattttcttgcattttaaaggctattgaatgataccaagaatgtttttaatttggtcgaccttaacaaaagttatgacatttttttttagtcgaaaaacagtacgagttggagcagtacgagttggagcagtacgagttggagcagtacgagttgaagctgtacgagttggagcagtacgagttggagcagtacgagttgaatttctcagggaatttcggcaaatttcaaacaatcgtattgaaaatagggcttatatttttagggttttgccctatttttttcatgagctcccagtgcaatgaaacgcacaaaaaacaagttgttttttttgttgttcattattttgtgcaactctaagttgttatgttttcgtacattttttgccatttttatgcgtccgatttatttaccgaaattgagaggtttttcttcataaaatgcacttgatcactgatgaattatgatcgtccggtcattttcaattaatattcatttcttctgcgtctgctcattgattttgttcttttgtccgtcactcatttgtcagcagaagacgtcccttttgtgatgctttgtcccgcttcgtcttcttcaacttcttccggtggcggagacaatggcctaaattaagcgcaaaattcaaattcggataaaaatcaaatgctttttttaattgctcacccaatgctattagtggtaccgaaaagccaaatgaacacattgtcccaattatcatctttctgctgcttctcctctttctccccaataattttgcatcgtttcattatccaatcgatgtcccattcatttgctttggccaatgtcagcttttcctttgtccattcgttaagaaattcaaatggcaccatttgcattgacagcgcaggaacagaaaaatgaatttggtaactgacggaagaaatggcattggcacggagaaaatgctaaacaatttggaaaacaaaaatcagtcatttgccaaaaatgtggagccacaccagcagggatggcacagaattcggatttccgaaattttgattttgccccccccccctgaccacacctccttgaaattgttgatccaatcagtgttcgtttgttcttgaatgtctttgcaatgcaatcgctttggttgtccatcttt

SEQ ID NO: 16774 - DNA, 4028 bp, Heterodera glycines
ccaattttgggctccagtacaattatgctggacttttcgtcttagtggtctgtgagttagtcaccaaaaggggggtcccaggttcaagtcccatgcatgctgaactgtattttgaggtttttaaagcaaatacatataagtgaaatgataacacagtatttaatgaagctcaaaaattaaaaaaaattttatttcctgtaaaaacgaagaaaaaccttttatcgaactgtgtctattcaaaatcgaattgttcttcttctccattgttttcttcgtccgtctcccgtcgaccaccaatttcttcttgctaaatcaccatcaatcaatgacattgataagcgaaatttcgtcagtttcttcttccggttgatcgaactcatcatgctcttccctctgatcacttcgtctctgaattattatatataaatttttaaataaaacaacagtttgatcaattgtccggagttcacaaatttcgccctcctgcaccaaatgatcacttctgcaactgcaaattggagacggaaatgttgtcactgcagaaccacaatgcccgatcattgaccaaataaaactgacgtctccgcccataaaccttttaattcagaaaaatggaaaaaaacaaattttaaaatttaccacttgactcgtttgcccgccaatgtgcctattccgtcaatttgttcccaaagtgtgcttccatagcgctccaagttttcgcggctatcctttgtagggaaaacggcacagacgaaattgtttgatggagaatttgaccgagcagcctggctgaatgagacggtaatcttcgtacaactctggccatggtcgccgctcagctttatgtagatttcgtcgccaaatctgatcagattgtccttggcagatgaaagacgcgcctccagagctgcctcaacatcagtgcacacaaatccaacacctgcactagtctcaattggtgcgtattgcaatgacccacagatgcggcgtttgatgtcaagcagctaacaatattcaattgaatttttaaataaatataaatgctaaaatttgtttttactttttcgagtggcgggaacacatcaaatttggcattgatcaggcgaatagtgttttttagtcgtctgtaagccttctgtgtaccgacaatcctgaggatcagaagagcatcctctggatcaactgacttgttttatcttggcagttgttgtttcttcttctgtggcgtgtaatgagcaaatttgtgccgaacttcccgactgatccgttcgagggacgcccggctggctgagcgtgatctgtcccgttttattacagccgcgatttcatcagccaatttgcgacgtgaggtgcgctgcaaatgatcgacattcatctttggtcgtcctgttggagttgctaaaattaaaaaagagaaaattatttgaaaaagataaaaaggggattttagtttcactcacttttgctggtggtcggtgtctccatcggtggtgccatcttttcctccaattgacggcgcagatcagcgatcattgcgtctctgttgcggacctgcagtcgtagaaagctgatcgtttgttcctgctcctccagctgtttgtccaactgctcggtttgtgtcgcggcgtcctcatatgccaagtccacgtcagttgccttgtccatcgttgtcaaatccatgtttgttgcattgtcggtagttgtaaagtccatgtttgttgctttgtcggtagtttctggacggacacgcacatggtgcctgaccggagtcgctgacaatggccttgggcttgaacgcgggccttaattaaagttttgcttctaaaatattgttttttattgacttacgaaggtccaaagttgacgttgatggtccactttcggcggcttgggtcaatgtaccctctccgtctgctgttgtctcggcttcggtctgctttagcgctgaaaaatgcagtgttttaaaataaaattaattttggtcaattttcgtcactttttggcgtcgagccgccttttcttccactttccctgcgccattccttccgttttcgatttgcttcggtgctagaacttctcatttccttgaatttttcagttttattacgtgtaagtaccatttttagctctaaaatactgaaaatttattgaaaattcgcgcagtcgtaaaattttttccaaagttgcgattttcttgaaattttgcataagcatatattttaaccccatttataggataatgctttgcttatttaccaaaatgctttttaactcgagatcggctcttccatttttacaaggcaaaatccccaaaaaattttaagttttgcaaagttttggcgttctgattactaaataaataaaaacctatttgcactgagagcacaaaattgggccgctgtgtaaataatatgtcgtgtggcggacttgaacctccgtcccatttcgctttactatcttgcaataaaccactgtgccacacatgtctcttttttagtataggagctgtggtgcaatcgtgtttgccaattcataaaaatggcttttggtgggcacattgcaaatattgctcgtgagggtatttgggcttctttgactggtggatggtattacgaacctgcgaattctttattttgcaacacacttcatctgtacatttggtcgcttttattcgtccttccgattctgttcggtctttctatcaacgggtccaacgaacagcacaattacggtcatgccatcatttatttgtctctcctcggcttcctttttgtgttcatcaaaatgtccgttgcttttctccatcacatatttgacacagttcagcccatcaaatataaatcaaaaaagaacaccgacggattgcaagacgaatcccaggtttgtatttattttctaataacttgtttgtttcttcataatttcattaaattttttacagaaatttgcccgtgggactcgcctttctggctcttcgatcagcgccactcgtccaattggaagtagtaacgcattggaagcaattgaaatggtcgacattcgcaggaacattaaccgtttgaggaacgaagctgacacagtgaataacgaacagagtgatgggtgtaaaacaaaaatggacgatgaaaacactgagagagaaagaaaagggtgtgaattgattgattcattagaaccgaaaagactaataaataaatgggtctaatgcactttatgagtccaatcgacttttatgagtccaatcaattgttagaaccaaatagactcacttgaaaacggattttgtttaggaatcgggaagcttattaccattcgttgccttccttcggtcattcaaatagaaactccccgtcaaaaaataaagttgacaacaatcaaaatgacgatgcttgctcctcgaggtcctcaacctcggcttccgaattatgttcagacaatttcctgcccaacccaacgaacagaagacgaaaaggcagacattcggttggagttgaattcgcaaacactgctgacagttttggtattttatcaaaggacagttttggtattttatcaaaggtactgattggtgaaaaaacattatgaaatacgcttttagaataatccaccatttccacaacaaaaacaacgcaaattttctgaaccaattgggacgaacagagctaacgccacacttaaaaaacactcgccaggcgaatggcacgaaacatttggacagaattggcaaagtgaaagacgaaaaaatattcagaaagcgaatgaaagatcgacacttctgaggaataattcgacgaagaacccaaaagaactgagaaggaatacgatcagggaagatgaggttggaaggactcaaaaaaaacaattcaaactttaattgtaagataaaacgccgtgcaaccaatttggccttgggagtttttgttgacggaatcgaaatggataacacaccgaaccaaagaagggaacgtgaatatttgttaagagatatctttatgagtggcgctgaaatgaatccgtcgtcgggtttt

SEQ ID NO: 16775 - DNA, 2072 bp, Heterodera glycines
atgccatttcaacgatcgaatctttatttttcggcatcttctttgctggagttcaaattttgcacgaaaaagtgaaaaaaaagtcacgaaaaaagtcaaaaatcccagaaagtagaaaaaagtcaaataaaaagttagaagtttcaaaaaagtgtagaacactcattttaaagccatttcgattcagaaaaaaaatcatttgatacagtcctgttgaaatacttgttaaagataaaacggattaatttaattgttcccgtttacccatttccatttattgtaacttatttttatctcaaaattaatattttcagaagccttttacttcatttcctcagataagtcttgaaagaaggatattttacctttaatgatttaataattttattttaattattttaataattttctattttaaaatttacgaatatcgaaaatttagtgattttttggttggtaaaacgacaccaaaccaaaaatgaaggacaaatccttaaaaatcggaagctcgaactttatacatgctaatgtgtgccgaaatacattttattaattagacaaaataaaaatataattttgaaaatcaatccgatgcaatgcattgagttataatttaaaaaaaacatattcattaattgattgattttatggttgtcatttttaaatagatttccaccattacaaattattgtaaaatttagataaatttatatttccctatataaaaaaataatttaattaacaaaaaattaatttttggggtttttataaaattataaagcataaaattaaggaaaatagtttattttatttttgttttaaaatgcattttctaattctcgtgcaaatatttttaatttgctttacaaatacctcgttgaatttgacattgtcaaatctctttgaatcatgcggaaaatatacagtggactcgctgcaaatgaagctccgctacaactcacataatcggagcagtccattagaaatttggatcagcagtgaagatgattttcctggcccacttggaatggtacaattaaaattttaaaatttagtggtatatttttcgaaatttggaagataaatccgttgggataaactttaaatttatttttttacagaaaattaacattataaatccaaaaaatgcaataaactaaaatccaccctataaattccataattcacatattcagacatcgattggtttttttgtggacaatgatggcgtcgtaaaatgtgcggctgtcaacttttttaaaggctacgaagggagaagaattatgacaaaaacccgaaatgttatggaacaaattcaagcaagattgccaagattccaacggcaacacatcatcgaactttatgatacgtaagtattttcgaaatcgcataaaaattgatacaaaattcctaaattttaaaaaattcggagggcggaaagctctttcctaggtctcaaaaaaaatcggaatcagaatgattacacggtgactcattaaatgatcggaattaaaaactgaatatggatctcatctcaagggatacatttttagcacaaaaaatcgcgaaataggacctaaaaaggaagaaaaaaaacaaatatattttcggatcaattttcggtaaaatttttcaattagcgtgttttttctgtaaattttcgggtaatttcttaagggtgtattttcgttttttttgcatttcgggtaatttcttaagggtgtatttttcgttttttttttgcatttttgttaaggatttttccgaaaaccctgaaaataggcgccaaaaattgcgaaataagcacaaataggcgcctaatctctgatttagaggcaatgctttgcgttttaatgaagaaattttgatcatggagttgagcattgaaacttttcatgatcgactgtacaagcgcattgattcctataagaatgaccaagaaatgcagaaatatatccggcaattaacacaaccaatcatggaattgcatcagggcacatattatgctaattaaacattttattaatcatgtaaaatttttaagtggcaattcatatgaaaatcactccatc

SEQ ID NO: 16776 - DNA, 2020 bp, Heterodera glycines
gtgactcattaaatggatcggaattaaaaactgaatatcggtatctcatctcaagggatacatttttagcacaaaaaatcgcgaaataggacctaaaaaggaagaaaaaaacaaatatattttcggatcaattttcggtaaaatttttcaattagcgtgttttttctgtaaattttcgggtaatttcttaagggtgtatttttcgtttttttttttttgcatttttgttaaggatttttccgaaaaccctgaaaataggcgccaaaaattgcgaaataagcacaaataggcgcctaatctctgatttagaggcaatgctttgcgttttaatgaagaaattttgatcatggagttgagcattgaaacttttcatgatcgactgtacaagcgcattgattcctataagaatgaccaagaaatgcagaatataatccggcaattaacacaaccaatcatggaattgcatcaaggcacatattatgctaattaaacatttaattaatcatgtaaaattttaagtggcaattcatatgaaaatcactccatcaaattacatgtacgtttctgtgaatgacgaacaaatattgaaaattaaaaattttgaaagtgcaaaaataattgattcgggcgacaaaaatgaaagttatctgtttgaaattgacgcagtcgaatcattcacatcattcaactcagaatatatgggcccagagaattatgcacaaacgaaagaagttcgtttccattttagtatatcctgaattagagatctaaatatttagaacggacggataagggtacatacttatgggctaaataacgtgtagtccgtaaaacccgtcatcggctgagaaagacgtgctacgggttcataaaaacccgtataaggtttcattgcggccccagttattcggtctctatccagaacagagtcgtgcgaaatttcaaaatttaacatagatttaattttatagtttaattaagttttggataatgagttcatgaaataattttttgaaatgaattacggttactattaagaaatgtttctgattgaccaaaatgctcttattaagatttcaacaaaatttgacatctggtctcttggaatgattattattgagattcacgtagaccaacttcggttcgcagaaggaaagaattcgttaaatgaggtcatttattttcatgtgattagagtttggcctggatctggatcctgccgggccttgattcttcctggatcaagatccagaccgtttttcggcaacctggattttccctggacctgttttcctggaattttagcaagaaacaggttcaagtccaacatggaatcaatgtcaaggatccaggtcaaggatcaaggtccaggattttccatgtcgaactcagcgtatgattaaaaaccttaaaattatttttaataggcaaatcgaagagtttaccttcgcgaaatcggttatttgtaccaaggatttgaacgaaacccaacattggactccattggcttaaataaaaatgaagaaattttcaataatagcgcttggataaagcaataccacaaagcaattagcattgtcttacaattatggcgcaattttcccaaaacggcacatcttgtcactgtttgttaaaataataatttaaaatgttttaatcgcctctttatttaaaaaaaattctgtcagttttaattaaggcttcaaatgaaaaataattaattaaatattaaaaaataaattaattctaataaatgttaaattcattaaaatgtctcaaataatatttataaaacaaaagaatctgttgcataatctacgggagcttcgattgactgcgcgcggaattttggactatttggacggattgtgtttccctgaagaaattaagcagattaaaaatgccaaggaattgcgcatcttcaaaacaatggaaattggagagttcaaacgacaattgacgaaaaaaatgcgggcgaaccgtttgaatttgtggcgaaccgaaaaccgagaaatgatga

SEQ ID NO: 16777 - DNA, 2258 bp, Heterodera glycines
  misc_feature (17)..(17): n is a, c, g, or t
tagatatttattaaacntccgaagaaaaaaaaagtaaaatgttaaaaatcataaaagtaaaaattgttaaaatcataaattcaatttccatcggtatcatcagtttcttcctcactgtcttcatttccacggatgtgaagtccctcaacaaagccttgcattacaagtccgatcagattcaaggcgtttgtcaatccttcttgcgattcaaagtcagcctcgtcaaggatacgcaccacattttgttctttgatgatgtaccgttgtcgtcgttttgtgcttttctggagacgttctgctcgtccaatgtccagttgtttgtcgatgtccttgatgaatgcagcgatgaaatcactcagtgacggatgatgattgagttcacgctaaattaacaaaaaagtgtcttccaacggacaaatttttactgcaaattgtccatgcgcggcttccatgccgttgttcgttcgctcaattgccatttgagccctggtgtacacattccaaaacgagatgggaagcgtggaggacagacgatgtcttgttcccagcgtggaataagctgcaagctgctttcttctgacaatggaatggttggagttgaaggttgtggcgaatgcagtccgaattgtattggtccactgcctgtcattatggatgcctgggaaatactgaacgctaaaattgaaaaatttcataaatttcatgacagaataggtgcatttacgagttgtgcttcgagtgcgacgcagaagaaagtgtccgacatcagcatgcggttcaaatgcctccgccccgcgatcaatctcgaattgagtggtgccaatgtaggttttggcaaaatacgccagccatccttgaactccaagcggtgccgcgctgacaatagttgaaaaagcgcgccgaacgtaaagtggcggaatgagtgccaaagagagaacagatctgattttgaaaaaacaaataaatacacataagctaatgaaagacacctgaatgttttgtgaacggatttcctttgaaccggtgcttcgtcgtcatcttcgttcaacaaattaaaaatgcccatgcttctggcttttcggaacaccgcttgcgccatgtggaagctgcagcccgagcgttcgcatgacgggaagacatgacgcatcgctttcagcattccaatctcgaagtcgctcatcacttaaaataattattaatgaagataatctgctgtttttttgccttttatgggaaggatgggttcaacggcacgcttcaactgttgaaggacttctgtgtaatacttcgaggctttaccaggtagcaaggcttgcgctgcaaccaccattcggttgttgacataacaaccgatgacgaacacttgcatccacggctttggcgcactgcggaatgtgccgtcgaggctccaccgacgattctgtttgagcactgacaacagctgaaattaaactaatttaaaaaatgacataagtataggttgacttgccttgctatgactgaaaatcaggacaacatcagattgtccagtcctcacttcacggctgtcataaatgaggacggactcatcattctttatcaaaagaccaggcggaatttgtatgttcagtgggtcggcacagttgacaccaccaacgaatttgttctttgttctaaatattgcatcattattttctctgaagtttgtctacctgttcgccatttggtcgagcgcttcattggtgccgagcaattcgaagacttcatcgtcgatgtcagtccgaatttgagcgcggatttgacatggtttcatttttggctcctccttgatcaggcgcttcatctgatttcgtttcgtctctgcatcataacgcgatggtgcgcaaccatggtgatgtccttttgcgcccagaatgcctgtcatcaaatcgttgtcgtccaatttggctgtcgctggacaattgcgctgttcgcacctgaaccagctaccatcttttctgtttttgataaatcgaaagcctggaaataaagaaataataaaaaaaaaaactattaacaccttgataccaaagacaaagagctccccggattgtttctccacgtttgaattgaacgggctcacaattttcttcgtcatcactcgaagcgacgcccaaattgttcctggttgaagtgccttcaatttgttgttctgcgtcctcaacattcagtacgctgtcttcatttgcagcaatgcgaggcttttttactcgcttttgcagactctcaagtatttcgcg

SEQ ID NO: 16778 - DNA, 1278 bp, Heterodera glycines
  misc_feature (24)..(24): n is a, c, g, or t
  misc_feature (432)..(432): n is a, c, g, or t
  misc_feature (1247)..(1247): n is a, c, g, or t
gcctacctaattaaaatgatgagnccggataaactgaattagagtgaaaaaagaatatttttacaaatctccgtctgttttttgtacaaaaaaaaaatgtgatgaatttctgtttcaaaatttgtttctgaaatgtgtataaaaagcgtaaattttcgtcatttaatgaagaagccttggcaacaaaaaaaaaaatgaaaattttaaattcttgaaaaatgttcgaatccgggtttagggttccaaataaagcaattattgatcaacatggatttatgcccgagttcagaaataaatcccaaatttcaaaatttcagtgaatgcgagagttggaccattcccgaatttgccctacaatcgccccccaccctgtcctgagaatttccatatcaatgtcgcagtgatgtcattatgcaaacggaaatctgaccncaattttaaattaatcttttattaccacgactgtttttgtcaatttcgcaattctctcctaaaatccattcattcggttacaaaaatttgttttgactagggctcggatttttagcttttacctaaaaattgcttctaaacacgttaagctttcgaatgataccaacaatgttggatttggttggcaaagaaaaaagttatagttcgaaaacatgctagggccctgcttcatttttctcgaaaaaacttcaaaatttaaagttcaaattttgttaatacgaaaaattaggagttttgccgattaacgcaggtttttcaataacattttccttggcccaatccgtccgtccattccttttcccacccctccgcgacggccatttgcatcttttccctttttcttccactctctcatttttctgtattctctctactcctttgcatcttttccctttttcttccactctctcatttttctgtattctctctactcctttgcatcttttccctttttcttccactctctcatttttctgtattctctctactcctttgcatcttttccctttttcttccactctctcatttttctgtattctctctactcctttgcatcttttccctttttcttccactctctcatttttctgtattctctctactcctttgcatcttttccctttttcttccactctctcatttttctgtattctctctgcactttgcattgctgatgtatccatccataaactgtttccttgttctttcgcttcctccctctcattttcttatactatttcacttgtttttgtatnccatcccatccgctgcgcttattttgggttt

SEQ ID NO: 16779 - DNA, 1328 bp, Heterodera glycines
  misc_feature (1308)..(1308): n is a, c, g, or t
tcattactttccctcttccaatttgccactctctccgactactttccctctttttcttagtcactctctccgattactttccctctttttcttagtcactctctccgatcattactttccctcttccaatttgccactctctccgattactttccctctttttcttagtcactctctccgattactttccctctttttcttagtcactctctccgattactttccctctttttcttagtcactctctccgatcattactttccctcttccaatttgccactctctccgattactttccctctttttcttagtcactctctccgattactttccctctttttcttagtcactctctccgattactttccctctttttcttagtcactctctccgattactttccctctttttcttagtcactctctccgattactttccctctttttcttagtcactctctccgatcattactttccctcttccaatttgccactctctccgattaatttccctctttttcttagtcactctctccgattactttccctctttttcttagtcactctctccgattactttccctctttttcttagtcactctctccgatcattactttccctcttccaatttgccactctctccgatcactttgccctgtgcccttcccacttttaccttacacaatttgctcaatgccccctcctccttcgtcctttccttttgttctccatttttcgctttcttcgcttctcctcttccccaaagtaatgccaaattttgtcgccgttctctttgtcccttcgcagtcagcgacaaattcgaggcgacacggcgaattcggtccattatttgtactgtaaagctgaaaaaagtgaatggaggaggacactctcccccctttttctctccctcactctctccccatatctctctctccctgttttccctcatcccctcactctctcctcctccctttgctctccctcccttttctttccctcactctctccccatatctctctctctctgctctcctttttcgactgaccattcgcattgtcattgatcacagcgcgacaaagtgattgtgaggggatattttgttgctttttgagctgttggacagatgaagtagacttagcacggaaaagcagggacgaagagaatggagagaagtgaacgcggagggaagaagaagagaagggaaacagacggaggatctaaatgagagagagagaaagaaggagagaaagagagagagtgagaaagaagggaggggaaaggggagacaaggagggatgggaggngagacaaggagggatggggg

SEQ ID NO: 16780 - DNA, 1438 bp, Heterodera glycines
gggaatttcgccccttttgcgacggtacagaaaaaacacagtgaaacactccctttgagcagagaattaattgtcagtggtgggagaattagggaaagagaccaaaagattgatttgatggaggtcaattcggtagggttgggaaagttcgtcgtaaaaagtttacttttttaagtcgaaaaagagcaaaatgaatggggggaattggcattcttcgttaatgtgaggcaaaaaaaagggaatgggagagagagagagagagagtgagaagggaggggggagtgatcgatcgattaggaaaagaaatgcgatgaaaaagggagggagggagggcaaatgaatggatggaagaaagaagaaggggtgacgaacaaacgcacaagcaaatattaaacagggagagaatgggcaaagggaaggggggggggagagggacccaactgaagatttgggaagagttaaaatggaattgaaaaataagagatttatcaaaaataaaataaaatcaaaaataaaataacaaaaagcaaaaaataacaaaactagtaacaaattattcaaatcaattaaaagaattagagattttaaaggacagtttaaaaggggaaaaggcaaaatgaataaaaaaaacataaacaattagagacttttaggatttaaatttgaagaggcataaattatgaaaataaaacaactgaatttaaacaattagagattttaaagaataaattggaaaaggcacaaatgaataaacaaaaataagagcactgtttcacccgcgggacatcaaaagttacgacgaataaagcgattggataatttatcgacggaaaaaatagccatcgttggagaaaagaggcaaagaatgacgaggagaagagaattgatgttgaacagatggagaacgggaagggggaacaaaaaggcattcttgctggtgatgggagtgttgggaaccgcgaaaaacggcacgccgaaagccatgaccataaggggacgcggagaaaatggccgaactcatcggaggggagccaaacgatggagcagagcagaaggacgaatttgaagaacgaccgtccaaccgagtctttttgggaggcgaagatcgatcatcaaatgaagaattatgacgacgggaagggtacgaaggtgccgaatagccacaatgatttggaaagtttggcgcattcgaacgttcgtcgaacaccgaaaatcggtcagcggaatgcaaaatggcggacggaaatgctaaaacaatgaataaattgggcagaaaaacggatggaccttccggcgagggcgtactcatttggttttcgctcaaacctagcggcggattataagcaaatttgttcgaagaatagaacgattgagaaaggttgggccgattctcgggaaatcggcagaacattttgggcggtatttttgaactgctaaa

SEQ ID NO: 16781 - DNA, 4110 bp, Heterodera glycines
ctgcaattggacaacggataagcttaaaagcatttgattcatcttttgacagtgccaattgctccccggtcaattcgttggtcagttcaaatggcacaacggcagaaagcgaataccacggcgaaaagtggacaaaaatgatgaaagcatcaggagaagaagcagaggaaaatgcctaaagaaaaaagacaaaaaagtaacaaaagactaattaaagtggataaatcaccgctttgatttgttccactcgttgccaaccattggttaaccgcttctgaattctcaactctgagcattttcggcaaattgttgggatgaggtgagaacacccatttggtcaccgctcggccatccgacgcattggcactatcatcaggcggaaattcaagcaaaatgtcggaaaagagagagacagtttggaggcacggacaattgcacagaatgggacggggcaaattgacgcattcggcgaaaaatgacggggctcaaaatcatttcgtgaattgggtgcttgaacattggccaaatggtgagcacaataaactccaaaatgcgaacattttcagtggtaatgtaccatttcgtcgaaatgacggcgaaaaaacgatgaaaatggtggagaaaagtgagcacattgtagtcgatgaagctgcaaatcagaaagtatgattgattgaggtcacagatcatttgaaaatttcattttcttacaaaatctcaatgcttctgaatccgatgactttgttcggcaacggattttgagggattggcaatgcttttccttttgaattgataatttccatttcatttgttccaattttgcatcgaatttccaatttgtccaacgtccatttgcgcgttttgaagtgttcatcaacgcggcggtcaaatcggtgactgatcagtgcaattccatggccaagctggtaaatgggcagcaaatcgaacacttccagccaacagtcggcagagatgaagctgaaaaaaacagattgattatcatggaagttcaaatttagattaggtaattaagtagctaattgtttacatcgctttttccatttctctctcagcttccttcggattgtctgacattttttgaattaataatcaaacaaaaatttagaaaaataggcaaactgaaaaaaaaattgacaaattaaaatggtacttgtgtaatttataaatttataggatcatttgctaaaaaatatcagtgtttaagcccataaatgcagggttacccttgaaagtttcccgaaataagagcatcgctggtcaaaaataagattttagggtcaaaaataaggacattttttaaaacacgcttccaaaactttgaatcgcttttttattcaacaaaatcaagcattactcaccgccaacctattttctgagcaatttcggcttagaaatgagaaatttatacatttccgaaaatcaattataagattttaacaattttgtcgaaacataagcaattggtaaatttcagtgcatttagaatcaaaaaaacatatttttaacaattttttcggcgcatttttccgaaaaatttttgggtatgggtgagggaagagagttcggcggtgccgataggcgccgccgagggaaatttttttaaaatttaatgcaatttgttaacgagctctgtccaaaaaatgaccaaaatttgcgatcttgggctaatttttaagaaaaataggagttttggggggccggcggtgccgataggcgccgctgggggaaaattttaagaatttttaatgaattttgttaggaattagccaaatttttcagaaatttcctcttttaaatgaaaataagacactaccccaaatcagaacatttcttagaaataagaacagatacacccctgctctaataggcgccgccggaaaaattcttgtaatttttaatgcgatttcttaacgattttgttcaaaaaatgacaaaattacgcttttgagctaatttttttaagagaataagaaaccgccgagagaaaaatttgaatacctatttaactgaaacttgttaagattttgcatattaattcgcttcaaaaaacatttctttcaaaaattatcattaaaaatctaaatttctccctgaatccaaaaaataagatgaaaataaggacaaagagcttaaataaggacaaatcttacaaataaggacaaagggtaaccctgtaatataggcataactttttgtgctgatcaaaaaattccattgcattaagcatttgttgttaagcagctactttttgagttattagcacctattttctaggtcgggtcattccaagtcacttcccaagtgtaatgcatgccaatttccaagtacataacgggggaactatggcaaaaaatttgtgactttttgacgcaaaaatatgctacaaatcggggcgctacgttaatattttagtataaaaaggcccttgtttcttcttctcctcctcattattccattcattctcccaatattctccagtcattttgttgctgcaaatgtcttcagaaaatgaaatgtaagaaattcaacaaaaaatttgaaaatttataaattctcccaaattttcagctttatctgcagcgattgttggcttttggtgttcgattttcttgcgccttcccaacttggccttggaattgcactgatcgagccgccgctttgacttctacgtggatgaacacttcgagacacgcaaatggaaattgaacaaacaatttcttattcaatgggacattcaagaaaatgggacgaagaaaatgcaaattgtcaattccgatggaaatccattgccaatcccgcaaaatccgttgcccaacaaagtcatcggattcagacacattcagatcatgtaaaaattgattagatttttcatgccatcacattttctgcttttcagttacatcgatcaaaatgtcatcacttttctccgccgttttcaccgttttttcgccttttgttcaatttacttggacattcgcactgaaaatgttcgcattttggattttgttttgctcaacgttttgccaatgctccgcgactccattcgtcttatgcttttgaataccatcgcttttcgccgtttgcgccaattggccccgtcattgctcaacaattgtccattccttcgcgctgtcgtgtttgaagacgccattttccccgcttttccgcccgatgacagtgccaatgcgtcggatggccaagcggtgaccaaatggttgttcacgcctcgtccggatggtgtgccgaagtggctcacaatcagatcctttgtggattcaccggatcaatggtcgtcaacgatggaacagctcaaagcggtgattatccctatttaattggcttttctatgattttttgtccgctttttaggcattttccaatgcttcttctccggtttctttttgtattcactttctgatgtcttctccgcttgacttcattgttccatttgatctgatcaacgaagtgactggggagaaattgtttcttctacaatctgaaaatgatttttggctcatccgttttcaaattggatgggatgagcgaaaatgggacaatgtgaaggataaactgaaaaatcgaacgaacccaattgtcattcggatcaaagatggcggattcgacgacgggtgaacaatttaaaatgcttaatcattttatgagtccaatcgtcgacctttgcttaaactttttgctttcaaatcgtatccaaaaaggtacggtttgttttgaaatggacagaattatggtacaaaaaaatcaaggatagtcagttggttggactcataaaatgccaatgtcttttaatttgcaatggaataatcatcgttttttcagtcttctcgacgacgcttctcccgggccgaatgatcagcagcagaaatgaatcaattaattaattaattggtgtaattatgtgaccgaaattatgttggcactttgccattaaatattgtctatatgtatgtatttgacgtttgcttgctcgcaaatgcgtccatttccattgtattttatgtatatatgtatatgaaattcattgtgagtaaattaatcgttgataaaatggctaatataaaacggtaaaag

SEQ ID NO: 16782 - DNA, 2576 bp, Heterodera glycines
aaatagtgaagaaatagtgacataattttcagccaaaaattaagcaaaaataatttttattcactgattgcattgcaaatgagtaggactgggatttttaagaccaaaaaacccaaaagagttacctaaaaaaaaattttaaaattaaaaatttttgccaagaaagtaaatttttgagaaaattttttttcatttcataggagtatattttgaaaaattttagcttgattcttaggggtgtatttttttgaaatttttaggggtgtattttttggctttattgcatttttgttaaggaattttccaaaaaatgtcgaaatagtgaaaaaatagtgacaaaacgccaaaatagtgaattttcactattttagtgacgaagtcgccaaaatagtgatttctagggtagcaacttttagtgacaaaaaatcccgaaatagttaactaaaatagtgagtaaaaatgccaaaatagtgaagaaatagtgacaaaaagtccgaaatagtgacaaatagtgacataattttcagccaaaaattaagcaaaaataatttttattcactgattgcattgcaaatgagtaggactgggatttttaagaccaaaaaacccaaaagagttacctaaaaaaaaattttaaaattaaaaatttttgccaagaaagtaaatttttgagaaaattttttttcatttcataggagtatattttgaaaaattttagcttgattcttaggggtgtatttttttgaaatttttaggggtgtattttttggctttattgcatttttgttaaggaattttccaaaaaatgtcgaaatagtgaaaaaatagtgacaaaacgccaaaatagtgaattttcactattttagtgacgaagtcgccaaaatagtgatttctagtgaccgatgatgacatcagaatcgaaaatttttaatgcagaaatgcgttttttaagctcctttcttcaaaacaattgagcaaaaaaaaagttttttcactaaaagttgcggccctactcattatatagttgagcatcgcagttttaaaagggtacactctttggttttgtcgaccctacataatctataaaagtgctgaaagtaatttttgtcagattcgtgatcatcacaatcgaatttttagggaccactattctgcaacatagctaaagtcaggacaattcattaaaaaaggacaagtcataggcttctctggctatagtgtttaaacaaattttcatgccccaagggcgaaaaatccataaggattctacacgtccggcatccatttcgaaccccgggcttcgagaactgaattgggcaagtccgcgttcagattcgtagtaagaaccttcaaaaaccctaacatgtttttgagtccaggacaaaaaaaggttaaaattaggaaccgaaatccgatctgcaacagaacaaaaacaattctttttactcaagtctggtcagttgtatccaaatcttagaaatttttaggggaccggcccgggaaaacaatatgcaaccattaaaaatatgccaatgataccaaatttactcgaccgatttaaattggttaaacaaaatcggtgtaaaatgaaaatgatgtagattgacagcacaaaacaatataaatccaaaataaactgatcatccatcttaattctcatcattcggctgcagcattgttgccggttcgtgtttcgacttaactcgaagtgtacaatttaactatttggtagatcttactgtaacttccgacgtcaatctgatcagggagttcagaaatagtaacgtcaaaacgatcttgcacactgttcaacgtttgagcatccgtttcatcagagacgaaagttatggccaatcccttggtgccaaaacggccagctcgagcaacctaatttaatttggacgacttagccattcctttgcttgttgcttactctgtggaggtacgtgtcagtatcctctggcatgtcgtaattaaacacgatattcacgcgctctatgtccattccacgaccaaataagttggtagcgacaagaatgcgtttttggaagtccttgaattgctggtagcgcgccaaacgttcttcctgtgccattgcacgatgaatggcgatggaggggaagttctgctcgatcaacagctgattcaatgcacgacaacggctgaccgaacgaagaaaaatgacgaccttagcatttgtaccgattaatatgtgtaaatacactgggtaaaacctggttgaactccaaagcatccaacaagtccaacaatttgcggttcttctcattttccttcagcctcacataatactgttgaagtccgtgaagcgtgagcttagcctcatcatcgacatacacctccataggctaaagtgttttgaatattaggataaaaatgcatcattctcagggaagaccaagaaagacattgttaaaaagaatgagactaatccttttgttggtacttaaaaacggccaacgtctttggagtttgttggatcatctgatccttttttctccccacactcaatttgaaacgcaacgtccgtctctctctctttgagttagaatagccat

SEQ ID NO: 16783 - DNA, 2451 bp, Heterodera glycines
gatcatctgatcctttttctccccacactcaattgtgaagcacaacgtccgtctctctctctttgagttagaatagccatttgaggcacccatttcgccgagcaatcgcacgatttctagaaataacaataaaggaaacaagagaaaaataacaaaacctcgtaacaattactccgcttctatcatcagcaccattcaaaccggacagattggtatgctgatggttcgagagactcaaattgacgttgagctccctccccgtgtcgtcagttttcatggctcattgaatagacaacgaacgggcaattgttgagaagaatttatgcaaaaacaaggcctatccgaacaccgccgattcgaagaggctaaccgcagcaaagaaggaaccgaactactcacttcctgcatgaacttcttgcagacaacgcgcagctcccgaggcaaagttgcactgaacatcataacttgcttctcctgcggcgtcattttgaagatttcttgtacgtcgtgacgcatgtcttaaattgcaggataggaaagaaagttggaaaagtcgtaccagcatccccaatcattttgtcacactcatccagcacgaagaatttgactcctttaagcttcagatgtccagtgcgtcccagtgctaaaaggcgacccggcgtcccaacaacaatgtgcggagtgtttttggccaggacctcctcatctttcttaatcggcataccaccaaaaaacacagaaaccttaacccggggcatgaaggctgtaacataatttagtaaaaaccttcactcctggcatgtacttgctgaaccgctcatattctttcgaaatttgaaaggcgagttcacgagtgtgacacatgacgagaacagagactaaaatgtgctgcttaaaaggagcttaaattgaaatgtcctacccgtgccatcagtcggtgtcagttgttgcaaagtggcaagcacaaacactgcagttttacccattcccgatttcgcctgacagacaatgtccattccaagaatagcttgtggaatacactcatgctgcactggaattcgattaacaattattaatgctccttcgtgtgttccctctgggcccgttccagacaaaaagctttttcttatgtaatcaaccttcagaagggtgctcaaatccacaatcaattatcgcacgaagtaactccggacggagcatcaaatctcggaatccgctgctgtgaatgctcgcataattaccctaaaaggtttgatgaatttttgagtcagttactttttactttaattttctttgttgcatctccgtttgttgctgcatcattttttgattgttgttcctgagtctcttcttgttcttcctcataatccaaaagttgttcctcgtccattatgcggaaatagtaagctcaaacaaagaaagcgaaattattgaccttaaaacatcatgtgcattgttaattaaaaaataaaaagtttttgcattgaaacagctttaaattgtaatgcatatttacaaaattcataaaagtatatttgatactaatacaggctaaattgttcagaaatcgataacataaatatatgattaaaaatgaatactatgtagtccataaaaaatgaaaaagctcaattttgcactttattcagccttcttgtaataaagaatactttgggctatcgaatgataccatgagtgtctaatttggcaaaaaatttccaagtgattggttatgagcaccggtcaattattttcatgcaaaacaagctcgtcgtcatctcaaatttgaagggcaaaatcgttaaaatcgggctttttcttttttttatggaaccaataatctacaatcattgccaaattttcaccaccatttcccaactgctggatcgatcagcttttttacataaatgtatttgcatgtaaaaaatctcaaatgaaaatcgaattttgttatttggcatttgtattgcatatactcctacaatttctttagtgcgtatgggtacatctttttattcggtgcgccaatccttcgtttggtcgatgggttaaactcctcactcgttccaaaaaagtgaacaaaaaatatgaagatgataatgataaagaagaggagaaagacgaatgcgatcagatcaggggaccagctggaagagggcggacgaagcaattggagacctgggggaggggggggggttgggtggaaggttggctctagtgaactttaggcgtccaatgaacttttaggcgtccattgtccagtttctttggccataacttttttattatttcgtttgataccaagaatgtagggattgaccaagtaataaaaaagttatggtcaaagaaactaaactttacgcctaaaagtttatttcatgcctttgttctgctttaccggttcgttcaacaacagccgtaaggagtgaatcgcgcacccattccaaatag

SEQ ID NO: 16784 - DNA, 1859 bp, Heterodera glycines
aaaatttttccgggaaaaatacccttaaacttgggttaattaaacccaaaattttgaaaagggggaagaaatttccccaaattatttacagaaatcccttccccggggaattttcacaaatggaattggccccggggaggggacaggaaatggagggcactggggccacaaacaaaaatcaataaccggggggttaaagaatgatcacaattggggggccatcacagttaaaggcaaatgaggggcggggagagaacggcaaaaattgccaaatgaaatttggttgtgaaattgggggcatttttgagccgcttaaataacaataaaattagataaaaagtggcaaatgtgagcagaacaaaatgggccgaaaatttgggcacaaaatgaaaaacgggggacaaaaatgaacgaatgaacaaaatgggcggaaaacgggaaatttgggaggttcatcgttctttggagtcgattcgccaaattggggacgggggcagaaaagttgcggtttgacaaattggtcattaatttgtgcgcagggcgggggaggaacacacaaaaacaattgacaatttgaaggaaaagggggacagagggatgaaacggcgaaaacatgttgcgcggcgggcgggggattggtgaagggcctcctccctcttaattccgccgatcattgatcggcgataggaataaaaattccgacaggcctaattaaattttattttattatgactcctaattattttgataatttgggccggcaattaacggcctaattaaattttattttattatgactcctaattattttgataatttattttattttttatatattaatttgtgtgcaagtatttcctttaattttaaaattttttccaatattccatcaatttttgccattgacagtgaacaaaagacatatcattttttgttatcccttctggcttagtttattgaattaaactgaaattctcgattaatccaattggattttgttttggattttcactgaatgaaaaaacctcataagggtcttttatacatggaaccaaattttcaaccataatgaagcaaaacccgaatatagttaataaggttaactcaaacggataggtttcaaaaaaattctttgaaattttttgggccggcaattaacgggcctaattaaattttattttattatgactcctaattattttgataatttattttattttttatatattaatttgtgtgcaagtatttcctttaattttaaaattttttccaatattccatcaatttttgccattgacagtgaacaaaagacatatcattttttgttatcccttctggcttagtttattgaattaaactgaaattctcgattaatccaattggattttgttttggattttcactgaatgaaaaaacctcataagggtcttttatacatggaaccaaattttcaaccataatgaagcaaaccccgaatatagttaataaagttaactcaaacggataggtttcaaaaaaattctttgaaattttttgggccggcaattaacgggcctaattaaattttattttattatgactcctaattattttgataatttattttattttttatatattaatttgtgtgcaagtatttcctttaattttaaaattttttccaatattccatcaatttttgccattgacagtgaacaaaagacatatcattttttgttatcccttctggcttagtttattgaattaaactgaaattctcgattaatccattggattttgttttggatttcactgaatgaaaaaacctcataagggtcttttatacatggaaccaaattttcaaccataatgaagcaaaa

SEQ ID NO: 16785 - DNA, 3278 bp, Heterodera glycines
  misc_feature (2751)..(2751): n is a, c, g, or t
  misc_feature (2759)..(2759): n is a, c, g, or t
  misc_feature (2773)..(2773): n is a, c, g, or t
  misc_feature (2776)..(2776): n is a, c, g, or t
  misc_feature (2790)..(2791): n is a, c, g, or t
  misc_feature (2797)..(2797): n is a, c, g, or t
  misc_feature (2811)..(2812): n is a, c, g, or t
  misc_feature (2814)..(2814): n is a, c, g, or t
  misc_feature (2817)..(2817): n is a, c, g, or t
  misc_feature (2824)..(2824): n is a, c, g, or t
  misc_feature (2842)..(2842): n is a, c, g, or t
  misc_feature (2845)..(2845): n is a, c, g, or t
  misc_feature (2877)..(2877): n is a, c, g, or t
  misc_feature (2884)..(2884): n is a, c, g, or t
  misc_feature (2887)..(2889): n is a, c, g, or t
  misc_feature (2891)..(2891): n is a, c, g, or t
  misc_feature (2893)..(2893): n is a, c, g, or t
  misc_feature (2898)..(2898): n is a, c, g, or t
  misc_feature (2907)..(2907): n is a, c, g, or t
  misc_feature (2910)..(2910): n is a, c, g, or t
  misc_feature (2936)..(2936): n is a, c, g, or t
  misc_feature (2943)..(2944): n is a, c, g, or t
  misc_feature (2946)..(2948): n is a, c, g, or t
  misc_feature (2950)..(2950): n is a, c, g, or t
  misc_feature (2952)..(2953): n is a, c, g, or t
  misc_feature (2957)..(2957): n is a, c, g, or t
  misc_feature (2969)..(2969): n is a, c, g, or t
  misc_feature (2977)..(2977): n is a, c, g, or t
  misc_feature (2980)..(2980): n is a, c, g, or t
  misc_feature (2992)..(2992): n is a, c, g, or t
  misc_feature (2999)..(2999): n is a, c, g, or t
  misc_feature (3003)..(3004): n is a, c, g, or t
  misc_feature (3007)..(3007): n is a, c, g, or t
  misc_feature (3009)..(3010): n is a, c, g, or t
  misc_feature (3015)..(3015): n is a, c, g, or t
  misc_feature (3022)..(3022): n is a, c, g, or t
  misc_feature (3024)..(3025): n is a, c, g, or t
  misc_feature (3038)..(3039): n is a, c, g, or t
  misc_feature (3052)..(3053): n is a, c, g, or t
  misc_feature (3058)..(3059): n is a, c, g, or t
  misc_feature (3070)..(3070): n is a, c, g, or t
  misc_feature (3075)..(3075): n is a, c, g, or t
  misc_feature (3077)..(3077): n is a, c, g, or t
  misc_feature (3079)..(3079): n is a, c, g, or t
  misc_feature (3081)..(3082): n is a, c, g, or t
  misc_feature (3093)..(3093): n is a, c, g, or t
  misc_feature (3103)..(3103): n is a, c, g, or t
  misc_feature (3105)..(3106): n is a, c, g, or t
  misc_feature (3111)..(3111): n is a, c, g, or t
  misc_feature (3113)..(3113): n is a, c, g, or t
  misc_feature (3115)..(3115): n is a, c, g, or t
  misc_feature (3117)..(3117): n is a, c, g, or t
  misc_feature (3123)..(3124): n is a, c, g, or t
  misc_feature (3127)..(3127): n is a, c, g, or t
  misc_feature (3138)..(3138): n is a, c, g, or t
  misc_feature (3144)..(3146): n is a, c, g, or t
  misc_feature (3156)..(3156): n is a, c, g, or t
  misc_feature (3163)..(3163): n is a, c, g, or t
  misc_feature (3166)..(3166): n is a, c, g, or t
  misc_feature (3168)..(3168): n is a, c, g, or t
  misc_feature (3172)..(3172): n is a, c, g, or t
  misc_feature (3174)..(3174): n is a, c, g, or t
  misc_feature (3180)..(3180): n is a, c, g, or t
  misc_feature (3187)..(3187): n is a, c, g, or t
  misc_feature (3208)..(3208): n is a, c, g, or t
  misc_feature (3233)..(3233): n is a, c, g, or t
catttatgcagctttgaatggagcagcatttttctcgaatctcgacctgagagatgcgtacctccaaatggaattggacgaaaaatcgaaaccgctctgcacaatcaacacccactgcggcctatttcagtgccaacgtctcccagttggcgttaaatcggcaccatccattttccagcacttgatggaccaaatctgcgcaggaattccaggggtcttctcttatttggatgattgcctaatcgcctcaaagaccctggaagaccacgtcaatgcgcttcacacgctttttcaacgcatcaaggactttggcctacgaattcaactcgaaaaatgcaaattcctccaaaaagaattactttttctcggccacatcgtttcctccaacggcatacgccccgacccagcgcgctcagaggcaatccagaaaatgcctgcgccgcatgacaaaacgaccatccgttcatttttgggagcgctcaattattacggacgttttgttaaaccaatgcgagaaattagggcgccattggaccaactcctccgaaaggatgaatcctggagttggggagatgaccaacagtccgcgttcgagcaagcaaaggcaattatggtttcagaacttctgctgacccactacgaccccacacttccgatcgtcgtagcggcagacgcgtcaaaagatggcatcggcgccacaatcagccacatttttccggacaaaaaggaaaaagtcatcgagcacgcctcaacagttctgaccaacgcgcagcagaactacagccaaattgagaaagaagctctggcgcttgtgttcgcagtccaaaaattccaccggatgcttttcggacggaaattcacactgctcacggaccacaagccattgctggccatcttcggctccaagaaaggcatccccatttatgccgccagccgactccaaagatgggccctaatcatggccaattacgattttgaaatacggtacatcaacaccgcatcatttggccaggctgacgtcctctcgcgcctcatcgccaattatccccgaccagaggaggatattttgatcgccaacatctgcaccgaaaccgagtgctacatcagcaccattctgcaaaccaaaaccgaacaacttcccgtcactgcagacgaaatcgcagaggcgacaccgaaagatgagattttaaagaaaattttggcattcaccaaatcgaattggccaaagaaaagcagcgacccggacatcgcaccgtattttccgaaaagggaaaacattttggaaattgaggactgtttgctcttccaaaaccgcgtcatcgtcccccaatcgcttcgcaaccgaatgctgaagtccctgcacatggcacatcccggaattgtgcgcatgaaagcactcgcccgccaacatgtgtattggcccggcatggactcggaaattgaacggattgtccgtcagtgtgaagaatgccaaaaggctcaaaaatcaccgatcaaggcaccgcttgccccttggactccaaccgacaaggtgttccaacgggtacacatcgattttgcgggaccatgccaagacggtcacgtctatttcattttggtggactcattctccaaatggccggaggtctaccaaatgaattcaatgacggccgcggcaaccgtcttcacactccgttcaatcatccaccgactcggtattcctgaagaaattgtttcggataacggaactcaatttcgttcgtcagaatttgcggcactctgtaaggagttcggaataaagcacacttttacgccgccattccatcctcaatccaacggacaagtcgaacgtttcgttgacactttcaaaagggcgatgatgaagtgcaaaggcgacaagaacagccttgaaaaagtgctgctctcctacagatcaacaccaaattctgccatcgacggatattcgccagatcaattgttccttggacggaaactgcgcaccaaattggcactcgtccacccaaaaggacaaattgatcagtcggagaaatttgaaaaaggtaagttcaaacagcaccaaaaggactattcaaccaaaatggcacagcaattcgatcggaacaatggcacaaaagctattgagttcctcccaacggattccgtcctgctcttgaattatcgccttggaaaaagccattggctacagggcacaattgtaaaaaggttcaacaattcgccaacataccgtgtccacgtcccaactctcggccgaattgtccatcggcatgccaaccagcttcggcgccgattggattttgaggacaattcaaattgggaaccccccattcaggaacaaatggccattgatccaaatcaaaggacaccgccacgccaacacgcagccatcgatcagcgaactccacctgttgttgatcaggctaggcaaaaggctaaaagcccaattggcgtccgacgttcccaacgcgtgccgaagccggtcaaacgcttcacgccaggttgaaacgaggatgtttcaatctcgagaagggaggtgttggagaaaaagcaaatgtactttgctcatgttcaattatcgattattgatctttacatttgtccattctctcgtccgttccttccccctcacattgtctatttaaaggctggactcttcccccatgttcacttcttctcctgccttcaatttattatttttattcattattctctccacaccgaccccattcgccatttttattatttattattatntctcttcntaaataaatatttnttnttcttattcactcnnacaaanacacaacaaatttnncncantcaccantcttcttcaaccaacaanaanacacccaaactacacaccaacaaaaccaatantccctanacnnntnanttctncaaatactncantttttcaccatcaacaaaaccaatantccctanncnnntnanntctncatatattccanttaattcnctnaaaaaccaacanacctaanaaannttncnnttccncaataancnntttttcaactttnnactctcaaattcnncaccnncaaacatttcnccatnancncnnaccaaattaancaactccttnannccatncntntncaatcnnatnccaaccaacanctaatnnnccaaccaccncaaaacnccncntcancnattctnaaccatncaaatttgtcaaataagatcnacgcccgaatttcaaaattcaattncgaccctaggaggggaaacactttcgaacagtggttcaaacggtt

SEQ ID NO: 16786 - DNA, 909 bp, Heterodera glycines
atgagacgctcaaaaaccctaaaaattctcgagccgagatcgtaaaatccaaaaaaaaaaagccatgggtcgggggacctcgccctctcgaatagccctaattttaattatttttattatttttttccattttacgataggattttgaacttttttttatttaaatatttatttttacctcctcccctcaattgaaaaaagttttgatcacttataaccagatcgatactgatcacttcactgaaaactcagtgcttcgcctcagggaaaattgatcaatcactttgcccattcattcttcacattcggctgatcacaacggtgaaaagcgaacatttcccagcagattgtaatcattaaaaaacagctttataagcttcaaatgcctccccttcggaagcggcggaggaggaaaagccctggctttgatgctcttcggctttatccacctcttgtgccttacctttatcctccctctttgcggcttagttagccttatcccctgtgttgtggcttaggttttatccccacttgtggcttagctttatcccgtccccctcctttatggcttacaattagctgtatcctccccgccccttcccactcatctccgtgtctaatgtccattaaacgatcaccccccccccccgcccgcccctcggctgtgggctcggctcggcttttccaatccaatatttacccaccacttggggcttcttcgtcgcctcgggggaggggtgggggcaaacttcacatttttcaacatcctcatctcctcctcgtcctgctagcctcagtatggaagaggaggaagagaagcattttcaccattcatcttccgccgactgcttcttcctcccctcgggtgtgattttttgctgctaaagcccgcctcctcccccccccccg

SEQ ID NO: 16787 - DNA, 2111 bp, Heterodera glycines
gtcagtagtgcgtgtgacaatttaattataatttaccaccaaaattcaaattgctttgttggttcctttttgttttgtgcgaaacattgagccatttaaatgagtcagcgaacttccacttaaaaaattttgttattctaatttcaaaagttttacttaaattaaatcaattatatgtctatctggaaaggtttttgattcactgtattataattagacagcatgttcaattttgtccattcactgcacatctttaattcatatcataattatgattattcctcaaatgaatccgtctgtggctatttcaatctataatcgtcgtccagcataacgcaatctcgttcaaggataattctctcacctcccccccccccctccccccactttcttccactcatttttcctctttatctcttccgcctcccctccctctttccttcctcttcttgatggtcaataaaacatgcaaatatatggatttctttggttttaaatagggttcctccccgacatgtttcggggaattagtaaattgcacttgaaataagatggaagaatctttaaatgagtttttaagacttttttgttctggactttttctttttgtgtttttttagactttttatgaaaatttcctccccgacgaaggtgttgctccccgacattttttaaatttctccagccatccccgacaaattcattcgggggatttcctccccgtttcccgacattttgctccccgaggctcggggaggaaccctagttttaaatctcaaattgagtaggattcaatttttttttttatccatttttggctcagatttttagcatttttcaaatttttgcctcattttagttttttacaaacgcacttaaaagaaatgtgtttcaacccacatacaatccaaatttttatgaaatctacactaattttgcaaatctttcaagtttcagccaaaatattcattccatttttgtgccaacaatttcccagccgatggcacttttttgtctgtaaaaattgcgccaaaaatgagtcatccgcctccaattgatgctttgtccacctcaaccgccgcttcatcttcattggcatccacaggcgctgcgcggttagcgccggcgttgttccacgccggcagcgccaagacaaattggacggcgatggactgtgtgtggctggaggaagtgcacaacatacaggcaagaacggaagattacggtaatcgtataccataccgatagtttacggtagaattacgataatcgtataccaattgactacggtggaattacgatactcgcataccgatcaaactcctaaaaatgtctggttttttttttctatgccaaatggccatccctgttattactatttattttgaattatacaaaacgtgccctctctttaagtttctacagtatgcataaaatacagtataacttccccgttttactgttgcagaaccatttgtactggcgccagaacagtcccgtgttgttgctgagcttgtacgcggttgtgtgcacgttcggcacggtggtcaatttgtttgtgctgttgtcatttgctcgggtttcacaggtgggcaaaatgaccgattttttggattttttatttttaaaaatttaaaaaattattgcaaaattatttggcacaatttgtttttttatttaaaaatgtttttctccaaatttcaaataattaaattaattttttaataaataaattctaatattttattgaaattaaaaatgaaatattttaaaataattaaccaatttaaaataaaattttcttctaaaatataaaattattaatatttctcaataaattgtcattttataaatatctgattattcaaattaatctatttaaaatatttttatagtttcataatccgcaaaataacaaaattcatgcttttcttgtaaaaatttgcgaaatgaaaatattttaaatttttttttaatatttttaaaacaaaaatttacaaataaaaaaatatttttaatttttttagcttcgcaatttgcacaattatttcatcgcaaatttggccgtggcaggacctgcttctgtgcacagtgacagcaccaatgacact

SEQ ID NO: 16788 - DNA, 1584 bp, Heterodera glycines
gtccaagccacgaaatgtccaaaagagtagaaacccacgaaatgtccaaaatttttcaaaatttataaaaacaaaatgagtctaatttaggatttttagggttttcggggtcgctgaatacgaatataccctttatattaccccttgcctaaccttaggcccatctgaataataaaaaactcaaattcgagacttggacattttgtgggtcagcgtaatttagaaaccaacttaatcattcattcgtttcgataataaaaatttgaattttttccaaaatttttgttggattactgtaacaaactctgtttacagtttcaccacaatgcgtgtcgctgttgtcacatgcaaatcgcacacatcggacaacaacaatgagcagccggacgacgaatttggggagcacgtcagtgccattttggaaatggaaaacaatttgaaattgcgccaaatattttgcagaacgccaaatgcattgtttcaccgaatcaatcatcatcagcagcagctgctgcggacaatttcgagcagcaattgcgaacattgttgagaaatcatggcaaaacagtgggccaagcgaccgaagtgttggcacggcttgaaattgttggcatggacggttggtcaatgaccgcaattattcatttgtttgcctcatttgatcagatcagatctgatcagccaaccaatcattttccaatttatcaaaccgatcggttaattgcttcccattcaaaattttcaaggctttaaaagattttgggaattggcatggcatgccgagcccacagatgatcggggatatctgtcccagcttctaagcggctaatttaccaggaatatgccattcaaatttttcaaggaggacctgttgccggtgccgtgccaccacattcaccgcccttgagcaaatgccatcatttgtcgccctcccccaaatacaaccaacaacagtccaccggtattgttgcttcaacttcaaaatgctcctcctcctcatctgctttttatccaccctcattttatccacaatgttttgtgccatcgtcgttatcagtgatcattgatcataatgatgggggtggcacaaacgctggtggtggtggtggtgttgccaacaacaacagcaacaacatggcaccgtcggttgcaccaacaccagcaacaacaccccaacaaccaacagcaatgccggtctattttagtttggcacaaatttcagcaaccgtttccggcaccgcatcgtcatcaacagcatcatcaatttcggacaggcatcagcagcagcagcagcaggtcagagttcggcattcaaataatgattttcgagactgaacaaattgaacagtttgtcaactttgagattttaattggcattcaaattttttttttaattttataaatttggctcttcaccccttcatcaaattttcgattgaccccctaccccttttgtatgtatgcttgattagaggattagcttaaactatggtgccacaaaaattcatttattcacagtttgttccaaatcgcttttccattgccgacatgcaacacaacaattattgccgatttccgttgctg

SEQ ID NO: 16789 - DNA, 946 bp, Heterodera glycines
gctttttttaaaattcatataaatttgtaacaaattttgttataatttttccaaaatttgactcaaactcacataagggttaaaaagtgactttttgaaaaaattaccggaaaaattgttgtggaccaaagaagaaaaaaaaaaaagtttttttttggattctccttccgattttttttctgtctgtttacggcctgtctcgagctataatttgatttttaatgctaaattttgcaatttttttcgctttttatttgttaattaaatttaaaattttttttttcaaaatttttaagtttccatccgcctccggctgtgttggcgccgcctttctccaccggcggttctgacaatttacaacaaaattttcttcttctaaccaatacaaacggcaacaataatattaataatgataatgatattgatattggccaacatcattgggagaatgatcagaagcgataagagaaaagggacaatatattttttgtttaattaatttgtttttaattcgctaattttataaaaaaaataaaatgaaaaatgttttattgtaaaaaaaagagagaaatgaatttaagcatcaaaatcagaaaaaagcatgtgatttaagagtaagtgatcagaaaaaaacaataatatatttaaaaatgagaaagtttatcaaagaaataattattttattattttaatatttgttatttttgtcaccgtttttctctcccatttaatcaccaattaaaaaatgttttttttttgccaatttaatgcatttttggggaaattgtgatgtgtgcgcacttttcactggaaggcataactgcgcaatcactagtgctgctcgagactctcggtctcgattcgagaaaagtctcgggttttttggtctcggggtcgagtctcggagaggggtctttcataggcaattaaacaaattaataaataa

SEQ ID NO: 16790 - DNA, 2171 bp, Heterodera glycines
  misc_feature (76)..(76): n is a, c, g, or t
  misc_feature (132)..(132): n is a, c, g, or t
  misc_feature (2141)..(2141): n is a, c, g, or t
gatggatggactcaaatggcatagaatccgaaaaaagagtccaatttatggcactcatagacaatttatatttacngcaaacaagcccaataagcatccaattaaaatggcaattaagcactcaaacacttntaattttgttaatgccagattttagataatttttttaataaaaaaataaaattggattggattaattttctaagccatgcttctgtagctgatatgcttcgcccaaatgctgctggtcaatttgctgatgatgcttctttctttgcttctccgctgttcatttgctgttcagtgcgcttaatcgttgcgccatgtcgcgcaaaaaatttttaattgcagctgcgcattcatccaaaacaatggctttgctttatccctctcccccctcccctctcttgtgatcgaagccaaccaatgtaagggatgaatgagaatatgcataaaatggattaatttgggggaaattagcgcgaaaagttgccctcagggcatgcgcggcgggagcgctttgaaaatgcttttactcgctcgccgcgctaatcacatgcgcggcgcgcgcgtgttgggctaatgatgagcaaaaagtgttagtgaaaacatatagataatatatatttcggctttcaggggtgtattttttctttttttagaaatcccgaattaggggattttggttcattagaatgatttaccaatatttctttttatcaactaaaatcgagacatgttccattgtaatttgtctttatcttttttttgtttttgattatttaatttaaaattgttaataatttatatgtttaaatcattttattttaatattatataccgttctttttcgaaaaaacctacctatttttcgttgaaaaaaaaatttttaatttcgtgggggggcggctttaaaacatgagcgaatatgcaaattcagttatttaaaacatgcgcgaatatgcgttatacagttatgtatttattcatggctttaggggtttcattttgttggattaaagacgagtctttttttcaaaaaatttactgatccaaaaaatcaaaaacaaattgaatgtttggcaaggtgaaaatatttgaaatgcgtttcattgaaaaaacaaaacaaaggccgatcacttggggaaggaggcgatcaaaatattcaaaagagcatcacatttgttgagaatgacgatacacccgttgtaatctttaaaaaaaataataatattaaataaattaaaaagagtagaaataaattgaaattaatcgatttaaaaaaaaaattaattttttattctactacccttattaataaatataaaaaatcaacgtgtaaaaatatgtaataaacttttaaaaaagcatgcctaacaatatgataaaataactgttttaaatgtaaaccatcaaaaaaaaaattttttttttttttttggcatttttgccgccaccaaaaggcctaataaaaaaaataccgacaaatagtaaaaaaaaattatattttcaaaatgcaattttaaaaaattaatttatatattcctaggctaaaatgaactaaaaaaattcatttttgtttatatggttgctaaagttttaaaatttagcacaaaattttaaaaattttctcgcgacgtcgcctgccggcactgtcccgccattttcggcacttttccatgttctattttcacggcacattttttgaaatttcaaaaccgaatttcgttatttcattatcaagtttaccacttacgaatttggcacatgatggactcgtgtttgaaattgtcgcgcaacaattgaaccaatgcgggcaccaattccctcaaactcggcaagtctttgttcatccacatgtccaacaccgttttgggcaccgccaatgctttggccatgagaagcgcccgctgggaatggaaccggacggacgaagcggggccgaggcggaacacgcggggccaatcgtgcggcgcggagacggcactgtgcggcggcaccagcaaagggacctcggcagagatcggaaaacacgaaattgagattttttgatttttgtattattaatcaaagcccaattcattttttacggtgttgtctaaataaactgtctgacttttctcgctgtctaaacatcagtngtagagaaaatcgattttttttttctatat

SEQ ID NO: 16791 - DNA, 1950 bp, Heterodera glycines
aaaaaatcggattttaaagtgaattttttaaaaccctgttaccttaaacagcataaaattaagaaatagtaattttttatattattaggacattacttatgttttttgaataattaatggttttttcaaaaagttacagacaatcaaataatcaggtacaatcacttctatcacatgtataatgctgtttaggcgatcaggaatgaaaaaactgagattttaacccgattttagacacctttacatcactttctcctctcccttttgccgtctctctcatttcttctccgcatccctctcccatttggtacatctctcatcctccattagtaccaaatccgtgagccagggtcccgaaatcaaattgatattccgaccccgtgcatcaattggacgaacatttcttcattttttcgatcgaccgaatcacttatctgttctccaaaaatttttaaaatgaaatttcgttttctaattgtaggtttgttacagtaaaaaaatctaaaaaattgttcatacctaacataaaacaaaaaatgtgtcgcatcaaactcactcactcactttggccaaagtttgtgccaactgatcaaatattttgcccaactcgcgcagatcagcgatcagtccgcgcgaagtcacgcgtgcccgattcaccgaccaaaggtcgggcttcatcaactgcacccttttgccacgccaattgctgtccacgatggcacgcaaattgacaaattttcgcagcgcgtcggaacggagggcccaattttgaagccaaacgaaaagcgaacggacgtcgtcgaagtacaacgagcacaactgaatgaacgttgtgtactgatagcagattttaatgccaatcaataaataattaattgtattttaatgcctttccaatttcgtcccttaaatttcgcccatagcctttttttatttaaaaaaattaagaaaaattcttttgagaaaatttcaagaaaaagattttgaaaaattttatgatgaatttctgttttttcgaacatttttccaaacaaaaaaatgctgtaaaaatttgctagcgatttttttttgaaaattttatgttgaattactatttttcgagaattttttcaaaaaaaggtaggaaaaaattttcaaaatttttttataaaattgtggaaaatttctgtttgaagtctaacttgttgctatactgtctgcctcacatgtaaaaaagtatgaatttttttttttgaaattttttaggcacaaaaaactaattagcattatctaatgctatcaaacatacaaattaggttatagcaaaaattataacaaaaaaaaaattcaaaaaatttatgtttttgagtgacgtcataacccccccccctccgccaccttcgcgtcctttttctgtaaaattggccgaaacagtgcgtgcaggcgcgaatttgcgacgcaactttgctcaagaaaatcgtagtgcgcgaaagtggccatctcagcgagcaattcgttgggcagacgacgacgacgggcgcccgggggacggacagagacatggcgggagaaattggagggggagaaggaggcggcggcaccaaccaatggcatgtggcgagtggaggatggtggcacggtggggacagagatggtatccggcatgggcacggtgtgctgaagaagggaaactgtaaaatgagagagggatactgtaaacgaacgctgacccacaaaatgtccagcccacgaaatgtccaagtctcgaatttgagttttttattattcagatgggcctaaggttaggcaaggggtaatataaagggtatattcgtattcagcgaccccgaaaaccctaaaaatcctaaattagactcattttgtttttataaattttgaaaaattttggacatttcgtgtgtttttactcttttggacatttcgtggcttggacactttgtgggggtgcct

SEQ ID NO: 16792 - DNA, 1618 bp, Heterodera glycines
cttaaacaatttgttactaattccttttctccccggtgactcctataattaataatctttggcattccaaaattacttggaatgggatgtgcaggaagaagccgatctccaagttgcgctccagtgactgcatgatcatgccggtcaacatcaggtggtagtcgtggatccaaatgaagtcttggggacgtgaatttcgcaccgcatcgatggcaaactgaaaaattaaaataaaatgactaatttgtgagtgcctcccccattcacctggtaattgacgcgaacataagagaaccaatgttcgttgagcaccttcgagtcactgtattcgggcagaatgtattccgggagattgtgcagtgcgggccacaaaagtccgttgctgatccccccgtagtaaacgttgtagtcctgctcctggacgataacctggaaaggccaaaagattacatagatgaatacattttattggggagagctgtatgatcgtctaaacaatcattgccgtttattatgcccagtcctttccatgtggaccaattgcacttcctcgccgctcaccgggttcagcttgtagttgccacggttgtagttgttcagcacgccgagcagtgacatttcctctctgatttgctttttgaccgccgattcgtcgtcctccttttgctcgtcgttcgcaatgacatggaacagaacgtctgccaatgcctggacaaaaaaaccatggttttcaaagtttccgacccgatttgcccacctgtttcatcagaggaagacccaaagtgtttgtcgctggcgctgcgatgtgtgccgggtccatccgttcgccaatgttcgggtctcggcccattttctcgaggtattcagtggaggtgattttgaacttgtcgatgttcatgccaaggttggccagccacatgttttccgggttcacctgggtaataatttgagcaataaatgccatttcagcgcagttttggccaattacacaaatcactcaccgacatcaccgggtccacgcacgagacgagtccgcccgagccttgcttgatttcccactcgcccgactccgactgtttgagcgccaccggcggcgcgttggacacgttgatcacacgctgctggaagtgctgcgtgttcactagcccaccgcacagctctgtgccgtcagtgccggtcgaatgttgcgcgtccgaagtggtggacaccgcactgatggacatgcgcttgtcactgcctcgacgaacatctaacgaaggaggaaccaacaattaattaacacggattgttagatgtaaaatgtgagtcgttttcgtatttattccgtcataaagtttagtgaggaatggcaaatccactgttttttgagtcagtattttaactgcccccaccgtggttattgttgtgctgctgttggtgctggtgcgcctccgcgtcgtcgtctgacagattgaagctcggccgttggcctgtctgctgttgtgctgtgccatttgtgattgccttggcgtccaatgcggcgagtaactcgtgaatttggtgttgactgccagcgccgcctccgttggccattgctgcggtggaggaagcgggggacagcgaattgtgcgaggcgtgc

SEQ ID NO: 16793 - DNA, 1460 bp, Heterodera glycines
cctctccgcccttttaatgttttttatttacactcgacgcccagcagcatttgtaagcgagcaaagcccaaaaaaaagatacaaatacacaatattatgctggtggatgactaattggcaggaaattaagaaggaaggaagaaggaaacacttgcaaattcacgtgggaaaaacatgatcactgatcagtgatcatgatcagttggttggctaacttctgcacaacccctccagcagagagcatgcgaccgaattttgtacataattgaggaaaataacttttagagcccggaaatttcaatttgcagttgccgatgaccaaaggtccctttttgagtcttttttaaagaactaataaggtggaggccgatccgacgggccgatagacaccgccgggtaaattttcataattttgaatgaaatttgggattgaaaaaagattttaatacttcgctacgtttaactttttttctatacgttaaatctataccaaattttgcatatcgatagagaaaaaaattctgcacatttttaacgctcgagttttatttttttacgctccgatccaaaattttaactcaaacaaaattaataatttcttttcctctccttttggcgtactattttcacatctctagcacacaaaaaacatcaaattcgaaaattctaataattttggttataagggtacaaaatcactttggacatttagaatcaataaagaaattaatagttttagcatttttgctgaaaacagcagtttaggacttgagttataacgtgataaaaatttgaaagtatcacaacttttttctgggatgtcaaattgcttagcattcgcttagaaaaagattccccttttcaaaatctttttttagataccaaatttgttcagtttacttgggaatgaagcgagttatggcagatcaaaataaaaaatacaaaaaaggcatttttcagtgtaaattttgaaatagcgggcaaaaatttacgccaaatgcgctatttggcgttatgagcaattttgtctgacatggggcgtacccatagtgaacttacatacctaattgaatttgttataaatttattaaaaatatttggttggcatgctgtttttgaaattttcaaaaaatgcaacttggatccctcgggatcccgtcccgcttcgagctctaccgatgaccataaaagagaagagaggggaaaggtaagcttaagctcaaaaatgctgcaaatgctttgcattttggctgtttatgaagggcatttttaagctgagcttccttttttgaatggcgataaaataaaaattgtgtgcttggaaagggatggcccagcagcagaaatggctttggatgagcatacaaaatctctccccccccttcccttcccttttttaatcgcattcaaatgatggcgagaattttctagaaacatttctatcgcacgattttctctat

SEQ ID NO: 16794 - DNA, 1500 bp, Heterodera glycines
tcaaaagttttaggaactgtacaaattattaaatgcaaaatcatttatttattgatttgggtaaaccaaaagcacaaaatcagaacaaatgctgagataactcaatttattcacccgaattcaacgtacactttcatacaatattaccatacagtgccatcaaggggaacacaaatttgattggaatcaaacaaataaaatcaggaaaacaaatcaaagcccaacaaccaaaatacgtgaataccacaaaaagaagcggagaatagaataattatacgggcaattaagtactttcaggcaggaaatgattgagtggaaaaaactagaacaagactataatatataagggaaagacagaaaagcgagggaaaagagaacggccaacaattcagtcaatccaaagcaaaatctgagcatttgtccatcagcatcaacgtttatacagagatcgagtgcggattcacctgaaatgtttaaatcttgttgcgaaattcaatttaaatgtttaaaattttgtaggtatataattaaacggtaatactggaggattgcggggttctattcggttttacgcgtcccatgacactttacgcgtccatggcattttacgcgtcccaacaacagtttacgcgtcccatggcattttatgcgtcccatgacatttgtgttcatggcagggatgtcattccgaggctcaaaaatttttggaaaccggaattaagtgctatccctggtctatggtattttagccgtcctaataactatgatgaaacctttttttgtccggtattcagtaattttttaactagaattttgttgttaaacataaagtataatacaactcatacacaggcaactcgaacaatggcttagaataggcctaagcttttggcttaaacctaggcttaggctttttttgtaaaattttttatattaataactttctgttgacattattaagaaaaattataaaaagaagattctagcttgtttttttaagttttctatttcaattttttcccctttattttttgccatgggacgcgtaaaattaaaaagtcaattttaccgaatgatgttgaggcactgtgtccaattccatatgaagaatcaattcagtgcaatatgtaacaataataatactaaaaaacgaaaaattggaaagaaataatgtaacatgaacaaatgtacgtattgcaaacattaattgaaaaagaaaagaattttatcccaggagaaattttaacttctcttacattttctcctttttaccttatttcatcaaaaatctttataaaatctgctatatttttgaaggtttttttcaaatttttaaatttattcgaagtttcatagattccgctgcgggatttgcgagattctaggattaatcccgatgaatcctttttttaatttcaggaaaatataggggtaatctgaggtgctaccccatacgatttttttttgaaaattttccgttttttagtgtattttgggggt

SEQ ID NO: 16795 - DNA, 1012 bp, Heterodera glycines
cgaaacgcaattcagactcaatggtgagtgaaatgaattacaaatatcgaagagatttccatttgattgcttcgcttcctcttcagagggtcgtcagttgcgcgttgagcaaattccgggcgccgaaacgttgcacaattttgaggagttacgcagaacgaactcggaggcgcagccggacgcacagcaaacgatgcgatccgtgctgcagaagttgaagacggacagaaacgcgtggcccttccaaaaaccggtcgaccccgacgaggtgggcatcaactgctgacaatcgagaggattagcgaatttaatagcaaatgagagtgcctattaaggtgcccgattactacgattacattcccttccccgtcgacttgggctcaattgccgagcgcctgaagttgggctattacactcatgtaacttatcatatattaaatgggcaatccaagcgaactctgagatattactgtgctcataattcttatcaggagcgaatgtttgtcgccgacattcgccggatgttcgacaattgttacaaatttaactcacccgagagccaatattattaccacggctacaaactgaatgaactttttgatcggctcacccgccaacattttgctcattgcaaattgcaggcgccgctgcccgcggtgaagccggagtatgtgccaaacgccggcggaggagggagaaaatgaaagggatttttgtggcattttgtaaatttgtgacggaatttacatcgatctcttgtattttttgttattcttaagtgcctatttaccccaataaaattccatgaaaagcgtgttttcttttgctgcgtttggcggatggttttgtttattattccatggggcggggggcaccatccttctataggattatactgaccagcgaatgaaaaagcgcccctactccaaatggtgttttgttcgtgcgtgaggaattgatccatccgaaataataggcgctcggcgtttgtccatcctttagaaggtgagaa

SEQ ID NO: 16796 - DNA, 1195 bp, Heterodera glycines
  misc_feature (6)..(7): n is a, c, g, or t
ctgcannggtctttggcaattaaatcagtcggttaaataaaaattggtttctttggcttttggaacaatgactatgatgcttttcatttggccatgactccgccgatcactccaattttgtagcccatttcaagtcgtcgtctcttggcttccagccagtaattacactgaccaaaaattccattttccgccagaatccaatggcatccaatgccggatttaaccatccagttgtgatgctgaaaatggtaattaataataaaaataataggcgagaggtaacgcttaagctgggcggggctcgttttagtgcggagcagtttaacgctttaaactttcttggaaacaatcgtattaaacacacttggtatcattcgatagcccaaattttctctattaacctgcgaaaaaaaaaatttctgttttcatattattttggccattttttgaaattttgcttgggctatcgaaagatactaattaattgtaagaatgtttaatcttttgtttcaaagaaaattttaaagagttcggcccaattcgacttaagctaatttgtaaggtttgaatgtgaagaggagggaatggcttctgactgaccaatagcgacacgcgtgaggcgaaatgtgatggagtttatggtgttggcgagggaggatgaggtgacattgttgaagtaaaataacccatccgggaagattgaagtaagtgtgagaccatttgtgaatctgaaaagcaatggcaatggacaaagaatggcatagccaaagaaagaatggcacagccaaagaatggcacagccaaagaatggcacagccaaagaatggcacagccaaagaatggcacctgattggtcaatgccacgtaaaagccgcataaaaaccaaaaccaatggatcggcaagtgttgctccaactccctcggctcactcgtccagtgttgccaagcgatgtgtcccaatttggggatgcacagcataaaattgtccccattcacttccacaaaatcatgccgagtgatcgctgtcgggtcaacgtggtgttcacgaaacgaacgaatgaaattctgacaaacggaaattcccaagagtcagtgtctaaaacgatttctaaccatccctatccggatttttattacatcttttttttattttggcctttttggcacccgaaaagattagtcataattgcttttg

SEQ ID NO: 16797 - DNA, 1165 bp, Heterodera glycines
aaaagtgtccaccgttccccacgtatccgcgccccaatggacgacgcccgagctgaaatcggccatcagcacaccgacgagggatgccaaaatgagctgaccgacggggacaagccgaaagtggtaaaggagggagcagccgaccgacagaaaaagggctgacgcaacgcaaatgcaagtgacttcttggagtcgtttccctgagattgggtggatgacagcttaagccccatgccaggcttgcctttgccgtacatcgatgccaactgtttggccccggcatgggtcggcccccagcggggctttgcctcgcccatgcaaacgttggcatttccattcggactttcctcaggcaccttaaaaaaacccatcactcaccatttcttttttaaaaaagacaaccgcacagaattatcaagagaaatttggttgtctggggaatggcattcctcggaaaacggctgagaagcgacagacggagacggggaagggtcgaacgaagaacccggagggcattccatggaaaacgaacgaacgaaatgaatgaaactttcgatgtggtcctaatgggtcatcatcacattgtattggcgtcgttaattaataaatacattcgagaatcatctaatgaattgaacggatgaatgaatgcattttgacagaaaacggagagtgaatagcaaagagtgaagactcattgtgaggggtgattgatagtcgaaagaggaagcgccggaggtggagggggaattggaggaaccgccccaccaactctcgaattgctctatcactctcgagtgaggaacggggggagggggggggggggagacgggccaacgaatcgattggccttaaattggcttgctttgctttgattgtccggtcgaaaagccagacacaagcaattcccattcattcgaacaataacaatcacaaaaaattggcaatgggctgtaaaattcgcaccattatatgataatgtgataaatgataatcaatagaatgcgagaaataggtaaattaataaaagtcaacatgtgaatataaaatgtgcaataataaggaaatcgaaacgagggagctgcggccaactgaatgactgctaaaaatgtcggcagggctcatagttagggggggggaagagaataggggagaaaagggggag

SEQ ID NO: 16798 - DNA, 1376 bp, Heterodera glycines
taattacaattatttataagttcttctttttacccattctattattataaatttaaattgacgatttcacacctgcaaaaattgctgttaaatgcaaagtaagcgattggtttaccaatggtgcagctgggaaatagcttatctcctcacccgttccattccttggccattttcgctatttttcacaatggacgcccttctatcccccacttgaatattgttttaaaaatattaatgtctatattgcttgtaaaaattgtacttctccaccctttatcagatgcgcttggtgttctaataatctctgtttcgaacattttattatcactagacaccgttgtaattaatattttgtgtattttaatttttttggaccacttatttgcactttaaaattgttaataaaaacaataaaaattgttgaacccacgcggagtcgaaccaacagtcaccatgacgccatcatgcaccacttgacaccatctctggagggaaaacacaagggaaaattccgatttttgaggccccataacttttttgtttttcgccacaaattcataactcacttcagggttggacaatgttagtggaataaagctttttaaaaaaaggaaaaatcaggagaatttatatattttatttggtttttcgaaatttacagatgaaaaaagtcttttttccagaaattctggaaatttttggtttttcagaaaaaattcaaaactccgttctaaaagagagatttcacaaattaaaataaaagaaaaatccgcgattttttgcgttacaagagattttattttatcactgttttcaaggaagttttaaaaataaaactttgcctttttttctgcgcactagtttcgacatattacgtataaataacggtgctatgtcgttatataaaaaaccataaaagttatggggaaaagtacacaaagtaccaggttttcagacatttttggccataacttttttgaaacttaacgaaatttttgaaattttgcaggctaatagaggaaacctatgctatcatataatagcaagaaaataaaaaatctaagaaatttataacagacatcttttcgttagacataaaaaattttgatcatcaaaaattctgaccaaaactttcttagaaccaacaaaattaagaaagtttgatatcatttgatagctctaacatttctctattagctcaactaaatttcaaaaaatttcgttaggtttcaaaaaagttatggcaaaaaatgtctgaaaacctggtactttgtgtacttttggccataactttgttcaaacttggccaaattttttgaaatttagttgagctaatagagaaatgttagggctatcgaatgataccaagaatgttc

SEQ ID NO: 16799 - DNA, 1222 bp, Heterodera glycines
atttttgttcttgctaaaaattctaggtttaaaattttccttattctaaaaagttataaaatatttaataataatttaactgaccaaaattaagtttttggttatgttttacctgttttactccctaaaaatccttaataaaaaaaaattttaatgccttttttggggttttcaagcctttttatgtcttttttttcgtgcctattaaagtggctttttggcgatttttggtgcctttttagtctgctctacttattacatcgataatgctatataaccccgagtgatttttctatattatttttcatgtttattaaacatttaaacaagttgcacttttgaattaattaatttttgccaacattaaacaaaaaaatctatttaccccccccccccctggaggataaatagagactgggggattattttccaaacctcctagactgagggataatcggagattgggggattaatggggattgggggataattagagaaatacggtatacaacattgaagcatgtatattatacacaatgattttattgaatattttcatatgaattatacaacattaaaattagagttgagcgggaccgggaccggaacgggaattcccggtcctccgaggtcccagtcccggttcccggtccgggaaaatctcaggtccctgtcccggtagggcaaccgggaaaaaccagcactggtaagaatgggggtatgagtgaaaaattagtgatgaaaattggagttaaaagaaaaatttgaaaaaataattaattaaaatattctttaaaagtaactttgcaattgccgtttttctactgtttgtgcccatctttttgggtcaccgtttgcccacactcaaaggcaaataaaattgaataaatgaacgataaaaacgctgaatatgaataaattcaaataacctacgattattttttgtccatcccactttctcctattttggttttttgcgcgaatttactttctgacgtatctacgtaagtaaatacagcaaatgctcacattaaacctaaactcctttctataatttattataactagggatgtcaattttatgtaaatatgtacatatttttttcctggcttttccatgctctaattagtaggaaaaacactttcttttgtctgtttgcgaacaaaaatcgggacttttatttacatatttcgagatttcataatatttggtacaattttt

SEQ ID NO: 16800 - DNA, 1284 bp, Heterodera glycines
attaaaagctaaaataattttcgtatatttttcacaatttatttcaaaaaaccaaaaaagtccggatccaattttaaaaactaaaatagtgcacaaaaggggagccgccgcacggcggggcttaaaagcattgtacagcataattaaaagctaaaataattttcgtatatttttcacaatttatttcaaaagccaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtactgcataattaaaagctaaaataattttcgtatatttttcacaatttatttcaaaaagccaaaaagtccggaaccaattttaaaaactaaaatagtgcacaaaaggggagccgccgcacggcggggcttaaaagcattgtacagcataattaaaaccgaaaataattttcgtatatttttcacaatttatttcaaaaaaccaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtactgcataattaaaaccgaaaataattttcgtatatttttcacaatttatttcaaaaagacaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtactgcgtaattaaaagctaaaataattttcgtatatttttctacgaatttatttcaaaaggccgggaaagtccggaaccaattttaaaa

SEQ ID NO: 16801 - DNA, 948 bp, Heterodera glycines
agcagaacaattcctcaggttttgaaaacatttttaaattaattattttatatttatcaattaattcaaaaaatatttaaattagttgacaattaagcgccgaccaataataatcatacgacgacttcacccgccccgccggttattgaacgaattgaaattcggctggttgacactgaaaacagaacggaagagactccattaatcattgtaaatagaatatcaaaaaattatttagaattagtcaaacaattaattctaatttatgatttgatataacacaattatattttgattattaataaatttaaattagttttttgttttgtttaggttgatgttgtgaagaaaaatggttcagcaggtgaaaacaaaaaaaaaataaattaacgaaaaaatttaaaaaagtttaaaagaatattaagaaaaattatatttaaaatctaattaattttggtttgtattatatgagtcgccgcaactattgaacaatcaattctggcggaaaacccaacgcttaatgagcaagttggaccaacaaaaccgacccaatcgtaaatttagaaaataattgtaaaagataaaaaggcatttaaattccgaacaaaaaaatttttgaactctaatttatgaattaaatatttgttaaccgatttcccatttttaatcgttctttagctttttgctgcgcttacatcagccaaattatcactcggttttgtacattccgtttgaaacgaacacttccgaaacagcaacagcaacaacaacaacgacaatgacaacaactaccgataaaccaacagcaataactgcagttgatggtcggtcattatatatttgttcaagaagaaatggaaggggaaaagccaatggataaaaattcgtccaaataattaattgatgaacaaatttagacgcaattagcagggaaatagtctaattgga

SEQ ID NO: 16802 - DNA, 766 bp, Heterodera glycines
aaaattgttgagtcaaaatttttcgtacttttttggttacaactttttgtaaattatttatcaaattaaattaaaataataattaaatttaattaaaacgaacatttatacttttgtcacttcggcttaccacgatgccgtttcttaaatccgccaaggggtaggaaaacaaaaaatgtaagacatataattcataatttggcttaaattcaaccaaattaataattcttggtatcattcaatagcttgaactgttatctatcagaatataaattttcaaattttttataatattatcaaaaagttatggtcacaaaatttcataaaatcttaagacagaattttttggccataatttttttgaaactcaatgaaattttttgaaatacaagtttaatttatagtcttacattttttgttttcctaccccttggcgaaatttatgaaacgacccagcacttaaataaagccatttttgcttaccaaaaagatccaatttatcaatctatttcaaaatgaattttcttcattttctggctcatcattttgtggctcatcatagtccggctgatcgtcttcatctttcacattcgaaagctgtggatcagctcggcttatctgctgaatgataattaggatgttaaaaactccaaaatagttttaaaattgttgccaaaaattaacaaattgttcaaaatttgttgtttgcacaagagcgggactccggggtaaacctgaggatcagaaaaatcaggggttttcagct

SEQ ID NO: 16803 - DNA, 3218 bp, Heterodera glycines
catttgtattttcttctctgtaatttaatcattggaaaatgcgaatttttattttactattgtaattttatcattggaaaacgcgcatttgtattttcagttgttgttaatgattgaaaatgcgcattaagtggaaacgcgtattttttattttactattgtaattttatcattggaaaattcgcatttgtattttcaattgtaattttatcattggaaaattcgcatttgtattttcaattgtaatttaagcattggaaaattcgcatttgtattttcaattgtaatttaagcattggaaaattcgcattttgtattctactattgtaatttaatcattagaaaacgcgcatttgtattttcagttgttgttaatgattgaaaatgcgcattaagtggaaacgcgtattttttattttactattgtatttttatcattggaaaattcgcatttgtattttcaattgtaattttatcattggaaaattcgcatttgtattttcaattgtaatttaagcattggaaaattcgcattaagttgaaatgcgtattttgtattttactattgtaattttatcattggaaaattcgcattttgtattttactattgtaatttaatcattagaaaatgcgcatttgtattttcagttgtagttaatgattgaaaatgcgcattaagtggaaatgcgtattttttattttactattgtaattttatcattggaaaattcgcatttgtatttcaattgtaatttcatcattggaaaatgcgcattaagtggaaaatgagtattttttattttactattgtaattttatcattggaaaattcgcacagcggcactgtatgacgtcccgctcttgaattcattcagcggcggtatggagatgtccagtttatgctccctgaagaacttgcctccgtcgttgcggttatatgcaaaaatcgcggcactgtaggcgcgcacgaagaacctctgtaaaaacggcgactaaccaaacatagagaaatgttttttgttttgtttgtgttttagcaaaggcatataggcagactcttgccttcgtgggggggagcagagcgatgacctgttttagtcgttttttcaaaaaaaaatttaaaggataggggcggtgttggtctgttccggtatacgactcgggatcaattgctttatttattacgtgtgccgacatttcgcccaaaattattgagctaatcgccctgaaccaggtctgtagccaaaaaaaatgttttttttatgaatggttgctcttcgaaccaaaatttttttaaaaatttaagttagccatttttttgccaaaaaatagcagaatttttccagttttcattagaagttagctctattttaagttaaataaaatattattggagagatttgtattcggatatttccgttgttctttccgtcctcgattggtgcgcctatttttcaggttaaaaaatctcgcaaaattttttatttctttcattatttacattactttctatagggcatttcttacagaacactgtcctaaagcaatggcaaactttttttgttagtctctaatgtatactttgtcatccttacaaatttttttagtaaggaaagtcaggttcgcgagtttatgggttgttttgagcacacaccatcccaaaaaacgagaagtgtaccaataaatagagagtgccagagaaaaacaatatctttttttctctaattttttgtctccttttggcgtactatctaatatttctattattaggaataacaacattcacttcgctctatagaactttttttccgccttacagaatttcttcatattttgcatatcgatagagaaaaaaatataggatttttcaatcgcttttttaaagaaaacaatcgcttttatttaactttaatttttattttaaggcaaatttaattatatggcaaaaaggaaaattgtgtgcaagcttaatgcaattaaatcggcacaaaaacgggtgcaaaatcgagaggagcgacaagagaagttggagagggcgagacaagccaaatccgcaaagaaaagtgagtttttcaccaatttttaactcaaaaatatatattttttttaaattttagccgctctacagccgaatcccaatgccgaaacgccacagcaagacgaagcaggaccgtcaacatctgctgcatccgccgaagaagcgatggaaccgccgccaccaactccaggaccagtgccgacgcccgaaatggacgaggaaattttggaattcgacgacccgccgccgtcgacacctgccacaccaattggcgatttggtgccgtttccgtcaacaccaactgcgccaatggacaccggagagacgaccccgccaccgctggccattgacgagcgatcagagcgcatcgaacaactggagaagcagctcaaggaccgggacgacaccatcaaatttctgcgcgagcaggtgctcaatcgagaagcgctgatcagtgatctgcgtcggcagctggacgagcacatggtaccaccgatggcaccaccaacgaccagcaaaagtgagtgaaaattttccttttttaatttcataaaatctgatcatttttcaattttagcgccaccaaacagaggaagaccgaagaaaagactggatgaactgcagcgcagcgccaggcgcgacatcgtcgacaaaattgtgggcgtcatcgatcgtaatcgctcgcgttccgcgagccgcgcatctctggaccggatccaccgagaaatccgccacaaattctcgcactacacgccaaagaagggccaaagctgcaggagggaatggaagcggaggatggacttctgctgcttgcccagctcgggacgcagatggcttacaaacggatgaaggcgactctaaggctgatcgacaggcgctttgacacttttccaccactgagaaaggtgcagtttttcattgatttttttgttttaccaactttttttgggtcgtcgaaataaaacgaagaatttgctcagctttgaaatatgatgtcatttcaacgccaggcgggcccggatatgtttgctctgacattgacggggcactgcggttcagattgtccacggcaaaagacaatctgatcagcctgatctctgcccgtggtctgccactgaaggtcagtggcgatcacgggcagggattcacaaaaattaccatttcgttggcccatgcatt

SEQ ID NO: 16804 - DNA, 1197 bp, Heterodera glycines
tacttcggcatttagctccaaaatttattttttatttttttatactagaataataaagattatgtgtctcaatactaaattgttaatttttttgcctttttgtataaaattttacgattttacacgccctaaatttggaactttttggcacttattacccattttagcacctattttggaggtttttagaacctaaaaactaactatcttggcagtttttagtagagaccggcgcgggacgggatcccgcgcgggattttgcggaatcccagtccgcaatcccgcattttttggaaaatgcgggatttgcgggattaatccagcggaatccagtcccgaaaagaattttgagttccaatcccgcagcgggatccgcaaatttgattttttgtgcgggattatgcgggatttaattaattttttaaattttttttttcaaaaaactagtaagttttgtaaaattttcccggcggcgcctgtttttgaaaaaatcgcgctgtaaaaaacgtgtaaatagtcactccttttcccaaaaatgttctaaaataatgaaaaatgacaaaaaaagattttgataaaataattggataattttttcaagcgaatatactaaaaacatttgttaaataccttttacttggttaagaattaaaaaatttagcctattaaaatatttagaaatttttttattatattgtatattttttgaaaaatttccgatttccgacgtttttggggtcggaaatccgatttccgacacttccgaaatttttggggcctcggaatgccatcctgataaggaccgccggacccctgttcctagttttttgaaaaattgcaccgcaaaaagtggttttgaaaagaaaaaaatagtcaaatttatgaaccgttaataatttgatttccgatcaactttttaccgtcggatccaatcgaaaaatcttagtcgacccatcagccccttttaatgcatcccgccagcccttaaaaatttatttttcagcattttttgatttttggaaattctttgaatttaattgaaatttttcgattttccaaaatcctgcaatcccgcacgggatcccgtaaattttaaatgcgggatttgcgggattaatcccgcgggatccgtcccgcaaaaaattttgagttccaatcccgcagcgggatccgcaaatttgaaatttcaggtctcta

SEQ ID NO: 16805 - DNA, 1595 bp, Heterodera glycines
gagtttctttggcacgaggactgtaagcgacgtaacgtcgatgcatttgatgaaattttggcagaaattgttgcttttatgcttgcaaaataagtctattaatattgaatgctctttgttgtattaaagaaatggggtgtgccttcaaaacgggaaagtacccacagctcagctggtgcttcatggacgaaacccaactcgtactgccccaactcgtactgtttttcaacaaaaaaaccctcataacttttgtcaaagtcgaccaaattaaacattcttggtatcatccgatagtccttaacgttctctatcacctgcaaaatgcaagaaaattttattgcttttcaaaaaagttatgcccaaaaagcgtaaaaaaacttttcgttcataacttttttcaaactcgatcaaattttttgaaacttgttggatagatagagaatttaagggctatgaatgataccaagaatgtttaatttggttgactttatcaaaagttatgacaatttttttttgtcgaaaaatagtacgagttggatttttcccgtgcttcatgagtatttggggaattgacgaacgatctgtggtttaagaataatgagtcgaatgtaaaaccttgaaaattaatgaaaaattttaaaaacatttatttatttgaatgattaaaattattttctttccattttatccttttttataattcaatttctgatcagcattgtcggttttactcactttagttggcctttaaagaatttattgtttaagcaaacaaaaatattaattaaatcccataaaattaaattcatttattcataatctaattgtaaaacatttttttaaatgggattttggacccccaaatttggcatttgaaagtcttccgttgcttctttttattgatggtttgccgatttctccttgattttggaggtcattattattattattatttttctgtccatttgcatatccgttttccatctattggctgagaacaaattacctttacaagcaaataaatcgttcatttattcacattaaatgccggctcatcacagaagagcatagctttttcaacttttcgatttcctgacgaattaattaacttttataaaaaaccgtcccataaaaaataattttatttgctatttaaatgctatttttattatatattcatttctatgaaatatattattaatttttgatccaacattttttttgggggggggggggggaacagttttccaggcgcaacgaacttaaaccaaaaaaaaaatttatcccgaaaatggctgatccttgcatttttcttaaataattcctttgacttttatctcgaaaaacttctgaaaactctaggttaggtaggcttcgtgcttcgtacgatttccactgattctggcgcttggcggcagcgaaaatcctaacaaataatcattaatttttaagatttgtgcaaatccaaaagcaaaagaaatgaatttttggcattttgcaattgttttgcttcatttatgtatgcaaatgttgtcagaacccactgctgaagtgcaggagaatggtatgtttttttttgttcaatttttaattat

SEQ ID NO: 16806 - DNA, 1010 bp, Heterodera glycines
tgcaattgaaagcgtgtaaaatggttgcggtaaaattaggcaaataatcgatactagaacacacaaatcagtcgtagtgaatgagagaaaggtagacaaagaaaagaatgaatggcagacaaacagagaaattttggtaagggttagaaagataaaaatgtttttacaaaattgaaaagaataaacaaatggcggatactaaattaaaattttgcgatttttatttaaaaaccgaaaaaagcacaaaaattgtccatttatcactggtactgtaatatacaacgaacctggcctttgaccgcaagaataagtgatagatgcaattttaattttaatttattagaaactggaacggtccgtttttaaattatttggttttcgttaagtttaatataaaaagaccaaaaatatacaaacaaaatcattatttccattttttcaatattttgatattttcatccatatttcggtattttacccaacaattttaaatatgcaccgcgaaaactcaatagttttcgaaaaaaatttccattttttaatttaaaattaccattgaaaaattttaaaatttttttaaaagaaaaaattcaaaaacaataaatttttacacatatgcgcttttgcttttagtctcaaaaatataatatttaagatattttgaaattaaatattttttgagaatttataactagggatcagggatgggcgaaacttcgagcttcgtgcttcgaaaacttcgcgttttttgggcttcgaacttcgagattcggcttcgggtaatttacccgaagtttcgggaaaaatacacccctaatgattggcttatggtaagctttaatttaaatatcattataaactttgttttttaatgtacagtacatgttaaatttgttaacataatacgccaaatttaaatttttcctccggcggcgcctatcggcacagcagtgccccaaaactcctttttcttagaaatatgggcccaaatcgcaaaatttgataatttt

SEQ ID NO: 16807 - DNA, 1762 bp, Heterodera glycines
ccccctttagcccctggggtggttgggggtctgaaaaagttagacttggggttagcgtggattaacgaaacgggaggcgcggcgcttttgcattttattatgtaacttgtcggggcgaacatttaaaaaaaatttcaagtccgtagcaccaggttgagtaggccatttgtccggaaaactggtaaaaatgaccgaatttggctgggggccggtgtattagaggtggcattggatgtgaaatgtggtgccaacgtgcttaaatgagattagaaaatttttggacaaagttccgagttggtcagacaaagtgtcgacttggccagacaacatgtctgcccctgacaaagtgtcgaaatttcaaattgtgcgcagaatgaatttatttaaaaaaaattctctacagcattacgagtataagaaaaaaaagttgatatttatattatttccttttccctttctttcactttcctttttccttttccctttccatttcttttcccttcacttttccctttcccttttcttccttttgaacgactaggctcggctgctctccggtagccggtaggggtcaactccgtctggccaactccgtctcagcaatgttcaaaaagctataacttttttctttgttggccaaacttcacaatcatggtatcattcgaaagccctagatgtttagaagatatttataagctatttctcagtgattaatcagctctcaaaaaattgtcagtttaaaaccgcaaaaaaggcagaattttcaaagttttttatttctatctttttttatagttctaaattttctgtaatttttagtaggctaatagagcctgtgaagagctttcgaatgatatcaagattgtttgattcggtcaataacttcaagaattatattgactcaaatttggctcagacggagttggccagacggagttggcccgttccgccggtagctgcttctgcacgaagataattggttttttggaaaatcattagacagaagaattccgctgaatgaaagcttttttgaaagtatagatagaagatgaaaaattcagcaaaatactgatccaaaattcacattaatagaaaaaatttctttcattttttcctgtttaaaatgttcctcaacgcgctttttgagttcctcgactgttatggcttccatttcgttttacatgggacaatatttcatgttaatataaaacaattggacttttttgttagcgctgaaaaattatttccacccaaaccaaaaagcccgctggcggtggataaaagagtattgagaaacgaattaatatatcatattttggcgcgattcagttatttccaccaaaattaaatatgaccgccagggatggcattccgaggcccaaaaatttttcgggaatctgaattctgaccacaaaatgttaaaaatcgtaaatttttttattatatttcattttaaatgttcttcagatgaaatgggtggaagaaataaataatggtgaataaaatgaatggaagtgaaaggaaaatggtaaattaaataaattcttcagatgtaacggaagtgaaaggaatttaaaaatgttgaataaaatgaatagaagtgaaaaaagggtaaaaattttgaaaaatgagaaaaaggttaaacaaatttgaaatttttgtgtatttatacattcttcacagtgacatcaatggccaatgtcactttgtccgtcctttggtcgtataatcctttgctcgagtccatcaattccttaatttt

SEQ ID NO: 16808 - DNA, 2958 bp, Heterodera glycines
acagtcaattcgaattcggtcatccatcagaacgaaggagggaattttgatggccaatcccaaaacatatttttgggaatggtgaaaatcgcaaatgaatttatggccaattaggcaaataatataaactgcttttgtgccaatattttccaatttttctaaaaaaaaataaataaccatcgtccgttgcgcgtgtcgtgccgtggcactcggcttggcttcatctcccccgccccgctcgcctggggctacaaaattcgctgctaattaatatcaacaccgtcctcctctcccgtcctcgtccctccaccctcagcagcagctcgtcgctgtgcccatatcggcacttgttataacagaaataagcccctgagggaaagggaaatgatgcgatgagtcccttcccccaccccacccccgggggatgggcgggggagaaaaggtggcggtgaattattgcaatgcaaattcagcggaccaataattatgctgctgctgctgctaataataaggattaataagccaaagcgcaaaagggaagtgccaatatttccaatatttttgtgtcaaatgcgccttttccccggatttaattaaatttttgcaaaaattttttccttttaaggattttttgcctgttagctgctttatcttatcgcgcaaaaatcattccctcgggggattcagctaaagttcaccaaattgattcgctaaaatttggccataattttcgacggaattctcaacaatattttagcccataaacttaagcccccctcccccggcttcttcttttcccttttcgtccctttggccatctgtcgtggccaaagatccccggaggcatttcatctgtccatcccaccaaatgtcctcaacggacagagcaaatcagcagaggacatttgttctctgctgtcgcaattcccataaaattggcaaatcgaagtttattccgtcggcactttccgatggcaatccttcaattttcaatttaaattttggtaggtaaatgtattttatctataaatacatattaatggtcaatcaattaaacgattgtcttctttagcagaattccgctgtttttactcaatttgaattgcctttctcttatcagtgcctccccccttatcaccagtgatcactccaatcgcttctctcttttcttcccaattcattcatttccttcgattattcacttttctctcatctcttcgaatttcttctgccacaaaggttaattattaatatggtcaattagtttaaaataaaataaaattcagagaaatggaggctttttttgatcggaaatgcactcagagatttaatgttgaaagaggaaaatattagcccaaaaaataactttttacaaattcaaatttcatttcagttctgttcatttttggcaaaactgcaacagatgccctccctctcccccccccccccttatactataccactaattcccccccccccccctttgcccaccttctgcccaattaatgcccattttggccccttttccccattttccatttgcccaacagacgccccccccccattcattgtgaacaaaaatgaagtgaaaaggtaattcaactgatgagacactttaacagccatttactaattggggaagaccaaacttttctcttttttttgcacttttcgccaatgaattaattaatttttgcttacaaattccatgcgattttccgtcccccctcccccttttttcgattgtgccaaatatcattccccaattcggtcaccacgtttttcttcagccattgtcctgctgaatgtgcatcttccgtctttcttggccctccgagaagggcacagattttcgtccaattcccagcggagtgccacctcaaaggtcactcccccgccgccattctctgcccattctcacctcccctggggggacgggggggggggggggggacaggtgctattcccctctccccgtcccgttagagtccgatgcataaattattccccccccgcgtcgccttttgacaccattcgctgtgtcctccgccggtgagaaagggtcgagagcgcctcgggagaaaaatgttgcggaaatttccatttcaatgctccccaatcaaaagttgttttgcctcataaaagggctgtcaaccatttatttgtgtttatttttggcacaaaaggttttcccctgcaaaattttcacacatttcgcccgggggtcataaatttgatacaaatgccccgaggccaaagagaagaagccgtgccatcgtaataaattaatgcccttgagaaagtcctctccccttgctgatttcttctctcctttaaattaatggctttacccgtcggtgtttggccaaaagtctcttcgaatgtcccggctttccccccccccggcgctttgtgctgagagtgttttcgggcggtccccaaatattgccgagggtcaaactttggattgattgaatgccccgggggaacattttcataagaataagcaaaaggggacgacagagaaggaagggacaactgttagccacactctcgacgaaataaactcactcccggcggcggcattatttgtccgtcccttgccaatttttatggacaaattcgcccaggggattaaattaatgagcgaatggccaatccaaaaagggcaattaaaaattaaaagtgttgcaaattaaatttaggctttaaaatctcgatttcaaaattgatccaaacaaataaaacaaatgaaaggctaaaaggaccattcccttttcttccattattttcattaaatgatgccttcgaggcacggggatttgtcccgaatttgcattaaattgtgggaatatcacccggccggcacccgtcccccccccccgctcattcattcaccggatgttatcggggggatcaacggcgagacggaggaaggggaaaggggggattaggcat

SEQ ID NO: 16809 - DNA, 2908 bp, Heterodera glycines
aaaaacgcctcataattaagagaatataaaatcttctctccaaagtttttattaagtgcacctttcccaagggccatcgggaacatattcacacaaaccgaatcctaattcggatcatcccaattttcgaaatcattgcgcattaagcggtactgcaatgatctgaggtgcgtaagggtttcatcatcatttggattttccatagcatcaaagccttgaaccaaatttcttatggccaaatcgttgtctctataagtttttttcctttctctaattcgtatcccttgcgttggatccaattcgtatgttggagcaattgtttagttaaaagcatatctagcggcacatgccggtgtcattttgacagcatcaatgatcgcaaccattacaactttgtccttgtccatatttatcctcatcaaagaagttcagagtgtgttttaattatttttaatttataaatttattctttttatttgtaattttttattaatcacttatagaatgccgttgtgatgaaattctaaaagacttctttcccgttacattcgttataaacacttatgaatttactgtctctgtgaaagaatacacacccaaagatgtcttttccaaaatctcgaaggaaattgggcatcctgttgaccaaatatgttttgcatgttagtgcttaattcaaaaggactcatattaaagcataaattaagctccgtctgattctgcagtgacgagaaaaatcaaaaaaactgaagccgacatgggacttcttttactctacacaattcgtggacaaggaaggctcgagatatttgagtgtccctaaattagttttgtgtgaatatgttcccgttggcccttgggaaaggtgcacttaataaaaattttggtgtgaagattttatattctcttaaaatcctcaaaagtcgggtcctcaaaagtcgggtcctcaaatgtagggtcctcaaatgtagggtccttaaatgtcgggtcctcaaatgtcgggtccccaaaagtcgggtcctcaaatgtcgggaaaatcctcaaaagtcgggtcctcaaatgtcgggaaaatcctcaaaagtcgggtcctcaaaagtcgggtcctcaaatgtcgggatccccaaatgtcgggttccctaagtatcgggtccccaaaagtcgggtccccaaatgtcgggatccccaaaagtcgggtccccaaatgtcggtgccccaagatttgtaaaaacccaaaaaaaaaagggggggggctttatcacctattttagtacctatttcattctttttagcacctaaaaatcctgtctctactattgagaaaagttcaaacgaattttggcgaagaagaattatttctttttttgaattctctgtataaattttgctttttagttgcactattttaatatttgtttacctgatccaacttgagtattcttcgaaacattcttcaaaaactgttttttatttttcccttttggcgatttcgatacgatttgctcattgtcaagaaggtacgggtcgcgtcccaattcatcgttcacttccaacaacaacccttgcaaaaacttcccttctgcgaattttgtcccatttttgtacaactgtatccaatattctacagtaacccacgtacttagatttttgaatttgacctaaatttaaagaacattggattttcctgtgttaacgaccttaatgtctaaatattttcctttgccccatccgaacaagtctcggtaaactgctttgattgcttccattgccgagctcattaagagctcgcctcgctcagtgccaaaccacggcttcacacacagacattcaaatggattcactaaatttaaaaaaaagcctaggaacggccgggtcgtatgaatccggcttacttatataatatgaaatatgcaatggaaaaatcaaaaaaaggtttaaagcaaaaataataaaaagaagcctgctaggctgaaaggacccagcgccgggtctggtggcgcttaaatgccaaacctttggctttgtgccaggtattgttgccagccagccttttttttttgttcaaatccaattgtaaggcaggcggccacaaaattttgaggtcgtgctgggtcatttcgtaaaatccaccacaatcattcccacccataattactttcgataatatacttggaaaatattttgccaaatttatttataataaatagataatctgttataatttaattaatagtagataatctgctatgatttaaataattcatgattttaaataaaattttgactacttttacagaatttatgttacaccctaacaattgaagaaaaagctcaaggctcgatttaaaaaaattatctaaatatttgtatgtgaaatttataaatgagttacaaatgttagtttttagccttcggaaaatttcatataaacttctttattatgttttgactttccttttttggcatattcttatttttgtcgagcatttaaatatgatagatcaaagtgtctgaataaaaacttgtttcggtaccagaaaagctgaagatccttttgctataattaaaatgaaaatttactccgtctcgacgatccctcgggcaaattcattttttgctgcttacattcccaacatttggcataagcatcggctgccagcgcaaacattcgccaatgtcggcaaattttcttcaattctttgaacgttttgcacaattttttgtgccgttccttttctggattggtggcacagttcagtgtgttttgccatcgtcctatttcaatgttggtacaattccattttgccacgaaattgcgccaaatgaaccgtttgctaagtgccaatgccttggccatgtcttgttcctctgatgggtgccatcatcttcgatcacttccaccgcaattatg

SEQ ID NO: 16810 - DNA, 1176 bp, Heterodera glycines
ggccaccatcttccaattactcccctcaacttcacctaatggatggccgtgctcaaattctctatccctgtcattttgttggatgaaattctcaaatttgtcgcccgacggatggaagcacatggtaaatgggggaggaagagacggcaggaggaggagaaaagggaggaggaacagaagcagcagcaggcgaaagcggaaaaaaataacgggaaaaagaagcagagcacgggcgggaaaagggctaacactaaaaaggctgactaatcggaggatgacatcacagggcgtgtgaaggcggactgaccgaccgaccgacgacggcccttctcacacatgccctaccgtactccaccgtactcttctcccctccctttggcccatttgttacgcttttgcttgggatgctttggatgttaacatgttccaattgctcgcccgttcatttttcctcgtttcttttgctgttcactttatccttcgtctcggcatattccctccgcctgctcattgtcctatccaatattttgcaatgctttgaccccctcttacgaccttttgttttcatccatcagttattttgattaaaaagatgtgctaaataataacaagcttggtcccactcaatcagtaacaactaattttgaatttcactaactgcgcatgctctgaccaactgcttttggaaacaaacgacaagatacagcacatttactaaccaaaactaccggaaatcgggtcgatattttaacatgattttacacttttggggagggcatattcaattgtcctaaaactggactttttcgtggctaattcaaattttggtctcaataatttaaacggcgagtaattttgggctcagcaaaaagtaacactttttggacaacatttaaacaaaaaattttttattagtattttatggagcaaaacacgtaaaacttaatcaaaaaacttagttttgatcatttaaatgattattaaataaacattttaattttttgataaggatttttaaatctataatctttatctagaaaaaaaaaattagatttaggcgaccaatttataagaaaatttttcacttaggggtgtattttcacaattttattgcatttttaatggaatttttcggaaaaccccgcaaaaaggcaccaaaacggcaaaattccaaaa

SEQ ID NO: 16811 - DNA, 2438 bp, Heterodera glycines
  misc_feature (94)..(94): n is a, c, g, or t
tgcacagtgaaatagcaaatatatattttagtttttgtgtatataataaagttccgagtacaaacgatagcttataatttaattatagaatatntagttaattaaacaaaactatttgaaattaaagaaagatacgagtattgcaaaaggaagtgacagaataaaggcactcatttaacaaagaatagtaacaattaatcgcgaacacagcacaccccgtcccattcactcccctccagtgacatcaacgacgctgaccccaaacagcggttgccgtaacgggcttctgctgctgtgcagcaacagtatcaccagacagtccggggaactgttcgattgagtcaatctgccatggtgcgttcaccatttcgatgtcatttggctcagcctttggtggcggtgggtcatcacgtcgtacaatgtactgggattcatcataaaggtcgaactgaaaaactgcgtttttttttgttggacaagtagtgagatttaccaattcttcgatgatctcctcaatgcgggatttggcccgttcgacgttatcaacacggcctcggactgtgaccaaagagtcgcccgtctcttgtttcggaaacgaaatttgacatttaaattccttttgaatctgcttgagcacttccgcgccccgcatgatgaagtgacgatggtatttggggtcgacagtaatttggatttgcgcctgggcctccatgtcttccacaattgcttcaattcgagccttcgctccttcgactaattccttgcggcctcggattgtgactaaagagtcgcctgtctcttgcttcgggaacgaaatttggcaatcgaattccttttgaatattcttgagaacttccgcgccacggatgatgaagtgtcggtgatgttttgggtcgacatcaatttggatttgcgtctgggcctcctatcatgaaaaaatagtgaaggaataataaaaaggcttgcttatacattagttatagcgctacgaattatgcccaaaatttaatcagataactaaacgtatgttgttaaattcaaggcgccagcccggttgttacttccagtgatacttaccaagtcttccacaattgcttcaattcgagccttcgctccctcgacaaattctttacggcctcggattgtgaccaaagagtcgcccgtctcttgtttcgggaatgaaatttggcattcggactctttttgaatctgctttagcacttccgcgccacgaatgatgaagtgtcggtgatgttttggatcgacatcaatttggatttgggcctgggcctccatgtcttccacaattgcttcaattcgagccttcgctccttcgactaattccttgcggcctcggattgtgaccaaagagtcgcccgtctcttgtttcggaaacgaaatttggcattcgaaatccttctgaatattcttgagcacttccgcgccacggatgatgaagtgtcggtgatgttttgggtcgacattgaattgaatcttcgattgcggttccttaataaattggatggtgtctactctttgtcttcccattggctctgccagcccaccctttcttcgcccggtcgcgtgtcatccggcgcgttcctcatcgcctcgaagcggggctcgctttccaatctcgcaatttcggcactgagctgttgctgagcttgtttgaccagatcggtgggtccttcgatgtagatgacactgtcttcgaaatcgatcttcaactggtcgtggttcggcaccaaattgtgcaaattctgtccctttgccccaatgagaaggcgtcgcatccattctttgtaaggcaattcaatggcgatgttgctactcgctttctggtagactaaacttggaaagattttaatggagaaaaaatcattgaaaattccaacctgcgccagcggcgtcaccaattttgtccttgggtcctctgagaatgacagtttcggaatcgctgtcctctgggggcaactccaccagcacctccgtttcccggaaaatctcctccaaccccgcacgtttttggccgatgacgtagcgatgctgcgcctttgggacggtcacttccacggagacaacggactctttctaaaaaatcattaatttactcgtgtgttgcccaatcagcttatttcccgtgaaccttctcattgaaaatcttcaaaatttcgaccgccgcctcatcgacgccgtcgcgttcgcccgttatgattatcgtctcgttgtttgcgtgtggtggcggaatgttcactttggcgcccgttcttctcattaagtcttccactaaatgttagtaggcaaagttaaattcggattgataatgtctttgttttaaataacatacctttctcgttgttcattcctttgatccacgggtaaaaagctcgcggaaatgcaaggatttccgttttttgtttggcctgtgaaatcaa

SEQ ID NO: 16812 - DNA, 3768 bp, Heterodera glycines
tagaagcttaagtcctctgagccattcttcgaattctttgtctggtagaggcaatactttgaataaatcgtcaagagtgaaatttttaagcttttccattaatctaaaaagcaattgcgacaataaaaaagaaaaaaaaattttgaaaaaatttgaccccaaaaaggggggtacacacgcaaaagagggaacccccccaaaaggtaagataccacttgcttataaaacatctcttattaaaggttcaatgcaaagtgcccgttttgttgtgttcagcgacaggctatgacgtctctaatcgcgtggaggaccttgcattcgaactgaaaatggacattttgtcaattgcacttgggtcagccgaaggatttgaacaagcggacaaagcgttgcattcgactagccgatcgggaagatggattctgctgaaaaatgtgcatttggcaaccgaatggttgactcaacttgagaagaaatttcgccttcacaatccacacccacattttcgtctgattttgacagctgaaattggctccgctctgccaatttctatgatccaggtgtataatttaaaaatttacttttttcaaattccaactttttttcacgcttcgcgtgtacttattttcgaaccatccacagggctgaaggcgaatctgttgcgttctctttcctccatttccccagcacgaattgcgaaggcgccagcggagcgagctcgtctgtacttcattatttgctggttccatgccattgtgcaagaacggctccgctatcagccactcgggtgggccaattcgtacgagttcaccgacgcagatttccgagtcgcgtgcgatactctcgattccactgttgacatggtcgcacaggtcattctttgttttttgtgatgatggttttctttttctatttagaacagggcgaatgttaagccggataaattaccatggctggctctccggactctgctctctcagtgcatttacggaggaaaaatcgacaatgattttgatcaggcaagtatacagtgggtttataagggaaagaaataataaaaattttcatagtattataaatgtttggttttgaatatcttttagccattttctcacctttctcgctagatgcattatttcacacttaatataatttaggtgcttctcgatactcttctcgacaaactgttcacatcaaattcatttgacgctgactttattctcattgaaaacatcggagtgaacgccttgaacatgccagacgaaactaactcaaaggatgggttgatcaattgggttattaacatcaaagccttacaaaagcctaattggattggacttccaaacaacgcagaaaaagtgcttatcgccgaaagaggtactgctttcacaaaccgaaatgccatcatgacgaaatcatttatttatcaattatagggcaagaatttatacggaagatgatcaaaatgtcggacgatgaacttgcatacgaagcggatgatttggaacgtaacaagcaagcccctacctggatggttcaattttctggacagtgcaaatcttggctcgatgctttgccacaagtataccgtctttccctctgaaaagattgacattcatttaattgttttcgtttattgtttcctattctattttttttagcaactccagcgtcttcgacggactaaagaaaatgtgcgcgatccgttgttccgattctttgaacgtgaaatcaacttgggcgccagacttttgtccgatattcgacgggacctcaacgaattgttgtccatttgtcatggggatcagaagcagaacaatcacagccgtgaattaatagctgcattggtcaagagaaaacgtgtgccagacaattggctccaattttccgtgccaaaagacgtaacagcacttgaatggatgcgagactttgtgcaaaggatggaacaactaaagcgcttgtcactttctgaaaatctgagatatgaggaagtttggctgggtgggatgttctttcctgaagcgtatataacggctacgcgtcagctggtagcccaaacgaatggctggtcgctcgaacagatgtacatgcatatcacaaaaacggaggaaggacaattaaaatcaacggcattcacattgacaggtggttgatgatgatgaacttcgttttcatcgcacatttatttatagaccttcgcgcaattggcgttctttgtgaggccgacgaaattaagctgacagatgaagtgcatgttggagtgccacggcttcagttcacgtggaccttggaaggacattctccagcgagtgttgtggtgcctgtttatctgtactccaacagggccaaatttttgttcggacttaatttgttaccaattggatttgatcattctatgctaagccagcgaggagtcgcctttgtctccaattgttcgctttgattgacttttgtatcttttgtctcaaagaatatttatttatctgtctattgtttttaatttgtttccaatgaataaattttgaattgcgttttttgcagactaaattagggaaagggatttttatttttcccttatacttccatgatttatgaatagtaatcgaattaattgccttgtctaatgcactgctttagagccttatgcgcgttagggtaaagtaaaaagcacagtaaaatattaattaatggtgaatcaccaaatcagatagaatgtaatgcagattcaaaataagaaaggaatgatcatgattcgaataaatccaaattgaaaaattttaaagtgtgtaagccaatgaaacaattggatgggtctcacatactttcactcatcaaatcaatttgcttgctggtgcacattgagaaaatctgggcctttcaagcgaatagcttctgcgattccgttttgaggtgtcttagaaagtagctttgcaacatacatccctatataaaacacaattagaaattttttttttgtaaccaagcaagttcatggaactgtttcgaattgttggagacttgactggccgctgtttgatttaaatgagtaacattgttcagtatttttggttcattaaaatgttttggctcgattttgcgcatttgagtcgttccaaaatccggcaccacgtcgggaggaaactggttaaagtgaaaacaaagccagtgaactggaagggtgctgtaattacaaatttgtctctccacctgtcccatttgtccttcaaaggctgcaattgatgaagtgttgatgatcactccgcgctggtcgttttcgtccggcacattgtcaatcagcagcgggagggcgtgtctgatcacgttgatggtgccgaagatgttcacctttgggaaacagttacaggatgaatggacggcattttggcggtcaaacgtcgatgagtcgccgaattttgtcgaggtccatttgggctctgctcgacggattgtacaatctctgcgcgaaagcgattccagcgcaattgaccaaaacattgagaccaccaaatttctccgttgttgcgtccattgcctttttcacttgatcatcagacgaaatcttaagaaagtttggaaaatacgaatgatttcggttcagtgaaatgaacaaaaaaaaagaagaacgcacatcgaccggagagaaaagcacattgtcagtggtgcccaattcctccaccactttcgctacttaaaattttaaaattcacgtgaaaccaccgacgaaccaaaagaccccccccatccactgcgaccttcagacatggcaaa

SEQ ID NO: 16813 - DNA, 993 bp, Heterodera glycines
tgacgatttttcaaaatttgtaaccactttccaaaaagtctgaaacgcaaaataaagcgtatatacgtttcagcacctcaaattatgccataaaaatgcattttggctaatttaggagcaaaaataattttcatgaaatgcaaaaccatggggtcccccctatggttttgaattgcaaaattaaatttaatttcataactttttttaaattcaagataaaaacatgagataaagcacattagattgggcttaaaattctctgcaaaaaagctcttagacgattttttgataaaatcaactcctgacgagttatggacccaatactgaaataagccctcaattccggaaaattttctatttccaaaaaaatttttaaaattttttctgaaaatgacaccaatcgatagagcatgaaaaacggttgcttgaaagtggtcttcgttttgcccggaaaaatctgtaaaaaatcataaaattcaaaaacggaaaatttttgagggggcctagctcgaaaatttctgaaaatttcagaaatccaaaaacatggttggatagagctcgtcaagctgtacaaaaaagccgcttacaccgacctcctccaatcaaaccccggcgagttatttgccggcgctgaaatggcctaaaaaagtatgcaatttttgctcagtttttcggaaaaatcggtaagccctagggggtcggtgaagaagcaaaaaatgtgccaaacattccaacttaatttcctatgggagcggatttttcatttaggcctttaaaaaatttttgaatcccaaaaacggcaaaaaaaaatttaaaaaagccatttcagcgccgctggcgctcacctggccaccggatcaaaaaatctatagttttcccagatgcgcctcaaaaagttgtccgcaaggtcgaaatcccgagcccctccctccagcggtcttgagatttagtttttgaaaacgaaacacgatttgattattagtgtattaaact

SEQ ID NO: 16814 - DNA, 1837 bp, Heterodera glycines
ccgcttcgcggcctcaggacgggcgcttcgcgcccgtttttttaatttgtgggagggatccggccgcttcgcggcctcaggacgggcgcttcgcgcccgttttttaattttttgtgagacgttcggccgcttcgcggcctcagactggcgcttcgagtccgttttttaattttttgggggatattcggccgcttcgcggcctcaggacgggcgcttcgcgcccgttttttaattttttgtgaaacgttcggccgcttcgcggcctcagactggcgcttcgagcccgttttttaattttttgggggatattcggccgcttcgcggcttcaggacgggcgctccgcacccgtttttaaattttgtggtggatatcggccgcttcgcggcctcaggacgggcgcttcgcgctttttctctatttttaaagctttattataatttttaaatgcataatatgaaatatttattgaaattgaaaggaaattatttgtcgaaagtcaaataaaataaaacttttattcatcaaaaaaattaaacataaatcaaacaaacaatatttaattaattataacaattaaataattaattttaatacaaagcatttatcaaaaattattttatttaaattaaaaattatttttttattaatttataaatcactattttaaattaattaaaaacaaagaggtacaacagtgattaaatgagttacaatagtgattagaagaggtacaacagtgacaagaagaggtacaaaagtgataagaagaggttcaacatggtttaaaattatataaataaggaaaagtttcttattaaagaataaaaatcgaatgcattgaatatttaagaaatttgaaatgatattattttttacagataaaaaataataatgaaattatttattaaaaaaaatttaaaatttacaaccaatcttcaaattaattaaaagcattgaaaaataactcaaaaataaatagaaaaataatgtacaccgatcggatccgaacttcgcccccccccccaaaaaatgatgcctcagaatccccaatcacacagggattctgaggccttaacgatgtccaaaccaaaatctgattacatattcgtgatcagcaccctaaaatgtccctaaggacatgtttttggatggtttttgatggaaaaaatttttcactcaaaaatcctgtccaccccctttggtcccgaatcccaaaatcacttttatttttgtatctttttttaaaaatgtgataaaaatataaaataaaatttatataatagagcaagaaattgcggatttttgcagtattttacttttacagtatgacttttcagaaccgagttatgaatttttttctgaaaaatcaaaaatttccagaaattctggaataactttttttcttttgaacattataaaaccaaataaatcccataaaattctcccgattttttgctatttttaaggctttattatagttaaatcgatgaaaccatcaccgagttatgaattttcaaattttaatccaaatttccaaggaccaaaaaaattttaaaaattttcgaattttaaaaaattccaaaaattctgaaacttaaaatagacatcataatcgtactcagcacctcaaaatagcccagaaaaaaaattttcacccccattttggcccacaaaaaaaatttcgaaaatttctagggggcctagctcgaaaatttttgaaattttccagacttatagtacaccattcgatagagtatcgaaagctctacaaaaatgttctaagacaatttttcgcaaagatcaactcctgacgagttatgggcccgggactcaaat

SEQ ID NO: 16815 - DNA, 1424 bp, Heterodera glycines
  misc_feature (1359)..(1359): n is a, c, g, or t
tcaaaaaaatgtttttaacgatttttaagcgaataggaaaattttttgaaaaaagttcgagtctcgggttttttgggtctcggtctcggggttttcggtctcggggtcgagtctcgggaaatttttggtctcgaacagcactaatggttagcataacaatcagaaaaatctgattaacaaatgaataaaaaaaattattacaatagtaggaaaaaaaagaaaaaaaatcgtcaacaaaaaaaagaacaaagaaatcctttgcgttttaattatttttacggattattgaaaagaataataaaaattttggtgtaaaacttatgtaacaccctaagtattataaaattttttaaaattttcgtccaattttaaagacgtataacaccttaaaaaagcccacgagcaaaaaatcagaaagtgaccaaaaaaccttaattaaaatgcgctttatttaactaataattttaaaagtaaactaacagcacaaacatttatcagataacaaaaactccctcaaaaaatcacagtgaagcaaatttgttttctcatctgatcagtgttgcaattcaaattcacaattttttagcaattatttcgtatttttggattttcatctttaatttcaaaatattatttcatttttattactttgagctcattcaatattcgttgctaaaagaataaatatttcaacgaataaattcgattaaattttttttacagattttaccgaacaatgaaaattcgtcaaattttgacgataaaaatttttttaataaatttagccttaacatcttatatttctttaattaaatcttaaataaaaaataaatttacatttcgatattgttgcaaatttctttttccaagttctcaaagttcgacttccaatttacatttttctgcaatttttgggatatttaactcataaaaatgtaatttgtttgggaaatattaaataataaatcgacattataataatggtctacaaatctaattaataaattaaaataattatatattaattaattaaaatcatttattccgtactgaaatgacccgccccttccgatcacccatcactcatacttttttagcttcggctcaccacgcaaaacaatgaagcctatgaatgtataacatcgtatttttgatttattttctgtaatatgtcatttgagtacaatctcgaaatgtttttggaaaaaagtgaaaacgaattaagtttggaagaacactggttggggatggttttacgaaatgaggaggaaattaattatggaataattaaagaggaagaaaacggggaaaatgcgcagagcaaaggcaaaaagcaaagcacaaaaattttttatggancaacggacactgaaaatgttcttcggatagattttgacggaaaaatagcacaaatgtgcgaaaaa

SEQ ID NO: 16816 - DNA, 1289 bp, Heterodera glycines
ggcttggccaagtgaggcgggattggttcccgctcctcttcaccattctcgtccctttcttctcttgacagacttttgccaaagatgatcaatttttgctattttgagacaattggcgcccatttttacattaaatggcttttttgaagtcgcgtttttaaaaaaaaaactatcttttttaggggggggggagtccggatatataatttcatcgaaaaacttaagaaaaatttaaaaacgcaacccagaattgatttttaaaatttttaaaagtaactacataaaattttttgaaattttgtgacaaacttaatttaaaaggtgggattacggattacggatttccgtaattgaaaatccagttacgcccagtcctggtgcagtgtgactacggtcactgtcctgaccaagcaaaaaagtagaaaatattcaacaaaagaatggcataaaattgaatgaaaatttgggaaaaaattgggcataaatcacaactatatttatcaatggatcaaagaatttaaccttcaaaaagaaaactgttataaatcaaaaacgggtgaacaaaattgaaattgtttaaaaatttaatgaataaaaatgaatataaacaaaaaaaagaaaatattcgaaaaaagaatggaacaaaattatgaagaaattgggaagaaaatcagagtaagcagtaatctaattattagggctataaattatatgcttttgcatatttttcttcacatatgctataaaaaagggggctcaaaaatagcatttatcgttaaattttttgatttggtgaaggtttttagtgcatataaaagcatattttggtctttttaagaatgaatgcatatatagccatttttgggcttttaaagcatatttcggtcatttttagcaaatttttgtaagaaaaataataaaaatgaaaaatacacccctaaggatcgacttttatgggaattaaaaaatacacccttaaaaatcgaaaaattttgaactttttctaagaacttttgaaaataaattttgatgcaaaagaaacaaaaaataataattttgtttgagtattaaataaaaattcaaaaaaaaaataaattttgaaatttcaaaattttttgcaattgtctaaaaaaagctccttagccattgttttggagtttttaaagtcaattctgaatttttgcacaatttttgtcatttttttgagggttaaaagccatttttggctgtttttaaggcatattttagtgcatatttgggcatttttcgggtttttagagcatatttga

SEQ ID NO: 16817 - DNA, 902 bp, Heterodera glycines
tgtttggattaaataggccaattagtgttgtcctactttgtgaattgatcaaatataaattctaacataaatggccacttttcaaaaagtaaaaaatatatttttatgtttttcaattttttaaataattcaaaatttaaataccattttcaaaaattgttttgaatggttccgtaaaatcgatgtccacaatttcagtgctgcacaataaatgcgctttaaccttttccagatttttgattcccatttcgccattttcacattgtccgttgtttttgtaacaataagccaaggtaaacacctaattaaaaattaagaacataattattttaaaatatattattttgacaaaaatcattttattccattttgcgatttattgttgctttttgtgacaaaatataaaataaaatgtgattttaatgagtccttttaaatttcgctgagtaaaaacaacaatattagagatcggcctggatccaggcctggattttttgtccaggaaatctaggtccaggtcaatttggaaatccaggttcaggttcaggctttttccaaaataccagtctctaaataataccaataaataattaaatataaaaaggaatttacactaaaatacattaaaaaataattatgattattaccattttaataaattattttacctttatgcaattgtcccggttaataaaatgtgaatcggaaaatgctttctctgccagcgctttcaaattttttcttttaggcaacataatttttttatgcgtcttcacaagcaatagcatggcgtcataaattgaaattgagtcaccgtttgaaatggaaaattccggtttcagtgcaataaaataaattcatttttgaatagctctttataaacgataatttaattaattaac

SEQ ID NO: 16818 - DNA, 1763 bp, Heterodera glycines
catcaatcaatactagaatatttttcttttttaattgcaaatattattttttttaaagatttgaattaacgcgtacatttcacatatccggttgacctctggtttccacaagagaaaaaaatatgtgaaattgaagtaattaaaaatgatcaaaacaaataaatgccaataaaatgtttcaccggaaaaatgagaatgtcatccatcatccatccatgcaaataattttaataagaaatttttttttgcttagtttgaagcttaggatgtgttttatttccatatttcattcataactttttcgtattaaaatttatatttaaaagaaattttcttaaacatttattttttcttaaagagaaataattggattttttttgttgcttttatctcaaaatgaatggtttaaaatttagcgtaattcacccaattaagagaaatttcatgtttattttttgaatatttttattcatatttcggagatttgtgctaagttggagcttatttttggatttttcgtccatacatattattatagtttcatagcgtgctaaatttgtgagcattttaattatttttattttttcaagcaaattttatttataaaaataaaatgtagagtactaatgcattcttacaatggcgtagaaagacaattaaataaagacaaataaaagtcaaaatcacaaaaaaggaaagcttgcggcagcatattttgtggcccaacacaaatcagacatttaccgctcagttaattagacccataaaatggttaatggcattttcatacttctatcaaaacatcaattagtctttccatccaaaaaacattgaacattttaccgatttaagcacatcaaatgagccatgtgagagcatttacagcttcattagttaatttatgtacacatatatgaagaggaatgaggttttttaggtacttttttcgtgaattttttatacctatttaaataccaattttagcgttttttcttacctccttacttatgaacattttttattttctgatcgatatttaatttcccatttgaaattaatttttaaaattataattttttaatttcataaattatgttttattacagaattggagagaaatgataaaaattaacaaattgcaaattccttatttttatcagtttcttttcattcttttaatttctccttttgaacattcattccaaaaaaactattaaatattttacgaagtaataaaatggtaaaataatttttaatttataaaatatatttttaaatttccttaagaattccgctggctttgttctactgctgtggaacattgtcaatttgcttattgtttgtgaaggaaatgtgctaaaagaggtaataaattaaaaagtaacaaaaattcatcaattagcattagttacactaattaacgaatcggtgaataattcagaaagttgacaagtcttttgcaagtgccgatcttttggttgcgcatgtgaatggacagcagagttcgtggaaggtgtgcttattttgtgtattgaaagacattttaattgtttgctaaaggccaaattaaatgccaaatttgccaaaatgacgccggaggagcagcagcaattaatggggtcacgtcggccatttcttgaaccaatcacaaaaagcacaaagcaacaaaacggaaagccacgccttaataaagcggacattccgttgaattttgatgcccgacaacacttttacaagtgtgccgatataattggcaaaatcca

SEQ ID NO: 16819 - DNA, 1163 bp, Heterodera glycines
ccctcctccccccccccctccgtttttctccaccgtcaccatcacatcattcttcgatcttaaaaaatcgttcgtttatttatcggacattttgtctgactctgttctaaatgagtacttgcacaaatttgcaaatgaatttctcacaattaaaatgaatcccctaaaaggcggtgacttcttctgtttgttatttaagcttttaaattctctaaacggcatattgttcatcataacatcacatcatttccactgtttcttctgctgaatccaccattatttatttgtctaaaaggtcaatccccccattttttcccaattaattctcttattttgcccaaatattggtctgccaaaaccacataggtaggtaataataattttcgtcatacatattcacacattttgtttgcatattctcccacacaacacatagtcagtcagccatcaatatccgtcccaattttcccactgaaactgcaaaatgaaaattctttgacgtttccctctccttttttggcatttctgttgcttaccgtattttttattattaagcattatttatcaatttttatttaaaaaataatcggcaataaaacagtggcccgacagtttggcacaaaatttattctttcattcattccttcgtttgtgccattattctctttgctctcaaaacgtgattccctagcgatgcccatcgacgctgctgctttgtgcttttccattgcgcggcattaatccttcccttttgacagttggcacaaatcgaagtgagtgacggagtgaagcgccgggggagggaatgttggggaggggaggggagaaaaaacaaaagtgcctcggtcaattatcgtccgggaggaatgagtgttcgtttcctgaacaaccaaccaaccgttagaaggaggatgaatatgattatgccgaaagggcggagagggagggaggagagagaatgggagggaaagggaaggggggatagaagagagaaaaggagagatggaagaggagagaagaggagggaggagagagggaaaaatagagaggggagggaggagagaagaagagagagggaaaggagagggaagagaggaaagtatggaggagtaaggagggatgtccgggagaaccccaaaacgggagagtttaagggcgggagg

SEQ ID NO: 16820 - DNA, 1796 bp, Heterodera glycines
  misc_feature (84)..(84): n is a, c, g, or t
gtcatgtctcgagtgtgttttgaggccaagtctcggtcttgtaccgtctctcgagcagtttaaagcaaaatcatttttacaaangatcaaggcgatgcagcactgagtgaatatgatcagaaattcgtcaacgctttgcgtctcaatgtgcaggaaggccgtgactttgggtacatttttgtcgttttggccgaccaacaaaaaaatgttttgtccggacttcagcaaaaatctgattaatttttccttgtgattgtttctccattccctcccaatttatgtaacatggcaaaattgatgaaattattagaacaaagaaacaatttgaagtcttctaataacaatatcattgtacccatggcataccgtccattcttttccccttcagtcgtgcaatgtactccccttttcacggtgaacattcttccagcaatgtccaatcgcctgtgacgactccgtccagaggtcaacaaacgctgtctttgtcggctgctttggttcaacagcagcaacaatcgggcacgtacacaccgaacgtaccgcagggggatggagcagcaactgcaacagaccgtagggagggggggggggagtgacagacctgaacacatggaaaagcgaccaatcaattatactcttcattttggttttggcttttgttttttaacttccatttacattacacttttattggttgggttggcagaattgcgcctaattgcccaccttcgacaaccgaccaattagcaaaggatcggataatttgtcacttttgacgcgggggaggacgaaaagagtccgcaaatgttaagcgtccctaaagcccagcggaggaaaagctcatttgctcattagaatttgtgccattggatagcaatgaacaaatgccctccctccctttgtgtaaacattcaatcggccgaaagaaattcacagcgaaggcacaaattaatagtgcaaatgaacgcacatttgtattggtggtgaattggcattgcattttttgacgaaaacacacaaaaagacagtgggaagggaagagaaacggacagcagagcagcagcagaagggaatgcgcaaaaatgacgtttcccttccgccgacgaagaaaggaaatgagggcaattaaatcaaatcaattaaaattgttggaaaataatggaagagaaaaagaaggcgaaataataaagtggaagaatagaatgatagagaaagggagagagaaagaagaaagagacggagagagagagtgagagatgagagaaagagagagagggagggggaaagagaaaggagagagaggtagagagagaaagagagggaacttcccccccccccccctccctgctttctttttggccgaagaaatgacttttgtttgttttgctgggaggggaggtggggggggggtcccttcccacgatcattttacgcttacaattgaaaatttttgttttacagaattgacatatccggtttatcatttttgatttaaaacagataaaaattgaaacttagtctcatcactcgtcggtgtttacatcccttcccccccccccttcccatttcatttccaaattcaaatcctccaaaatccctcgtgattcattcccttcactggaaaggccaaaaatataggctgatcgatcgcataagtcacacacagcggaaagaatctgataaaagagcagtgaaaaagaaagaatttttcaagaagaaatggggaagggtggaagtgataaacagggacaaataccatcggtgtttgtttggagttcaccgcgggggggggggga

SEQ ID NO: 16821 - DNA, 2188 bp, Heterodera glycines
accttttcaatctataccaaattatacataaaattggttttacattctctcactttcgcccaaaaaagccgacgacgagcatcagcaaatttcttaccgccctttttcacttattccgacgtcgccggcgctaattgtgcctaattaatcactaatcgacgaccgggatggatggatgggtggatcggatcatcgttctccgatcattgctcatttatttttttcacgctaatcactaattctcacatttgctgcctttattttcacagcacaaaaaaagtgggctactgcacaacaattgttgataacacagcttaattgctcaagagtcgagaccaagaagagcacattgacgagagttaaaaaaacactaattcaactcgagattgaaaggaaagcgatcatgagatttcatagattcttcggattaaagcaattgttttaccgagaaaaattcgcccgagagaatagagacaaataaaaaattgctgggttaaaaaattgactcggaaacttaaaaagtcaaatgccagggaacaaaatgcccgattctcattccaaagaatcttggttctcgatctcgagacatttcccccgatgtttccattttttaattatttattttactcgccattctttaaaaagtgtccccccccccccccacccacccacaagcaattttccaattttgcacccttttcagtaatgagaagagaatgatgagaaatcaacaatgcaaccaaccaaaccatccaacaaggaaacaaagcaacaaaggcttttcgttttaaaaattaaaataattaattaattattaaatgattggtcgcctctctctctcccccgcccggcgaaatgccctccccccttttttcgacttaaaaggtcgccgccgtttttccattcaattgcaaattgaacttcctatttcactgttcactgttcacacattcaccatctctccccgtttccccgcatattacaaattttgaatgggttgtcacataaataaaaaaaaagtgtgaatggaggcgaagggacaaaaaaaagggggggggggcgaaggacagaaaaaatggcgacgaattaaattttatgggtttaaattttttaacggtttttaaattaaattatgaatgagcagtggcgacaaacaaacttttttggatcgcatatcggacgatggaattgacgagaagagattggaaaagatgaggtgaaaaaatgaattaatcgaatgtttatgatcccctcagggtactgatcaatggatttgccaaggtatttagctgatctctaagactttcccgtaggaaaatgctggtcccattaaatgcataatctcaaaacgatcggatatccccggcttttatcagcaaacggcaattactcaaggacagggggttagcctcgtgacccgagactgataaggcctttgtccctgagattagaagaggccaagacctattccggggacttatcttgactcaatcccgagattctcgagcaactgttagttgatgctaatgatactcacctgtcttgggttcaacgacacaacagcggtcggttgccggggcggtcggcgttcatggtgctgttgctgtgctggttgggcggtgttgctggtgttgctgttacaggttgaacaacactcgttgttgttgttgctgttggttgccgaccctttgttggtggtggtggtgttgctcatctttgaacagcacgttgatgtcgacatgataatacttcaaaaatttggagtgtttgaaaatggacttgaatcgaattcgaacaaaagttgcagggcttggaagggaaggtttggaggaaaatttgtcgagaaatttgcctaaaatttttcaaaaattcaattaggctattaagaagcaaatggtggaatatggcccgaggggcgaacatcaattagccggcaaaaggaaaataaaagaggggaatgagaaagagaggcaaagaaagagagaagtcgcgtgaaacatgtaatggaagaaaattttttttttgagaaatttgctaaattttttcaattaaatatgtgcttgttaagcagcagaaaatggtgggaggggtccaaaaatgcccccccccccccaccccccctcccccctcttccccaggggggcgggggcgaacactaattagcggtcaaaaggttggcgaggggaaa

SEQ ID NO: 16822 - DNA, 918 bp, Heterodera glycines
gatgagcaattagaggcgtgattggaagaaataattatcaagttctattgagataacaaaattcagtactccgctaaacaaaatgagcaccatctggcgaatatcattgaagcagaaacgactgttcgattatcacaaagcgattcgtgaattcaatgggaaaaagtaagatctggaagggaaagatcagtttcaaaggccgcgaggaaatatcaaagcaaaatgaaagaacaaagatcactttctaatgatattacttagacacaataaaccaccgaacaaagacaaacattagtaaaaccttaataaatacataaagagcattcattgagtgaataattaggaatcattaaattttgaacatttcaaaacggcatgcataagatgtatatagatcacttgaactttactgattgaagaaattcagcatttttagccctattgggctaagggcaatgaatgacgccgggcactttttgtgtcccacctcccgtgcccgcccctcgcgggcggagtgacgaaaaattccaaaatggaaaagcgggggcggcgaacgtttgcccgccggggaggagggggtgggaggggaatgagagggagccgaggcgggagcgagcaaagcattaaatgcggagcggaatgaaggcacctcaaaaagaggggaggaggaaggggggtgaatgcttctccccgctgttcttttttgttgtccgtctcctgccgagccgacggacgacgacccgatttattctggccgagccgacgcttatttgtggccacgagtcgattcgattcgatttatggccgagcggaagcgtcggggaagggcgatatattgaggctggctgtggtgccgtcattaatgaacagcagccgaatgaggaggggggggggacgggagagaaaattcgggaacgg

SEQ ID NO: 16823 - DNA, 231 bp, Heterodera glycines
gctcgagcaggacctgcagaagctagcttgatggggatcagattgtcgtttcccgccttcagtttaaactatcaagagagggaggggagcggcgcgtagcgggggaggtgggtggcggaagaagaaaagggtggggggagtatgagtatgatggtcaatatggagaaaaagaaagagtaattaccaattttttttcaattcaaaaatgtagatgtccgcagcgttattata

SEQ ID NO: 16824 - DNA, 2807 bp, Heterodera glycines
ttcaataggttctcgccctaaaaggacggaacagtacagttctcgtcctaaaaggacggaacagtacggttcacgtcccgaaaggacggaaccatgaaagagagagaaagaatagagaaaatttttaaactgcaattttttgaaaaagatttcaaatttggacgaggaaaattccattgattcacgtcctaaaaggacggaaccgtaagatctcgtcctaaaaagacggatccgtatggttcatgtcccgaaaggacggaaccatgaaagagaggagagagagagagtagagaaattgtaaaaacgcaattttttttgaaaaagatttcaaaattggatgaggaaaattcgctcacgtcctcaaaggacggaaccctaaggttcacattccgaaaggatggaaccgttggaggggggggggggaatgaggagtttaaattttgaaaaaagaaaggtatatttaaaataaataaaatgagatttttgtggaaattgaggaaatttacgaaaaatgttaagaaaaaagaaaaattattggtggaaatggggggacgacggcgaagttacatcattatgagcttttttggcgctccttgcaaagagaacaatttagaaattttttcactttttttttgtttatttttacacataataatacatattaaacattaacaattgcgacgctactgtaaaagtggtcgatttttaaaattttttgcacttttttggtctaattttttttccaaatttttttacaaattgactccatttaggctattttttgcaattttgtattcattttcgttcggtttagcactcccgtgtattgttgcccccccccccctcaaaatctttaaaaatttataggaaatacccgttttaacttaatttttttttctgaattaaggtcttataaaacgcacatcttcaactgcctcatcaacatcatctgccgcaaccggcttcaatttttttttgggtatcagctgtcctgccgacatcggctatgaatacagaagatcagttccaagttcccactgtggcccaattgcatgcgatctataaggaggacatgataaggcaatgaacgtcatgttgaaaaccgaaggctacaaaaatcgtgaaaacccgcttgcggccagtcctagggaacgtgcagcaacaaagaaacagctcaggtgcaaattatatctcgtaataccacaatttcaccccacccctttggttacttctgaaatttattttatatagttctttttaccggtaaaccggcttccagacgtcttgtactattctatacttctttgcctagtctttcattaaatttatatacagaattaagctaaatcaaattataggacacatttacatttgaatttaaaatttcattgcctaaggtgttactcaggaattgtgagacacatttatgatatttaacattaacggagacacaatatcctatttccccaatactgcacctatttgctggaaggatagtgttcacagatcatctttatattaaaatgggacacatatgtatatataggttaataattagtcaactttttgtgctgccaggcaaacgcatcactcataccactctcgcagacggaacagatgtccagcttgctgaacctatttttcagcattcaaacacttctcctgtctcttacacgtaattacttaattgcctgttatttttttaagtgtataaaaataattattttttgtcagtttggcctttggggcgttggcaacgtttctcaagtgcgatggcctgaacacttctgccgattccgcggctccactttctctctactacacgttcaaccgaacgaagaagaatatcctgaatgcagctggacaatttaaagacaagatcaccaagagagatgtcactcctccgttaaaattctacagcgacttgtgctttgcattgacaaccgggttcaacacaaacatacgtgaacttaacaacctggcacatctgccacttacatcggctaaaatggctttctacttcgagcagttactcgacagttagttgcacactttttttttataatgcaaagtagtcagataggacacagtagtgtgtctgcacgggtaccaccacacacataaatgtgtcccagtcaataagtgctccaagtagtcagataggacacagtagtgtgctgagcacttttgtgtctgatttaaagaacttaaaaagtttcttaaaaattcacttagggaaaaatgtctcaatttaaaagtctcaaaagtgtatatttaactagatggaatcggttttgaagtgccattgactatggacaaggaattctaccctcctctggcacaacttgttgactacaagttaccagtgtacggagacccttccaaactcaaacatatcggccatgcacttgcttccaaaagagatggaccggagaaggtaattaatgtccatgtgtaaaaaagtgatttcgcctatacttttataattttgttgttgtttcagcagcaattgttatttttcttgtccgttctgatcgcggtcactggcattgatatttctgccgttatggcttctttgggtgatgacgatttaaacctttctggcggtacagctatggacatctctagtgcggacattacgcttggcgcctccaacgttagaaagaaaactcgtcttgacatccttgtgaagcaactcttcaagacgatcagttgcccctggcttatttcatcatggagcagatcgagatggaagaagtcaaccagctattcaaaaataactatctcattaagcttgtgacgctata

SEQ ID NO: 16825 - DNA, 1143 bp, Heterodera glycines
tcattataaaaaaataatatataaaaaaggtgaaaaattgtcaaaacgctgtggctttaatatagcgccacctttgttacgtctttaaattctagctgtatatgctccttctgccgactcggctccgtgttggcacattcaaaacatgctagaaggaaaacggactacatcagtaaaaataatacgcagttatcaaattcttgaaaacatttagctccaaccgacatcatcatgcttgctgcctatctgggagtgaatctgttcatttcagtgcagtttaaaggtttccagcaccagtttggaattccaggtaatggtatttcagtcttatatagtatgagatacaaaaattataaatggttattaggctctgcttctgtaacagtcacattaatgtgtctcattctataaataaccagttacttaaaaaagacacaaatattttaggcaacagagcctaccttaaatcgaatctggaacgtgcagacaatgcgcttctttcgctgaatgaatgaattgtttttttaattgactttaatataattagctgcccatccaattcttcactcatgctggagatcaggctgcttcctgggtgatcgaaaagctcaaaaaggacaccgaattgcgtgcttctccttctcctattcaactcaattcatgttgcttttgtttcgacataagcactcagactacctacatcatctcaaaaccgaatgagttcctcccccgtcgcggccatactgaggattcccaagaatcacaagaagatggcgaataaagcacgggacaaagatagccgatggaattatctgccgatccggccggcacactaatgtaactattttggcctgcttttgcaagcgataacttctctgcctgcccccactgatttcaaaataaaatagtctcttcaacaatcactttatccttcatacgaatttcctcctctggatgtcaatgcgattataaatcctagcatatcggggcaatattaggaatatttgaaagtgtgtctccttaataagtaacatatatgtgactcaagaattcttagtaacacatattccaactgttttttaaattacaatgaaaatgtgtctcgtaatttggattggcttagtgtgtccctaaatgtcaata

SEQ ID NO: 16826 - DNA, 3558 bp, Heterodera glycines
ccaaaccagtaactgccaaattttggcctttgaactaagcacgaaatccttgtggcttttgttcccaactttactgccactttgcatttgtgtgtatgggttggccaaggtggcagaagtgggcgtattctctcgctcaattatttcggcaattgcacgttcggcttgtggcaacagaacaaaaagtttggaccattgctcggcataaactgtaacgctaatccaattgatgagcatcttaaagtggctcacaaatcagtttcataacatttatttgaccgtgtctaaaggcacctgtacgatttggttgggagcggtgcaatattcacgcatccctcgcccgtacagcttcagtgcttcttgcaagtttcccatttggacgtattgctggaacaaatcctcaagggcacgtctaattgactcctttcgaaggtgttggtgccatttgcgatgagattggtgccacaatataataccttaaccgcctcgtccttctgccgtttgaactcggcgagcagtgcctccaatcggctgttgcccttcacagtggtaacttccacccaagtcctgtccaattccgggatgctctctaccccctgaattccgctcgccttcgcagattccacgcgctgatacgcggcactaagcatcgaccaattttgagttttcaaaaattgacactaattagaccaatttaaaacaaaagtgcaaactttaatgacataagtgatgagcattttcaaggcttcaactttaagcggcggacaaacgtcggcaatgaacaacagccagaaagggaaaagggttttgtgctgacaattagtaaatgggacatttttgcagtttaatggacttggtgaaaatccacagggtgacgtttttaaattattttttttaaataaaagcaccccacctatcgtttttcatggtccacttaactgcaaaagctgtctcaaagaaacctgttcatcagagcataatctgtgtagtcattggaaagcgaatccaaatcgatgccagcggagttaactgtgggaggcttcggttgaacttctgaatgtggaaaatcgattctcaccaatatttaccaagtgaataaccgtgattaataggttcgtcaacaccaattggatcatttatattccctaagtcgaaatcagcagacattggctcttcgataaactcatcctcatcttcctgctccatcccctccataaattcgtgatcatccattaataaaatcgggcaaatcttttgctttaataataaatataaattaaagatcatttaaaaatttatgaaacgttccaattgtgagacaggatactatttgatctagagaccgaaattttgaaatgaaggggactttgaaaatggatcgggatggaacccgggacgaggctcccgtttttccgggaatcccggtttcagccaatttttaagaaaaagtttttggtctggcggtatctataaatgtctgacggtgaaaaaatgtaaatttttgcaatattttttaatataggtacctactttaccaaaattgtctatttttgcaaattttagtgaaattttgagggccagtggtgcaaagattattgacgatgccatcgagaatttgtggatttatgaattaagaaaaatgagtgcaattttcaaaatttgcttttttataaaaaaaattgttattttttatttcagtgaatttcattaattatcgtaaaatttaagactgcactaattatatataattataatttgcagtgcattgttgcgattttttcattgggcaatggtaaagaatttggtccctaatgaaaataaattaaagcgttaaattttatcaagatttaaaatttgaccagttttaacttatattttgaaaaaaaaatttccaactttttgttcgaattcgggtccggggttcggaattgggcaaatccaagttcaaatgcgtaatcaacaccctcgaaaaccccgggaaactgattttgagccgaaaataataaagttaaattagggaccacaattctttaccactgcctttcattggtaatttacttagtttcaaaaaattttaatttgggtttggtgctacatacaagattccaaccatcatcggttcatatgcaagaaaatatttattcaaaaaaatgtacaataacaaaaataaatttaaaaagaagaaaaattgctcggtattccagacccgtaaagagtaaagtagagatcggtaagagaagttcgaattcgtgtttcctatcagatgaaaaacaaaaatgcacgaagaattaattattatgcaactcacagtccgaacatccgagattatcccccacaaaaggtcggccaaacgttttgtattcaatggatataaagtgctatacagccaaattaaaataattattaaggaaggtgttatcacttttcggtccattcaaaaggcgggttaacacaaagccgttgagccacagaattacgaacaaagggatcgggatcatttgcaaccaattcgacgaggctaaatgctaatttgggtaatcgcacccaacgatcgactcaccgaagaatcgtgccgatgaatgattgatttcgacttcgtctgatcattgccacaaggcacgccaacgcagtgagccgcaacttaacaaaccaacaacatacaaaaagactaaataattattgctcaccggtgcataaatgcctttgcactggccaaacttccagaaaatatccgtgtcgattgggagatggcgaagtttttgcaacttgattaaaaaaataatgattaatcgaatttctttttggcaacgattcaattatttacttcgtaaagcacttggatgcagtgaatgctgataattcggccgaagcttggcctcatcgtgtccatgttaagcgcatgcgtaacttccctcagcacaccacgcgcatgaaccgacaaacaatcgggttgttcaacagtccgttcagacattgtcaaagttttgccttttgttctcaaattaaaaaaccctaacccttcttttaccaagtgcgtggatcagtgctcctctgtagtaatcgtcagaataactaaagcaaaaacggatgaattttagaaagcgaaaaatgaccggttagtgctgttgtcattgagcctaatcaggttgatgatgaattccaacacgtattccggacactctcttccgtcttggcctcgaattaagccaatagcagcgggcaaagcctaagatgaagtgttttcggcgtgaactaagttaatgagtgaacttgtccaagcaaattgttctgaaggttggaggaagtggccgcgtaattatttggtaatggaatgtcaggcgaagttttactcccaaaattctggcgaaagtaatcgatgagtgggggagactcgccaagacggctttcggggagactgttgtaaatttggacaagacagtgggcagcctctcgtcgaattctgaaagtagtttttaaaagtaaaaggaggagagacggaaaagacacatggtgttgttgatacgcagcagtgaaaaaaagttattggttaaatagcaa

SEQ ID NO: 16827 - DNA, 3823 bp, Heterodera glycines
taaaattttaaaaatattaataattttatcaaataaacgattaatcatttttatttttattccacaacttttgacagatgttttgacgtggcttggtggtttgatcagcaacaggcaacaaccgaaacaggtgttacgcaacaaacaattgaaatgataaaataaaatttaaatttttaaattaattttttttttgttaattaagtatttattgcttgtttagcgtcttgagtttgacgagcgcgaccgtagcggacaaactgggcacgactcgacgatcgaaacgactgtaaaaacaaaaaaatttaaattattggccacttcattttgatttctaatattatgtttgttcgatttcagcttttgacccttttccacaacttgattgatggatttctgatcggctcatcggctggggcaccgctttcctgcctgagcgtttccgttgcgttgctgtgcaagcagtccaaaaaaagtgaatagcgaaaatactaatttgtagtgccaataaaccaacaaaaaatacttaaaaaataccaattaaagttaagaattttgataaattgccaacaaaaaacgagaaaggacgaaaaaactatacttacaacatttttattccgtgtgatttttaaaaaaatgataaaaaaaattttaacacttatgcaaggttttccgaacaaaaaatttcaatgtttttgaatattaaataacggggcaatgaaggaatgtgataaaagctcagttgaacttaatttaatagtaattcttataaataacgattaatttgtcactcttttctttatagtgcgcctgggcaagtcaatgaagatgaaaagcggaatgtgagttctgaaaaaaataattttgaacaattccaccccaatgctggcgccccataaaaaacgtttttttactatttttaatttcccgctttctttttcaggttcatttacatctcctcggtatgtttgtttttttaattatttcttaagacttatggctgctgctgtgaattcttaaaattaattttaaaactaaaagttcaccatcccgcaatttaaacgggaattttattgtgttatttcttgaagtttaaattattttttgcttatatagacatgaaaatgcgcaaattccaagggatttttgaggccggaattcatgattatagaatgtttagcctctggttcattgtacaataaaattcatttaaaattttccgcccctcttcttaggtttgcatgttgccggcaatgaatgccaaaatacaagaacagctgaaggagtccgcaaaaaaagcatttaatgttttattgtgtttttttaattcaattttattcactcattttaaattttgatcaaattttaccattctatgaatttcatttatttattcgtttattttcctatttttcaaaaggttatttgtaatcacttcaaactgcgcctgttttaactgctgaaccatcttccacagaatcttaaaaaagtgatattctttattttaagaaaatttatgcgtatttaactaaaatagtgagtaaaaatgccaaaataatgacaaaatagtggcaaaaagtgtccaaaaattgatcaaaaataattttcattccataattgcagttgggtgcttttttcgtttttactgcatttttattgagaaattttccaaaaaaaagttgaaatagtgtaaaaatagtgacaaaatgtcaaaaaagtgaattttcactattttagtgaagaagcgccaaaataatgttttctagtgacgaaaaatgtcatcagaatcgaaaatttttaatgcagaaatgcgttttttgaactcctttcttcaaatcaattgagcaaaaaaaaaaaaaattttcactaaaatcacggccctagtaataacttttttatttgaagatatgtagaaaattctaataaaagcaaacagtcgcaccaatgctgcagtgaaaaattcaatttacgaagagaaaaaatttacaaatattttgttttgtgtatttttggattgataatgttcctaattgaaaaaatcataaaaaagactaaaataggttctttttaagcgatttttaagcaatttttagagaataagaaaattttttgaaaaagtctcaagtttttgggtcttggtctcttaaagccagattattctaaatttttaagaacaaaataaaaaaatatattaaaaactgttgatttattttttttaaataaaaatattctattattaatgttttcattgttttccatttaaaagaaaatgttacagcacaaatttggctcggaattcataaactggtttctatttaataacataaataaacttggaaatgtgaatttaaccattaaaaacaaaaatcggctgtgggctgtcttaaaaaagtaatacctggaacccaaatatttttacatataacttaatcactgacagcagtgcaaataaggtacatttcctttccaatattttcttaacaaaattgagcaagaaaaaaatttggggaagaatttttgataaaattttccaatacctaggtgtgtattttttgaattttttaggtcgatagtagcaaaaatagtggcgaaacgccaaaatattggcaaaaaactattttagtggccaacttccaaaataatttttttttagtggaaaagctccaaaatagtgattcttagtagagttgagcgggaccgggaccggggcgggaaatcccggttttttcaggtcccggtttttggaaaaccagaaatcccggtcccggttttgccagtcccggtcccggcgggactaaataagcactggtaagaatggggtctgggtgagaaaagagaagggaaaatcgaggtcccggtcccgacttttctagtcccggcaagtcccggtttttgtcaaatttcccggtcccgctcaactctaattcttagtgatgaatagtggtgttaaaccgaagaatttccgagctaaaaatgagtttttcatgcatttctcgtcgaaataaaaccgcagaaaaatagttaaaaactaaaaatccggaccctactaatcaagtgcaaaattcaaaaaaaaaattcaccactagtattttttcacaaatcctcgagctcaactgatatttatagacagcaaagaatagtaaaatattgttaaatttaaaaatattcaataatttagaggaaaatagttagatattttatttaataaaattttatcaattaaagtggtcataaatagggctgccaaaagtatgcaaatgcatatttttttcctggcttctcaatgctctaaatagtacgaaaacactttcttttttgtgtttgcgtataaaaatcgggacttttatttgcatatttttgcatattttgggcctttatgcatattttgcatattttggcttgttttacattttcatgtatattttgccattttttgtgcatattttccgattttttgcatattttgccatttttcgtcaaatattttccgattttttgcatattttgccattttttgtaaaatattttccgttttgaatatcccttaagtaaattttggcagacaataggatgagctttagtgccgaaaatcttgagaaattattgattttcaattgaaaaaaaacccgataaaatttatgaggaataaaaattttttattggatttgcacccataattttcaagtttttttgtgcatatttggtgcatattttgcgatttttgtgcatatttggtgcatatttcacgactttatttgcatatttatgcgcatattttggccacttttcgtgcatatttttggcagcccaaataattatttat

SEQ ID NO: 16828 - DNA, 3243 bp, Heterodera glycines
atgtttcgcaaattcattgcgatcggcgaaccgaatttggaggcgatggattacgctgccggcgtcgcctcctttttggtgatcgccgtcggcggagttttgatcggtctgctcttctctctgatcacttgcattgccacaaagtccgatcactccctcccccccttccttctgctgatttgccattgtcagattgaccactcgtgttcgcatcctcgccccggtgttcgtgttcatcgtcccctacatggcttatctgactgccgaactgttcggcctttcctcaatcctcgcgtccgccccccccccccactttttcttctcagcttttccccttttagcatcgtcgcctgtggcatttcgatgaaacagtacgtgaagggaaacctcagccacgacgcgtccaactcggtcaaatactttgtcaaaatgttggcccagtgcagtgagacggtcatcttcatgttcctcggcctctccgccgtttccaaagtccatctttgggactgggctttcatcgtcgccacaattgccttttgtctgctttatcgcgtcatcggtctttttccgttcgctctttcgctgttcttttaatcgtcgcttttcttcccccaggggtcgttgtgcaatgcatttttctgaatcgtttccgcaccaaaaagttctccttcagcgaccaatttgtcctttcctacggcggtctcagaggtgccattgcctttggcctcgtcgtctctttggaggattcgcttccgccaaagcaaatgtccgttaattgcccatcaattcgttccccgtctattaatgaagtaattattccctctaaggttcgtcaccacttgcatttccgtcattttcttcactgttttcttccaagtgcgtctttaattaatcctcctgctaattaccatctctctctctctttctttctctctctctctgtaattaccgtccgtcttctctttccttccttcacctcctcccaatttaaaagggcattaccatccgtccccttctccattggcttaaagtgaagaaaaacgatgtggacaaagaggaaacgatgttcgaaaagctctgctcgcgggtgaggaattttgtgcgccaaaatcggcaaattattttgcgcctgtcgcagaattgtgactatttaatggccggcatcgaagacattgttgggagaaaagggcccaacgcaattcgggacacgtgagttggccaagggaaaggcaaacacagcgaacggacgcaccaaaggttcgaacggttcaacgccaaagtgctgaagcccgctttgatgcgcggagagcagcgaaaggccttcgacgcgtcgccaattataagggcatataacaaattgacacttttggaggcccaaagaacggtcaggggaagtgtccgaaggtgggcaaaggccgcggggcactgaccgttgaaaatgccctccccaaacggacagaacgcgcaaagacgcccccctcggccatcgcatcggcccggcgcccagcccttcgtcggccagcgccagttccacactcactcatttccaatggaaggaaggaaggaattccgcagagcgaaggacggcatacgaaggggtcagtcacagtcactcattggaacggaaaatgtcacatttgctgagagtcggcacatttgccaaaaccaaaagcaacgccatctgaacgtttaaatgcgtttaatttttcggcagatctgtgcgattccgtcgcagcaaaagccaaccgacgctttttacggaatatttgcgcgacttttcgataaaaatacaattgaattggagaaaacggagagagacgacgacataaaagacaattacatgatgtatttcattagcaaaagtgaagaacatccgacgaacatcagcagaagaaaggaaccaaacggagaaaccgacggagaaaggaggggacggtcattgagcccaaaagtggaagttagcgacagaaaacaattgttaattggggccaatgatgagttatcccttcagagacaaacgcgcacgtcgaaatgttccgttgctgctcatatgagcatcccggtggaccaattacagccaagaaattgccgaatgtgaatcaaaaaaatgatggaacggacaaaaaaacgctaatggacgaatagtgaaaaaagaaaggacgaagggatgcgcaattggcaacgacaaagaaaaacgggtgtcatgcaactcgtacaatgggtataggctaattttgtaatttattattgtacgagttgccattgaccccaaaacgatccaacccaaagaaaacagacaataccagtgaatgctcaccattttttgatttttgtaaaaatttgtatagtgaataaaatggtaataattgtccgctccgtccgtccgatggtcaattcagtcaatttggggagatggcactcaaagggactttgagttgttcgaccaatgcgtgcaatttgaccagcaaaatgcccaacggcgctttttcggttcccaacaccgccaaaagcattgatgcgacgcgcgtaagcacaacggtgccccggtcgcagccgataatcacttccctcaactcgtcacggacacctgagaaaggcaattgccagagaaaaggcggaggacgaaaggaaaaccctgccgctcgaaagtctcccaaatgttggcgagtagcgccgaatagacattgccactgaactgacgggtcgcctcactgacagtcctcgagacggtcaaccctataaaaatgaatggaagaacagtcgacacgacacaccaatccgtaccgtccttgttgaagaggagcacacccgccactgctccgccgacgacttggccgaggaaggcatccaacgcacgggtgcgtatcataaggcaaaagcaaaaccgaaggaaaacggacgaacaaagcgaagaaacggaaaaagtaaactgatagaaacgattaggctaaggaggaatttgtcggctttaagtttatttggtgaatagaaatgttccgccgtcgcaattcgctgagatcgaaacagaaaaaggactcagaccgtccgctgtcccttttttcttttccgttcgttcagtcggtccaccgatgagtacactgtgagttagtgcacacgtaatacaaacgcatttcttcctaaataacgaaaggagtgagtcttttacgactatcggaaacaaattccggtgcgaatattattttgaaaaatgaacgaatttaaaaataggcatctcactgtcaa

SEQ ID NO: 16829 - DNA, 1135 bp, Heterodera glycines
tgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattattgaaaaataaaatggccatggcgcaccgcacttcgtttcatgttcgagagctttgttgcatagaaaatttctcaaaaaaagagatagccatttttctggaatatctattaaatataaaaattatttgaaaaataaaatgggcatggcgcaccgcacttcgtttcatgt

SEQ ID NO: 16830 - DNA, 1662 bp, Heterodera glycines
tttttcttcttccacaataaaatccatggacaatctcactatgtccacttcactgtcataaaatcctttggtcggatccatcaattccttaatttttgcaattttattaagcacaaaaagctattttgactgccactcactgtaaaagtaatcattataagtccccagcaagtcgatttgttgttaaaagaatggtcaaattttttagtaaaatcctccgttcctttcttttgtgaaacaattcgaaaagtggcagaacatttgcagctccaatctccatcttaattaaataaaaattatttgatttagcattttataatttactttcttttggagcggtgcagaaaaggtaaaagcccagccatttctcagtactattttctttggttcttatttgtgcccaaattttccacggcaatccttttgtgtaaatgcatttgcttaatcgcctgctgttcacttcctctcgcacaaattccgacaatttctcaatttccatcgaaagtgtgccttctttctgatcagaaatgcgtccatggcacggaaatgccattgggtattgtccgggcgcaccgcggagattcgggtggcaatggtactgtaagacggcgagcagttcttccactgtcagaacgcaggaagatactgtgataaaaacgcgaaattcctcgactcgagaattaaaacttttaaacagttttgcggactttttactgaatttgttaagaaaaaatttctatttttttattcatttattaatctatccctttaatatggatgggcacgttatgaatttaaaacaaagggtgttaaggcggtcggcatttatacataacaaatttggcgtgctttaaaaaagtcggaatccaaaaaccgatcttcaggggacatgtccgcgtcgggagtctcgatcccaaccaacaataaacaggattaacacaaaaaactaccaatatttagcgaaaatttcctctttgtgatcagtgggaaacgtattttgaaaagtgccggaccaagcgcagaacgacgattttcagcggaacattcgacggcattttgacggcacttttcgtctgcccaacgaatggcctgaaaaaacaaatgaaattagttatttttaatcgaataattaattaattagtacagctttccaaatggtgagttcgtcgtcgattttcaattggtcacgttcgaaaatttcgcacaacaaattttgatcaatttgcaaaaattcttctgattcgaataaagtttcggcattttgatcaatataatccaagcagcgaagagcaaaatccttaaaataaaataaatccaaaatttttattgacgagataaacttgttttaggggtttttattgtctggaaaaccgattctggcatctattttggcccaattcgaacataacccggattcgaacaaaaaaaaatcgaaaattcaatttttttttaacgtaaattcacatttattgcacaaaatcacggctcttatgcagtttaagtcccatatttttttcatttccaagaaaaaaacatacaaaatatagggtttttcgggagcgctgatcacgctctgtcatctaattcgaccaatttcgaatctcggacccgaattagaacaaatgtggataattcgaaatttttaaattatcacgccaaaat

SEQ ID NO: 16831 - DNA, 1839 bp, Heterodera glycines
aattccgcacaacaaattttgatcaattgcaaagatcttgctgatacgaataaagcttcggcattttggtcaatgtaatccaaacaatgacgagagaaatccttaaaataaaacaattaaaaatattttgtataaatttcgatttgcacattttggttgagaagacgagcttcgacaaaggcaagaaaaacatttggcaactcattaatcggaaaatccaacaaggctttgaccagcaaagaaacgttatatttattggctaaaaatgtttaaatataattatttatttattttttaaatttttcacccgcgtaaagcactgccatggcattttgtccgttcaattcgctcaaatcttccgcgtaaaagaagctcaacatcactctgaacgcttatgcttcaacatcggtcacctcaattacgtgaggacagtcggcaaaaaaaatgatgaaaaattatttttagaaatattttcggtatttttttttacttttagtctttgagtttttgtcatcaaaacggaacatcgacccaaacacatcagaagcgaacatcatcacgcatttgtgtgctttcaaaagctaaataaactcggaatagaaatggaaggatggggttttatcgggccaaaaatgctaaaaattatccggtgtccttaaccctatcctgcaaaattttgtaatatttttttcaagggcaaatttatgccctaacacgaatatgatgtttgtttttagctcttatgcgtttttacaccggccccccttacgacgaggggggggggggggggggtgtcgagacaacccttgtatatgtatgcacgaatctgacatccatttctatgaattccgaaccctgaacgcgaatcgaacaaaaaatcaaaaactcaaacttatcaaaaaaaaaaatttatcttttgcaaaaaaaatgattaaaacaaataaaattaatcagataataatattaaaaatataaatttcgactttttattcgaattcgggtttaaaaattcgtcaaaactggtgttaggttcgtgttcagcgcataaaattaccctaaaaaattgttaaaaacaaaaattcagggagggtgaccggggacaaaaaacggctacaaatccctgctttttctcagccgttgaaaattaaaaaaaaaacactggcaaattctgactacccaattcggaattttttctggttattgacctgttgagaactatgtattacctaatcaacatttgtgggttcaactcacctccttttccttcccaaccaaaaagtgaacgtccgccccttcgccagtgctcaacatcagcttgaaacggtcctgcaacttgctggacatgtgaaatttgaagaaaaaaataggacaaacaaattgctgaatacggaaattaaacaatgattagggctcgaaattatatggaataaaaaacataaaatatggactaagaaagaccgaaatacggacataaaaagcgcaaaaatggccaaatatggaccaaaatatggactaaaaactgccaaaagccagggccggcacttggaaaatgggcccgggtgggtaataataaagttgatccctcgccccccttttttcgaaaaactttttttttgtttttaaaagtcatgaaaacatgtttctatgggttttcggagtcgcttatcacggatccggcacccatttcgaccaattctgaaatccggaccgaattcgaacaaaaaatggaaaactttcgaattcacatttttggttcaaagtttttttaaatcaaggctcccagatctgaggatttatcctcattttgtggtttttgataggtcaatgaggatttttttt

SEQ ID NO: 16832 - DNA, 1825 bp, Heterodera glycines
cttacagcatataatcaaaatattttatacatttctagcttaaatatttttgtattattcataataataaaaatacgtccctatttatttcttttcatcatagatacttttgtatagaactaattaaaaatgcataaggcatttttaaaatggccaagtttcagtcaaaatctgtaaaaaaatagtcaaaatttcaaaattttcctaaggcgcctggcccccaaataaaaatagtggattttattcaaaaaaatgcccaaaaatttctgatcaccttattttttttttttgtttttcaaatcatttttttttcgcagcgctctttttctaaagatttttaggagaaagaggtcccgcggtgccgataggcgccgccgggaaaaaatttgaaaatttggatgtgtctgttaacagattttgtccaaaaaaaatgataaattttttcgatttgagccaaaattttttatgaataaataggtttttcttatggcgcgcgaattttgaaatttaaggtctattttgtaacagatattcaccaaaaatttatgaatttctgataaatttttgtttttttttcttgttttttttgtcaaaattactttgaaatatattaaatttcatgatttagtcaaaaaattgaatttaatttcaacgaatggaaaattgagttcaatacgtcaatagattatgccaagtatgattgattttcatgggtatttttggtttaaaaaaatcctattaatcaaatgaaaataaattaaaaaagaaacagtaaaccgtgttcgaacttatgaccaaggcagttttagtgttcaagaactaaccactacatcacaatacatataagttaacaaaatgcaaattactttatttaataaaaaaatattaaaaaaaaattcaaattttgtataattttttgtcttttctctcacaaaatgtcattcttaggggtgtatatttaaccccgaccccgagtcggggttaagggtcggagtcggggtttgtcggggtttaaagcgtcggggtcggggttaaccccgaaaaatggtcaaaaatgtcagggttcgtggtcggggcggggttggagttgcaaccctactttttccgattaaatgtcggcctcgtcaaggatcaacatcacattttgtctatgataatgtaccgttgtagtttggtattagtagtcgaaacgtccgattttaggtgagtaggcaaagtgtcgagtagctgaagtgtcagtaggcaagatgtccagtaggcgaaatgtccgattttgggttagtaggcgaaacgtccaataggcaaaatgtcgtcgtgccaaaaaaacaaagaattcacttcgctctgtagaactttttttttataaagatttttaaaaattttgataccgattgagaaaatttatatatcggattatagaagcttttttcaaaaataaggtgcacaaaatgttgcccaaatacaaaaaattctatgccaatatattttctctggcacatccatttgcttaaaaaatgtttggtaaaagcttattctcatcaagagcttccgaatgatgatgagattgtcaatttagtttgtttgctcgaaaatatgcatttctctgcactctctatcgttttttgggctgtgtctaaaagtcggatcccctaatgtcgggtttctaatcgcccattcgcaatgtatctgctcagttatatgtgcggttctgggcatgccgcgtttgaacagcacgcggattgctttgcggaagtggagaaccgcgagcagtacgtacactgcaagcgaaccgcgtcgcgtgccatggaccgtgcaactgccgaat

SEQ ID NO: 16833 - DNA, 2104 bp, Heterodera glycines
ctgtacgtaaaacgtttttttcctaaaatttatgaaaaccaaaattaatgctctaggtcagagatggtaacggaattccgacatttctgactttttgcagataaatgtgtcattatttctatcgctcgtttatggtccttaactgtatgtgacaagagatggcattttgtcaggacagagatttttatccgttggacctaatccgagaaatttcaaaaaaataatttgggatctccgagaatcagcggcagcggcatctctccacttataaaatggcattgcactgtttatgttcagatcactcgcgagtcgttgcgcgtcagtctgccgaactgcgacttggaaaaggcattggaacaaccgcagcagcaggagaaacaaagcggagctaatattgataatgataatgaagctgttcaaaaacgtcctcagaaatcgatcaatcactttgaagggatcgactaatggaacaaaagccaaaaattgaatttacaaaattataaaaagtgtgatcagagacagcgattgtttggtgggtgctgttttggttgaaacggttactgatcagctgctgcgcaaaattaaagaattgtctctgcataaacaaatcgcaaaaaagggaacaaaaattcatcaccaccgttttcaaaattggggtgcaccgccgtcgataattaatggcgcaagatcgggtggattaatcccgtgaccgtttgataatctttgactgtcccaccaccacgagatgagaaaaaattattcatcttttccccgatttaaaatgcgtccgctttttttgtgctggtcatacgttccgcagcagctgatcacgatgacgtccaccgatcgggcggacaaggcacggacaaagtgcccattcggagaagcaccccgggggggggggcaatcagtgcactgcacacaatccctgccgcttgttggcgcacaattcgccgaatatccccactgccccccaaatccggtgtcctccaaacgcacaaaaccacccaaaattttgaaaatcatcgcattgtaatgcattttgctcaaaacacacaaaaattagtttgttttatttaaaatttaaaggaaaaaaaaaattaaattttagggataattttgagtaaaaattcaatttaaaattggggtttctaaaattttcggttcgtttcttaagtgtgcatttttcgttatcattgcattatcaattttttgaacatccttaaaacatgtgcgaaataggcatagattatgcgcttgaattagacacaaaaaagtcgaaaacagacaaaaacaggcgtaaagtaatcgttagacaaaattattaatttaattcaataatcaccataaaagtttgctcattctcgcgatggatttcagcatcaaaaaacaattttctaaatttgattttgcaatgtctcgtctcattttgctgcttcttttggttgcgctgttctgcgcttgcgctttggtcgagcacgcatccgcgcagtggggcccgtggggcggcggtcgctggggcggaaaccgctggggcggcggatggggcggcccgtggggcggtcgatggggaggcggctggggacgaggtgatcattttttatccgcttttattaattgccactcatcaacaggcaattaaaaagactaaaaggggtccggaaaatgagatctaattaggcaaaaggggcggggcgtaaatgcctggaaaattaattgtaagtgattaagccaatttatattgttaattgggcagatataaaacaacaaattagcatttgaataatttcttttttcaaaggttggggatggggacgccgataaaccaacgggaaaatggcgaagatttggaggccgcggcaacggattttcaatgtgattggcgacgaaagatgaacatgatcaatcagaaaaaccttctcaaaacattttttgtaatttatacaccgctggacacattacaaatcgtcttgtaatcagaagcaaaacatatgaccaataaaaggtgcaattccaatgcttttcattaatttgaagtggtaaaaaggcattatttcaaagaatttttattaatgttgacctacggcaaaaggcatcattagca

SEQ ID NO: 16834 - DNA, 1010 bp, Heterodera glycines
gcaggtcagaagatagccatttttccaaattttcacgatcaaatggcgctcgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcgggttggaattcccttgactgtagaccagaaaa

SEQ ID NO: 16835 - DNA, 3001 bp, Heterodera glycines
  misc_feature (2975)..(2975): n is a, c, g, or t
aaaatcgttcgattttgcaaaagtaatggctatacaacgaatgcaaatggccaaaagatggccaaccgtccgctgattcatcccaattgcctgcctccctttttcaatctctttagaattaaatatcatttttttgcataatttgttttttcagagggtcagaactttttcatcaacccaataggaagaaaaacttggagcctggcttgtcggcaccgtctatcccttctttcccaaaaaacccaaaataattttcatttccttcaaatttcccgtgtttttttatttagataattctgagttgatggctacatcctcttgtgctgattgtttctttttccctttcgtcactttgagtttgaatggcgctggtgataaaattgaggccaactttggccccaacttcagatttgatttggtcactctttgaaggaagaaaatatcacttttgatcagctttattgattttttcctttttcttttcctcagtattttcataaaattattttacttaaatatttgatgaattacctcaaaatttggcattttgtcagtaggatttcgtatttgtctcaccaatccctaaacttatgggactgggaatcagggaaccggaattcaatccgattcggtcagattctcgatcccggcccggaaagcagttaatatgtgcattttgaccttttaatgaaagaaatgtataaaaaaaatcaaaagaaagcggagcgaaaagataaggccaaattggacgacgaaatattggggaaagaataaaaaaaagaactgaaattaagttttaaagagaaattttatacctttctatcaactccatttttgaaaaattaaaaatttgttatttactcattttaagtcattgtaaagtcggagttttatccaaaaacgatacaacaaaactagcttaattatttttttaaaatatattttcatgcatattaagggcatgcatagtttcattattaagtttggcttaaattcataatattggatttttatgcaaatctattaagaaattataacaaaattagaaaatttttcgtctcgcctcgggaccgtaggccaattcttataattaaaaaaaacaaaaatgtcaacaaagtctgtttgtggccagtattattcttattttggaatattttcgatggcatcttagaaccttaacgatataaggaagtgtttcacagccgaccaaagtcaaagttgacgagaactcaatcattctatctccctatacaatctgatacagcaacactccagcaaatggcactccaaataaaaccgattacaatgagaacggatcaaggatgtaggaatgccgacttccgattggcggtttccgacattttgggctcggaattcccgttagagatggctggatttttctgagcatcgtaattccgactgccgaaattttataatattaaaatccatttaaacttatttttcatagaaagtcctctttaaaaaaagcaggtcggaaaatccataaaaagtggaaattctgttgcaatctaccaaaacattcttattaggttaaatttttatgcattaaaacactcaattaaacagatgtaattttttgattaattatacacagtgtcaggcccgtatccagaaaaaaatttcggtgaggatacccgaagagcttttttttgctcttcgagccaaaaatttttcttcattgttatttttcaaaattttaagcgcaggggcgaagaagtctcgtaacttacgaagaatgccccaatttatttcacaaaaggaattgctgtttattggcgatgaaaaagagaaagcaaaaattatatccttaatgtgagtaactgaaagctgggatgatcgcttcgtaatgaaaaaaggaacgggggagggaggggagttgcaaacggaagagggggaaaattcggatctctttacacaacacttccggtcacaagtgcgacactccgcccggcgggtatgtggggaggggtgtcaaaacgaatcgaattgagcggcacgggctatcggtcgagtttcgccagcgacgttggggagtggtgtacatgggatgtgccgtgttggaaaaaaaggaaaatcatttgaattattgggttggtaaccagtaatcccagtaaccacttgaaatgggcgaggagagtcatctgggcgatggtacacgtattttgggacgttcggtcggtcccatggctgggatagtgacaacaaattcggtgcttttcgaaactggagccgtgtcggaaggaaatgaagaatagtcggtatttggtgtagaaggattaagcttaggattttcagattaggttgggggaagggaggattccattgtgggggcattattggttagtttaatttgaggaaatttgggcgggattcgttttccattggtattacttcctcaatggaattctaacggagcgaaaaattaagctttaaatgtttgtggacattttgaatgacaataggatcaatttttggggttttctgggtttcaggttcaggcgagagggagtcaattccgaaatatagagctgatgtggcaagaataggatgggaatttttagcaattgctttaagcgatgatttgagttttgggctggcctgggagggctgagttagtattataatactgacgataaaaacaaatacaacagtggggattatcgatggggatggtgcatgtgcgtgttgtttgagttgcaacggattatagtggtgctggtgggttgagcggtccttcctctgaaaaagaaaatttttatcgagcaagtaaggtaagctgttatctgcaatatatgaaacaacaaccttacattagagaggcctgtcaataccttctttcgaattcttttttccccaatatcttattggttttttattctgccttttttgtcaactcgttcacccttttctccatttctcgctggcttatttgccatccgggggagttgttcaanaaaaatctttataaatcatccgtaaa

SEQ ID NO: 16836 - DNA, 3272 bp, Heterodera glycines
ggggggaattttgaaaatttgagtaaaattttttaaccagattttcaaacaaaaaaagtcttctttttgggtattttttgggctcaatatggacgggatttctattttaaaaaatataaaaaatgtgtcaaataaaataaacttatgaggaatcatattttgtcgataggaaatccatgagcctaaaaaaaaaattcgaaatattttactttctgtagagggattgaaccaggggaaagaagaagggcaggtcagggagactatccactaggtcatttgcgcaattgtccgtgtcacttttaaagaatatattaatatatttttaaatttttcccttttactctaattttcatatctaatttttcaccaagaccaccattcttaccagtgcttgtttttcccggttcccggttgccctaccgggaccggaacctgagcttttcaaaatctgggaccgggaccgggacctctgaggaccgggaattcccggcccggtcccggtcccggcgcactctaattttgttaatttcgatttttaggtcaataatttaatattcacaagcaatcattttcttttaaaatatcaattccaatattttttattttgtttctaaatgaatgctttcaagaaggcttcattttttaaaaaatattaaaaggatttttcgtaacaatttatcagttagcttatttgtcattacgtaaagaaaaagctccaaaaatttttaaataaaaaaaaactcttcctttgatacataaaagtaaacaaaaaaatttcatataattttttacaatatcccataataaatttagaagaatttaactctatattccttaaatttgaacatttttagtgctaactgaaataaattgactcaagtcataaaattttgtcactttttgaacaaaatgccgaggtgataaccgatgaatatttgcgaagtttatgacaaataataaaacagaaaaataatcatttaaaaactgcttaattttacgcgaatccttggcttatgatgaaattgattgtgctgacccgttttttgcacaaataccggacccggccaaccctactttgggcttcaattgtgcaaattttgggtgttcttttaatttaaaaaatcatccttatattttcgtaaaaggaagtccaaattcgcaacaaaatttcagaatattattttagtgaattttatttgatatatctttttaaatctcggctataagcttgtgaaatgcgatggcaaccctgattttaaatttaatcaattatattaaataataaacaattatttaaaattaatttattatttttatattcttttattattttttaatttgatattttaaattttggcgatttgatatagtcgtaatggtcattgtcgaaatgtccagccacctttttgggttaaatttagcaaaaattaatatttattttgacaaaatgccaaaaatttgaaatttttttcataaaatgtatattttttacattcatatgcaaaaatcccgattccaagtacaatcttggaaataagtacagttaaaattttccaagcacaaaagccgaaatctaagtatgtacttggcatcgaagtacgaatccgagccctgcaataattgtttattgcttttcatttgacttacacttaaaaaattattttgaagcttttttcaagataaatcattttttgacgggatttgctaaaaattacttcacaactttaatatttttacaaaattcaaaaccgatgataaatattctttttagaataatgaaactctccctacaatttttcatttattagttgtggcattggcaccttcgttttcttctgacatgctattttttgcgcaagtttttcgtaaaaatgtgattaagaagtgtcacatggcgtagccgtattagctattttaagatttgttttttaaatgaccaaaaatttattttaaaaaaataataaaatatgttcagatgaattgtcgcaagtttcattttattcattgaactcttccatatttattcttttttgataatttttcttttgatattttaatattatggaatattttaaaaagttttatgaatcttatcttttaaaatttaattttaatcaaaaaatttttaaattaaagtattctctaaatttctttaaataattttcaatttttcatcttgaacccttgacatttgattgtgtacaaaattctctatctgttgcacattgtgaaggtatttcttttgagaaaatctctccccacatttttgggtcatcattttgctgaaataaaaatcaatgggaatattgggggataagcaaaatccaattcaaatttgtttcttttttgggtcaccgttttgccgtgaattattattttatgtgctcgccgccgtccatcataaatataagtgaaccatcccatctttcttcatttaactcttctggtgcattttttacaaaataatacaataattattattttatgaattcataaatttgacttttgtgattattagcccctaaaaggaacctcgggaatccaatatgtctttttcaccaaattcaacaattgccgaatttacttctgatcagggtaattaagcaataaaattcgagtaattattatagtaaaattgttgactaaggatttcaaatttaattttagcaccgtaccaaaatgaaagtcaacaaatgcgaattacagaaatggaacggatgcaaaaaatgtctttacatggcggatacggtagaaaattctttgcttgtacatttggagattatattagaattttcaaattattattatttatttttttcatattaatttgttcaaatttttcgctgtagacagtggacacaaaatgggcatggcaaagccggacaccttggcggatcgaatgaaattgttgctgagcacggccaaaggtgtcgatgcgcattttttagttgggcaaagtgacaaaaaagaggcaagtgaaattaataaacaattaattaattacggtctaattagcgaatgacatttttagacaattaattacggtaaaattaaattttaagcttgtgcatgctcacaaagccattctgattgcttcttcgaatgtttttgaggcgatgttccaaacggacaaagaaaacttaaatggtaccaatgcaggaaagagtaagcaaaaggggatgaattatgaacacataagcaaattaatatatatgcatattggactagcctcatcctctggttgtttttactcctgctatttgccctaatta

SEQ ID NO: 16837 - DNA, 1297 bp, Heterodera glycines
cagaaaacagtaaaaacgctcctatcatgcactaggcgctgagatatatgcacttcattttgacaacactcatagtaaaaaattatttcgttagaatacgagaaatatgatcaagaagagacagtctcatagtaaaaaattatttgttagaatacgagaaataattgaaacgaaacactggttactaatttgcatatatctctgcgaaaattccagatccaaaaaaatcagctataccattcgaaagctgctttcaggcgctctcagaaaacagtaaaaacgctcctattcatgcactaggcgctgagatatatgcacttgactttctgcatataattgccattctccgcagcaaacttcgcgttctcaagcgtgaatagttaatttttttgtgctgaactgtgttagggttctccttgcagtgcgctcaactaagtctcttggagttagagcatttttcatggtattttcaagaaaattgtgcaatgtgggcgacccggaacattttagacagtttccaaaccaaacactcatagtaaaaaattatttcgttagaatacgagaaataatttgaaacgaaacactggttactaatttgcatatatctctgcgaaaattccagatccaaaaaaatcagctataccattcgaaagctgctttcaggcgctctcagaaaacagtaaaaacgctcctattcatgcactaggcgctgagatatatgcacttgactttctgcatataattgccattctccgcagcaaacttcgcgttctcaagcgtgaatagttaatttttttgtgctgaactgtgttagggttctccttgcagtgcgctcaactaagtctcttggagttagagcatttttcatggtattttcaagaaaattgtgcaatgtgggcgacccggaacattttagacagtttccaaaccaaacactcatagtaaaaaattatttcgttagaatacgagaaataatttgaaacgaaacactggttactaatttgcatatatctctgcgaaaattccagatccaaaaaaatcagctataccattcgaaagctgctttcaggcgctctcagaaaacagtaaaaacgctcctttcaggcgctcagatatatgcacttgactttctgcatttaattggcattctccgcagcaaacttcgcgttctcaagcgacccggaatagttaatagtttccaaaccaaacactcatagtaaaaaattatttcgttagaatacgagaaataatttgaaacgaaacagtgcgctcaactaagtctcttggagttagagca

SEQ ID NO: 16838 - DNA, 1214 bp, Heterodera glycines
  misc_feature (1103)..(1103): n is a, c, g, or t
  misc_feature (1197)..(1201): n is a, c, g, or t
atcaatttagtttttttcatttaattgcttttttattttttatatttgagaataaagaatttattattggtttaactcggttatgacttaagaaatcaacaacttattatataaataatatttacaattttttaaatattatatatattttttttttattaattaaataaattataattttaaattaaataaataaaaataaattattattattaaaacgcacttcgttgaccatgttcaacagttcgtcctctgttggattgagtcccaatgttcgcattgcgacacccaattctttgatgctcattgtcccattcccgtccttgtcgaacattcggaatgccgttgcgaactcttggatttccttgaaaattttgatttaaaaaattaaaaaaatatatttccatgcctcaactgtcaggtcatcgtcgccagcagaggagccagctaaaaaattgccaaatttcattaaaacattgacaataatgcattataatggaaaaatattcgtccttagaatcaagcacgtccttgaaaatttgatcaccctaaatttttgaaaaaaaattcaaataattgttaaggtaactagaacatcagggatgtgtgccgacacccacaaaaagtttcggaaatcggcattcccactgctgaaaaaatttcggcaatcggaattccgagccaaagaatgtcagaaatcggcaaacagaaaacggcattccgacacctccctgctatacttaagcacgaaacttaaaaaaaaagtcttgcaaattgattgacaactgtgttacagtacctagacctaataaaacagacagccttactgtattgacgatgcattttggctgttgctggtattgttgttgattctgcaggtgtcccaccgcttggttgatgtaatgaagtggaagcgatgagaaggcaattttcactgccagccaaaggggtacggtgatgtggtgaggcgattactgtaccaatgggtgatgatactgtagctgttgttgaggcggcaccagttggaggcaaggcgctctgtaaaacacaaaaattttaattttaaaatttataaaaaaaaagcaactatgggatcagatggnggggaggcattttattggtacatcgttggtggacatcgaataataataaataaattcaattcaattaccgtatttcttaaaatatacccccccnnnnnaattagaaccccc

SEQ ID NO: 16839 - DNA, 2125 bp, Heterodera glycines
  misc_feature (2087)..(2087): n is a, c, g, or t
agaagcaatttcatagaaatggaataaaatttgtgtaaaaatgaaaaaaaaattgcaaaaatttattgcagattaaaaaatgtattagagacccaggcttgataaaaaaatatttgttttacacataaaaatattttaaaaaaattcttctggcactatacgaaaagtgacgaattttttgaaaattattaaaatcagggaatggataattctttggtttttcaattttcatgatttgttcgagttcggattagggattcggaaaagactaaaatggatgctagaatagtggatccgttagttatttgagcattcatttttttaattagggttaagccccgacatgtttcggggaattatgaaagccgtaaattgcacttgaaataagatggaagtatcttgaaatgagtttttaagacttttttgttctggactttttctccccgacattttgctccccgagggtcggggcttaaccctatttttaatagtcgagaagctacaaataagattataacttaattttcattcatttaatggatgaaaattaggaaaattttttaaatccaacaatgctttattaaaattcttaggaattggcaaaattttcgaaaaaccattgcttacagaatgccaataaactaatgttaccatatgccctaattggcctaattttgtttctcggcctaatgagctttatacatttgattttatcgaaatcttcggcaggtgaatgacctgatcggcatttatccagggccatctaaaccctagaattttttatcattagcccgacccgctctcgtcttacaagcacaaaatgaacttgatcccgaacatttaaaattcaagattctacaagataatgtgacatcagttgccaccttcggaatgccctttggtggctgtgccgtctgctaatgcgtgccgacgcagcggcagccaccagttgcgcgtcacgggaacgcctcgcttggccaagccgattgccagccgtggcaccgcgcattctgatggccgttaatggccaaatccgaatagagaaggacgtctcaatccgcacagtaagtgatgggccgtataagccggaacggagatcggttgatgatgaattttatggcggcttaatttggcatggcatccaaatattttgccaaaacgctttttttattgtcagcttttcctcatcagctgatggccaaattccgctgctgctttgtgtagaaatttgttgttctttttttgttgtttttgccgatctgacccaaacggaatgccaaaaaaacggcttctcctccttttttgtgccaaaatttccgccgatgcgagggtgccagcagcaggaaacaaacacacaaatgaagtgggggtgaatgtgagttgcttttcctctacataaccagcagcagcagcagcaggcagtagcgaaaagtacggcatttgtgtgccgtcgtggtgtgggcggagggtcgaccgaccgaccgacgagacgatgggccaggaagggaacggcacacgacgcctccccggggggatgtcggatagccgccgcccccgccctgccgcccctctcattttataagtttcttccgcttgggatggcggtggcacaagcacaacacaaaaattgggcggcggcattttctcatcatgtcggcacacggaactgcacccgtcaatggaagaattaatgaatggcatgaaacggttggttggttggttggttggttggttggctgagtgagtgagtgccgtgttccatcattgtagctagttgtcttgcgaacagctagccagccagtctcccggaaactttttttgttttcgcgtttcattcattttcggcacaacatcctcgccgtcgccgccatttgcatcttgggtaattagcgcccattagtggaggtggctgccggatgttgtcgaagttggactcgttctcttgaagacatttgtcctttaatttcgtgtcaagagtgaatatgtaatgttcgagactgttgtttccagagcactaagcacctgtctatcaatgagtttcatccattttaagcacatcctcgccgcagccgccatttccgtcttgngtaattagcgccattaatgggggggggggggggtgggg

SEQ ID NO: 16840 - DNA, 2182 bp, Heterodera glycines
  misc_feature (70)..(70): n is a, c, g, or t
  misc_feature (97)..(97): n is a, c, g, or t
agagagtgctgaagactcggacaaggagtgggcagaaagaacattgggtgaattttatggatataaaganccggagtgattaaagacagtgatatgnagatataccacgtatttaagtatattatattttatattttattaaaataaaatgtctaatttgttttacgttcttctcccaagtgatacccctggctataggaataagccaaataaatttagggttcatctccctcgtagtttaactttttccgggcaatggttgtgtgggcttcatagtataatatatacaaattcatggcccgctgttggaactactgaaaatcaatgggtaaaggtgcattttcgaaacgggaaaacaataaaaattgatattcccactggttcctaccaaaatgaagaagaattggaaaatgctataaatgatgtgataattactggaacggaaaaatcgtttgtggcggctcgatttaagaggcaacaaaatttggcggaagatggtgtcgatttgtttttccattataatcctgatgattactgggaaagaattgaggaagaaagacaaaaatataatgaaatgatgaaatctatagagaaaaaatcatccgagcgtgctaatgaaatggacaacgatagaaaaagaaaaatagaggaggaggaaattgaccctcttcaaaaacaatctttgattaagagggctcggttggacgcgctagaggcagaagccagacaaagggacgaaggaaaagaggagaaagagaatagaacaggacaagaatttctcaaaatgtatcctgataactataaggagaaattaaatgaagttcgactagaattaataagagatttattcaagatccaagaccatatgaaaaaatatcagggcattgccgacggtagaaaaattcaagaacttaataaagaggcattacgaatgagaacagcaatgaaacatagaaggaaaaatttaaatgcttttagcaaggctgtctttaataaagacttacaaatatcagccgaagaattcgaaagaacaaattatgaacagaacaaagactatgttgaatcgttttttgatagttacccaactgattactgggagcatattcataaaaaatatcaagggcttcaagaagattatagaaaaattcgcgaatatcgggagcagcaacaatttacaaccgaagaacagaagataaagtcaatacagagtgagattgaccaactccggcgtcttatcgactatagaagaaagagattcgcagcgttagagtatgaagctaaaaagagagattcgcaacaacaaccggtagcactagcactaacacacggcgaagtgctgaaggagcgaataagtcaagtgatcggaaacagaccgcatgatgatcgtggtgatgatcaaacgacaaaaactaatggtcaatcattagtcagtttaatagaacaattgcagaaagaaagagatgagagcaatgctgtaagtgaaaaggaaacccaaggggacaaattaaccgttaaatcgaagagtgacgtcaaaggggaaggaaagacgcatggagatgtattaaaaaataagctagaagagattggggataatgaagatggtggtgatgatgatgatgatgatgttgatactgaaaataaaaagacgagaggagaaattttagctgataaaatacgaaaccgttctgaaaacgaagaaaaaacagaaggaaagatatatggagatgtattaaaaaataagcttgaagagattgggtataatgatgatgatgatgatgatgataataataaaaagacgagaggagaaattttagctgataaaatacgaaaccatagtgaaaacgaagaaaaaattgaaggaaagacgcatggagaaattctaaaagaaaagctttatgcggctaatgatgatgatgtacaattagttgcgccaaagggtgaaatatttaaagaaagaattgaaagtatcaaaacaaccgataaaactgaaaataaaacccatggcgatttattacaaaatataattgcatcaaggcacgttgagcgaataagatttaaatatataaaagaacgacgaaaattttctgtgtattttaacgaacaaattattgcttatatcgaactgtcagcccagcttgggtatatactaggattcgatgatccatcaaaaatacatagcggg

SEQ ID NO: 16841 - DNA, 2140 bp, Heterodera glycines
  misc_feature (35)..(35): n is a, c, g, or t
  misc_feature (54)..(54): n is a, c, g, or t
  misc_feature (62)..(62): n is a, c, g, or t
  misc_feature (67)..(67): n is a, c, g, or t
  misc_feature (70)..(70): n is a, c, g, or t
  misc_feature (95)..(95): n is a, c, g, or t
  misc_feature (159)..(159): n is a, c, g, or t
aaatatggtgcatcaaatatttgatccaaataccngtaaaattcgatgatttgntaatatangagcnaantggtatgggagataattaaccattntcatggagtacctccttatcaacgagggtatgggcgtcagcgaggtggtggagtagggatgttntacgatttttatggagagcaatcctcccaaaaataaaatctgtcggaacattgttgggtaaagaagcactagcaacaggctcccgtgttttagacaccatcgagaatggggaatctccaaagagtgcaataattagccaagtcaagaagggacttgataatgtaatggaaaatggtggaattggacggcaatatggaactggtgtaagaagaaaaagtattaaaagaaaaacaattgttgggaaaactattcctaaaagagcaattaaaaagattaaaagatcagacatatttggcggtttatattaaatatggtttttaagaaaatcgatcaagagtccgtgaattcgataacatcagctttgtccatttttaccttaccccctacaaatgtttctataagtagttcttgtgtacgtgaatatttaccgcttaatccgttaagcgatatccctttccactttaaaattcatccaagttcaaattttattgatttaaataaatgttatattctaaccgaaatgtcgattaaaaagttcgactccgctactaataaatatattatactcaaaaataacgaacaagtggctacaatcaatatgatcggttcgacttggataaagaacctaaaaattatcgtccaagggcgcgagatttatgactctaactctttgtatgcttataaagcatactttgacgcggaattatcatattctaaagatgttaaacattcgcatcttcaagcaagtggttattacaaagacagtgacaaccaggacggaactgataacaaagcacccaaggatttgattgtagaagaaaattattttctgaaagccagactgtgcaatttattgcaaaattggatgctgatgtgttcaaccaggatagatatatggttaatggaattgagattgacatacaaataacgccgaatgacaacgattttatgataatggcagcatcagacgataaatataaggttgagatcacttcttgtaagctatatgttaagtcgttggaaatcgttgatggtctcgctttggatctacagaagaagcttgaaagcaaagaagcaaaatatgcccacagaaaaactttgattaaatcagtgttcatcagtgagaatcggaccgagtttaatggaacactgtttacagggcaactgcctaaaagagtaattctcggaatggttgaaaattctgcatatgtaggctcacaaaagaagagcccgtttaattttaagccatttaatcttcgatcagtttcgttgatcgctaatggaaaacaatggcctgcagcaccttttgaacttaactttgataaaaatttatatacacgcgcattccatgaaatgaatgaatctttgggaatgaattccaccactgacagtaatgggatcaccctagaaaaatatcgaagtgggtggacaatttttgtattcaatatgacaaatagtatggaagaaaatgagtgtattgatcttatcaccgaaggtacgaccaccgtttcggttcagtttcgaaaacccgttcagtcaggagggattactctaattgcgatgagtgagatggattctatcttaattttggacaaaaaccgtaccgttatgacagacactagcgtttgatgtatatttaagtgaattgttttagagtattctatttgtcaaaatgtttttatttattgtgttaattttaataaaaagtacttttggtcttaacggaccaatacttgtgccggaacgatcgagggatagagaaatgacagacatttattataaaattgcttccttcaataagtcatatttaattcagaaaaaccaaagcgaattattaagtttaattgacggattagtagcccattttgagacttgtaatgccgttgaaaataaaactttggccgaatggctatactgtattttagtgtccctgttttggttagtggcactaataactggaatttttttatctttcgaattc

SEQ ID NO: 16842 - DNA, 1383 bp, Heterodera glycines
tttcgcccggttcgatggactggaaatggatacggtaatcgtaatccaagcactttacgatcagcacgagctcatccggctggcgaatgagcggccgcggaccccacgggtgcaccaaatcgccgtccattttgccaagcggcataagcacacggccttgtagcaaaaatctatgccagcagaagtgacggataattggttgaccgatatacatttttatagtatctcacacacctttttttgccattttaacgcccaattttggtttccttttatgcattatcatgtgactcacccgtccacattgtacaacggcagactggcggatgccaaccgatgtgccgaaataccaaagttggtgccgcaaccgccgcccaactcgctggttgcactgcaacgcgcgctggcatagccgctgctgttggcactgtgcggcggacaattgttggtgccgtagtggccagactcatttggcgtggttggcacattctcttcaaccaatggcacaccgcgcacaatgaaacacagctgggcctcacgtggcagtgcagaaatgtgcacatcgaaatcggccttttccaaattaaaaaaataaaaattaatttttaaagagtttacccaaagttgaagcggcacattgacaaagtgatactttgtcacagcagtacggggcgaacttgagcacattccgtacgatttggtgccgtacatcaggtgaacttcgacgtaaaaactctgcaaaaatatgccaagaaaaatcattttaaaggagaaagaattcatttaaaaaataaatttaaataaatttattataaaaattaattgaaaatttattattttcttattcaaaatctaaaaaatagcaacaaaatgaaatttttatattgttcttaatatgattcagaaaaatgtgtataaaatttcgaaaaaataaaaatgcaaaaataaggacgtaaatttaacaaattagaatcaaatctcaaatctttttaaattcattaaaagtaagctgaaacccttaatttttctactttttgactaatttctaatacaaattatcaataaaaaaaaatttaacaatattctagtgaaatttttctgaaaaagttttttttgtaaagttcgccaatctttaggagtcaaaaataccaatttagctgagggagagtcattctaataaagcctaaacctaatgttaatgtgaatttggtcgtgattaattcaattctatgtttttacaacggcggtatttggtgtgcccacttataaatgatcaatgatataattgcttttactcactttgtatttggttgtccaatggccgggaatgttgtgcaccgactcaacgttcagcagcaaccgctcatcacacagtgatgagtc

SEQ ID NO: 16843 - DNA, 2773 bp, Heterodera glycines
atttggaccgagattaatcaggataaagaaagcagtgaccgaacacagtaagcacctcgtcttccgcgtgttcgtctcccgccgtgggttcaatcaccgaaaagtcggtgagtgcggaacgacaataggcgaggaagagccggagaagtgcggacacaatgcatgaagtggcattggccaacgattcggcacaatttgccgaaaaaagcatgtcaatggccgcgaccaaatccaacggttgggtgttgttgatgaaggtggtgatcattcttggaacataactctttatttcattttatcagtaatatttttgcatataattgccaattattccctcgcccctctctctctctcttctctcgctctctatttttctcactctctctctctcccttcatctttccgctctctctcttctctctctcactttatgctttggaggaccggctgacgaagccgcttgtcctgcgggttggccaaacacttttccacgtgatttttcaacgtctcacaaaaagtgccaaagatttcggcattcactgtcggataggctggaagtgaccttaaaatgccaaaaatattcaatttaaagttgatttgtagagattcgcagctaatttcccacaaaaggaatcccttcgcgcattttcaaaaattatgaaattttaaagacaattcgaacagaccaaaccataaatattcatagatgccgaatacgcttaataaggtcgtgctattacttgtaattctaaccgaaatgaaaaataataatttctcttaaatttaaatattttttttaaatggacaaataaaatttgagacggaaatgcccttttattgtaagtacgaagacggaagtgacccccgcccaccgaaagatgctacctctttgttgttccattaggtgatggggtggacgggagttgacttttgccaacttcgagctcaacatcactgcccttcgccaacagatcgccgacgaacggatgcctccctaaataaattaaaaaacatttataaaatttgaattggcatccaaaagtccaattggaattttataggaataagagaaaaaatcaattaatttaaaattgattaatgctaggccaataaatgcgcaccaattggcacgtcgcggacgagaaattcgtcggagccgtacactttcagcgcgaagtcgcccgaggggattttgccctgattttgcgcaattgcctcgggcgtcagcagatcaagcaacactttttgcagaatttcttcgctggtgttgcgcgctccgcaagtgaactccaaccggcgcggctcttccggcgtgtcgcgcgaccaactgaacgtgaaaaaagcattagccgatggaattaatgccaatttctgatcactcttggcactgatcatggctattttcggatcaggcatttaaaacattggagggataagcttagagcggggcattccgtactgacattactcaaatcacacggagtaagcgttttatattttaaatttttgcccaaatattctttcataagtcatggggttgaatttaaccctttgacaagaggcgaaatatcactttgcccctctttgcttgaaaaatgctttaaacaaatcattttccgctgcttacgtgccatcttggtggacaagcaatttgatggtgctgtcttcgtcgatcacaaaatagtccaacaccggggaaaggaagaacacattttggctgggaccaagtgccattttccggcattcgtcggccaacaattgtttctatttaaaatgccaaattactaattggtttgatttattcaattagtccatttgaccacctccttatggaaatcgcagctcaatttgctcgaagccttcagatcatcgcagctcagcattctgtgcgcggctgttctgcttgctctccgtttcttcaaaattttgaaatgctaatttaagcagcccaaattaattattataataattactattactacaataaatttgtccacaatgagtaatttaattgagcctaagtgatcgcaatcattttttggggaatggaacagcaggaaacgtttctttagacaatgttccaattcagggtttttttatagtgtttaacctcacgataataagcattctcaaatattttaatgcttaatcacattgtgttgtattgactaaaaatttgcacaaatcgccccgtggatttttgtctcttttcactttatcttcatgttttgaaatttttcacggaaaaacattgacataaggcttatttgtgcaaaaattattgtctcagattactacgaactgagttacaaaaagtggactttgtcaaaattgaattttaatccaacaaaaacaaataaagcacctaatgcttaagcatttcttcctttacctttaagcattccccagaagaagcatgtccattgcagctgcttgccttgttcgccttagcaatgtcggaagatgagcatggaactgtagaacaaccatcgacaagatgaagctgttcattggaagagtatgatgatgggccgaccacggcactttccttcgtttttgtgtcacttttttgtgccgttttcatttgttgcagcttcacatacaatgggtcaaacttaataattatttggactttgaactgatgacatgaaatggttgattacttcttcaattgccatcgaattggtacttcgcggtgatcgcaaatcgatcagatcaccattgaatgttgctgatcggaagggcacccgaaggggtggcgaaaccgatcgaa

SEQ ID NO: 16844 - DNA, 1578 bp, Heterodera glycines
aaaatttattaagattttaataaattttgttctactgtacaaattattaggcaataataagtaaaataatgattagtttttaaccatagtgcgacattgcggatcgacatttgcggaccagtatttcccgattgaactgtcaaaataaagaaaaaaaaattttttttttaaattttcaataaattaaatactcccaaaggggggccacctcgtccaatttggcctgaattaacggggtgtttaaacgtggcaaaatgggagcagcattttttaagtgtatctgatcattggtcctattctgtgagcacaaattatcaggtgaaagaaaacttgactgttatgcgactggtgcttccgctagacatttcttacgcaattttgtttggcatttatttgctcatcggcatcattttacgtcgatttcgtgccgtgatgtcggagattaattacgtagcattttacaatacggcagttactgtaagcaattaagattttgtaattatttttgatagagtaaaggaacaaatacatggattttttgaagagggactgaaacgtgaaatcacccgccggacaaattttggatttttctagattcagccatgcatccaaagctgattggattttttgaaaaataaattttttctgggtccaaccaagcagtgtatcccaatctccgaatttttggactaaaatccaaaaaaaattttttttttgattctagttttgttgcagaatataaaacctgggcccattaaattccgtgcgtcagcatcagaaaaatgcagccgttccgaatttttggatttagaaccagatcagagtcccaaaaaaccgaaggacctggatcagaaatttttagcttttgttgctgcactcacaaaggaaggtctggaggtgtccgtggaatttcggaatgaaatttggtgggtgcatagagcacccatgggttcttaagaaaagtggttttattttctgcgaaatgagtacgagtgccgagatatgacgtgccaaacttttttctatcccaataaatcgaataaacatttgcaccgttttgtgttgttcggtggtgcagaggttgtgcgtttggcgtttgtttttgcccccacaggttcgaatccctcttatgcaaattaatttcccccatcttatttttgcttttatgcaattgaatggccaaaaaatcaatcccactcgcacccaaaaatttatttttcgtccccgttcctaaataaaatgtccataaatccccaaaatattctcaccttcccatattatgacaaaaaatttaatggtcgaattggtcaacaccgtcttgtgtccagtgttgcgacctggagaaagatcggtgttgttggtcgatagttggaacggttggaatgaatttcggctcccacaaaatgtccaactacaagtcaaacaaattccaaaacacgggactggattttcccaaccattggacgtttatgtttttcggtactaaagtcggggtagtaaaaaatccatcaaatatttttagagtttggaagcaattcacaagaagaataacggaatttgagaggtttacgacattaa

SEQ ID NO: 16845 - DNA, 1309 bp, Heterodera glycines
  misc_feature (17)..(17): n is a, c, g, or t
atcatatattgttgatntagtaaaatgcctaattaggcaacatcctcaaagggtaaaattttttttcgcttataattgtgttgtttttgaaaatgtggattaaatatttcattatgggtgggtatgaattcgattttcattaagaaaatgagagcaaaaatatttaaataatgtttaaattgcagaaatattaaatttgtacaaaaatgtgtaaattaagttttataaaattgaaattttttgccaataattccttgtttgttttaattatttgcgaaaaaatctcattttttgatgaccaaaaagataagaaaatttatccccaagaagatgagttgaaatgctcattattttagctaataatttaataacaattttcttatttttatttttttttgatcagtagagtagaaaataaaattcattaaaaagatgtaatcagcaaaaaattaattataatattaataaatattacttatttttaaattttttacataatgtggatgttttttgattgaaataaatatgatcagtagagaagaagtaattattttaaattattttttcaaataaattggtgttgtggtttttttcggaaatcagtagaaagctttgatttttcacgtgaataaaaatgccaattaatggacaaaaaatatacatatatgatttgggattttattttaaaaaaattataaacataatcccggaaaaatgaaattatgcctattactcattttaattatatttataattgctgaaattaaacgaattgaaacagctaataaaaaattactgcaaaaatcattcgatgaaatatttggagaaaaatgggaagaaaaggaagaagaaaaaagagaaataattgggaaatattataaaataaaagagaaaataaagcaaaaaggaagaaaatattcaaaaaaagaatggggaaaattgaacataaaatagcgaaaaaattggggacaaatcgaacaaaaatttataaatggattaaagaattaggacttaataaaaaaatacagaaaagctataaattgaaaactgtaaattactgatcaaaattttatatcatcactatttaatataaattagatttcgaccttgacaataatgatttagtttcatggaaccaggtctaatttattttatttttttactaaccttggtttttcctagacctgctggattttcttggattttcccagaatacccatgtccagcaggtccaaacaaccaattttttttccggcgcaagtggaacttaatgatttttaaaattaaaaattcgattgactttttttaa

SEQ ID NO: 16846 - DNA, 2796 bp, Heterodera glycines
acatgaaaacgaagtaaaagtcattagtgcttcaataacagatcatttgaaccatttttagagtaaaaatctgaaattcgaaaattttgattttcgactttttgttcgaattagggtccgggattcggaattggtcgaaatggatgccggattcgtgatcagctactctgaaaacctctagaaacttgttttgtaagacttttaaattttttgtacttaaaattccggcggtaagccattttcaatttatttctcacagcataaaggcaaaaacaacgcaacacttttttgttttgtttctgatgtattgtactttaaaggcaaattaatcacaacaaaaaatgaaaggaactttttgaacaaaacatttttaattaaataaatgattttcataatgcattttccattgaatacaaagaaaagggccataaaaataacaaaaggattgggtggggatgagtcactgcttttcctcttccggctcagaaatttgcatccaatgatttggcagtcgctcttgaaacattgtcacctgaaaatgagaggagattaatgtgactgaaatgaattaattaattggccgggactgactttgttgtcgacgccggagacagccaaaatggtggcacaaaatgaccaactgacgtgccaaattgctaaataaccaccatatatttatttcttcataacttgaaatctcacggtcggtgtatttgcatagaactcggttggtccacttctgctcgtccccgtccaaattacagcgccaaatgataacacgcccatcctgtaaaatgcaatgatttaatgcaaaataattagagcggacgggaccgtggccccgccgggagggattttgccgggactcacgtcccctttcttggacaaaccaacgggaccggtagtcccagtcacggggtcccgcccgggtccggactaaacccttgtaggctaatatcatcgctaaccactccgcacgaggcgattgtgctcgtctgcgactcggacggtgcccaggcgacgtcgcgcacccaattctcatgtccgtcgagttcggcttccattcgccaagtgccgggactctcttccctatacaaagaatccgaaaattaacgctactggcgaattggaaaatagtgcagatagtctccacccttccaaactttttttaccgaaagctaaaaaatcattagaaaacaattaataagttttcttgtctccagccttccaacgcagccatttatattaaaaaaatattcggaaaacaaaaactaaacaagttgctattcaatctgaggttatttcatgtgaattttgttgaaaatgaatttcgacttgttccctcttttgcagttttggggtccaagtgaatttggacgtaatcgacgagcaaaacttaagccaaggccacatttaacttcactttttttattgtataatctatcccgtcaattgtgaagcgccaaaaagtcctctccgaaattttccacaattaaaatttgtatttcgacctccaaactttgacgagacggtcatttccacccgaaacaaaacgctttgggtcaatttgttcactgacatccaaggccgactgcagtcgtttggcgggtgcccaactcaccgcgttgcatccctaaaaacatttccgagtcatgtgccagattcgaattgaatggcacaacctcgtcgtgggcgttggcaattttcaccggggaccacacatcgcccatgaattggattatggaaattgagcagtcggtggagcaacaggcgaagatcagtccgtactcgggggcagcccaactgatgctgttgatgctggcctcgtgttggttgtattcgtactgaaatggaatcactcaatgaataaacaaaaagcaattcaaagtgtggcaaaattgagcaccgatttctgccattttccgttcacttccctccatacgatcacttttctgcaaatgaattaagaaagtttgttaatcctctggcatattgtgacgccgtcccccaatgaaattcaaaatttagtaatgttcagtttaagtcacgaaaggtgaatgaaaaattatgcattattagggatatcacaaatcccaaattcgaataaacttaaaaattatgtagcgttttttatttttgagcaaaaaaatcgggtacttttcggttttggggcctagattttaatttaaaaataaatatcataggtcgcacagaattgcaaagactaggcttaaaattatattgcgggcgtacataaatgccacaatttgagctgtgatttcttcaagttgaatatgtgtcatttttttggcatcatagcgccagatgaactcgcacaaattctgtgcgtcttttgttttaaaaaaaataaaaataaaatcaaatctaggccccaaaaccgaaaagtaccaaaaatcttgtgtcggtttcacctgtcatgtgaacaagaggccaaaacgttgtcaaatttgggatgggcccagctgacttgccaaacggggccgtcgtggccggtgagttcagccatcggaaacggttgtccattggccctaatttcgaaaattttgatcagatggtcacttgagcaggtggccagccgagtgccataataattcatttgtgcatcatgctattaattcaaaaaaggtattaaaatatgtttagaaatcactcacaattatgtctctgtgtccagtttcaacttttgtcgtaagtgatgccatcaaaacaattgcaaatgggattctttggcaataattttataacgaatgacaaattatttaaaaaggctgaaaa

SEQ ID NO: 16847 - DNA, 893 bp, Heterodera glycines
attacaaggaatacttatgtggaaattgtggtatagagcagaatccgggaaagccaaaaatgcgcgaattcgtaaccagaaatgctagtcttatgaagcgaaaagtacagttatatttttctgatagtgttagtgagaattgcaattgaaacattatttatcatatattcaagcattttttaggaattaaaatatttaggaattcttgtagcatcctattcctacatgttgaaattgagtcgaatacattgtgacatttatgcattattgtaaaaaataaaatggtttttagctgcctacctgagaaagtttaaaaatgtctttctcttcaccatggttttgatgaaagagtcgatctaacatataatttcgtgattaacctctaattacaaggaatacttatgtggaaattgtggtatagagcagaatccgggaaagccaaaaatgcgcgaattcgtaaccagaaatgctagtcttatgaagcgaaaagtacagttatatttttctgatagtgttagtgagaattgcaattgaaacattatttatcatatattcaagcattttttaggaattaaaatatttaggaattcttgtagcatcctattcctacatgttgaaattgagtcgaatacattgtgacatttatgcattattgtaaaaaataaaatggtttttagctgcctacatgctagtctaatgaagcgaaaagtacagatataaatttttaaatactattattattttaaaatttaatttattattatttttatttaaattttagtgtgggagagatagagagggagagagagagatagagatagagaaatggtcagttttcgcacatttgctttttgtggccctaatgaggaccgtttggattatattgatccaaa

SEQ ID NO: 16848 - DNA, 994 bp, Heterodera glycines
  misc_feature (14)..(14): n is a, c, g, or t
tttctcgcattttntatcggcgagaatgacgcggtctacgtccttctcatatatttccgccttcgctctttcgcgcactttggttgtgccaatttggcacaatctccaattgggcattttctttgtccccctcctcctcctccttttccttctcctctccttcggaccctatgccatccatccaaatgtcagaggtgtagtcgaaaaatggtgtgaaatcggctaaaatgccatttattattatttttcaattattatttaaattaatttaaattattttttactattttatttttttttatttattttttttttgctattttattactaatttttcaaattaattatattttcgttaatatttattttttatttttttactttttataaaagcacttaaaacttcggacgaatgtctgggaattttttccatttttttagggagaattgggacggatttggttcaaatgattttaaactggcactttcggccacagatccggacagacccgccctagccagccgattctcgaacttaattaattacttttttggctgttcccttttaaaatttgcgaccaaaaatttgttcgttgcaaaaaggcgacaaaaaagttcctttgaaaagcaaataatcaatggctctttagtaggaacttttggcactaattgctttttttatttttaagatttgtaaattaattatttttaattttatttaatttttatattttcatctttttatttaatttctatttttattattattttaaattttcttttttatacactctccaataggcttggattatgccgccgccatctcttggcaccctgccagccgccacatgtcaccacacccctccaataggctttggcttctcctccccaccgcccaataggctttggcttttcctccccaaccgcccaataggcttgggtttcacccaataggttttggttttcccttacccacaggctcttgacccggaac

SEQ ID NO: 16849 - DNA, 3029 bp, Heterodera glycines
ttgctcacattgatttgctgcacatcgccaaaacagattgcttccgcgtgtcgacgatcagatcggcgctccaacaaattctggcaaaatattttcaattttaaatttccaataaattccccaaaaataatcgttttataattaattagttttgccttaaacaattttttggctttattgaggcgaccatttttcgcactgttccgttgcgctgttccgtcaccttaaaggacggcatgccaacaattttatatttttttaatggcacacctcaaaaacattttccagtcgaatttccacggatttgtcaatttcgagtccgcgcaagtgtaattttttgtactttatttgatcatcgcaaaacaatgtgatgttggccaatgcatccaaatttggcctaagaaaaaaattcaaaaaattttacaatttaaatgagaattttttcttaatcattggaaaattttaggaaaactaaaaaattgtaattttttttttgaaaaaaatataataaattttttatattttttccgcttgcctttcgtccgggtgctgttcccatcgcattgtgagaaccaaattttccaatgatcttccatgttcaccatatctttctgctctaatcaccaaaaaaaaaaaagtttttatttttctgaatttttaaaattaaaattttttgaattttaaaaattttcaccttacgctaaccaccgaattgccctcgtcgtgtgagccgtcgacacgacgtgttttcaccaaatgggcctcctcatttgtataaattgccgacccaccggcataactaataaattttaaatacaattttttccaaacaatttttaaatttaattaaagcgaattcttttaaattttttaaaatattatatatatttttttaattactgctgttcagcgcggaaattgacaccataccaccgattgggctgaagccaattcacagtgtatcggcctgaaaataattatcaaaaaaatcaaaatgattttctgaaattttcctcacccctagtcaaaaccaacaaaacaccggtcaaattcatcggtggaagctcttcgcctgtcacagtgtcaacaatcgaaatcttaaaaaaatatatttaatttaaaaatattttaaatttacaaatttatttttgcgtcttaccgccactcgcgcagtgtccggtggcccctgccgtgtggtggtgataatcatttgggttgaggacacatcaatgctttccaccttattaatttaaatttcatcatttcttttttataaattaaatagtaaattaaaaaatatattttttatttaatttaaaataagacttcaaagaattttaaatcgttgattgattgtggattagaagaaccacctgatcaaccagttcactagcaggatttatcggcatttgtgttgtggtggcaaaatgttgttcagcaacaatcaccgtgccaatgggcaccggattttggggaaattgcgcaacggcacaccgtaccaatgcgacaaccagcaggcacacaattgtgccaataaatacacccatgtttaatcaatcaaaatcaatattcactacctaattaagaaacaattaaaattattacaaaatgccaaaaaaacgaaatgcgctaaaaatcataaaaaaatgccaattgcaaaatgtgtaaacattgtaatatccgatggaatttgtgctgttggctggcaagacacacattcattccgctcggttggccaaattgtggcccctggcgatttgtcgagcaccgtttggcctttaaaaagcattcttggccaagagacataattgtgggccaatttttggttggtcgcagaagtgtgtgccatggaaacgaagttgggaaaaacgaaaaatgctagaagaatttttttttttttttgcggtggggacacggcgtagaaaatatttttgagaatgcgagtgtgaaggatgggaattttacgaaattttatgggattttttttttaaatcactgcaggggcacagctaggggggagggctgaagtggctggctatatatagcccacccttgtcgaaattgaaatgaaaatttttatgaaaaatgaaaaataaagtgaaaaaatagaaaggtcgtcgctcggaggggcttatagtcccccccccccatccctcgaaacctaagggtctggttttcgtataattcgaaatatccccaattccgaatacttttcagattggctcctggtcctatcaatctgaatatcttcggcttgttgttgatgagcgtgacgtgttccttggtgatttctacgataaccaggaatggctgctggtaaaacatttttatccaagaaaattgtaggcatactttgtaaaaaaaaaaattttaaatttttcatagaaaatttcaaataaaaaaattgtcgtataaaaatttcaaagataaattttctctcatttttttttgtatattaacatcataaaatgtagagagcttcgaattctatgctaacattcggctttgaaaaatcttaatctaagttttgatcggacacttagaatggaagaggccttaaaattttcaaaaattgaccccctcgcccattccctccgttcaaaggtcgatgcaatgatttccaacgggtccatgctgtacttgcgcaacgaatccttctccactgtgcaaattcagctgctgcttcggcgtcaatcattctactacgtgttcaacttggttttccccaccactttggtcagtttttaaaaattttgaaatttaatttatgcaaattgtcaaatttaaatttgcaaaaaaaaaatagggtgcctttaggcatcattgaacagggttttttaaaataagtttttacaggtttcattggttgctgtgatcggtttccatgcgccgatcaatgcgactgggaggcgtgaaagcaaatttcgacttggcgttatgacattggtaaaattgaaaatcacacacgaatggtgtcattaaatctgattttttttttggattttttaagaaaaattcaggattaaaaa

SEQ ID NO: 16850 - DNA, 2643 bp, Heterodera glycines
aggaaaagggtaaataccgtaataaatatttcaaatactctttattagtgccaccaccctctaataaagcccccacaaatagcatggggttgaaaatcgggtacattatcatttatctcccgcgacaaataatttatcaaaaaaaaacatttttagaaatgtttatacccatatcttgcgattttctatcccgtatatttgtaattccatttgctattaataagtttttgtttatccatccaattcaaattgcccctagtttaggcgtcgatgtgcaagaagtgtcctcgagttccgccgggcccaccagtgataagtgaaagaagaagaagtgatcatttgaggaaggaaatgaaatgattattttaggcaatgctttatccgctaattatttgctctttgagctttatccttttgttttggctatttattgtttgcttttttaggttgatttttgcttccgaatatgcttggatacataaatattttctgcttataaatttatataaatttctgtttttgattagtcaaatcttttttaacatccgaattcgtgctctgcaccttaaaatagccctagaaaattttttccaagattttcaaaaaaaaaacgggaccagtaaactccatgattgccgttattgccacccaaaaagttataaagcattgaacatgctatggctttgttgtacaagcctttgctcggctccattaatccttaacacaccgagtcaaaaacgagacatgtgtcaataaagagagagtgcagagaaactttttttctctaacttttctctccttttggcatactatctaatattttcattattaggaaaaataacattcacttcatcctgtttaacttttttcctgcttgttaaatccacaccaaattttgcaaatcgatagagaaaagaaaaatgagcaaactttcagtgttttgagtaaaaattttggcctagaaagttattcaattcgcatttatctgaaatgtttttaattttttaggatttatggctaaaaaaattattgcttacgcttcaaggcagaagaggtgctgaacaactgaaaaaaaggcgagaagctcagacggagaaggcgaggcaagcctatttggccaagagaagtaagttttttcagcattttttactcaaaaaaatcaattttttaaatttcagccactcaacagccgaaccccaatgccgaaatgccacagcaggacgaaccagggccgtcaacatctgctgcatccgtcgaagaagcgatggagccaccaccaccaactccagcaccagtgccaacgccggagatgtacgaggaaattttggaatttggcttttcgctgccatcgacatctgtcacaccaatcggcgatttggtgccgttttcgacaacaccaactgcgtcaatggacaccggagagacgacctcgccaccgctggccattgacgagcgatcagagcgcatcgaacagctggaaaagcaactgaaggaccgcgacgacaccatcaaatttctgcgcgagcaggtgcgaaaccgagaagcgctgatcagtgatctgcgtcgtcagctggagcaatgtgcggcaccaccaacggcgaaaaaatgttgatcatttgcaacgcacctcacgccgcaaattggctgaagaaatcgccactgtaataaaccgggacagatcatgttcggccagccgggcgtccctcgaacgaatcaatcgggaagttcggcacaaatttgcccattacaccccccagaaaagccaacgacaacaaagcgaagcaattgatgcagcagacggcctactgattctctgcctcgttggcacactgaaatcatacgaaagactgaagcgcacatttcgtctgatcaactcggaaattgatgttcttccaccgcttaaaaaagttagaaaaattagggaaattttgttcatttttttaggttttggttatcaagcaaaaaatttgtgcgccattacattatcaaaaaattgaaacaacagctggtgttggatttgtgtgtctcgatgtcaaggccgctttggaatttcggctcagttcggccaaggacaattcgatcagcttcgacgacgaattgttgatcaaactgagcggggaccacggccaaggctttaccaaattgaccatcagtttcggccaagcacttcgaaacaactctgcttccaacgatttcattgctgcagttttcccggccaaagacaccagggaaaatttggaacagtatggtgctcttctctggccccaaattgatcaaatgaatgcattgatcaacagaccgattaagtggtaaaaagggtgaatatttttttaaattgtctgaaggtttatcggaggtgatgtgagctttgtgtgggcactgatcggtcattgcggatcagcagtgacttcatttcaatcacccatctgtaattgtcatcgtgatcagatgctcactgaaggatggcagtgtcaaacccggacaatcccgcagtcaacgcaacagtcagaacaattcgccaagcagtggaaaacggagagaaagcaacagccgcagttcggtccagcacgatgggaattgtcaaggcaccgctcatgaagacaattgaatttgatcggattattcccgccaccgtttcacgtg

SEQ ID NO: 16851 - DNA, 1021 bp, Heterodera glycines
gtgattttcggtctctagaaattaaatttataatcgaaattaaggcttccaaacatcgcaagacgacgacaccgaaaaagaaattaaggaatttctcgcgccggaaatcgcgaacccagacgcgaacccgttggatcgaacggaagaaaatcgctccccgattttcaatcctcgccaaatttgcggaaaaatatctttcagcacccgccaccagtgtcccaagtgaacaaacattcaaagtcgcccgtgatgttttcgattatcgccgttccaaattatcacccgaaactcgcagaacaacttatttttttgaacaagtctcttccccacgaattacaattattgaaactatttttttgtgtattttattaaacttgttatataatttctacataattgatgaaatttgtgggttttttcccaaattaacatgtaaaaattaaaatttgtactaacccggaacccggtcccgggcccggcagttttaaaatccgggttgaccgggttaaccgggttttgagaggccgggcccggaacccggttaattctggaaaaatcaacccggcccggagttttttggaaatttcggtctactaaaaatactttattttctttaaaattggctcaaaaatcagcaaaatttatgcaatttttagacaaaatctgttaacaaatcgcattaaaaatcataaaaaaattcccggcggcgcctgtcggcgccaccggacgcccctgtccaacctccaaaattttttaaaaaatgtcgcaaaaaagaattttgaatgtaaaaatggtcgccaattgtctcaaaatcgcaaaaattgataatttttgatgaaaatctgttaacaaatcaaagaaataacaaaaaatttttccggcggcgcctatcggcaccgccggacccttgtaaaaatatttgatttgaagcaattttgcgaaatgttcttatttttgaccataaaatcttattttttggccttaatgttcttattttgaaaatttttcgatccgagccctg

SEQ ID NO: 16852 - DNA, 2170 bp, Heterodera glycines
  misc_feature (22)..(22): n is a, c, g, or t
ttgaaacggtcttttgaaaggnatcgctcaccaaatcacgacaacgacgatcagaacgatgagccaaactggaaaaccgctcgccgaatcaccaatcacacacggttctccgcctccgactgattccatcacttgacgaacattggtctgaaacaacaaagcagaaatagatgattcacctgtaaaaacgtcaaactcacgaagtacgccttccacttcgtgcacagtgccgtcacttgtgtgagatttcccaagttgactttgaacactcgaccgtcaggcaattccgctacttccttgacggttttgatttggcaggtgacactgcgggagttgcaaccggagccagcgccccctccatccggacagttagccgattcagtctgaaaccacaaaaaactgattgtttatgtgacaaattgagtgttttcactcacctctgtctccaacgctccgagttcacaaaatcgaccgctgacgacgaagttgttcactgatgagaggcatgatgctgatgttggcgcaaatactttgaagctcaaatcctcctttttgttcgtctggaaaccaaagaggatcatagcaccagtggcattagtggcgtcggaaccaattctgaaatgggatattgggatgattgattgtttcacaaataaacgggttttgcacaactcacagcagaccatcgtcaaccgctctgaagccattgatttcaccgtctttcgccgtggcacaactgaggctcgccagacgcacgtgctcaacgccagcatgacaaccgatgaagagaaaagcagcaatgaacagaagcggacgataagaaattgacattgtgttgctgcgttaatagaaataatgaaaatccccgatggaatgatgtcttttatagaaacatggtgtgcataattctcctaaaagacatgcgttactgcgaaatgcaattggttgttctctatataagggatgtatgtgtagtctataaaatggttttgattcccattactgcaatccattcacatgcttctttttggttttgttcatatgtatacaaaaaatctttaattttgtttatttcaaatggacttcatcttttgtaaaaaaaaaaacttccaaaccctaggatttttttcaaaattcaatgaaattcaaggtgttttggggtgtccaggtctccatgaagcaatgacctgaacatttttttttgtaatcagccttaaatttgatagatagactatttggggtcaaaaaccagaattttgaaaattttattccaaaaatgatcataaaaaatgagtgagtgaaaatttagtttataaaagcgagatcacgcatgtttcaagctcatttttcaacttaaatgcagcaaaattttgtatcatctatctcctgatttattgcctatttcgactatgctccattccctttgctaacggctttcgaaaatcacgaaatggcatttacaccaactttttgatgtgatcaacggttttcgagtcctcccctttccccggatttctactctcaattattctccgttttgatcaacggatttgcgaatccccccttcccccgatttctactctcaatgaatctccgttttgatcaacggatttgcgaatccccccttcccccgatttctactctcaattattctccgttttgatcaacggatttgcgaatccccccttcccccgatttctactctcaatgaatctccgttttgatcaacggatttgcgaatccccccttcccccgatttctactctcaatgattctccttttcaacggatttgcgaatccccccttcccccgatttctactctcaataatctccgttttgatcaacggatttgcgaatccccccttcccccgatttctactctcaataatctccgttttgatcaacggatttgcgaatccccccttcccccgatttctactctcaatgattctccttttgatcaacggatttgcgaatccccccttcccccgatttctactctcaatgaatctccgttttgatcaacggatttgcgaatccgcccttcccccgatttctactctcaataatctccgttttgatcaacggatttgcgaatccccccttcccccgatttctactctcaatgaatctccgttttgatcaacggatttgcgaatccccccttcc

SEQ ID NO: 16853 - DNA, 2120 bp, Heterodera glycines
tgaagctgtaaattgcagcgaagtgcgcgtcgacgaagtgccgttggacgagcgtcagcaaatggccaacggcacagtgatgcttttcctgttcttcctgttcgaagttggcattgcttccttggcattctgtccaagtgccttttttcactcagttcctctatttgccttgtctcctcgcaatttggaagcatcgtcaacattcttgctaccagttcctcttcttcatcggcctcaccgacattctgatgctgcccatccaggggctcgtctccggcatttacagtctgtttggcgttgtgttctgtgctaatccgccgtttaattttgtcatcgcttcgtgcggcgcaggtgcaaaatcctatcaattttatccaattcaaattccaatctctgtttagccctttttgccgctcagacgagtgccaattttttcttggcattggaccgactcgtcgaaacaatttctccaagacttggcaaagttttatttgcaggtaaattagcaaaaaaggcttttaattgccattttttcagaaggccgtgcttggcgatggacaatggcatcgtccgcacttggcctttattatttttgcatggttaaaccggccctatttgcaccaacctatggcaattggttcatgaacccttaccaggactacgcttctgtggcggttgaactaaaagacgtaattgcccataattagctaattgtctaattaataatttcctgttagtacattagcccattcgctgtttattacgacacttttttgtccttcggattccccgcgatttatcttctttttgttgtgttctttttgcggaaacaagaaatgaaaaagaatattcaacagaagcgaccgaccacaattgttgtgtcgacccattcgcttttcaaaaaggtgaaaatatttttaattttccaaattaatttcccctttttcaaaggttgcaaacaaaaacaaaaattgctcttcgggcggtcattatgcaaaaatcgtaagtcaatcatttatcagcagcacctaattagtgtgttttccatctctaattgccaggtgtttgtccaagtggccgcaattaacggcataaatgtgggcacttttgtgctttataccgtaatgcagcaccttccgatgagcaaatcgctgattgtcgtcggcttctacttcaactatttgatgtttggtcggtaataacacatctggcaacaattaactgttttattaggcattccgccaatcgtttatttattcgtcaaccgaacaattcggaacgaatgccgcgcgatggccaaaaaattggtcaaattctgatgaaaaggaagcagcactcctccaccggagatcaccaattatttttcctaattcctttatcattctttttgtatctcttttcgttttttcctttctctcattccctaaaatttgtaacatttttttttgtatttattaattagcgaataaattgcatttatccaattaattttcatagaaaatagaaatgacacaaataattgcaaagtgtcagaacaattatagcccatgctcatcagtgtagaacaattgtattcatccgcatcaatgcgttgttcaccagccgtactgagtggccaattgctgggccaatgaaaccgtttccactcggccgacgtccgtgtccgtcccttcggtcactccgacgagaaatgctgaacactttcatttttaattaacgaaacaacgggaagtgctgatgaccctctgttcgttcttgcaatcgtaacgccgtgttgtccgtcaatctctcctgaacatttgtctaattatggcaattagtgagttggatcgaaccgctgaggcaagtgttgttggcagcggacgggggctgcgtaattggatacctaaacaaagagtaggaataagtaattaaaattatgtctattacgcacgtcactccttcgcaggctaagccacggcttgccaccacgccgggctaaaacaactaattaattggggcaatggccaatgattgtacatttttaacggtgctcactgcccccttcgctttcattcggccccaactaataaacaactacacgatattgaaagggaaggggcgcggaaatctccttgaaa

SEQ ID NO: 16854 - DNA, 1653 bp, Heterodera glycines
acataaaaaccaggaaatgcaaaaccaaatggaatgattttttgaaaaatttaaaagcaaattggtaaatttaatttaattttaatttatctttctctctccaaaactaaaaataaatgcgaatatcctctcataataaaataattaaaaattagacaattttgaattttgaatttttttgaaatttaatcggtcaaattcgggaggaccatttgcccattatcagcgaagagggcacttccacagtctccgccgggtgctgaatcatttggccaatgcccgtgaaaatctccgcaatattgtgaaaatccatcttaattgtgtgagcacaaattatccataacagcataaaattggcactttctcttcttttatttctatttattttaccgggttttccccaatgccaaaaacattctgttgattggccaacaaagcgacaaaaattgcggaaattaatgtcgaaagcattttcatttcggagtagaatagttatgcaaaaaacaaattaaattaaatttttaaattaaattattttgtcatttaatggattcgctttcataataatgaacagaataaatgggatttctttcttttcttttgatttgggtgaccgatttttcctgaaaacagaagtgaaaatgctgtgaatgtgcgcgatggattttgtggcgatttcggcggacggatcattcggcgaaatccaaaagtgtcggagcattcgcgcgcttcggacgagtgcgctattttaggtcatcaaaacctcgcaaacagaagaagcagatgagcaaccggcgcagaaaaagcacacttatttaagcaattaaaataataatttgtatataatattaattattagcaggtcatttcggcgctttgaaagggtttaatacacaaaaacacctgcttttatgtaatatttgtgtatctaatagtttcataaaaaaaaatccgttcaatcccggaatctgaaccagttcaaacccatggccccaaatctctaaccacgcaattaaatgaaatcattttaattttttgttcatataaattggtggtgtacaattgattagtggttttctgtttttttaaacattgtttgacttttgggtttgagatcagctccagcggactgctgccattgggaccaagtcgaagtccttcaaaagctgacagcagataaatgagcatgtgatggcatttgtcgttaagggcaccaaaacataatttgtaacaaaactctgtcacaactcgccagcagatgcaagaaaagaccaagatatttccggcagcgtttgattaaaaaaacaaaaaactaaatgcattcattttaaattgtttcacgtcgtttactaaaagattaaattataaatctttgggtttaaagtcatcaaaaaagtgacaatttttatgcaaaattcgctaattagatcagataaattttcaaaattttcttggccgcagctttggcaccgccgttgtcctccccttcaaagattttatcaattgtaactttatttcgactgtttcgtgcttattaatccttttggttttgccatatctcttctgcctctcttattataacagttttccatgaataaaataaaaataattcggtcggaaaggcttcccggcgaatgaatgaattcgcattgg

SEQ ID NO: 16855 - DNA, 209 bp, Heterodera glycines
atcaccaaaatttggacaattattttcgatccgaccccggttaagactaaaaatcaaggtatgaattcgaactgaggcgatctaagcactgggactactgaatcatataaaaatagacacttcagtaacaaaaacgattgaataaaagacagttaacaatagagaccggcgcgggacgggatcccgatttatacaaaattgttttttgg

SEQ ID NO: 16856 - DNA, 1806 bp, Heterodera glycines
aaaaagttttgaaaaaatcgcgctgtaaaaaacgtgtaaatagtcactctttttcccaaaaatgttctaaaataatgaaaaatgacaaaaaaagattttgataaaataattgaataattttttcaagcgaatatactaaaaacatttgtgaaataccttttacttggttaagaattaaaaaatttagcctattaaaatatttagaaatttttttgttatattgtatatttttggaaaaatttcctatttcttgcaccgcaaaaaagtggttttgaaaagaaaaaaatagtcaaatttatgaaccgttaataatttgatttccgatcaactttttaccgtcggatccaatcgaaaaatcttagtcgacccatcagccccttttaatgcatcccgccagcccctaaaaatttatttttcagcattttttgatttttggaaattttttgaatttaattaaattttttcgaattttccaaaatcccgcaatcccgcacgggatcccgcaaattttaaatgcgggattaatcccgcgggatcccgtcccgcaaaaaattttgagttccagtcccgcagcgggatccgcaaatttgaaatttccggtctctagttaacaacggtggtcgatcatttcgccactggtcgtttcgtcactgttcagttcgtcactgatttgtgaggaataatttttaaaaaatgttggcaaaatgtcattgtgtaaattattttcattaaataatattttttatttcggaaatgattattaaagaattatgttgaaaataaattctgcatttaaattattatttcataattatttaaaatatatatttttaattctttgttacatgcgatggaaaatatgcacaaataagagtgcgaattggtcagtacattttgatttgggctaaaagatcgttatcttaaatctccaattgaggcaaatttaggcatttttcgtgtacatattttttgatttagttttggaatttgacgggacgaattcaagagggtcaaaaactaacaattcgttggaaggatgacattacatttggggatcagttcttgagccaaaaccgctgtttagcaaatttgcaaggtggcaacacatagttgctgattatgaaaatgcgccagcaaatggcattagaaggaaaggtattaggcgaaatccctctatgttgatcaggacaacaatttgcgtcagatttttgctgaatttgagcagcgagcagcacaagaccccatttgttatctaagagcatgttcataccatttggggggaccagagcgtttgggccccggggtcgtttgggccccggggtcgtttgggcccccgtttttgggccccggggtcgtttgggccccaacccaaaaatagaaaaatgtgctttttaaaaaattaagattctaaaaactaagcctgagggatccctcgccacttggcataagttaagtttaattaacattcgctcattttttacaattttacttattccaaatcctattattttttaatagttaaccaatttgatgtacattctgatttggacatttttcaaaaatggctaacccaattgcaaccaaaaaacaaaaagtaaaattgtcttacgaacgccacctttacaccttcgctaaaatgagttctgatgggatgacaaaattttggagatgcgagttcaaaaaatcaatttaacattattttggagtttctccggggaatttctcgcaactatcgaatgaacccgtgaatttctgttaatttttacattgtttattgttaaaattattgttgaatttatttttaaa

SEQ ID NO: 16857 - DNA, 2620 bp, Heterodera glycines
tgcttttcaattcattaattttttgacaattgtatcttctgtggcctaattatgcacttttctacctaaaaatgccttcttcgtttgtttaattattttaaaatttcatcttccattcataaattatgcatgaatttttattgaaaaatgagttaaatacaatttatggtgtattgatgagaaagacagatacatcagaaaacaaaaacattacaaagtgtggccaaaattcttcacattgaaatcgctgcctataattcccttcccaacatatggtcggtaacatttctgtaggggcatggatacgaccctccctccctcccgaatgttcggtcggaggaagttaggataagtgacaatgattggctcataatcacccgttgttgcgtaccgcaccacttcttctttgaacgtctcgtaacgcatgccttggttgttgatcacgtcgtagttcagcgtcaatccgcgcaccttgagcacgtattccttttcggcatccgccccagctccctttcgtcgcaaacacagaccatactaaaatgtgaaataatcaatacagattgatgaatttaacttaaaatttacctgttttgcacccccactgcaaaactccacaatgtcgtggtccgggtactcgtcagtgaactggcccagatgtggaccaattttgagcggacatcgctcctccgggtggacgaggatgagactgtctgtatctaaaaaatatttgcaatttatttcatgcaattttttagagcatatgtaccggtgtagagtagctcagagcctggcgacctaaccaccttctgcatggctttgagcagaacaagccgcgcagcggaagtggtccacagagagatgactaaatttatcaatttagcacaattttataagtttattctcaccgatgtttgagcaagcgtgctcatcgacccagtcctttttgtggaggtaggtgatgaggatgtgcgtctcgtccagctgatcgatcgatgtgacttcgatcgatttgttgtccaagtactcggccagcgtcaccgggtcgtcagtgatgagtgtctggcacaggccaaagttgcgaagcgaaaaacgcccccctaaaaattacattttctgtccaaatcatatgtcaaagctcacataaattgttcaggcagagctttgccagggaccgttttcccttgttgaccaccatttttgcaggatcaatgttgatgccaaactgctcagcacactctcgtacaaattgttcttccttctcagcgtcccctcttatgctgctgtcaaatccgcttgcctggattttttgagccatgaattccgcaatgtaggggcggaatagcttgtcgtcgctttgctcgtattctagcacgcggaacaccttcgtgacgcggtaaccctcgtcgagcgctgcgttgagctcaatcgatgtgcaggtgctgacccatccgcgttgttgatcagtgtgctgacagtggtagtcgttgtccacgcctccagttggatattctttggcacaggcgatgcacagaggaaagcacagtcggtcgtccactttgaccggtaacaccgcaacgtcaattttacggggcggcacaacccagactttgagcagcgccagcgggaaaggattgtccgctgcgcttgtccactgcacttgttggttcagcacgtgcactttcgggtgtccaacaggatagcgagtggtgaagcttaagatttaaaatttatttgtcaaatggagaaaaagaactgactttatgtaagggtataacgacgtgaagtcgtaataggagatcttctctccgggccccgccttgcgcagcaatttcagtggcccggtccgtcctcccgtaaatgcgtccctgatcaccagtggcccgtcatccacgtagttcgcgaaggatttcctcatggctttgctccgctctagcatggacgtgattttgcactcccaatacacgtccacacgattcactcgggcccggatgtattccatccgctttgcgtcgcgctcccgtacctgccccgctgtctttccgttgggcaacaacatgttatcgattggataacatttcttgcatccgtgccaagtacagccttaaaatattaattttttatggaataacaataataatcaataccgtgcacttcaattgcacgcccctctgcctcaatccacccgtccagcgagtaggggccgatccgtttctctcctccggcagagtgggcggtctgcacttccacaccgtactcctccgagtaccagtggaagaaccgtagggcgagaaggctttgattttgagcgttgtcgtaaccgcgctctgggacgatggccagatggtcgtcaggcaggtggttggtgcgaaagtgtcgcatgcacgcgccggcgatggtcatgcactcacgaagtacgtcgatgccatcatggttctctctgtcgtcgatcccgtccacgtactcctggcgacgcgaaatctcaaagaattcccgacggaatgcgacaagggcagccatcagaatctcgacatcattcgtgcaataactgaaacagaaaaatttaatttgtacattttaaaaaaaacccctttacctggctagcgcctcatcgagcataaaa

SEQ ID NO: 16858 - DNA, 4054 bp, Heterodera glycines
aaacgaaatgtaaaaagaattttgggattttaataaattttactcaaaaataaataattttcttggcaattatttcgaagctcctcgcgttccaaaatcgatttcctatattcggcaaatcgtttattcaaattcaaaagtttatttaaaaataaatttttaaatagagccccccgattaagcaaataattattatcgcaataataaaccgccattttaaggttgtgcctcccatttcatcgtcaacaacgtacaaacagaattggcctcgggatcgcccaaggggcacgattacataagagaaggttggttaattgttgttgatacccgaacaaatcaaaaaaaaaaagagagaattgggtaattaatgagttaattgattctatcgcccaaggcaatcccactcgtgatgtactccaagaaagcatagcgaccctggagaatgctcgccattgccgaattttcagctcaggacttgccgcaattgcagcagtgtcccatttgcttaattccggacgtaaaatttaaaagcattcccaatttttagcatcctttccttagagcatgtcatcgtgtcgggggattgtaatgggcggcacgaaaaattatttcgacaaaatttgtgtgccgcatcatggcttggagctgagttttgtggatttgacgcgattggaaaacttggagaatgaatttaagcccaacacaaaagtacaaaaccataaaaaaccatttgaattaatttaattaaatgggcagatggttttgtttgaaacaccctcaaatccgcttctaaaaatcgtcgacattgaagcggtgtgccgtatggttcgagcacgctcaaaagattgtgtcgtcgttgttgataatacggtaatgatacgagaggcattactatacgtgagggatactgtagccaattacagttcatgacaccgtactttcaacgcccgttggaacttggcgccgatgttacggttcaatcgctcaccaaatacatcaacggacacaccgatgtgctgatgggcaccgtagttaccaacaaggagcagcttgatcagcacatatacgcccagcaaatttgtagagtgattttgattgaaagatggctttcctagcgtatgtatttttgccagcccaaaaaaatcgacaaaattttgaaaaaaaatgataaaagggagtttttaaatatttttcagatgctggcgccgttccgtccgcctttgatgcctttttggtgcttcgtggcatcaaaacgctcccattgcgaatgcgccagcacatggaaaatgcgctggcaattggacgatggcttgagaaggacccgcgtgtggaaaaggtgaaaaattagaaaataaattaaaaagtatttaaaattacctaaaatatttaaaataatttgtcaattaaattgttgttaggtgctttatcccgagctcgagtcgcatccgcaacaccaaatccacaagaaacagagcagcggaatgtccggcatgctctccttttacattcgcacagattttgacggggcactgaaattcctggccaatttaaaggtgttgcttaaattctaagcattttttaatcataaatttttcatttaaatattttattaatttgttatttttaaatattttttatacatatttatattttttaggtgtttttggtcgcccgatcactcggcggtttcgaatcattggcctcactgccggcggccatgtcgcgtgattccgtgccagcgaaggttcgcgctcagaccggcatcagtgataatctgatcagactgtcaattggctgtgaggacaaagctgatctgatcaacgacttggatatggcaatgcgagtggcgacggaatagcaaattccttttttttggtttttcgaaatttaagaaatgttgattgatgatttacaccttttatgatgttactaataatgagatatattcacatttgccttgtcttttattccgattttttataaaatgtttttaccaaggataaagccaaacttaatgcttaaaagacttggggacatgacaatgcgaatggcgacggaatagaaaattcccttttttggttttcgaaatttaaaaatgctttgatgttaattatgccttttgtgttgtaaatgctgttacacaaaaaacaacaaaatgataaatttgttcataactttgtcaaaagatttttggtatcattaataattataagtgtttttatgagcctccaaaatttcgtttaatcttaaaaaagaccagctttttttgtacttctgcccatatttttcttttcgtcaaaaatcatgaaaaaataaaattttgtcgtttttgtagattcatggtcacatctttttatggcgagttggcttaatcaactaaagtgactttgattccctaaataacggaaaattattgaagagaattttttttaattttaaaaattatcaaaaattgtaaatttatatcaaaaataaaattcattaaaaccaatgttgttttcccgaattcgagcaaaaattcgaattcaatccccccccccccagcattaatggcaaacttcttttttaggccaaggacgtttagcagatcatttgctaatggagattgaaatgcacataattttttggtgaatccaaataattatgcgtttgtaaaaattaagaaaaaaattttcgcaaattcaaaattttagattcaaaaacgttatttttgaaaaattttgaaaaatgctaaaaactttgagatatgcaaatttattttaaagatttcttcagggaaaatatttaagacatatttcttttatgctttttcttgagtacaatctgaaaacagctgctgcaggttaaaatttttagtaaaaattttctcgagaaaattgaataaaatttaaattttcttaaaaattggtaaatttatgtcaaaactaagcaaaaaagcgaaaatttcgattttcaggttggtttttcgctaaaaattagtttttagtttattctatttttttcttataaataattttaaatactctatttagttttttgaagtccatatttttggccatatttcgagattttaaaaccaattttttgcagccctaatgatcagttttgcaagattttttctgaggcaaaagaaacgaaatagaggccaaaaggggtgaaatagcaaaagtaggggcaaaaatggcaaattcaaattttcatcaattttcaataatcttagctttttgaaacattttttaaaacaaattaaaaagggaagattggaaaattttaggcatttgtttacaggtttagtgccaaaaggctattttagaaaaaatttaaaaaataaccaaagaaaaacctggatatattgatgagcaatggaaagttgcttgaatattcacgaaaatgtgcttaattgttttatgttcatccaaatagtttctttaaatttaatatgctaacaaataaccacataagtattcttaaagaaattgaattatttctttcgttgttttctttttttaaatatcaacaatcaggacttcctttttaatgtaaatacatatttttcttggattctccttgctattaataataggaaaatcacttcttttttgtgtttgcgaacaaaagtcgggacttttattggtaaaacggacttttactggtcacataaaaggcctaaatatgtgttaaaaaatgcaaaaatatgtgctaaaatttggaaaaaccaagtgtatttacgcaaaaaaaaaatcgtatttaatatcagtctttatcaattttcgcccgacctccaatcaaaattttggcgatatcaatcaatttgtaaatcccggattaatttttccatcagttgaataagttccttccgggaactttgaaatccagtgacgatttaacacagcgtttgatttggctgctttaggcagttaaatatataaagaaattttctaaatgcttaagaaacgtaaagtagtcaattttagggtgcattttcagattttcttgtatttttcttacgatttatcgcaaaaatgccaaaatatgtgctaaaaaatccaaaata

SEQ ID NO: 16859 - DNA, 3329 bp, Heterodera glycines
cgcatttacaggccattaagtaccttgactggcgcgctatagtgaagggctccagatccaacatgccggaaatgggggtgaaaaacgaattcgtaaccacaagctggacggctggattcaatcacaaaataagtgtattgaagtgctcggatggtacgttaaataagggtgctgctataataataataacaataaatgttccaagctattggcacggttgcgagcggtgttttgaccctcaggataagctggtcgatggcaaaacatgtcgagagcttaatgaggccacccaagatcgactacaccagctccgagaatcggattgcacgggagagtgcatgacggttgaagagatttgggtatgttgtgatggttgatgacccaacaatatcaattctaataatgattcatttcaccgtgtgcaaaccaaaaaaaaagtgaattaaggagtgtgaaattaacgccttgctgtctgatgcagccttggaggtaggtgtggtacacatttgctgaggtgctctcatgtcgatcggtcggtcagtgggtcggtcgtttgatgttcacaaaacaattcaggtcggacaggaccgttgaagctgtttgccgaaccaaaagaggatgaaaagatatcggtatacgatattgtcagtctttatccgtgggtaggttgtcatccgaatcagcattatgatatgctttttctgaatgttctgttttaggtaaactacgataccgagtatccaatcggagtacctaaaattatatacccgtctgctgtacagatgttggttaattggtaatatttatcaaacacactgttcctggtagaaccaatcaaacgcacgcactaataaccaggagctcgcctgatcagctggagtacaaaggaatttaccgcgttcgtgtgattccgccacgagggctacgcatccctgtgctgcccatgaagttggatgaacgtctattgttcagctgctgtcatcgttgtgcgtctcagttccgtacgctgaacacgcgatgccagcacgtgtgcgcacattcggatgctcagcgagcatacaccggcaattacactcacattgagctggcaatggcccttcggtacggctaccgtgtggaccgtttctggagagcgtggcactatgagcagtggtctaccttaatgagcaattcttctcaaattggaaacaaaaactgtgcttttcaggagcgaccaaatcttcaaggaatacgtacgtctcttactcaagcttaaggttggttggttggttggttggttggctgcaggtttcttgttctttcgcgttttcacccgtttcccgaaccattatccaaacaagcacattgcacatacatatatgttacgcagattgaggctagcggcttcccagatgggattacaactgaggcacaaaggcaccaatttattgatgcatatgccaccgtgtatgccgtcactctggacgtggaccgtgtgcataagaatccagggcttcgcttcatcgctaaactaatgttgaacagtctttggtaagcaaaaaaaaaattatgcaaacagtcgcctcattctttttttggccgctatgatcgcatccatctcccatcaatcaatcaatcaatctgttttcaggggcaaatttagcatgagaaatgaactaggaacaaacaaggtcatcacaagaccgcaggaattctactcattggtgctcgaccataaagtcgaaatttctgccatcattccgctatccgacacagccattcgagtgatgtaccggcacaaaaaaagtttcgtggaggagcattcgtcaagcaacatagtgctcagcttatggacaacaagtaaattgtcaattcattcagcaaccaggattctgtataacaaacaaaaaaaaatgtttgtttgtttttttctactccaggtcgtgctcgattgaagctgtttgagtacatgatgcaagtgcagaatacggatggagccgagcttctttatacagtcagttatcgtaggcgaacatatgcatttgtcacagtggttggcataagagttaccttttcccgttgtgtctccaggataccgacagcgtgattgttttgcacaaacgtgatcgggtgccaatcctcacgggcgaatatcttggacaaatgtccgaagagtacgcgggatttgaaatacaaaccttcatatgcggaggtatgcgctatgccaattagtaccatcgaacggcgtggggatgtgttaactgtctgccacttaggtgcaaagcagtacgcctttcgtatgacaaatgtgcggagcggtgaagtgaaatatgttcaaaaaattcgcggcatcaccttcgatgtgcggaacagtcaatcgctacaatttgagtgcttccgcaacaaagtgctcagctacggaggagtagaaggaagacgtgccgatcgcggcggagatgatgatgatgatgatgaggacggtgatgtcgccgtgcagcaaagtgcagctgtgttcacatatgacaaaatacaaccgacaagggagagccgaattatcacacgcaagcaaagaaagcactatctgcccgtttgtcagaagggcataatcaacgaacagctggaagttttaccctttggctaccgataaggcagaatcagcagcagcagtagttcatatcgatcataagcaaattttggttctcaataataataaagtgttgttttctattggtgatcaaaagcacaggagtcgcccaatgtttttttaaaacacgcaacccgtgtacatccatccatccataatatgtgacaatgcgcatgcgtttctgctatcgccgttgttgtttgtggaccgtcatctgcttgatcgtcaacaccgccattcgttttctgcttcactattttctctcttaacgcctcaccatgcgttgttgttgttgttgttgttgctgtttgtggtctggcatcagctttatcactatcaccatcattctttttcttctgcgatattttttctcttaatgcctcaccatgcgtgcttattggttttgttgttgttgttgttgtttgttgactgtcatcaactttatcgtcagcaccaacctcattgatggtggtacccgtacgcggttttaatgactctcttgcaatcaatgcagatgcggtcggccctggaattgcactaccagcagcagtcgaagcaaagtgttgttgttgttgttgttgcttttgttcatcacgcttttttgcctcaaattcaagcgcagcaaatctcttacgcctgtactcaatcagtttttttgcttgctcaatcttcttctggaacgaggcatcgtcctttaatcctactg

SEQ ID NO: 16860 - DNA, 2747 bp, Heterodera glycines
tcttgccgatgctttcaaaattccattttaacatttattttcttatatttcacatttcgtttgctttttaaagaaattaattaacataaatttattttaaagtaaatggtttttctttttattttcgtcatttgatttgcttattcaccatattctgttgagtgtcagtccattcccatctctttttgacgaacagcaaaaaaaaatttgttgtgatttttatggaattttacacaaattgacaaaatattatccatttaataacagagaaatttttgagctttcgtaaaaataaattaataaaaaagattatttaaaataaaaatgagaatatatcattttatacacaatagaatattattatcatattaaaaaaacagacaaatgaactttttgattaccgttttcatcatttttaaagtgacaataaaattcacaaaaggccagccgaccacaaaaccgtaataaatattttattttttaattaatttcatttttaagacataattcggttgccattgagaaagtgaaggaccagcgatttgacgcattggcacaatgccatgtcattaatgggacggacgaagccacaaagaagccttgcggaattgaatttcgccttccacatggaggaggaaattgcgatgacgggttgaaataaaattagaaacatttgaaaataaaattaaaataatatttataacaaatagaaatgccatttaaaattgcttttttagtttttggatctgctaccagcctgttcttcaacgtggtcgcactttggatacaagcaccaattacaaagcgaaaagaacattcgcaattgatactgaaaaggtaaatagtatttaattaataatgtaattagttaattgcttgcttaaatgattgtttgtggtccaggaccattcaattacaaaagaatgtgctcaaagaatgccgaaggatagtggtaaaagtggcacaatgctttggcgtggcattaaactgcgcacagtgccagtgccatcggacaaaaacaaaggcaaacactcatcatcatcgactgataatgatgatgaagtcaccattttggagacaacatttaacgattcactgaaaatgtttgtttttaaaataaattcgaacgtggtcgcgactgcaccatggaggccagggttagcaaatcagtgccaaattgagaatgataattttgaattgcatcattttgatcacttcctaataattttatattctttttgttaattttgaatagggtcagcgcagaagggaggggggggggggaaatcatcggtactttcatccttttgatcatttggatgttcttccatttgactgattcgatctaataagttattttcatttgcttagtttatccaaccatcgaattccaacgggccaacttatttggaaattccatgcgttggttcggttttatgtcctccaaaacaaacaaataatgttttctcggccaaattcaccaacaccggacagcaaatgattatcatcaaagcactgacagatgccaacatcaaaagtgtgaaggtggaacttttgagtggcaaaaagggtaacgaaacattgggacacaaatttcaataaagccaagccaatttaattaggtaaatatgtctagatgatgccatcaaaacggaagtgagctttaaaattggaacggacatcgattttgaggtggaattgcctggggtaattttgaaaattattattgcaattactttaatcactttcatttagtcctcgaaattgattcgaagcaaaggcatgcgcttggcccgtggcagttacgtgttgaacttggagattgtgctgctcaagcgttgctacatgatcagactgaatggcactcagtttggcggacttagttgccaagcaggtgttaagcaatattttaaaatcgaagattctccaataatttgagcgaatttttaagacggtttaaattaagaaaaatgcaaaaatttaatattttatgactaattttatccatcttatgaagaattttcaatccaaacgagtctatcctccctttggttttaatacataattttgtaataagtgtcactttaaaagcacataaattttttttttctaataattaagaaaattcggaattataaacattttttacaaaatttatggaaaaagcttatcagggacaaatttttgagaaaaaaacaacctagtattcatatattatatttacttatttcgtgttttagcacatataaatcccagccctggtcagaatttttcattggaggcgatcaatcggataaaggtgaatgaatgagacctgaataattcagcactgaattaagcaaaatgttaaatttgggtgtttaaggtccaaggccaaatgttgctttttgctgatccgcttgtgaagcaaattgatgacaaaacatttgtgccaaatgaggtgcgactttaagcaatgccaacatgaataattcgcatattttcaggaaaattcaaaattttcatcgggaattattaacactgaaacagatgaatgtgttggagaaaatgtaagttaagacctcggggcaaaactgcttaattaattaattttgaattaaggcaatcaatccataatttgtaaatagatttttaaaatcaaaaattattgtaaactatgaaaaaaagctatttttgaatgttttgttaatccattttgcatagcaataatctttttttgaacagatggtatacacattgaaaatgaa

SEQ ID NO: 16861 - DNA, 2153 bp, Heterodera glycines
caaatgagcatttataatttctctttgtttccgccatggaatggaaccgaaattcccttttatttgccagagacccatcactgttgtggaggaagatgagagagcacaggtgacagactcggaatatgaagacggaaagggagtggaagaagaaggggaggaggaggacggagaagaaaaagtgaaggaggaagtggaagaggagggggaggaggaggacatggacgacccgagcggagagagggccattttacgagcaattttggagaaaaataaaccgaaacaaagcgaagaaggggaaatagtggacaaaaaggaggaagagcgggacgagacgaaggaagacaaaggcaaagagagggaagaggagggggaagaagacgaggaagacggcacatccagtgtggtgacggactttgaatttcaggcatattgaaaccgaaaaattcggaaatacgttgctcaattacagttcagcacaacggatgatgacgcggaaatggagagcattggttccgatttggagggaaatgggatcggaaaggaggaaacgcggcggaaaacgattgggggcaaaagggcgagggggaaacggggtggcacaaaaaatgccaacaaaaaacaaccgcaaaacagcggacggaccgggagagcggcagcgattttgggggcaacgaatgccgaaaaagtaggagaaagcatcgaatggcatggcaaattgagatgaataaaattgaatttagacaaaggacggcgggcgggagaaggaaggagtggtcagttttgagaggtccaagcacagtgttccgcgcaacatgtggtacaaaaagttggccaaacgtacaaaagccaaacaccaacaataagaaataattgatgatggcgattcaatgggagtgctgttgcgacttttaaattgtcattttgtactgttgtttttgttgtttgttcataaaatgccaagaaagagaagggttacctatcatttcgtcactgagacataattttttaaaaatattggctaatttcaattaaattatcttatgaaagtattaaatggtttaaaattctctaaaaattattcctttataagaataccaccggtggaagcccctttttcgaaaattttttgagattttaaaaagccaaaaaataagtttataagattttaaagatcgctctgatcatgaatttgactgttgacttaaatgataatgctctgagataacgatagggattttctgctgctgctttctgcataaattcagcaaaaatttgacgcaaattgttctcttggtcaacagagagatattgcgcttaagacttttccctttaatgcctttttctggcgcattttcataatcagcaacgaatattaccatcctgaaaactttaagcatcccttttaacaaatttattcataatgcatccgatccctggtcttttgtcgaagttgaatccaagtggtgattttatgaaataaaacgtaaacttaagtctgcaatataaaacaaggatttccaatatttatctaaaatttaaaaaaaaaaaattcctcagtgccgaaatgatcagtgacgaactgaacagtgacgaaacgatcgtccacctttttaacatttttacatttttttgtaataattaatagactaattgagtctatgaagagttttcgaatgctatcaagattgttggattcggtcaacaacttaaaaagttacattgactcaaagttgactcagacggagttgacaagttccggataaaaaaaatgaccgtcattttcttggcaatggctcaattaataaaaaaatgaccatcatttcttggcaatggtacaattaaattacttacctaatttatttgtctccgttgaaaaaaaaaaaaattacgagccgattttttatgctcaatactgaaatggccgacatttttatattttctttccccgccggccgcgaccaaatggccgccgcaacagcagctgctgatgctggaaaatgcccacatttgccatcatgtttctaattagttttttttttttttgcttattggcaagggacccaaaactgagcagaaatgtgagagaaaagtacggcatgcgtaactttttcatcacattctcgacttttctctcgccattttgacctgca

SEQ ID NO: 16862 - DNA, 1649 bp, Heterodera glycines
  misc_feature (105)..(105): n is a, c, g, or t
  misc_feature (124)..(124): n is a, c, g, or t
  misc_feature (134)..(134): n is a, c, g, or t
ataaatttgaacttttttttggtattccaattgtttatggttagtttttaaataaagatattagatttttcatttttttatctaggaaaaaaaacgttcacccgncgcttcaaccccccccccncctccaaaanaattgaaaaaaaaattcatttaaatgaaaaactaattaaaaaatttacggtttaaaaaaaaaataatcagggcgaggagatgcttcctcaaaaattgactaaattccttaacaaaaaaaaattgttggtaaaattttttgtcccttttcagctggaacagtatgccgatttgtatgccagctcttgcttcaacttggtccattattcggtctgctatatcttccgcgctccaatggcactgatgccgcacgagtcgacggtggaccatggggccgcaatgccggacatagggtcacgccaaaacatgactgtggaccatggggccgcaatgccggacatagggtcacgccaaaacatgactgtggaccatggggccgcaatgccggacatagggtcacgccaaaacatgactgtggaccatggggccgcaatgccggacatagggtcacgccaaaacatggacggtcagttgttgttttggggttttgcctaaacgcccgtctccaggagcaatgaaaaaattttcaaaaaacaaatacaaatttgcatccgcgggatccttcatttgcggattcgctgcaagattagtatattaacgaataggtttttatttttatctttctcttaaatctaaaatgatggaaacttttcaaacaaattaatttgtaagcaaaaataaaagatttctttacagtcaaaaatatttaacacttttgcttatttgaataaatgtttctaatcagtccaaattcattttcaattatttttctcgaatatttctttttcatttgcttaattttctctttaattttaataaatttttgcacaatttcccttttatttttatcaatttcatttaaaaaatgatcaggtatttgtccactattttctgacatttgatcacattcgcttgcaatttttctttcatctctaaattttcatcaaatatttgatcaaattgtcatgccaatatttttgaatcaatttttttttttgcattttttgtcctcttttttcgtcagtttgtcattgtcccattcatacatgaaaaaaggggggggggtcgacccccccccccccccttcgcccgcaaagtgccccaaaatggggtaccccttcgcatcgacggggggccggtgtaaaagaggtgggggggggggggaggcaggaccagtgtaatacgggcacttggtaatgctcgataacagctatttggttgataaatgcttgaactgatgtgaacatttaatatattaaaacgtgaatgtgtgacattgagctgcttgacaaggaaactgcgtacgattcattagcaaacagctataatattactatgaccttgacttcatactgggataattgtgcttattcgagagctaatatatgcactatagatctaatctcaccagagcgaattgtatttgtacttcataaaagcaagcgccctaagggcgttaagagttgactcagaactactaagttgatcgcacggtcttggaacggctacgtgtgttt

SEQ ID NO: 16863 - DNA, 1521 bp, Heterodera glycines
cagtaatgggacattttttgctaccatataacgacctacaatataggttgaaactgaagagattattcttttttggtatttcgcaacttaatggagaattttaaagcaattcatgattcctatatcaataataatcgtaataaaattaaattagtgaccccagtatggtattcattcatttaaataattcattaacatttttttggtttctaataatgatccttttgataaattttgttataaaattttgactccacatattctaattatgggaaactgatttgcgaaaataagatagacaataatagacagaaaatcaatttataattaattaacacatgttaatttgcgggcacatatcaattaaggctaattagtgttcattaatgcgtatttaattggaacatttattcacaagtcttatcccccaaaatagctgttataattatatttttttattattattagtataataagtgccacttcacagatatattattgtatacagaaaaattgtctgtgaatggaaattgtattaattacacccttttaaagtgtcattttctctaatataaatttcctgttattatatactttttagagaattttaaaaaaaataatctagtatactgttttctgtaaacgacaatactgtacacgctaaatttgtacccacttaaatacccgatgcatattttaataattaacggcattttgtgcttttacataaaaacataaattttcagcgaaagtatctttaaaccgtttgtttatcaaaatacaataattttaattgacataatttacaaagtaaattgaataactaaatttaaaaaaaccaatttttactataaaattaaaggcttcaatttattaatttaaaaatatttaaaaggattctaaaaagctaaaaacaaaaaagaattttccatcttccgctcaatttgataaattttacttataacccataaataattttttgtcacatatttccgccataatttgtggcattttgcacgaaccggcgaaggccatttgcaatccgaacggatatattactcaaaatgctaattaatataattaaaaaattaattagagtgagttagaataataacaagatgttttttcaaaccctctgttaattaaataaattccctttgttaattatatttttaaaatatttaacattaaattaaatataaattcttttttagaaaggccaaaagtcaaaattacgttgcgtgactttttatgttttgtgactttaccgacaaaattataaaagcaggctctataataggcgccaaaaaaattgaaaaaagacatgaaaaagcacaaaaccctcaaatgggcatgaaaaaaggcatttaaaattttttttttattgaggattttcagggagaaaaacacgtataacttaatcaaaaaattaattttgctcatttaaatgattattaaatattttataatgtttttcgaataaggaaaattttttaccaaaatttttttaacaagaaaaaa

SEQ ID NO: 16864 - DNA, 1721 bp, Heterodera glycines
ttagccatcataaaatgtgcaatttgtccacttttttgtcaatatttttgctaccatctaccgtatacagcaccggtgatgacagagtattccaccataaccgtatgaatgttgtcagacgacaattgcttcaactaccacattttttgaatggttgcgctgtgggtggtggcggtggttcatcaggcaaaaaacaaaaacaatacaaccaacaattacagcaacagggccaaaatggcatatgggacagcaacgaggtagagcaataccgtaatgactaccaactgaacagcatacggtatgtcttacaaatttattctgtatttggtatggtttaacttacaaattatactgtatttgttatgtcgtaccaatttattctgtattttctggtcaattcatatgttacagtattttgaaagcgattaagaaacaaactttaaaaacacttactaatcgcaagtcttgaatccacctgggaatttccataaattttatgaatttaactgaaatttatgatggataattaaacgtttgagggcctttcaaatgttaacaaatttgtcaaaaaattgaaaattatatagccgtcctaagaatcggattattcaaaaaataataaaagaatggcccacatattttttgaatttcctaaaatttagtccctaaaaaatgaccagaaaacttagcccaattcgaaaaaataaattaaaaaattttctgcaggccctgctatttctctcccgttcaatgccttttggtcacaccaggccaacatcgggcattcgttaaccacccaaagttcaaccagcaacagaagcagcagcagcagcacaattttgagcaacaaattaaagtagcaggcgaaaaaggcactgcagtcaaggccatcaaaggaagcagcaaaatttggcatcgacaaagtccaaaggaaagtgccaaagatggagcgcaacccagacatgaacaatatgatgccggcgatgtacaagttgttcatcaagacgaagctgttcagcaccaacagcacctcaaccatcacaaccgtagacggcatagattattgaccagcggccaaacattgtgccaacacaggcatggcggcattggtggtgatgccaatgccaatacgacagatggtggacgaataaagcagtggaggaggaagtatggcgaacgcaaactaagacggcatccaatttttggcaatccattccgaattggactatgaccatagcctaattagcatcataaagatatttttgtataaaaatttatcattttttctttaaaataaatgatttacaatgttttagctattttatttattagctctttatggcgattttggttgtagtttggttttttaaatacgaaatattttctatgaattcaatgaaaaacaaaaaattttaatttaattaaaattaagcaaattaaaaaacagactggacaattgtcattcaattgcaatataacctttaaaattttcatgcttaagaaggtcaatgtttgttgattattcataattagaatacgaaaagcataatgtctttaaaaattttttgatgattaatttgattgctatgaaaattctcacaaatggaaattaaataaaacgactaaaattaattgttacaagagctaaactgtttaaataatttattttcaaaaaacatatttttggttttggttttaaaaatttaaaattatcgcttaaa

SEQ ID NO: 16865 - DNA, 1991 bp, Heterodera glycines
gggggcgggggccggcggtgcctataggcgccgccggaaaattttgaaaatttgattgtgatttgttaacagattttcaccaaaaaaagataaaatttttgcgaagtctggccgttttagtcagagggtcggtttagtctggcaagctgcttttgtgctacacggtttttattgtgatttttttttcgaaaaatctttaaatctaatattaaaacatatttaacaaagtatttccaaaaaaaaaataactttcgagaaatatcaacgataaaattggtggtgtcgggattaacaatggcattgacatggtaattgtgatcattttggtaggccgggtaatgtgttgatggcattgtaagcctgtaagagtcgaagaattctctcatcggcggcatgagcgcctttggaggagggacttcaccagcgacacatcgtgcttgcgattatgagtcaatttttttaataaagctaatgaattttactggtcaattcctgggaagtttggtaatttgagcccgattttttaaagattttaccaaaaattatggtttggataggaatctgtcacccacagattgtattgtggactagaaaacttaaacatgtagaaatttgtgaagaaaattgaagtcctgcgttttaaagtcacatacataaaatcaaaattaataaattgtcgcattgatggggtgttctttttacccctatttgttgctaaacagagatattttaagtttttacttctttatgattgacaaaaaatattttaagagttctgggcgaaaacggctagccagactaaaacgacccctctgactaaaacggccagactaaactgaccctgtccgaattgcatagttctttgcctccttattttggctccctatcatttcgtcactgagaaaattaaaaaattgtttggtagattgtcttttaaagtcatctcttctccaaaattgtttttctccaaatctgtcgtaaggccagccgaaaaattttttacaataatgttttttttttttgcaaaattttgtgataaaaattgcttgaaaatggagaacatttgttcaaaaggcagtgccgcgaagagacgatgtgcggggtagtgctaagactctctagtctcgctcgagaaaattctcgggtctttttggtctcgagcagcaaccaaatccaacgatcttgaatcattcgagagcccttcatatgctctattagcctgcaaaattctggtcataacttttttgaaccttaacaaaattttttgaaatttttaagctaatagagaacacatagggctatcgaatgatatgaacaatgttggatttggttgtaaaaaagttatagccaaaaacttgtactcgtacgaaaacgacccggacccgaccccttgtacaattatgctcttaatgtattatggcgaaaaaataaataaattttagaaataagcacccttggaagtggaattaactgagaagctaaattggtctcttttatttcagagctttttgctagcacgtttgtttttcagcgacgaaacgattagtgacgaaatgattggccacccttattttaactacttagggtgtaacataagtttccgcacaatttttttttgacaaattcaaaaattcataactccgtaatttctgcagttattttaataattctttttttattttgttcgtcagaaagtcttctttcatttcatgccattgtttcattttttatttgcttattcaatttttttagtattttttcccgaccatgcaaaaattgaaaattggcccactaaattttctcgaatttttatggtcaaaaaagtaacctgatataacaaaaaagaaggttttctgtacaaattagaccagtagaatccgaatatggccttaaatctgatctatcttttaaccaggagcttgtctgctccagctccatgcatgaagcgcgagaaggacaggtttgtgagaacccagagaccaaatctaaag

SEQ ID NO: 16866 - DNA, 1935 bp, Heterodera glycines
attaattaaattcagatttcgcgacgaaacatttaaaaatagcagcaggttctgaaccgtattggacaaaaatattcacatcacattaacagtagaaaaaagtgatacgaatctttcccatttgattcttaaaatacatataaattttgccgctttcggccattgcaaaatgccaaaacaaaaaaattctgaattctggcgaaatgctatgtgccatttttggaaggagccgtgccatatgtaaaaatgagcaaaattggggtgtgaagaaaatggcaaaacaaatttgttatctcaaatgctggctctctctactatgttttttttaacctaaggcgggaattttgaattttttttgtctaaaaatggaaatttcaatttttgtgccggaaatttcttcataacaaaacaattataaataataaatattatttatttttgttgagcgaacgaattcacccaccacaaccaccccaccagtttttgtgtgtcaacgcttaaaaggtaaaatgaatgagtcccatgggaaaatgccgaaaattttggtgccaaatgtcattttaaatgccaagaaaacccatttttgggtttgttattattgtataggggcagttagttgttcattatagaaaacacaagtcccaaagtacaaacaaatcggaatatttatcagtagggaggtgattttatgtgttgcaaaagttcaaaagtgccaaaaataggcattaaaacatgcgagtgacgcaaaatgccaaaatgttgttcaaagcaagcgctcaaaatttagttttgatggcgagaaaagtttaaaataaaataacattttgtggcaaaattaattttaaaaaatgaagatgatcggcagcagttttgccgccctaatcccgaggcctaacatatttctcgtcccgaaacccgactcgaatttttttttttggaggcttcccaacccgaatccctctgcccacggcaaccctggtcggcagcgagtaagactaggttgggaattgataaatgaaatgaaactctgattaagtgatggcttaaattctgtttacagtacccaaattttttcatttcttttttttgtaatttgggatcaaagtgtttggaaaacaaattcgctgctgctgaaggaaattaagtaaacacacaaaagtggcgataaaataaatgataaaataaaatttaatcaaattatataacaaaattcgctgatttggtggtggaggcgctgctcaaaattttgtgttgtttttgttatgattatgggttttcttcgatgctttttctgaccgtgtgattcatttttcacctcacgaacattgaaaatgagcaaaaatatgggggaaattgggaaagaataactcgtgaaaacagtgaagaaaaataggccataggtgaggaaaaagtaaggaaatgcaattagtaataattaaaaacaaaaataaacaatttaaaaataatggaattaaactttgatcaaattttttataaacaaaatgaatgatcaggaagcaaaaaagaaagaaatattataatatttataattaattaaatatttcagaaaaaaacataattgatgtttttaatgattatttcttgtcatgaaaatacgttggaataaatgaaataaaattgttaataattaaaaaataaatgtaaaatatgtataagtttaaaaaatcaggaatttattatataaattattagcaaaataaaaattttaaaatttaaactgtagcacctaaaatggaattagaattcgcaattaaacaattgtaaattccagtcagattaaaatattataatttttgtttttactataaaattcaaaagttgggaggaggggaagtatctttgataaaaaacagtacgtactttttctttttctattcactttcatcatacatatttcccgaagcaacaaaaaca

SEQ ID NO: 16867 - DNA, 576 bp, Heterodera glycines
gcactgaccttcaccgagacgcatgcagtgcaagcatgcgtcgggagacaaatcgtcctatcggagcagaacttcggcattccaaaagaacaatttgacatcatcatgagcaaccacacaagagtgagacgcaacgtacaacccaagcaacttgcttcgcagctttcagctgctcaacttgccacaacaatggcactctcgcagctctacttgaaggaatttcagcgcaatgtgcacgtcagcaatccaacgcttcaggcacgaaaactcctaaagcgcgaaaatctgcaagctcgatgaatcagcgaaacaacaatcgaagtgtttccctgcgttccaatctccctctccaacatcagctaccgaacaacaaaggactgctacaagttcattccggtcacaatacatttgccaaacgcaacaagagacgcattcctcgacccggagatgcgcgctcaccatttcgctaccatcaccttcaagtgcaacaaaaccccaacttgtgggttcgaatcgactcaagaaatggaaacgtccaacgactgtcacaaacagtcatccatgagctctacgaaa

SEQ ID NO: 16868 - DNA, 3158 bp, Heterodera glycines
  misc_feature (4)..(4): n is a, c, g, or t
  misc_feature (1085)..(1085): n is a, c, g, or t
  misc_feature (1092)..(1092): n is a, c, g, or t
aatntaattagatatttttaagtgttaagtatgattaattagataagataattgttttgttaggttttttgtgaaattgattaggttttgttaaataattgttgatttttatgatggacactgtgtaaattgaaaatttaattttttaatttttttttgtataaactaattaactaatatgttccttctgttggtatttgcagtttccattggtctcgtcgaccttccaaccatttttccttggcttttttttcttcttgtctgtgttgtgcttgtcgatttaggaaccagaactaattaattatttttaaataattaaaatatatattcaaatatttgattcatttaaatattcatttccctaattacattgacttgatgcatctcaaggcccagttgcttggcccagtttcccatttgaactggatatggataacgtgtttcgctaaatctgcgctccaatctttccaattgatcagccgaaatgatttgtggttgtatcttaaaattatattttttagaatttgcattttattaaattataatttctaattatttttaaataaataatatttattgatattttaaactaataatttttaattttttgaattcgtattttattaaattaataattgcaactaattatcattatttttgctttggtaattggccaaacattgttctgctgtttggcttttgcttcaagttgcttttcctcactaccctgtacacgtcgaaaatggaaccatttctaaattaattttaagcaattaaattaaatttaaaaatttaactgtccctaattacattgatttgcttctccgttgggcccgtttccttggccatttcttttcgcataaaaatgtccgggtatcgtatcgtctcaaattcgcattccaatttgatcaattgttcaatcggaaatttttgtttttgtgcctaaaaattaaaattgatatatattaatatagtatatatttcaatgacatttttcatcactctttccatcaactttcggtgccattctttgcgttgttcttcaaaccattcctaatttaaaaaaattgtattaaaaattattnttcttanaattgaagacccatacatcgacttgcttatgcgttaggcccgtcttctcggcacatttttcaataacagcgaaactcgggaattttgtcttcgcaaattcgtcatccattttttccaattgatcggccgaaaagttttgtttcagtggctttagtaaattgaaaaacattttttagggagttattcaattaaatttttgaaaaattgaatcatttataccacagttttttgttcaatcgcctccgttttggtaacattttgtggtgattgctgtttttcgtgtcggacactgaattttatttttaatttttttttatagtaattttcgaaattttggtgagtcatcgttcattataatttttaattactaaggaattctttctctccattgattgtgccgccattcgaaccattccttaattagataattaattaattaatgattaggttttatttttttaaatttaattaattactgcaatttctcactttcacttgcgtttccgtaaggccaatttccttggctaaaatttcacgttcagaagcactaaaatatttgctcttctgaaatccgctttccaatttgtccaactgatcggccgaaaagttttgttgttgagccttgaaaataatatttttttttaaatcagaaattttattttgtatttaatttgatatccctaaaattaatttgtaaatggttttgtttacttcatcgccttccatcgcgtccatttgattaagacaatcggtggcagaaatggatggaatttaaaaaaggctctcggaaaatgcgtcagaaatacagaatttctaaaataacggttctgtagcattaagtattttattgtacatggtacaaaattgcaaaattacataaatttttatcggagagcggagagggcctatccggagaacggagttggggagcgcaaaatatcatttgaaaaaatttaggtccgctttgtgttctttttatagatttttgagagccggtgaatttttttattttctataaaaactaacattttttaacaaaattcagtgtaatttttagttaaaaacctgacaatgcttctttccaaaaaaataactttaaacccgaaaaaaaagttttctcaagtttttgggaagccaatccttaacagtgtaaaaattgctcgttcctcaaaggcgagtaaggttggggagcccggtatcggggggctcaagagcctaatttaaagtggagccgaaattcctaaggcaaaattgggcgtatttttgtggcacaaattctttctcttctccttctaatcctccactcattttcttccattattaaccccacaaaatgtgtgctgagtctcctcaattgggactttgctggaatgggtgttaatctcagcaaaaaatgtattggtttgacctaaaaaaagacattttctgaagggacgccattcaaacaaaaaatagatgccaaagaatttggaactggcaaatacaataacatatatatatatattatatatatgcatggacactgatgagagtaaattaatttgaaaattattttttgcgattttcgtttgttgttcaaaatgccaaaaaatttttgtttgttttcccgtctctccgtttttcgccattcattaaaacttgcgaatacatattctctggaaatttcattgatttgccagagggtgttcgtgaggaaattatatctaaaaaataaaaaaagttggactatattatttttgcgttcattttagccaaaaatgcacggggcccaaatgcctctgactcgattgaggtcaaaccaataattttgctgactaaccaacgcccattccaagcacaaacagagagagtgaggggtcagcagaacacattttataagggttaataatggacggaaaaatgagttggaagaggaggaggagagaaggaaattatgtcacgaattcggcagtaggctttaatttaaattggtaaaaaatccgaaaatatatattttttaatcgtctgggcttgtagaaactcaccaaatattcgatagtattttttcgataccatgagaaattgca

SEQ ID NO: 16869 - DNA, 1937 bp, Heterodera glycines
tgctaattgcagcaaatgatggtcgtgaaaagaattcaagctaattgcagtcaatctttgaactctttaataatcacttcattaaattcgctttacaaattatcaaacaagagcatttccattttgcacacatgcttacctaatcttgtccaattagtcaattgattgaaatttcgaaactccaaatttgcttccatttcacaaatttagtcgctaatattccccagcagacaaaaggtctgctgatcccccaatagtaaaagcagcaaatgactgatcagcagagcacacatcatccgtccaacgggatcaccgacgagagaagaaaaagcaccagccaccatcacacactgcggcgatttgatctttgattaggcaggcgacagacacggatcggtggtacaaatggaagttgtccccttcggcagctcccctccccctcaatttataagactagggatgggaatttaagtcacgaaacggggatgattgaggtgtttttttttgcctaaaagaatcttacaaatatggataattgtttcaattcctggggccttatgctcgtctcgcggtttagagctaaaccacggttaacggcgttaaccgtggttaaaaatccttaaccggtatgctcgtccttccctttttaaccgtggttaaggctaaaccacggttgagttaaccgtggtttactgcctccttaaccacggttaacgcaggttaaccgtggtttatttccaaccggtatgctcatctaaccgtggtttaatctttcttaaggaatcttaaccacaactcgagttgtggttaacgtaaatttatttaataatttaaatagtaaaataaataaataaattttttctatggtaattttacatgcagaaaaagaatctgacttttatttttgtctattatataaattattgacggattagtgttatttcatcaaaaaaatttgaacacgcccaaaccgctaaaatagctttttaaaaaaggtgacaaaattgctgctgtttgtagcatgttgcataacaacgtaattgtttgtaatgcactattaccaagaaatgttggctccattgcagttcacacggccataaaaaaataatttgacaattttaatgcagcaaactttttcttgaagcatccaaattaaacattcttggtatcattctatagccccaagagtcctctattaatttgcaaaattaaaaaaaaaattgctgtgtttaaaaaagttatggccaaaaatttttagaaaaccaattcttgatttaatagtttttcggggttttttaataaaatctatgctaatattgataatataaacaaaaaataattattataataatttaattatatttttttaatattaattatttttcaatttcaagataaattctcttaaccacggttgagttaaccatggtttacttaaccatggttaaagacgagcataccggttaaggtcggtcgttaaccacggttaacgaaaccgtggttaatgcgttaaccgtggtttactaaaccgcgagacgagcataaggcccctgcagttaatcaaattcattcccttctgtctattttcgatcttttgtcctttttttataaccctcattcacattttttcggcaattcctctccaatccacaacttttcactccccgagggtcggggaggagcccttgtcctttattttgtttcattaaatagaaaactaaaggacacttacatgttccaaaaaaaggcggagacctaaagtaagtaaataattgcttaaatttacggttttagtgtctcccccccctttttaaatttaattagcatttacccttcccactctctctgtttaaatcgttttgtcccctaattgaagtgtccaaattcaattttagaacgtacatttcaatctttccctgctgcaatcgcaatcgaat

SEQ ID NO: 16870 - DNA, 1235 bp, Heterodera glycines
gcaattagacggataaaatcttcttctaggttgaagatcagtgtcgatgttgaatcatctcaagcatttctggcgggattggtcgtgcaagtcacattataaaaaatcggatcgaagctgagaagtggaaaacacgccaacaaaaagctgtatggggccgtcagagtgaaacaaaagcaacagaacagaagagatccataatataaatatgaactcactcttgaaccgtcccataggtactctatacttaattatgtaagctctcagtcaggatggtcggacattctttgcaaagacggaaagttcgatgttattctataatatatacagaggatattgatagcgtacaaaataagtaacaaatcgagggaaacagtgaatttgcctcttaggagaaggtcgagccgtggcaatgaatgggaatgagagttagaatagccttggcctcgcgatcattatcctccccccccccccccaaccattcactcacattcattcccatctcgggtttcacacttcttcttcttcttcctcttcttaagttagctgtttctcatctcaattcgggcagtagtaggctaggctcggccggttggccaccacataacggcgcttggccaaaagagagaaaagaggcaaagggttaaccctccgggggggggggagggggagccggagggaggagttctcttccaccgccatcgaatgggaggggggaggaagacaggggaggaacactcgagaaggaggcaaaacggaggagaaggaggttatcgagcggaagaatagttgacgacgagtttaagttagttggaaatcaaatcagaaaaaagtcagaagccttagctcagttaatgcgcggccatttgtttttttttcatttgagaaacctcaaatttcgtcacttccgataaaaaaatttttttttttgcgctctcaaaactccgctgcacccgcagcaattatttcctcgccgcctgcgcggcggcgtccctggaggacggcggacgacttgagcagcacggcggcagcagcggcggcgtctcttcagcagtagagaggacggatggacgacgatgtctcccgcttcgcccagctcagagcctcagcccccacttttctgccggacgacgcactgccccccactccccccccccggggtccctcctcccccccccactccaaccatttgaaatttggcggcgtaaatgcgtctattgcccttgcctttatat

SEQ ID NO: 16871 - DNA, 1433 bp, Heterodera glycines
tccgtaggaataaaagccaaagcgtggctgcgtcccgtccaacaatttcctagtgcttagtgatggactagcgagtggtgtccgtaggaataaaagccaaggcgtggctgcgtcccgtccaacaatttcctagtgcttagtggtggactagcgagtggtgtccgtaggaataaaagccaaggcgtggctgcgtcccatccaacaatttcctagtgcttagtgatggactagcgagtggtgtccgtaggaataaaagccaaggcgtggctgcgtcccatccaacaatttcctaatgcttagtgatggactagcgagtggtgtccgtaggaataaaagccaaagcgtggctgcgtcccgtccaacaatttcctagtgcttagtgatggactagcgagtggtgtccgtaggaataaaagccaaggcgtggctgcgtcccgtccaacaatttcctagtgcttagtggtggactagcgagtggtgtccgtaggaataaaagccaaggcgtggctgcgtcccatccaacaatttcctagtgcttagtggtggactagcgagtggtgtccgtaggaataaaagccaaggcgtggctgcgtcccgtccaacaatttcctaatgcttagtgatggactagcgagtggtgtccgtaggaataaaagccaaggcgtggctgcgtcccatccacaatttcctagtgcttagtggtggactagcgagtggtgtccgtaggaataaaagccaaggcgtggctgcgtcccatccaacaatttcctaatgcttagtgatggactagcgagtgatgtccgtaggaataaaagccaaagcgtggctgcgtcccgtccaacaatttcctagtgcttagtggtggactagcgagtggtgtccgtaggaataaaagccaaggcgtggctgcgtcccatccaacaatttcctaatgcttagtgatggactagcgagtgatgtccgtaggaataaaagccaaggcgtggctgcgtcccatccaacaatttcctaatgcttagtgatggactagcgagtggtgtccgtaggaataaaggccaaagcgtggctgcgtcccatccaacaatttcctaatgcttagtgatggactagcgagtggtgtccgtaggaataaaagccaaagcgtggctgcgtcccgtccaacaatttcctaatgcttagtgatggactagcgagtgatgtccgtaggaataaaagccaaagcgtggctgcgtcccgtccaacaatttcctaatgcttagtgatggactagcgagtgatgtccgtaggaataaaagccaaagcgtggctgcgtcccgtccaacaatttcctagtgcttagtgatggactagcgagtggtgtccgtaggaataaaagccaaggcgtggctgcgtcccgtcaacaatttcctagtgcttagtgatggactagcgag

SEQ ID NO: 16872 - DNA, 2087 bp, Heterodera glycines
  misc_feature (1963)..(1963): n is a, c, g, or t
tgaaaagcattcgcatggcattcgcccgaaattgttagccagcaaataatatttgtacaaaaaatgacagtcaggcccaaattcgaagagaatggcacacaggaaatgaaattcgcaatgccaattggattcggatgcaaattccacaaaaagcgctgccaaagaaaatcgtcggattcgaagatatttcaataatgtgaagcgaatcattttttgttgttttctgtttgtaaaacgattccgtcccatttattttcacagtttagctatgaatttggggttaaaaatactctgatcatgaatcgaggctcttattatgcatgaaccttcattttgtctatgtcatcaagtgtcataaaaaaaataaatcatagccaagcggaatcgaaccccagacccccgtgcaagtggatggtgatcctgtccgtgttcttcactgcgcacaactttgccatgatgttgtacgggaccaaggagaagccgttgtggccctacacgctgttcatgaagaagagtgacggagcataaagaagctctctcgacgacacatattgtttttgtgtgtattaggtgtaaacaaaaattcatgttttatggacggaaaatgttagtttggatgtttatgttccatggataaagaaagctgcgctactgtttgttgaattaaagcgctttgaatttttttcaattaggtatagactttctaaaattttaaatcttaaattaataaaaaaaaatttcaaatcgaatttacttcaatcatttcaagcaatcaataatttgggctacatgagtaatcatgggtaatagtgctgatggtagccccccttcaaaaaaaaaattttattttttttaaattgtaaatttggtgtttcaactttttgttcgaaatctggtccggggttcggaaaaaatgtaaatcacgggggttccccccttgactaaattgcattgagcaacaataggttcttgagtgaattcatgaatatttttattcttaaaaaatgcctgcctaagtaataatattttctgttttagtttttccactaatgcgctaggaaaaatataattatttttttcacttaattagccttgcatttgtgcttaaacattcatatatttttggctttcccatggggtattctacatcacatttttcattgtagtatttcttgtgactgagcagggaatcactataaatgcattatgattgactctttactataaagctaaataaagaaaagtttatttttagaactcgtacaagttgtcatctgaaaatcgattttaattatttcatttatcgcataaaggtcgctatataattgactaaattgcattgagcaacaataggttcttgagtgaattcatgaatatttttattcttaaaaaatgcctgcctaagtaataatattttctgttttagtttttccactaatgcgctaggaaaaatataattaattttttcacttaattagccttgcatttgtgcttaaacattcatatatttttggctttcccatggggtattctacatcacatttttcattgtagtatttcttgtgactgagcagggaatcactataaatgcattatgattgactctttactataaagctaaataaagaaaagtttatttttagaactcgtacaagttgtcatctgaaaatcgattttaattatttcatttatcgcataaaggtcgctatataattgactaaattgcattgagcaacaataggttcttgagtgaattcatgaatatttttattcttaaaaaatgcctgccctttgtgaggaggaactgtactcgttgctgatgcaacatgacaaaacggcgcaccagcaaatggcggacgacggcgcatcattgccatggcaaacccatcattatcatcatcattattattcgccatcgtcgctgtcgaagaaagcggtgccaaactttgcaaatttgcacttncaaacattccttgaactgatcgccacactttatgagcgtgaaacggaccaaattgttcgatgctcgcgtgaaattacggacccaaatttgcgtaatttttggcatttttcaattatatacattt

SEQ ID NO: 16873 - DNA, 1717 bp, Heterodera glycines
  misc_feature (67)..(67): n is a, c, g, or t
  misc_feature (84)..(85): n is a, c, g, or t
  misc_feature (159)..(160): n is a, c, g, or t
ttttcaaaattatattcattttttttctgcttttttcagggaaggattgtacgactttgtgttccgnaatcgggcatctcgcannccttcgcttaaaaatgcctatctgtcaatgctcacttcgctgtgccaaagtgccgaatcggcagacgctttctnntaattttttcaaataatttttgatttgattttttgttaataaattgtttttcatttatttccttttgtgcgcatttatgtcagtgatttgaatcattttcaatatttttgatcatttttctttaaaattttctcattattttttttcaacgagaaggcaaagcaaaagctacacaaaatgtgctccaaaccgacgaatgttttcctcttcaaacgccttgtcagccccgtccaaatttgctgccgttcaataaaaggcggcggtttggtccatccggtgaccggcaaaaatccgccaacgcttgaggaattcgacccgtaaagacacaattttaattgctatgattgaaagcgatttgttttttcagtttgaaccccggcgagtggcagttgggggtgagttttctcacttaacaattttcgagtgggggaatacaaaaagcacacgtattttacaaaaacaaagcctagcctaaagcttaggccgaagcctctgggccaaacctaagaaatttttacgagttgtcttttaatgagttgccatggcatcattttgcaaaaaaaaaaaaatttttccaccatttcaaaactattctaaacgacaaagccataattagtgaggaataattcatgtttcttgatgtttgagcccttaaaagtctttaacagtgttgtatactgtactgtgtcattaccacaaattttttctaccgtgtttttattttatcattttttctttctacaggcctatggtaaaattttgcctcgtctcccggagggcacgcgttgtggcggtttggtgatgggcaaatacggcctgtacaatccgaaggtgcgcgcgctgcaggaggaatgctatgtgagactgagaccaattttggcattttttgccatttcaattatttaaacacgatggatccaatcaataatccgatcaaatccattcatttggcagccaaaaatgatggccggcgtgccgacggagcgcgtcaaccgaaaccaggagatcaccttccaaatgtgcaagtggatggtgatcctgtccgtgttcttcactgcgcacaactttgccatgatgttgtacgggaccaaggagaagccgttgtggccctacacgctgttcatgaagaagagtgacggagcataaagaagctctctcgacgacacatattgtttttgtgtgtattaggtgtaaacaaaattttcatgttttatggacggaaaatgttagtttggatgtttatgttccatggataaagaaagctgggctaactgtttgttgaattaaagcgctttgaatttttttcaattaggtatagactttctaaaatttcaaatcttaaattaataaaaaaaaatttcaaatcgaatttacttcaatcatttcaagcaatcaataatttgggctacatgattaatcatgggtaatagtgctgatggtagccccccttcaaaaaaaaaattttattttttttaaattgtaaatttggtgtttcaactttttgttcgaaatctggtccggggttcggaaaaaatgtaaatcacgggggttcccccc

SEQ ID NO: 16874 - DNA, 3626 bp, Heterodera glycines
  misc_feature (3549)..(3549): n is a, c, g, or t
  misc_feature (3552)..(3552): n is a, c, g, or t
  misc_feature (3573)..(3573): n is a, c, g, or t
  misc_feature (3581)..(3581): n is a, c, g, or t
  misc_feature (3610)..(3610): n is a, c, g, or t
cttttaaaaaaactataattaattaatagggctgggaatttaagtcactaagaatcttcaataagtcgactaaaaaagtcataaaaaatagccaaaaagtcacaaaaaaataatttaaattcagcctattaaaagatttagaaatttctatttccaaaaatttccggcagttttggggccggaattctgtggtttccgaaaatttttaaggcttcggaattagggttagacgggtccgagtattgggcaaaaatcgggttcgggtattgcccggtccagaaaagccgagtcggacccaagtttagatattttaaaattaattttttatattttaaagaaatcgctttttaggtttcaaacaaatttttttcacttttcataaggaattttaaaaaaatttcactaaataaaaaaacaagtaggtaaaaaatgaaaataagttcgaaaaaattccgaaattctgaatttttttaaatatttaataaaaatttcattaaaaaaccctcaaaaatagcgaaatatgtacaaaaaaatttttgtgaaatgaacgcgcctttcctcttttcgtcaaatttagcatgttttttggtgttttttcttaaatgattcccttaaaatttaacaataaaacttatatggatgaatagaggatatttttttcgataagaaatatttttattaaattttttagtgctaaatttaaaaagtttattaaaattttgtgcgcttgattttcaaacttagggtcacaaaacaccctaggcctacacttgatttttccttcagaaaacatcaagtccttgattttacgccttacggacatttgcggacggacatttgcggacaatttcgtgaaaaataaaaaaaatatcgtaacaaaatttaaaaaattttctgaaaatatggaatggagactgcaaaaataaataaaactttgtttttgggttttaaggcttaatatttaatttcactggtcaaaaagtgcaatgctggtcttttaagtgattaaagtagagttggtcccaagatcggggaagtgtgaatgtcgcctgttgcactcaaattcgggtgagagtgctgtttttatctttagaaaaaacccaaatatttatgaaaatttattttccaacgagggtttttccaccgacattttttaaatttctctagccatacagacaaatcttgtagggtatttgctacctgccccctgaattttcgtttccttatttgttcgggttggagaagaacccaagataattcttgctctactgttcataagcaggaaagcatttcagggccccaaaaatttttagaaaaggaaatcggaaatctaatgcccaaaaatgtcgggaaaacaggattaaatccttgccctttgttgttcggtcggctggggcttcaacaaagcctgggtttgtccaagaaaaacttgtccaggccgcgctcattctgctgttggatcgatcgagcttcgcgttgttacagcacataaccatttaatcgattcaacgcaacataccgtaattaaaatgataagggtgaattatttggaatcattaggtgcgtgatcgcaaggaacaaatcaagcagagagccgcaaatcatgcagatgctcccagaaatattaattttttaaaatgacgctcgttgggccttgagcaagccattggaaataaaaaatttatttttgtgtattaattgatgtattgaaaaagttaaatattatgatgaagagaataaaatatcttattcttaaattgataaaatctaatagtaatatttattcaaaattacataaaataaatttaaatgaaatgtagggcaaagccgcaaatgtcgggccgcaaatgtccgattttggcttgggccgcaaaattcagcaaaaaattgggccgcaagtgtccgaaaatggcccttaagaaatgggccgcaaatgtccgaaccgcaaatgtccgggccgcaaatgtccgatttggctggggccgcaaatgtccgagccgcaaatgtccgggccgcaaatgtccgggacgcaaaagtggggtaacccttcaaaaaatcaaaaagattggaattgaaggaaaaatttataattttttaactaactttttaaaaaatcggagttttaaggttaaaatcggcgatgaattgtcagaaagtttcaaaatattttcgggagtgccccagggaagtgtcttagggccattactctttttaatttttataaatgatctgccgtcttttatttcaaataaagcatcatcagttggcatataaatgtatgctgacgatgttaaattatattatgcccatgaaaacgatgaccattcaaatcagttggataaagcgattgaggctttggaaaaatggtcaaaaataaatgggttagaaatttcaactgaaaaatgttttgttctttatttagggaaaaataacaagaaaaaagaatattttattaactcaaaaaagatttcagaatcggaaagtgtacgtgacttgggaattataattgactcgaaacttaatttttcagaacatattagcaaaattatacgaaacgcatatcttagaattttccaaattttgagagtgttgaaaagcagggaaataaaaactctaacagcagcctataaaacttttgtacgacctcaattagaatacgctaccgaagtttggaacccaaatttaaaaaaagacattgacaaaattgaacgggttcaaaaattttcacaagaaaagcacttagaaaatgtggttttgtgtacaaaaaatatggggaaagactaaaaatcactgatttacacaaattagaagaaagaagaaaaatcaatgatttaacaacagcttttaaaataatcaaagggttcaccagcctcgacgctgggaaaagtttctttttctcagaaaggtccaggaggcctttacttttacgggtaaagcgccacacggccaaaactcaaaataattttttcaatagaatagtaaaaaactggaataatcttccactggtagcggtgcaaattaataaggcaaaggaattcagggatttactaaaagcaatgagttctgagtaggattttccatgttgccatatttacactatatttttatcacctgtgaatttttaacatttgattgatttatttttattcattttttattacggtattcactttgtattttttatttgaccaactttatttgttgttttctttttggcaccatataagagcactcacgtgcctttggtttgctcgataaattaaattaaattaaaaaaaacaattttcaagaattttggggtttttgtcaattgccaacaatttttttggcatgtgaattttttaaaaactatttttcaactatttttggcttgtcaataaaaattttgttatacacaccgagtcaaaaaacgagacatgtgtcaataaagagagagtgcagagaaactttttttctctaacttttctctccttttggcatactatctaatattttcattattaggaaaaacaacatttacttcgctatgtttagcttcttttctatatngtnagatcagaggtcgcatcgaanattttccngaataagtaaatcagtagtaaaaaataanggtttttagggtcaaa

SEQ ID NO: 16875 - DNA, 1369 bp, Heterodera glycines
  misc_feature (1339)..(1339): n is a, c, g, or t
gattcactggtcggaattcaaatagtaaaggattttttcatcaactgtaaactttccaagcgattccaaaagtttctgatgagtttttaacacttgtagcaattcttttttgaccaaaaagttccaaataaaagccaattctgaatttttgatttcctcgacccattcttccttagaaacactaaatggcaatttcggaatttcgggtgttaaaacggcagaaatgtgtgcgcaattttcgtttcccttttcttccaaattaaggggttttgagttaacggctcgtgaaagtgcgtcagcaacgtgattttcttttccaggcttgtaaattacttctaattggaatggagcacctaattccatgatccatctgtccacttttgaatttccgaccgaatttttgcttttgaacatttggggaagggccttatggtcggtaaatacgattgttggaagccatgcaataaaatgcttaaatttttgtacggcaaattttatgcctaaacattctaaaactgttggtccgtaatttgactcggtttgtttacagcgtcttgatgcgtaacaaattggtctcattttcccagattgatcccgttgacaaagcactgcacctagcccatctttgacgcatccgaaaaaatatgaaatttaaattttggatcgttctgtgccaaattaaagtccggatatttcagtacaacttcatcaacaattaaagattttaaagattcaaaactcttttttgcttcgtccgaccaaattaacaccgtagcatcttgttttttcaacatttttgttaatggtgccgcaatttttgcaaaattcatgatacattttcggtgccaattgaccattcccaaaaatctttgtaattctttgattgtttttggcatcggaaattctttgatgggtttgtatttttccgggtcttttgcgagtccttctcgtgtaagaatatgtcctaaatatggggtttggtctaaagcaaaaccacatttttctgccttgactttcattccgttttcattcagttttccgaaaacctttctgagatggaccatatgatcttcaaatgtttcagaggcaattaaaatgtcatccagataaacgaaaacaaattcgttaatatattcgaacaaaattttgttcatgagtctttgaaatgtggctggggcgttacttagaccaaaaggaaggactaaaaattcatacagaccaccaggtactgtaaacgccgttttttcgatgtcttcttccttaactcgaacctgccaataccccggcattaatccaaaatagtaaaatagtgtttgtttcccaaatacatcaaaatttnggtccatgtcggtattgggtacgaatcttt

SEQ ID NO: 16876 - DNA, 2052 bp, Heterodera glycines
  misc_feature (989)..(989): n is a, c, g, or t
ctccgctagaacaattggcatctaacgaactgttgatgagcggcaaattcggcgacccgactccgctggtagcccaattcgctgagccggtgccatgtgtggcgaacaacacttatttggtgacggcacgattcatggtgaagtgcaaacaatggatgtaaagaatggcacatattcattggcacaaattcagacggaggagggcgtttcaaccttccagggaaaggaggggcaagcggtggtggcggtggaattgccatttgaccaaacagtgcgattcaaagtacggcaaaaggctggaattcgttcaaggtgttccaatttgcgctttctttcagttccaagcgtggcgcaacggcctttggaacgacgacggcggccgatcggaaggacaaattccggcacttcattttctaatccaatggcccgaagaacagaacgaagcgagcgaaaacagcaaaaattaatgggttttgttttttgaattcgaattttgttaacgaaatatttttaaacatcgaattatttatttggcattaaattatttatgttatgaattttatttaactcacttttctataaaccaattgatgaagttgttgtgttcgttaattatttgaattaacgccaaaagatgctcgtttatcgatcatccttttgacccttcgtgttgtccatttaaaccccccttttcccccattccgtgcattctccctcattcattaattgtttccatttaattgtgacccgctccctcccttcgctatttattatatttatttgtgtggaataaatcaatattattccattgactgttgaacggacacaacagttattggcgcagtcagcgaaaaaaaagacgagcgaaacaaaagtggagaggaaagaagcaacaaatcagcaattggaattgctaattccgagttggaatagcaattgccaaatcgtcagagaataaagctaattcccagttggaatagctgcgcacncaggtggtggcaattctcatttactggtgttaatccgagttggataacagccagaggtcaatcgccgaatttgggaaaaatttcgacattcaattgttaatccgagacggataacaattgcgaatcactgttaattcgagtcgaataacagtgaccatccatcatcaatttcattgttaatccgattcggataacaattggcaatcacagttaatcccagttggataactgttgaccatcatctttaatttgatcctagttgtacaaattaataaagcgcaacaatggcagcagttgtaaaggctggcaaaggaccaggtccttacacatcggaaacgtcatggacaatttgggaagaaagattcgaattcttcatcaaacttcgaggcatcaccgattttgagaccaaaaaattgctcttcttttcggagattgggccaatctacgaagagcttcgccaaatggcgttgccagacgacgtacgtgacatgccaattgtggagatcaaagcgctgatggaggaacgatttggcgagacgaagacgattgcggcaaaaaggtttgagctgttttcagccaaacaatcatcaggactgtccattcgtgattactcaatccaacttcggacttaatttccaaagctgaatggcataaggattcggtcgacatgtgtctgagcgctcttttcatcaacggccttaaaaaagattcaattcgggccgagttgataaagatgggagtgaacgaaatgaagttcaaagatgccgttgaaacggcagtgcttctcgagcagtccgaattggacgcagagcaaatcggtgggcataagaaagccgaagtggctaaagtcttcgctccaaagggaggaagaaagagcagcgcaccgacgcaacagcaacaaatgcaatgccaccgatgtgggaggaatggccatcgcaacaatgagtgcccgaacaaggactcaaaatgccgaaagtgtggaaatgttggacactgggctgtgatgtgcaagacaaagcagggctccaattggccaaggaggcaagggaagccagtaaaccag

SEQ ID NO: 16877 - DNA, 1373 bp, Heterodera glycines
attaattgtatacggtgggaaaatgtcggaacggcaacccctttctttcttttctattttttttggactttgctgtcaacaaatgattgcttttctcaattttcgcacacttttaggccaaacaattggcaatgtttttgtgttagctgtgtccccccccccccactcaccttgaagcagaacggcccttccccccgtcgctgtccattggagcagtgcgacaactacgagcagaactttgtgaagtggtgacagatggcgaagtgccgttgatgctgctgccatgccttttggttttggcgttgactttaacattccgtccctccgtctccctcccttcttttgcttcttcggtccgtcgctttcgtttgtcggacccattttgttcttccttttctacagccctttttatctgttcaaagcttcttcaatctgatttcattgtgcgcaaagaagcggcagttggcgaaaagtgttcacggaaaagcgaccgatttggagggattaagcggcgaaaaaagccaaaaggggaggaatttgaatggaacgcgcagactctgcgacggcttctgcaaattgggagggaaagtttttgagggcattggcaaacggaaaagcgtaaagagagggagggataaacgcactattttaaaatttaggggatgaaaatggcaaatgttgagggggggggggggggttaatcggagtggtgagaggcattccgttatgtatggatgtatgacagccggagctcaatattttaatataagcctaaaaaaagattattattaaaatgcaatgcaaatttaaaaaattaaataaaaactcaaataaaacctttgaaaaggacatattctaattaaaaggcatttagaaaaaaaccatcaaactctttacaaaatgttcggtccgagggatttgtttaagtccaattaaatatttatttattggagaaggaaaagaaagtcacaataatttgggggaacaaaatataaatgcaaaaatgaatgaagggaagacactctgagaggggaaagggagcatatttatgggcgaggaaacaacatgaaataaggggaatcgattggattggcattatgtcacggacattcaaatcatcggcggcaatgccccgaacacctccccccttaagcgcggttccgaggttacggtgagaagcgctgcggcggacggcgatttcgctgagggtaccgtcgttgctgtccatggtcaatttgacctccaaaattttcctgttcgccatgcgggtactccaatggcatttccactgggatttccctctgatcctcaacagcaatcgggcttgggatgtcgaaggtttcgaccatcaccgagagctgatcatcggagtc

SEQ ID NO: 16878 - DNA, 1523 bp, Heterodera glycines
ggagggcacctcgtttcccccccgccgtttcccccccgccgattcccccccgccgtttcccccccgccgtttcccccccgcatcgtttcccccccgaatcgtttcccccccgccgtttcccccccgaatcgtttcccccccccgagaaaatttttaaaaaaaaatttctaagttagcaattttttttttaaaattttctcgggggggaaacgtagggggggacccaattgtcgtatggaaaatggagttaagggggaggggggaagacagaataatcacgcaaagggcgagagggcacggcgaaggaaaatgccatccgaacggggccaaagggaaggagtgccaccgttgaagagtcacaaattgaagggcaatgattgaattggcattctgtgaactccactttcaggctaagaaagagttagttttaatgcaatttatgcaaatatacaaaaataatagaggagaaaaacgagtgcaaaaagaggaggaaaagaagagattgaattgagtgatatgcaaaagcgaagacattgaaaatggtgatcaaaataagaaaattaacaaagaaacaaaaataaaacaggcaattatttgttggagagagaaaccgaatctgatgataggaaaggtgcaaaaataaatgtaaaaatgcaaaatattattataattagtgaatgaatgacatcggaagagagctgaacgactagaaaaacgaatggcaatttgtggtgagaaaagaaaggatgaaatggcaaacgaatggaacaatcactccaatttgggaaggatgagtgatttaagagatgccaatgattagtaatgagttcaaaatcagatgttaaagcattggttaagcattccccgcctccaaaaaggcacatttttcttcgttctcgcccatcaaatgcccgagtcgacagaagcagccctgttgagaaaggcccgggtgacggagcccggccgttcgttctcctgcagcatcgggtcgtggttgaccccatagattttgatggcttttcggcccatccgttgaagcaactcttgcgaaacgcgatgagcctgaaaagggcgtgccattgagcctccaaacgaatgcatttgattggttacagtgcgaagcgaagtgtgccattctttgagcgaaatttcgtcctgaaaatgttttttttggaaagagtgccgccaatttgcgtcctcgggggcacctgattggtaaggatcactttgctctccttcagcccctccttcagtttcaccacaattgccgtctcgcccttcacctgttgcaactccgaggaaacctcctcaatttggtccataaataacagctgaaagggcaaatgtaaagcaaaagcactgctccgttccttccctccacacgaacctccggttttccgctcaatgactcggggtacagctccaaccgactcggatacagcttgccatacttggtctgccacgcggaagtgaacggaccgcccaactttttaatgtaaccgtggatgatcacgcggattgat

SEQ ID NO: 16879 - DNA, 1278 bp, Heterodera glycines
aaaataagttaaaacgaaaagagaaaaggcaaagggacggacgaaatggccgaccttttcgggcgaagtgagaaaactgaacagggaaattgggggagtgtgccaatatttggcaatgttttcacctcagccggattgaattggagctggacacaatcttaaaatgtgaagaaatggcatcgctcacagcaaaaaaacaaacaaaccgccggaatcatcgcgacactttcgccacacaattgcaagtcggacccactgcttcggttgtccgtgcccaaatgaactcggaggacggcactgagagcgaattgaaatgccatgaaaagagatggaagggtggcaaagagaggtcacctcatgcagtcgacctgagcaggagggaaggggcttctcctcccatcccttttttactttttcttctgtcatttgtccctccacgttgaacatgttcgccttcagcagcacttggtgcccttctcgaactcgaatctccaaatcgcacgtcaaattctttgtgtatttgacgggaaagccgggcgatgctttaaattgttcgaattctttcaaaattcattcattctttgccaattccgaccaaaatgccccgtcgtccgctgttcgttcgcttcgattgtcgtcgccgatggttttccctctttacagtctttggtgtcagacacttctgaactttagtaattaatcaccccgctgattggcaaatagaaaattgccaatttcactttttgtggccgccgggcgaatttcgtaccgcgcgtcaaagccattggcagtgccgaaattgtcggaatggaaaacgacgcgcatttcgtgggagccatgggcggacactgtgggcccggggaagacgtgccaacaatgtttggctgagaaaaagaagagaaagcggcaaatgcaattggaaaggaatgaaattgactttctttgtttaccctgcaatttcaaagtctctccgccgttcgcatcgcgaaaaacatcgaatatttccaaccaatcgttgcactcgtccatggaattctcctcgaaaagcgcaaattgcttaattgaagggaaaggcggcggtaattggggacgaatttggctaaactttgaaaaagagaagaatttgggcattggatgggccaacgatgtgataagtgcactcggcatcaagcggatactgaaacggaagagcagacggaatgggaggcaaaacggatgacgaacgttggaaggatagcggggactgttgaaagagccgaccgagtcgcggaagcgaaa

SEQ ID NO: 16880 - DNA, 1735 bp, Heterodera glycines
  misc_feature (123)..(123): n is a, c, g, or t
aaatgccaaagggagagacgggaaaagccactgatcaacctgatctgcacatttggtgccacagtctacaaagaaataagtcttacttattacacaatttggactaatcattaactaattacnccgcaatatcgcgcggccaaattcgaagacagcaaatcctccgtgggcgaatccaattccgaataaatgtcaacatattcggactcacaactgaacataaatgagcacaaaagaaaagcaattaatggcattcaaaggaatgggtactgtcggggtacggtacttactgattggtggtgccctcgagttggaactgctcaatttgcagcttcactcgttcccgcggttgggcgacaaacgtgtatatacactgaaaaagaacagttacgcaaaataacacaaaatttattgggaataaaaattaaaaacccctgcaaatgtgctaattgttttacaaatttgggatgattattaattaatgccctgggacaatcattttcagtcctagcagcgctctgttggcgttgtcgtccgctggcgctcacttggatgttttcgggcagtgattggtaccgcacaattccgttcgcctcgtcccttttgcccgcttcttccgcttcctctgccgctgctgtggcagtgacaaagggttgccacgagctgctcggcactctttcgtagttgccatttggggcttcatcattttcggcattttcgtcgtcagatgaagcgaaaagggcggaagagtcggcatttgcctcccggggaaacactggcagagagaagtgaccactgcggggcgaatcgaacacgtgatcgcaatcggtaaaagctgcaattggcatttggacggagaaaagatatggtgcatgagagagagagagagagagaaagagagagagagaaaagagagagagacgagagagagaaaaagagagagagagaaagagagagagagagagagacgagagagagaaaaagagagagatgagagagagaaagagagagagacgagagagagagagaaaagagagagagagagacgagagaaagagagagacgagagaaagagagagagagacgagagaaagagagagaggagaagaattagagaaacgagggcagggggggggaggacacaaagtggagaaagtgtttgaataattagcacatttgcagtttcgttttttgaaaatgattgccggcgcgggaaagggaattactcttcatattgaagaacgccgcgaagccaaaagatgagaatgaccagcagaatgccggcgacgatcagagtgaacagcaaagcgaatctgaaccattggcgcttttccgccctctgtcccgaggcgttcgcccacattatttcgcagtccaacgaccggcagaaggcgcagtcctcgtcccccgcggctgcctccccgcccctccccggcaccgccgttgtgttcgtccgcgtcagcttcccccgctcgctgtcctgttgctgttcgcactggttcatgccaacaattgcgttcgcttcgctctcaaataatgccaatgccttcgtccactctttgagtgtgccgtgccattcattctttactcacttccatttctgcttttccctccattattttgtgctgttgtgccattccgccgtttgcgctgtccaccgaatgttcagtcagcggtgagaggaatttgctggcggaagagggcgattggtaatcaatcaaggcgcgtcttttga

SEQ ID NO: 16881 - DNA, 2258 bp, Heterodera glycines
gattaaagggaccatcttcgaaaagtctttggcagcgcgcaccgccatatcctagcagatttttattttaaacatttttaatcatatattattagttaatggttttaattattttttaacaacaacaaatagatataactgatagctttagatgggggcgaaattctctgatattttttaaaaaccctttgacaacagagcaattttcccgaaatgaaaatatttattataattttcatgatataaattgggaaaaatacttattaataaaattaaacgagaataaaattgcccttcatttcccgcaaaaaatttattttttcgattcttaattacatatgcattaaaaaatatttttcatttattcatattataatttttcggtattgggtgtgaggtttattgattaatggaaggagtcccaaaatacaagccttttaattgtgaattcatcagatgtatgaattcgaatataggatagatttgaaaagaatttatttattaatttaatcgtgcattttcatagtcctttatttcccgcactaataaattttcgaagatcaaaagagaaccgaggggtttattccgatcgtttttcttaagttttttcaattcataattctatgtgttttaaaaattgttgcaattcacaaatcgataatttccgttgatatcgattaattgggggggggcataaaaaaatcggctgaacactcgcgcagtggtgctaagcgtacccgagaataccattaggctgaggtttttagtgaccgaggtctctttacaatttaatcgtttttcgagatttatgaattactctttttctctaattctcttctctctcgtatggtgaatgcgcatctctctgcacagggggggggccaagatttttaccctaatactacttacatgtttttttcctggattcttcatagcctaattagtaagaaaaacactttcttttttgtgtttgcgaacaaaagttgggacttttatttacatatttttacatatttcgggatttttctacatattacatatgtacatatttttatacatattttggacttgttcgtacatatttcgcaatttttcgtacatattttcatttttaaacatattttgaggatttttgagaatttatagaaattttttgtgaataattttttttaaatgtatccctaaaaaatcgaataaaagatatatcaaaaattaattttttaaatactaaaatgtgattctaagcttattttggtcatttttatggcattttgtgcctattttactttttacgaagaatttttttccaaaaaataaccattaaattttttttttacatattttcgtacatatttgaggatttttgtacatatttcatacagattttaacattttttatacatattttatttacataattcgcaaatattcttacataaaattagcagccctaaaaataagttatatttccaaagacgtcctggaaattgggccctctcacttgaaaatttgaaagtatccttgaattcaacatgtccttgaaaatgagcactccaagaaataatacagaaattttaatttttgaccttttataccaaatttttattaacttattgcattactggtgcaacatttggtactaaattgcacaaaaattcccaaattttttccaggcgcgcctatcggcaccaccgggatctctctttctattttttaaaatttaattcaaaaagacacccagaaatcgttaaaaaataataaattttagaaaaacaattaacaatttctcccccccccattcccaaaaagtctcggaaaaagcgcccgcaagaagtgttgtgaaaagtaaaaatgttcaacttttgaaaatcaaaatgttaaacttcctgttgattcacgattttttaatatttttattactagcttagtgccggaacgatcctggcgcaccctttccttttttcgtcagtaacgattcttctgatcgggactcccgcggggtttttacatgattcccggtccaaatatccatatttagtactattatgtcgttttttttgtttttaatattaaagtgttacaacaaaattcaaaaacaaaatttataaaagaaaagttcaaaatgcgttttgatcggacccaattatcatttatttcatgcttcagagagtggtcagatcgaatttgaaattgggcccaaagttggccacaatttcgtcacccagagtgacacaacgtgacgaatgggaacagtgaag

SEQ ID NO: 16882 - DNA, 1481 bp, Heterodera glycines
  misc_feature (1236)..(1236): n is a, c, g, or t
  misc_feature (1288)..(1288): n is a, c, g, or t
  misc_feature (1314)..(1314): n is a, c, g, or t
  misc_feature (1390)..(1391): n is a, c, g, or t
gtcggttccggtttccccatttatcccctttccctatttatacccctttccctccctcatttatccatccccccgccccaatccctcgcccaattcctccgcctcattcattcgttcgtttgtccatttgaattgggttaattttcccttcgctttgcgcttctccccctctttttccctcaccaataaaatccgtcgtcccttctcaacaaatcgctcaaatacatcataatattcttttgaagatcgtctcaaattgttttccgtgcgcaattttctcatttattataaattattgcaatttaatttattttaaatttaaaattatttgttgaggtgagattggtcaatttccattcttattttcatttgatatgtaacgtcccccgccccgtgggtattttaaattattatatgcctattatggcattagtcaattatgggcaattagcgtcttcacagggcaggaacatttaaataaaataatgtgaaaatgaatttaaattgaaaaaattaaataataatttatttattttaagaatatttaaaagaacatttctatagaaaaattatttaattgaattactaataacgagaaatgttacaaaacctcctccaatttttattttattaaaccgaacaagcgcaatcgcaaaattttttgatcattgcttgtaaaaagaaaaaatgctgacgaattgccactgacggattgtccttgatgtccactgacggattgtccagtccattactgacggattgtccttgatgccactgacggattgtccagtccattactgacggattgtccttgattgtccactgatggattgtccgcaccccgctcgtgcccctccattttctaacaaatttgccccgccgttacagtcgcttgcgtcggcattttttttttgcgtgcctcccgcaaaatttaatttgttcctaattgggccaaatgttccattaattatttgtgttttttcatgtttttcaaccgtttattcattctgtccaaacatgcgttctccgcccctccgtttgctgttctgtcacggattgggcgctgccaaaacggacgcccaattaatgggccaatgggcgcggcaaaggcaaatcgaattccaaatgttggatcatcattaacactaattagcaattttaattatatattattcttttagaatccaatacaaaaattacggcaacccgaacagtgtttgggcggtgaatcattgnggtaaaacaaaattatttaatcatttttatttaatttaatatttaatcattnttatttaatttaatatttaatcattnttatttaatttaacttaatttcatcacttttatgggtcgtattgtattttatcagcaattttatttattttttggnntgtaaattatttttcgtttttgctaattaatacaggtctgataaagccctttttgatcattcctttctttgatcttggggctgatcattt

SEQ ID NO: 16883 - DNA, 1011 bp, Heterodera glycines
taatttgtttgactttgacaaaagttatgggcagtttttggttgaaatttccatttgatggtttttatataacgacagcaccaatcagattggccacctttttcagtgcgcgacattggcgtcgaattggcacgcgaccaaaacgcggcgggggcagcgaatgcatcgcgcggcaccgtcgccgcctgcgcttcggctggcgcccaggcgctgcttcgcgcactttggcattcgccactattggcacagcatttggccggtgattttggcactaataatagctttaaaaaaccgaattttccaataattctcgaggcctgctgctgttgtcgcccggcgtttgcatgaaagtgccaaattacgtacagcgcgttttgcctgaccaatgggacgcgttgaggtgggcaaaacgaacggccaaaagtcaaaactaaattgtatttttgaatgaattcaattaaatttgtacctgttttaaaatggggtaagtgccatttgcgagcataatacgtcgaggtggtcgagagtcgatctcgacccggtaaaagtttcggcattttcatggtctcgaggctcggagtcaagtgattccgtttttgagcatcgttaatgggaccattttggcagaccagagcagttaggggttgttcaatcacaaataattggcaaaaattatgccacaatcgctgatcatttctgtccatgttgtcggctgatcagtactgaaccgtctcccctccctcctaagggccggccttcccgtggaccatccgagcgccgaccgaacagtccaacttcggataaacatggacagtctgaaggactacgaaagggtgcgccggggattggcatagatttttcgacccgccaaaatttggagattttccgcttttcttgagtgtgccggtcgcaaaagtcgcgactcgaaataaatctcgagtttttgggctcctctgtctcgtaccgggcctcaaagtcatgtgccaagagctcgagcttggactcagctct

SEQ ID NO: 16884 - DNA, 3005 bp, Heterodera glycines
  misc_feature (7)..(7): n is a, c, g, or t
  misc_feature (2951)..(2951): n is a, c, g, or t
  misc_feature (2972)..(2972): n is a, c, g, or t
gcccgancacgtgagcaaagcaaacagcgcaccttactcgttttgaggtgccttgacggacgctcataaggcttttcgcagtcgaggcagtagtgttgaccaaacaatccatgcaatttctgcactccatcaaaatgctggttgttcaaatagagcacaatgggtgtgtcgtaatggtcgttgatgtatttgtacaatggcttgtattgtcccgatgagccaaagatgaacactgcaaaccgatgctgctgttgttgactgttgttccaatgatcgaccacacgcggcacacaaatctcagcatcataggtgttccgaccggtccgtacaccaatttgctgcatcagttgtaaaacatcccgccgcagacatccctgttgaccatgcaggctgtgcacatagcgatggaacttccaatgaggccaacccctagttttggccaccattgtcgcctgcaaggcgtagaagaggcaatgcccatccggattgcaaatcttaacaaaattgtcactaaaattatacttgcgttgtgatgttggaccttaatcaaacaagtttccgtcaccctatgatgcacaggtgctaggcttcgtcgagcaccgcccttcagcacccttcggccgggcagtccagaacggtcaactgtggtcaccaccacagtgaatggctcgccccacagtgtgacgttttgctgctgcttgctctgtgccactttggtgaactgattgaggatggtgttgacggtgttgtctgtgatttgtcgaacggggatgggaatgtccccgccggtgagcaacggactgctgatcatgcagccgagatgcgtgggttcaattccacgtccacgactctcctccatcgctgcgtcaaggcagtactggaagatgccggccaggagtccctcaggatttgctgctggcacatcctcaatgctgaatcgcgacttaattttgctgtattggaagcggggcacatgctcaacggtgctgtccaactttttcacatagtcctttgcagactttgatgatgatgaactgccgccgccgccctcttgaagcacctctccaagcaattcattgatgagaaagccgcgacgcggctttttgcttggggccgatagaatttggtcaatggaaaacaaagagggatgcttgggaggctgattttgcattatctaattttacagggaaaaataatgaattgaatggataaaatgaacaatcttgacacatatttttgaggcatggaaattgtcgttgtgaatgcaaattaatggataataataataataatttaaagattttttaaaccaactatgccctgaagagcagcgcactgccacccattaagcacaagacgacagggcacctaaacggctcgggtaattagtaaaggtcacgcgtacaatcccaagccctaaaagacacacaatgctgccagaataaacggagcccaataattgggcaaccgctctggttaacagcagaaaataaaaattttattataatttaattatttttacaaattttattattattaaagtgagtaaaaagacatgagcagatatgaatgaaatgtgatttggactgagtatttatgaagcctagggtcggggtgtccccatccgaataccaattaattttctcgaactctccttccttattgtcggcaaattcaaatttcctttgaagttatctccttcactattgtcggcaaattcaaatgtcttttgaagtcaatattaactattgaataattaatgagcccatgaggaccgacacaaaaatattttaattcactcttcattcattcattcaaatttcatgaccaatatgatgcccaagcgattaccagccgagcttctcttcgaaattatctactcactgcccataatgtgcttatttggcggggtaacacccaagccaggtgggaaaaaaaaaattcaaatttcaaatttttcgcaaaatttaaggccgtccaccatccggtatcgcagtggtcaattggattatcgagatatttcgggcgaagcgtcacccaaacttcacccaaattgtaataataatttaatttaattttgtatattttgttaatttgtaaactcagaaacggcttgctctcgactttgacatgatcagtgcaaaaggatggatgtcagacggacagctctacctgcatttcagtttcaacaacaatgagctgtgtgacccgggctttttcaatgagttcgcccgatatgtttgcttcggcaaatctgggcgcattttctgctcccgaattttggtcaactcgcacaattcgctcgtaaaatttttgaactgtttttgtttttcaatttatggtaaaaaaaaatgttaaggaaaatggtgcactttgcaatgtggtgctcaagcacatcacaaaaagtgcaaacccgttctcaatgaaaaagtgcacatccatcgatcttgtgcaccgcgacaattttccggcaattttgaaggcaacaccgagcgaaatggtagcatgcgggattgagccaactgagcctttgtcggccaatgatgatgatgatcaggcatacattttaaagaacccgcattttgatgatgaaattggctatcttgatgtttatgctcaatcatcgggcttttattttttctttttttcaactatttaatttatttatttaaaattttatggagtacaaccgtaacatataaatctgggtttgaacaagactcaagtcggttgagaaattgattaaatgtgtctccgagggacaaatggtaaataaaaacaatgcagtgggcggcacaagtggagacaagtggggactggtatgggtgtgaattcttcgttaatcccttggggaattggcacaaaaatgatgatgtgatgagggaggggggaggtgggtttgaacaaaactgtcatagtagaacactggcgtatccattcccttagcatanatggcgcaccaatgagagccnctccttggtgggtgggcgtcccctgttcacgac

SEQ ID NO: 16885 - DNA, 1927 bp, Heterodera glycines
  misc_feature (74)..(74): n is a, c, g, or t
gaaaatgatgcaacgtgtctcatctatatctcggaaaaaatcattataactggtgtcaattcaatggataattnacacaatttatttcaatatctctcaagtgtgattcccaaattttttcgttgagattataattttttattcattgataataaattttcaaaaccatccagaataacccggtcgagttgggtcagggtcaatcaatgttctctttcttcgttcagccgtaggttgtattggtggatgtgatacatcctccacatatccaaatggtcgtgtttgcattcccggtcgaacacggcccttggcgtagaaaggtctgtagtctttgtgggcctcgcaggtgtatacgtcagaacggacatttcggtcaatttgcgggaaagttactcggatgcaacgatgggctccacctcctccgtacacgtagagatcatcgttgtcgatgacatcatcactaaaatttaaaattattagttgtgaaaaataaaaaaaactgacataggtccgtcaatgttatatgtagccagtgtcagatccttcattgcttcaaaattcagtaattgttgagtggcgtacgataatctgaagcttcgtatttttaggttggcccgctcatcagttccgtctcgtgctgtgtgccgaattccataattttttggaccaccagctacaaattccacaattcgacgatcaacatgctcacgcttcatttgtccaagtgcctcgccttccggaacacaccgcccacccatcttgttcacgtagtagattgagtcagtgtctaaaattatctaacattttttttttctattgtattcgcaaaccacaataaagaagctcagccccttccagtgcaatcactttttccatgtatgaatagagatgaagtctcgcgtacgatgtgacgtatattgcgactggaagacagtttgtgaggggtgcctttgcaaactcgggacgcttcctgacaacaactcggtccatatgctcggagacgtggacaaagtccagtttgtctaatgttggatcgtccaagagttgatggaattccgctggagtgcgcgtgtactttatctgcgtgaaacccacgcgctgtgccatttttcccctaaacatttttttttgttcaaatagaagtttaaaaaacgtataccacagagaatttgccaatgttttggcaatgaggcggagccctgggttgggtgtcattttcgttgagtctagttggatgccttccgtgcgcatgaaattatccacgaattctttacgttgttcatctgtctcacacccttccggccacccagtcgcttggactttgagaccaacgaatgtattgacatatttgctgaacaagtcgtcgtcccactcgtcatagttccaaaccttttttttatatattttttttcgttatttttaatgtacctcaaagagatcaacgacaatatagccgagttgaagtgccttgttcaattccatgtgcgtgtatgcgcacacccaagaacgcttttcgtcaccatgttgacatggacgttgctggcgtctgtccgcacaccaagcacagagtggaaaggtgaaacgtccatctttggtgcgatagcccagcaacgggacacgaattaggcgcggtgcgagcactcgtacaagtaaaagtccccggaacatgttatttgacgaacatgtccagggaagtggggccgtgggtggatgaagcaatacctcacgcgtgagaacacgtggattccccactgggaaaggattcaccttctaaattcaaatttaaattcaaatttattgagaaaaagcaccatgacgtagggatataggctaactatatcaatgcacaatatctcttcatcgtctgagcacacatgatgaagtttgaagggctccgtacgaccaccacggagtgcatcgtttcgtg

SEQ ID NO: 16886 - DNA, 2197 bp, Heterodera glycines
  misc_feature (2158)..(2158): n is a, c, g, or t
  misc_feature (2161)..(2161): n is a, c, g, or t
aaattttttttggaaaaacagcgccacaaaaaaagcgacttaaaaacaaaaaatttaaaaaacaagttttggtcattttttgaataaaatctgttaacaaatccgaagacaattttcaaaattttttcggcggcgcctaccggcaccgcccgaccccccaactgtccccgaagttttaaaaaacgcaccgcaaaaaaaaggtggaaaaaatggacaaataataaagtttgtttctaaaataaatatatttcatgaaaatattttttaattttcatgaaaaaattttaaagatttttgtttggatttttcatgacttggactcggtttaaaaactaggactctgacccggctttctgtacccggcaataccctgacccggtatttgcccaaatacccaggcccgtacccctaatttaatatacgattttgaagttttttaaattaaaaataaggctacagaaaaaattgaaaaactctcgcctctcgtcctctcgcctctcgccaactctcgtgtttttggggactctcgcctctcgccaaactctcgctctcgtctttttggggactctcgcctctcgccaaactctcgctctcgtctttttggggactctcgcctctcgccaaactctcgctctcgtcttttctgagacaagtcacacccctgatgtgcacgacagtatgatatggtactttgggtataatttcctttaagcagcacaagcttaacttcggaacatttagtacatactctctgaatgagctgagaaataatatatattatttcaaggtcatgaaaatttcaagaatttttatatgggcacgagtgtatgatatggtactttgggtataatttcctctaagcagcactagcttaacttcggaacttttagtacatactctctgaatgagctgagaaataatatatattttttcaaggtcatgaaaaattcaagaaggggtgggacaactctcgcctctcgtctctcgcctctcgccaactctcgccatttttggtactctcgcctctcgtctctcgcctctcgttttttgggacgagaggcgagagttgaaaatacacccctaaagattgaacttttgagcagccagaaaaattttcaaatttacgcgaaaaaaaaatcttaaatctctttctttccttccttaatgttttctctatttttggatagctccaattcaaatatggtctgctggctaaaccttctgcctttcattatttttctcttgggttcaattccccaacggtacagaatttttttaataatttctttaaattattttcaattgaaattttaattaataaaaaatatttcaatttaaaaattattattttttctttttttaaacagcctaaaactgcaaatttaaccaaaactttgatcattttttgacaagttctgttaatatattacactcaaaattttagaatttttccggcggcgcctatcggcggtgcagattcggcaccgccggaccccgcacccaatgttccaaaaaatttttttttggaaaaacagcgccacaaaaaaagcgacttaaaaacaaaaaatttaaaaaacaagttttggtcattttttgaataaaatctgttaacaaatccgaagacaattttcaaaattttttcggcggcgcctaccggcaccgcccgaccccaactgtccccgaagttttaaaaaacgcaccgcaaaaaaaaggtggaaaaaatggacaaataataaagtttgtttctaaaataaatatatttcatgaaaatattttttaattttcatgaaaaaattttaaagatttttgtttggatttttcatgacttggactcggtttaaaaactaggactctgacccggctttctgtacccggcaataccctgacccggtatttgcccaaatacccaggcccgtacccctaatttaatatacgattttgaagttttttaaattaaaaataaggctacagaaaaaattgaaaaactctcgcctctcgtcctctcgcctctcgccaactctcgtgtttttggggactctcgcctctcgccaaactctcgctctcgtctttttggggactctcgcctctcgccaaactctcgctctcgtcttttctgagacaagtcacacccctgatatttatatacataatcatatgnagnttggcggttttaagaaacgcccacctggcggtttta

SEQ ID NO: 16887 - DNA, 1337 bp, Heterodera glycines
acaaaaagcgtaatcgatcctttctccatttcattttctttccattttcaaattcactctcgacaggacggacaatctcaagagtctctccgtcaaagatattatggtccaccaaatagtatcacttagtcatccctgttcaaagaatagcaccggtttctaaaggacgatgagtccccgcattgtgaatcagtaaattcccgacccatcttttgtttgtaccactctcgagacacgaaagtgtaagcgatccctcacatctttccccattaactcactctcgactgcaaaattcccgagagagtctcgacaaagagactgatcctcccgatttcattgggctgcttacaccggggcttttctattttagctccattaaatccttttttgctttgctaacttataaatttttttcttgttttgatcactgtcaatacatctttcgagaatcactctccgccaattttcgagagtctgatcaataatcaatgtattaattgccttaaaccattaattttttatttttcgctataataaaattcctttctgcctatgcttcatcctccattaatctgtttgctccgttttgccctttttttctcttcgctttcaccgatcgatgctttctcttcccttccgttctttcgttcgttcgttccctctccaaaaagcacaagcggatgattgtattatgtaagcgatccccgtccaccggtcggtctcgaggcatctccgttttgtcttgagaaattaacagttgggggacggatcccccccccccccccccaaatgccaccgctgtctctagaggatgactctctcgcgactcactctcgactgaatgaatcgagaatttccaagggatgtatttccggaattaatcgccaagtgattaacaaaaaataatcgactattgtaaaagagcacataaatccacatttccctttcatcttgctgagttcttctccaaaattagacatcggaaaattggaaaaaaaatgtcttaagataaaaaaataatataatatatatattttttggcacttttctcaggaaattgattgctacaaaaaactagtcattttaataggccacacattttgatcataattttgaaatttttttttcgaatattcatctctcgaaaaaggccaaaggtttgccctggcatttgtaaattatgaatttttcggtaatggtgagggtcaactgggccttgggccaggttttggggtataactccgtccataattgaccgacaaaaattttcaggcaaaatttaacatagggcactcgaatgatatcaaattcatttattcggacatcattcatttggt

SEQ ID NO: 16888 - DNA, 3269 bp, Heterodera glycines
  misc_feature (3111)..(3111): n is a, c, g, or t
  misc_feature (3142)..(3142): n is a, c, g, or t
gtgtgcatttaagcgactcgctgtgcttgcccactgcatatcaaatagctggtaatttttatttctccggcctaatccagaaaaaatcactatctctttttttggaatattttacgtctcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttgtccggcctaatccagaaaaaatcactatctctttttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctcttttttttttggaatattttacgtgtcaaagggagtgcatttatccccccccccccccccaaatgccaccgctgtctctagaggatgactctctcgcgactcactctcgactgaatgaatcgagaatttccaagggatgtatttccggaattaatcgccaagtgattaacaaaaaataatcgactattgtaaaagagcacataaatccacatttccctttcatcttgctgagttcttctccaaaattagacatcggaaaattggaaaaaaaatgtcttaagataaaaaaataatataatatatatattttttggcacttttctcaggaaattgattgctacaaaaaactagtcattttaataagccacacattttgatcataattttgaaattttttttccaatattcaactctcgaaaaaggccaaaggtttgccctggcatttgtaaattatgaatttttcggtaatggtgagggtcaactgggccttgggccaggttttttggtataactaactccgtccataattgaccgacaaaaaattttcaggcaaaatttaaacatagggcactcgaatgatatcaaattcatttaattcggacatcaatcatttggttggggctcagtcgttgccggtccgtgtggcaattcaaaccctttttcaaaaatgctttactaaaaatccaaaaaacatggttaaataaagaaatagtcgcttactgattttattttacccataattatttatcttattttgcgagttttcaaataagcttttttgtttgttagaatattgttgtattgttgtcctgaaaaaaaagattttattataatattttggctgaccaattcaaagtcccaaaatttgtgaaaacaatggtggaaaaatgacactaaagtttaattaatattgtttttttgttaattgatttttgagataaaaactttgcataatttattcccaccacaatgtttttttaaatttaactgacgatttttacagcaaaattagtacgattggactctcctctctattaaaatattaataacattcattaatttaattggattaggcaaaggccaactgatcattcatttgttaatcgcgtgaccacgtgcatttaaaatgataataataaaaaaataattacttttccatttgaaccacccaaaaacattccttatcactggtataattcaccaaattcgtccttcaaaatcaaaattttacattgtatcgtcatatcatgtcatcttcgttgaattggtatatccccccatatatcaaccagaacttttttttattttcatatacatatatttccagggtccggatttatacattttttatttttcacaaaatttgaaaatggatttttctattcatttcgtagttgtaagaatgacttgaatattgcaggaaaataccttgatatgaggactttctatatgtaaaatttaaaaaatttgttaatatacaaattaaaaaatatatttataaaacttgataaatcaaattcagacactgccttgaagagttttatctaacgaaacgaacagaaaaatcgcatttcaaatttggtataaaataaaacgaatccggaccctgttaatttacatttttatttttcctggcgcaatttaattaaaaattagtttattttttcttttaataaaatccattaactcctgctaaaagcaaatgcaaataaatatccgagttttgatccatcaattactttaatagtaataatctcttttgactggttctatttttcagttgcgtctccccccccccttattttatttttccattgtttcgctttatttcgtcactcttttgtccattttattgcatttatctttaaaaatatgaatattttatttcattttcaattcaatttaattttttaattaattaattaatttccttttaaaattgttaagcaaatgttattgaggctgttgtgactgttttttgttaacaaaagtgcaatttactacacactttagccacatttatttcttgttatgatggccatggaagctcagcaacaattagcaattaatggtgccattttgggaatgccgaaaaatgaagcgagttttaaaaataatattgtaaattaaattcaaattgaaatattgtcaaaccaaccaaactttttagcataaaaagtaatttttttaggcaataaatttaggtattaaatagtttttgctttaaaaattcaattcaaaatttcccgacagcgcctaatgcaattttttggtccttacttaaaaaagggtgacctttttctccctttcctgtcgttttaatcgattgtgcctaattaccttaattaactataatcaccaaaaataagtgttgcaattgcaatatanattgaacaagcattgttcactttcagattgngcatcatcatttgtcacttgaaaatgggttcggccatcacacgacaaatggcgaccaaaaacgtgctgatctgtgcattttgttgtacaatttggaccactccccaaatttcccaaaaatgattttt

SEQ ID NO: 16889 - DNA, 3157 bp, Heterodera glycines
ttgcatttttgttacaaattttccaaaaaatgtcgaaatagcgaaaaatagtgacaaaacgccaaaaaagtgaattttcactattttaagtgacgaaacgccaaaatagtgatttctagtgacgaaaaatgacgtccaaaggaaaaaattttaatgcagaaatgcgttttttgagctcctttcttcaaatcaatcgagcaaaaaaaaaagttttttcactagaaatcgcggccctatttatgtttatgttgtaattaattcattaattgtgagtaatcgttgataaaattgctgatgataaaatggagttgatttaactgtgccaacacaataaatgccatggcacaacaattttagccaaaattttgaaaaaatcaagtacttgacgaaaaaacatagacaaatgcaatgattttcaaaattcgagctcgtattctttatcagtacccgggaccgggaccttttcgggttgaaaacccgggaccttttcgggttgaaaacccgggaccttttcgggttgaaaacccgggaccgggaccttttcgggttgaaaacccgggaccttttcgggttgaaaacccgggaccttttcgggttgaaaacccgggaccgggactttttcgggttgaaaacccgggaccttttcgggttgaaaacccgggaccttttcgggtttgaaaacccgggaccgggaccttttcgggttgaaaacccgggaaaaaaccaggactagtcccggtcaaaaccgggaccttggtactcagttgtactcagttgtccgctaccaggtcccggtcccgtggcactctatttttgaccatagaaaaagtgattttgtaagaaattttttaaatttattttttcgggcggaacaccaattccgaaggattaccaacaaaaagatacaaaaacattcatcaatcccttttaatggctataaaaatgtttgttttttcgattgcctcgcatttgaaaaaagtaaattttctaacgcaataattctgcaattattcttccctttgtgacgacatcattcggaactcggccaaattgtgctaattgcgaaaaaatgaacagacggtaagcaatttgaaaagtcacacaaattcatcatttatttagctaaactgttttcccacttcagttggatttgcaacgacgtgtggatggatattttgccctgttttgaccgtcctcaactcggcctcaaattggcacttctttcgccacgtttcaatgcgttggtggacaaacatttcgatggcaaaagcgaattgacaatttggagaccaatcaaaattcatcgcaaggacaacggacctgaaccgaacctatctgtgcggatggatgacaaatttgtggaatttccattgcccgaccgtccgttgcccagcaaaatccgttttaattaccttcggattgagtacttaaaaaacagttttatggcaataaaagcattcattccatttttaggtacatcgatcactccgtcatcgcttttcttcgttccaatcatcaaattttcgacaaaagaggcaccaatttatatttgtcgattccatcatcacacaccacggatggccagcggatttgggacatttttgttcgtgaaatttggcccattttttcgacaaacattcgctgtttgggctttaccaatggtgatcatttggacaatttgcgtcgtctcatttcaccgacaattctcgctgatctcaaccaattgaattcaatctattcatttggtctgtcgcccgctgcgtttggtgatggttttgatgggccaatttctgctggccaagcattgtccaaatggttgcactctccgagaaaagatggccaacccaagcgattgcgttgcgcagttttctacagacaaacggacttcgattggattaacaatttcaaggaggtgtggtccgggggggggggacaaaacgtaaaaagttataaattaaaaatttttgaaaaattccgaattttatcaaaaatttcggaaatcggaattcagtgccatccctggtgtggtcataatttcgacaaatcactgattgttgttttccaatcaaattgtttagcattttcttcgtgccaatgccatttcttccgtcacttacgaaattcatttttatgtgcaagtgtcgtcaatgcaaatggtgccatttgaattgcttaacgaatggacaaaggaaaagctgacattggccaaagcaaatgaaaatgaattggacaaccgatggataatgaaacgatgcaaaattattggggagacagcggcggtcaattgggaagacggaaattgggacaacaattgtaacaatgtgttcttttggctttttgctgacactaattgcattgggtgagcaattaaaaaaaaggatttgatttttatccaaatttgagatttgcgcttaatttaggccattgtctccgccaccggaagaagttgaagaagacgaagcgggacaaagcatcacaaatggaccgtcttctgctgacaaatgagtgacggacaaaccaacaaaaacagtgattggccgcagaagaaatgaattaattaagaatgaccgaccgatcataattcatcagtgatcaaaatgtattttatgaacaaaaacctcaatttcggtaaataaatcggatgtataaaaacggccgtatgtacttgtcacaataagccagcaacttaataagtccgattttggcaaagatgaaaattgggacaacaattgtaacaatgtgcccatttggctttttgctggcactgattgcattgggtgagaaattaaaaaaaggcatttaattttgtttaaataaaaaaaatgtacgaaaacttaacaacttagatttgcacaaaataatgaacaacaaaaaaaaacaacttgttttttgtgcgtttcattgcactgggagctcaggaaaaaaatagggcaaaaacctaaaaatataagccctattttcaatacgattgtttgaaatttgccgaaatttcctgagaaattcaatgattttttaaaaaaatcattgaatgggatttgcggaacaggctatatgctccggctataaattttacaaagagtttaacaacccacgcataacacaaaaattttggcgctagttacaagaaggacctttttgacaatgtaatcactttttt

SEQ ID NO: 16890 - DNA, 1652 bp, Heterodera glycines
ccggccccccaacagaaccacttttcatcttattgttgtagtataacattcgttgaatttgcagtttaggaaactcaataaatgccaaaaacaatgacgaagacggattatggcataaatcgaggttgacaaatgagcacaaggaacgatttgggacccaaagaagcctgatttaacttatgtgttgtcgctatatccgaatgtcttgaaccaaactagagccgagcgggacagggaatttttccaaaaacctggacttaccgggaccagcaaagccggggccgggaccaagttagggattccaaatatcgacttaaagtatgaggttaaaaaatataattattcaaaccgggaattcccgactcggtctagctcagctctagacttaacaatgaatgcataagtaaataagctttccgtgttatttggttaacatgatcataagtaattttgctatcgatatttattcctaaatccctaattgtatccacagaattattgtttttccatcaaatttgaatccaaataaagtacaagttttttgatttaaacttttattttgtcatttatttgccctttcaaataatttatacaatgttttattcataatttcgttttcggctcttgctttatagcattggattttgcggtaagctcacgctgatttttggatggacggtgatttctaaggctgaaccttcacgggctttcagccgccgacaaaaagaaattttatctgaaaagttcagtaaaataggacaaaaaactacagtgaagtaagatattcttggttaataaggacagaccagaccattatttccaaccaactttggctgtttgagaccaaaaattttcccgaggcttgagaccacagtagtataaagccaaaaatcttgcgggtgcttgaaagtccgtgactattgggaaagcagcgaaaattttataaattggaaaaaatgaaacagaatttcgtataatttcaatgaaaaattctattttttgaattaaaatattttaggcaaaaatagaacaaatataaatgacattccattacaatttcaaatttttaaataaaattgataaaaaattataagttgtgcgaatttattatataaaacttaaaaatttactcaattccaccttgaaagaacgtcagaaaaaataatcagtagacccgtatcagaattgtacggataagggatatgggcttgacatcgaaacggggtagggatttacgggctaaaaatcagtaaaacccttaactcgcaaaaccagtatcggccgaaaaaaatacggataacggtcactaaatttatattaaaaaattatttattataaatttaaagatttagataaagaaagatgttttattctgcttctgtattccttaatagatcctatccatttatttttatcaaatgcaattccattggtgatttataaattgggtaattaataaaaacctatttttattaaggcgaaaattaaatgctaattgcacattgagaagccgatcagaaaattgaaatagtgaatactcaacgaaaaaatttgaggcacaccttggcattaagctttcgaatgataccaacaatgttggatttggattacaaaaaaaaaagttatagaaagttataatggaaaaacacgct

SEQ ID NO: 16891 - DNA, 2312 bp, Heterodera glycines
tttcgcttttcgctttttatttttcaatttaggcccatccctggtgccgacggcaccgccggacctcaagaaatccttattctcttaaaaagtgaccaaagttgcaaattttaacatttttggaccaaaatccgtaataaaatgcactcaaattttcgaaattttttacaggcgttgcctatcggcatcgcaggagaaatagatatcttattattattaataatttgtctgtttgcacaatgaaaacagaaagaagcatcctagaattaaaaaatatgtcaataatagaaaataaaatatatgcatattatcaattaattataaaaatagaggtaaatagaaaatttacattgaataagtaaacctttttaattaaattaaaaaataaaatttatcataagttttgttgttatatttaaaattaaataattaagataaaaataaatataatgattatatttcgttttataacataataaataaattacagactataaaccacaccaaaaatttaaaatgtttttaaaattaaatatctattcgggttttgattacatatcaaattattaccgtattggatgagctgaacaattaatgaccaagcaaagaaagacggtcaatagagaaatggagttcattggataattaattaattattagaatttaatattaatactatttaatttatttactattaaaaatgattttatttattttatgaataaaatttttagttcccaaatgatcaaatgaaatgaatgaaagtggtgaggtacaccactttttcattggacattttggcgtaaaatgtgaaagaatgcataattaactatttattatagaattaataattttacaaatttgtgagtaaaaaatgataaaattgaataaagccgagctgatggaggtaattgagcactgttgtctgatggaccccgaactctgctgcaagttggcgctaactagaacacggatgctgctgaacgtgctgctccaagtcatccgaatcgagagcaggtggacgtccggagcggggttcatcttcgagctgctcattgccttcacgaaattttgtgaaccatcgcttaactgtagaaagagagagtgcatcattgccctcactttcacaaatatttcgaagagcttgggttggggtataattttttcggaattcgtaaagtaacagttgtcttagccgaattttgtccgttttttgaaaatcgttcgattttgcaaaagtaatggctatacaacaaatgcaaatggccagaagatggccaaccgtccgctgattcatcccaattgcctgcctccctttttcaatctctttagaattaaatatcattttttgcataatttgttttttcagagggtcagaactttttcatcaacccaatagaaaaggcaaatgaagacggttatggagaaacgctcaaataaatgatgataatcagggatggaattatatatgctaaaaaacgacaaatatgtgcatgtatatgtgccaaaaaccccccaaataagtgataaaaagttaaaaaagccatgccaaaaactgaaaaaaaattgtttaataaatacgtgatatcatttctatccatttcgctagtaaaatgctaatcaaaacatttaaatatttacatatttactacgaatttttattctgtctgtgtgctgggaaggtttgttatttaaaaagatatattatttgaaattgaataacattttgacccataaatacctaaaaattttcataaaatatcttttttgaaaattcttgtgcaagttaaatgaattaatttcttaaaattgctaaatttgtgtcaaggtaaactccacacgaaaattttgactttttttgttgtttatttagttaatttagcagtgcaggcaaaattttattgcaaaaaataaaaataaaaaggaaaacaaattttaattcattaatttttcgatttttaaatttattttttgcttattaatctcctccataatatcatgcgctttattctgaggtttgaaattcacatgtttgtcgtttccgacttctcgaaacgaactgaatggggattgctaatgcgcatattgcgaaatattttgaaaataaaataagggtcaattgctagtgaaataatcggaatgaaaaaagggataaccacattgcgaaataattggggaaattgcgaattaagcacctcatcattcattttaatgacaggttttcaaaactttgcgtaccatattgtgaaaatattttccattttagaaagaaaaagcggaaatataaaataaaaaattccaatgaaatgaaa

SEQ ID NO: 16892 - DNA, 2505 bp, Heterodera glycines
ttctttgatgcgattgtaggtactgttacgattgattcgattttcgactgcgttgagcatcactttgaaaaggacgtatggcaaacgagggttgtccatcaccacgaagaggtcatcaatgagacgagctgtttggtcacggaaatatggttcaggcatggcgtacccggacaaaatgttgttgcacgccttcaattggaattacggtaaacaaaatgaaaggattgtcacaatcacccaaatacctgaatgagatcttcaaatcgtgtgttcatccttatttgattccgtgactgcaactccttttctcgtgtactgtcccactcctccatcggaccggtgaaattcacgggtttggacacggcaatgtcttcctggtcctccaatctcgcaattaaagtcccagggaaaaggacttgtcccggttgcgcaacctgaacaatttggccgctttcgtaacatgctaacccaaatgtacctgaactagacgaccacccgcctttctgatttccaaatttatgaccattttcatcgactccatttctccaaaaacctctccaattgtgacatattgtccgtccttcttcaaatactgcaaaaatcttccagcatttttcgatcgtaacatcgaagggtcattttctttctcgaatatggttaaagttttgccaattatcactttgaagcgttcagactgaaaacaaatatgaattgtttggccatttgctcattgtcagttttgagtacctcttcctccaaatggcaagtgtacgcctggtcttcatgggtaacaagcaaagttccattaccaagctcacggacaacagtgcacacgatgctttcattcaaccggacgagaaaattgatgggcccaaagcgattgaccatcactgagtatttggtgttgttgtgcaccaattcgaattcccacgtctccacaagtccggactttggcaggatttggcccttctcgagcgcactttggaatttggaaaatacttcggtaatccgagcgtggccaacttaaatttctctttagtccaaattcatcaaccacggttggatttgttactcagagtcgccccaattgccacactaatgtgcggtgggtattccacggatgcttggacgcgtgaggcaattcgggcgtcgagccacccggtgtgaaagttgttgcattcgaattccttgtcgtggagaaggccaacgaggtaattcacttgggaggtaaaagtggcacgcaattccaattctttgagtgcacacaaaagggcagaaatcgcttcgtatctgaaaatgcgcaattaatccaatttcctactatgtcatttgatgccttgccttgtcattcctttcgcaaaaagatgcccgaactgtgaatcggcaaactcatgaactttccccgtactggagacggaaaagtaaccccaaacattctgattcgactggaaattgagcacttcaacggcgccactcgcaggacggaagccttctgctgggtcctcgctggtaattcgtgccgcaattacgctgatatttgtgtccgttcggcactgttcttcgggcaacggagaagtgcttaatttttgaaaatcagatcgacttgagaatcgagctgttgattctgaactgacccgtatcgatccatgccaaagaaaagacgaatctcagtgattctgtgcagggggatgcccatggcgatttggagttggacggcggggatattaatgttggcgaccatttcagtgcacggatgttccacttggagtcgcgggttaagctccagaaaatagtacttctgctcagatggcaaatacatgtactgaaagggcaattgcagcattgtcttccgtgaaattcgcccacttcgacagtcccggcactgacgtagcccactttctttgccaaattcacagcgtccatttgcatttgccgttggatttcctgcggtacgatccctgcaggcgcctcctcgatgattttttgacagcgtcgttggatggaacagtcgcgcgtgaaaattgggatgacttggccgtattggtccgcaatcagttggacttcaatgtgtcgagcgttaaccatacacctagataaaacaaaacaaatcagaacaactctgagctgtagacaacttcatgatgaaaattggactgccgggcacttcggcttggactcttcgaaaattcaatcggaagtcttcatcgctcaagcatttccgaatgcctttccctcctcccccttcggatgctttgatcatcaccggatatgtgatgtttttgtcgtccatcgactgcagtccttccttgactgacgtgacgcacgcttttaaataaaggtccttcggaatttccaattcggccgtcgaattgtcggcattttgctcaggtgcaaccaaaccactgcccgaccattcgatggttggaatttgcacagtctgaacccaatacaatagatcatagcaaattcatcggcaagggcgacttggggggggggggggggggg

SEQ ID NO: 16893 - DNA, 932 bp, Heterodera glycines
  misc_feature (134)..(134): n is a, c, g, or t
  misc_feature (144)..(144): n is a, c, g, or t
gccaatgttgcgctgctaaagttcgtcgggaaggcgcgggttttcgctggcgtgtccccagcctgcccaaacccgcgtccacgtttgttccgtgtagcgtgttcaacgatttcgtcgacgtttgcgtaattatnggagtggcanccggcgggagaaaagacgaggtaatcggccatcttcagatactctgtgacggacaatgaaaaatgacttggaaagataaaatcaacctaatttgcttcacctgcttttgattggatttcctgctcagtcgtcagacagatgaactttattattcgatcatcgcgaaaaagttgcatcaaaagtttgcgcctaaaatttccaaattttaataaaaaaagaaaaaacgatttttacatggaaagaatgcatttgaccgcggcaattccatttgttgcgacaagaaccttaaaaaatattttataaaaattaattttggtgatttttcacctttttgatgtgtctcgcctttgctgagtcctcacaaaaatcgttgacaaatgattcaatgtccggaaagactctgttcttctggtcaatctatcggttaatctgtgtaaaaaaggagcagaaacaaaggaccgacttggttgctgctcaactgagttgatggaccgtcgaacttgctgactcgaaaagtctgcatcgtgggcgtgttggatggccccggcatgtcctgcctggagtcggattcagccggggaaaagagctttctgaaaaccaaaagttaaataattggtatgaatgttaaatcaacttttcaaaacaaaagaaattataagatccgatttatctggaaccctagtctttcgaagaaacgacaaaactgcaccattgcctggctgtgaccgggaagtgttatttttgaagcaagtttcttttttttaataaaatatactgtattttaataa

SEQ ID NO: 16894 - DNA, 1112 bp, Heterodera glycines
tatgttaaatctgtcaggtaaaccacacaagtaccgcccaccctaggatggatttctatatacatatttttccatatttcgcgatacatgtctatattttggcatttaaatccatgttcgcaatttttggtccatatttatggccatatttcgtgattttatatccatagtgattttatatccatatttttttggcatccctgataataatgtcattcggttgaccattccctccctcacttacacaatgcgttgtttccctcccgcgatgccttctgcattttatcggtgaattccttcaattccggggcgtatttttgatgaagggccatcattctgcgcatgttcacgggaattggaaagcaaagcaatcgcaaagtgacagttgcttaaatgaacgcctagttatttaaataaaaaaaattcccctggttttccgactcactggcaataattgtgccccaccagggaatgtccaatgtcaaatgtgcgtattccataacccaacgcatccaactcgacggcttccaccatgtccacaatcccaattcatccagcacactctgtccgttgctcagcatttcttcaagcgacggcttatagataggaaccggaacttctggcaccaattcggctaatcgggcgggcaaatcgcgcaagaaaatgtctcgagttgacagacatcgaacatcggcgagcgaaggagacggagaacagccgccacacacagcaaattttaacagagaccggttgccaattctcaaatatttagtggtcgaatacatttacctagctatttgaaaaaagctttaagattcaagactcttgcctcctccgacgaaaaacacgtttaatttatttgttttggcataatgttgttgttttttaactaagtaaaaaaaaatttcgcttttttgttttttggcttattttttttaactaaatttaaatagttaattagatatatgagcttatagcttatatcattcagagaatggaccagagaaataatacagatgctgaggttcaaaaaatttcattaaacattcaacagctgagtcaaaagggtaggttaaatttaattgtgtcattatttcattttttcgacctgc

SEQ ID NO: 16895 - DNA, 1840 bp, Heterodera glycines
cgaaaggccgccgcgcgagagaagacacagatcaaaaccgtgacggtggaggacgaacagttgcacgggcgtatgggcgcctacgaccccattcagatgagacagttgcagcaaaagcaccgcatgaatttggacgaaattcgcgaacgccaagaagtcgaggggaccgatatttcttcccatttgactcaaaatggctttccttaaggctctttctgctttggagcaggacatcggtgacattaatcagattttcaaagacttggcccatttggtgcacgaccaaggcgaaatggtggacagcattgaggttgttgtttaagctgtaggacaaagggagggcaatgggaagagcaacactttttaaatagtgccgaaatgcatttagaaaaggaaagggcaaatttaaaaaatgaataattattcaggcgaacattgagcacgccagcatccacgttcagcaagcaaacacaagcgtggcccaagcggtgcattaccaagcgaaggcacggcagaagaagctgatgatttatgtgagtgaaactgcgcaattgaaaaaaactatgccaatcaattaatttgctaattgccttccaccggtgatattttcagatttaatttatttactttcaggctttttgcatctttgtgctgctcgtcctgtttcttgtgctttacttgtggctaaagcactgagaaaggcatttccagtcggtgaaacatttcttgcgattgccaatgtttcaggcacatttttggaagcggtcatatcaaacttaacacagaaaagctacagacagaaatgaaaggggtttgccaatattttccgattgaaaaatagtcaaaaagaaaatgcattgttacgagaaaaaaaacttgaccaaaaaattaaccgaaactcgtcactttgctttcttggacctttaattataaaccatttgtaatttgacagtttttataatgtttatttcgcccattatctcttcaatcattgactgtgatggtttccttttgctctgtttgaatctgatgatgatttaaagttttattctcattttatatcaattataatataattcattaaactttttttatcttcgcaaaagttaattttttttacataaattaacctaaattatttgttgtttttttctattttttgtgattgttatcgaaatcccggggtgtgaattattgctaccggtcggttaagtgaaatgagtgcgtgccaatgacgggcaatgccatcccccccccccccccctataaaacgtcgttttccatgtgtccgttttcatttggctctccctttttcgtctctcctccactctctccctctgtctttttgcttctcatcgcttcctctgaattatttttgtgatgactttgcttttacttctgtccgtcccttaccattcagtgccctttctttcccctcctctttctcccttcctcctccttctcttcctcctctccccattttcttttttttcttcccctccctttctcccttttttattttatttttcctcctccgtttcgcccttttccaggtaaatgtccaagtgctggagaactttctgctcgcgttggaattgggctactccaagcacaacaatccctaccacaacacggcaaaattttgctttgctttccctccgttagtccatcaatgaaacgaaagcgcaaattgaattttgcctcgcccatttcggtctaattggtttaattggtcaagaaaaatgcgaaaaccgggccaaatagtgaatggaatgaattggccaatccatcagacaatttaatgagtgcagcaaaaacacggaacgattcggtcgaccat

SEQ ID NO: 16896 - DNA, 1386 bp, Heterodera glycines
aaaatatgcaaataaaagtcgcggtttttgttcgcaaacacaaaaaagaaagtgtttttcctactatttagagcatggagaagccaggaaaaaaatatgcattttcatatttttggcatccctgtttattaaaatggcatcgtgggtcgtgaacatccatcatttgcggatgttcgaatttgcattttgcaattggacttttctcttttgttaaaattgccttcagaacggacaaacggaagcagcagttggccatacgaaaaacaattgtccgtttcttgccaatttggccccttgccaaatgtgtggggcgagtggaagcaacaaccacacggcgatgtaaaaaacaaactcaaaatgcccccttatggcgacgaaaaagaaaaaatccctttgcaattttaggtactgtccaaataaacaagaagttcaccttgaacttaacgaaaaagtcatggcgtccattgtggcaatgcacattgacgacacgccgaccaatggacatggcggcaaagagtatcattgtcattttaacgcacagaacaacagccgatcgctgattcagcgtgcttcgcatgtatgttttaagtggccatatgggtcgattttagtttgtctttttcataaaattttccccttttggggtgagagctattttaccgcctccttcataggtctctttgagagcccttttttatctctgactttatgaattcattatgttggtttttacagattcaaatgactccgaccaaacgcaacaattcgttgggcacttcgaccatctctccgaagagttcgacttccatccgttggttttatctgcttaaattgcatttgcattttccctttaagtctgaaaccatttaccaccattttcaaaattcaatttttccatttatttagcgttgacgcctctcagcgaaaacagtccggatactttctgtgcgtttatggaccccgaaattctgctaaattcgcccactgccttctcaatgtctttctgtcgcattgtccgaattgcctcgacgccttcgacgctgccgtcggcttcgtctgctgcgacgggtgcttcgactaacgcgagacgctctctgtcttttggagggtactgaacgcggaagtgccgggtgaaggacgcaattggcacgaaaaaacccatcaaattatggaaaattaaagacgaaaatggccagggtattttagcgatgcattttggccttcacatcctttttgagcattttttgcttataattttggtgtcaaagtcttaaccaaaaaaaaaacaatttttgactgatattggcattttcattttttcaaacctatttttgcaattgcctggtccgaaattctggacacctgccaaacaaaaatttgggattt

SEQ ID NO: 16897 - DNA, 2325 bp, Heterodera glycines
  misc_feature (40)..(40): n is a, c, g, or t
  misc_feature (48)..(49): n is a, c, g, or t
  misc_feature (63)..(63): n is a, c, g, or t
ttttcgacatttggtcgcagaagtcgaaacatcggaaaanatggtganncaaaagaagagcanaaggagaagaaaagttggacagacgaagagcatttcttcactattaattatgggtattaattagcccaaagtcatcagccacgaaatacccgacaataattcgcgataaaagccaaaaagggaatatgaaagcgctgctgccgttcggccttttatgcacaaatgtaattaattagtaattgatcaaagctaattaaattagggagaaatgaatgcttttcctgggatttctcgattatttcggcgattgccttaggctaacaatttgctgttcattaatatctctgaatcaatcactttagttatattggaggtgctcatttgtcagctcttgaacaatcagagaaatgagattacctatcagatttattactttaaaatatttattattttaaaattatttattaaataaaaattattttcccaccgcatttataaataaataaatcatcacaaatatttataatttattggacattattctggtcccagaatacaaaactagccgaaattaaaaacaaaatgtacaaaaattcattgaaaaatgaaataaaaattaaaattctgtcgctaattgtgccatttccttggggaaacccgcaacttctgtgtatcctttcaacgtggaaagcctccgccaaaatgtctccttttgtgccacgtccattggccctgtttctgtcacggtgttcggccgtttgatgtgcaccaatcggacgggctgacgacggtccgtgccgagtggggaccaatccctttcgccgttgagcatatttggcacactaattgagagacgagatcaattattaaaaatgcgattataaatggctaacaattagaaaagaatggaatttgaaaaaagccgggtggaattgtgaaacacagcagctggacgtattttatggcatctcaaatgccaaaaaggtgtaatgagcatgttggcttacccattcttcacaaaactgccgtaggcatgtaccatctctgcgcgtactcttctgtcatcctcgtccaattcgaaattgcccagcaatggcacgcccaaagtgaacgcgtattcggctgcaaatttcggatgcaattatcaggcggcattcgccctccttcaccagtgtgtgccacggcgcggaacggcaacagtttggcatggcctttgttcaaatggtcaaattggtgcagaaagacgggccatccgagggcggacttcagccgagcttcggccaaaattggcataatgaaaaggacgtcggaaaggaactgaaaagggggtcagagaaacttgaaacgaattatcattaattgcccttaattaatccgttgctaatttccccccttttgccaatgtttcttttggctattctgataattttcggccttcccttcggacctaccaaagtgtactgcttcaaccaatgcattgtgtcgttcgtcggcgtttcgtcggcatagaatttgatcagtttttccacaattgcccttttgcgcttctcaccctctctgccattggcatttcgtccaatttgttcagaatggatgattttttggataaatttgacgagttgttcgtgcccaaatgtgttcagatttgtcacggttaatgcagaaattgaaggtcagcagagaggtagagactatgagtggcttaaaaagggtgggcgaattggataaacaaaatgccaatgccaaatttgtacactctcttcccccatctgagtgaaacatcatgagaaacgaaagagtagccaaaacttctaagaaagagcgcctcatgcggcgaatagcccattatcggtatcactacattgctcgtgcttatgtcctattaccttctcaacggtaggcaacaaattcgtcgtccaaccaaaacttgtatgcaaaatcagtcctatttcgtgccatatcttggtataaatttcataatcttgtttgaaattttgcaggctaatagagaaaaagcttagctatcgcatggtacatataaaatttgattgattttaagcaatgttatacaatgttttgtcgaaaaaattgcaaaaatggcggattttacgaaacgacctagcacgttgcatgataccaaagtaatttgtcataccgaactccgttccgaaattttcgagaaaaaagtgaattttttacgaattttatttttactttttttaatgagaaagattaatatatttaccccttgtacttttccacctccacacatattaccctgccattaccaaaagcagttttgttgcttttttaaaactaata

SEQ ID NO: 16898 - DNA, 1525 bp, Heterodera glycines
tggtttattttgtttatgtatccaccgattccacggccttcgtctgactctttgtccaactgccgccgtttgctcttctttttcaattcttttcgtttgcgaatcttatttttaaaaagatattaaaatatcagcatcaaaattaatttatgccttttgctgtttggtcgtgtctccttgctgttcttttgcttcatctccgtttttcgctgtttcttgttccccattttgctcctgctcgttgtccccgtcaaagatgtcgttgcattccgatgcgattatatatggccaacggcccgcattaaattcgtggatcacacgacagcgtgagttggccggcatttgagcatttaaaacgcaagagacaattttaaaggcttggaaaaacagatggagtctggaaaacaaaaaggaaacaaactattaaatcaaaatgttaaaagttgcgctgacttatagcatcggttcacaccggacacgaaaatgaccgtcttcccaaccagcaatttcaactttatcagtgccaacaaaatggtgaaacgttcctcatcatttagacattggatttgaaactgttgaagttggtctatgccggggagatcactttcctgaaaaataaaggaatggcaatttaagaaaatgaaaaatataaaataattctttcaccttaagtttcaatgacagtatttgaccgacaacaaaggtgcgcttcagttcggtcatgtcttcgttgagtgtcgccgatgtcatcacagtttgaaagtggggcggcaacgcacttttaagacgactgaatataatgagaattataattattaaattaatcccagtaaaaactaacccaatttcatcgcggtaaccgtatgaaaagagcaaatctgcctcatccagcacaacgtgggcaacgtttatcagcaattttggcacttttttaacagcagccaaaagccgaccaggcgttgacaccaaaacgtccaacgactaaaaaaatcgaaaattaaatagcattataaaaattgctgaaatttgctacaacttcattctccaacatttcatcatttgcttctgcatattgtgccaaattaagcgaatggatgaacaccaacgattcactcagtcgttcgagcaaagcaaaaatttgagaggccaattctttagtcggagcaatgaccagcgaaaaaggcccattgctcttgcgaataatggaattctgaaattttatttgaagctacagtttgttttacactaattataaaatcggttcttgtccgttatgctttcccataatcattttatgtgtccaatagtattttttataaaagacaataacaaattatttcattttttacatagaaaagttagggatatgtctaaacgatcagaatgaatttgcaaatctgttggcaacatttcaggcgtagtcccattcaggtgttattattaaaccgttaaattaatatatcactaaatttttatcatatataataagccattttgctaccagattttgactaaaaaatgacca

SEQ ID NO: 16899 - DNA, 2493 bp, Heterodera glycines
  misc_feature (93)..(93): n is a, c, g, or t
cattaatgtttcaaagtcggataaagattttacgaaatgttaaaaaaatatattttacgtcattaagaaattacggaacttatgcctttcccngccacactaacctggctaagttggatacttttttggatgagcggaagcagaaatgccgctgtcttcccactccccgttcgtgcccgcgccaaaatgtttttcccatccaaagctaacggaatcatggacgactggactggtgttggacgtccccaacccatctcggaaatagccttataaaccaataattgcgtttttgaatgactaacagtaagacttaccagtagcaaacgatcatcaaagtcgaaatccttgaaatcggcgaatgtctttgactgcttgccatttcgatcatctgatttcgtggcatcatttttggacgaattgttattcttacccataattagcacttaaagtcttgataattaagcagaaaaataatgaagttcatatatttactcaaaggttcataagccaatatttggttttgactaaaaaagaccatatatttttataagcgaaaataaaataaaacaatggaagagaacaaataaaccagaagatcaaatctcacacatcaaaaagcaaaatgataacagaacagtcaaacgagcgcagaaaaaacaatttaacgcaaagtgagcacatcggatgtcgcacggttgactcgatccatcagaatagctaaaagagtaacataagtaagcaaggaccctgaaaattggtcgggatccgtagaatctcagacggtctcgactttgattgaaatttaaaaaataaaagggaaaataaatgttacctgactgtttgtccacccagaccaaagtgtccaactgcgaacgtaaaatttggtgaatttgatcaagcattgaacgatgatgctcgtgctctttcaagtcgtcaccgctcaaactgtcacctgacaaacgctgaaggtccgtaatctaaaagcacaaatggaccttcatttaaaaataaagcttcaacctgttcacaaagatcacccaactcatcatccaactgcttcatttgcgcatttacagtcatttgaagttggagactaacaaaaataagcaaggcattaaatcattaaaatgcagttttgccctctcccaaattcgacacctgacccaccacccacatattttggcgttgcaaatccgccggagttgcatttgccatgtcacggatcaccaccgacggttgtcctgacaattgctgttggtccaacggagacaatcccatcgttttctccatttgcgtaatcagtgcatccaattcagtctgctgttgagataaaatgtccaactcgcacacaaaacgttcacgttcttgttccaactcgtcaatgttttgacccaatgaaaaaaccttcaaagtctctctgaattaaaccggtaaaaatgacaaccttatcctgagcacggcgtagaacgatgtcaaatgcatttaaatcatccagttcagccataaaatgcttttcttgtcgctcgaaatccactcgtaatttcagcagagtttgttgaagatctttgaaattcatccttggagcagcagcggcagaaaatgtggcagtggaagaaggcaaactaaaagaccattcattgggagagagaaaaatgttagtaaaaaggcagactaatagtaaagataaaattcaactgcaaaatgtatacccaaaaaggggagcagaggttgtggtagctgatggcgccacaaacaacgaggccgtagcggtagtggtggtcattggcggtggtccaaacaacgaggccgtagcggtagtggtggtcattggcggtggcccaaacaacgaggccgtagcggtagtggtggtcattggcggtggcccaaacaacgaggccgtagcggtagtggtggtcattggcggtggcccaaacaacgaggccgtagtggtagtggtggtcattggcggtggcccaaacaacgaggccgtagcggtagtggtggtcattggcggtggcccaaacaacgaggccgtagtggtagtggtggtcattggcggtggcccaaacaacgaggccgtagcggtagtggtggtcattggcggtggcccaaacaacgaggccgtagcggtagtggtggtcattggcggtggcccaaacaacgaggccatagcggtagtggtggtcattggcggtggcccaaacaacgaggccgtagtggtagtggtggtcattggcggtggcccaaacaacgaggccgtaatggtagtggtggtcattggcggtggcccaaacaacgaggccgtagcggtagtggtggtcattggcggtggcccaaacaacgaggccatagcggtagtggtggtcattggcggtggcccaaacaacgaggccgtagcggtagtggtggtcattggcggtggcccaaacaacgacgtcgaaacggcagtggaagaaggcaaactaaaggaccattcattggagagagaaaaat

SEQ ID NO: 16900 - DNA, 2224 bp, Heterodera glycines
ccttttaaaatctttattttatttcaacgacgaaacccaccacgccttgttttcgtccatattaaacgttgtaagaccctgtccccttcgaaattggacacttcattatccatttttaattttgagtttaggacctcaaacggatttttccattagttgtattatgaaatcgccgaaggaatttttcataaacttttcttgaagttttcttaaaattttttctatttgtagaaatttttcagtattttccgagggaggggaacggcgggggggggggagaggggaagaactgctcccattgtttaataaggccatcaaatacatctttgaacggcgctatttgaatagacttggaaatgccaacaaattgtgtgaggacggagagcacgcggaacgactcggggctggactgaatctgtggaacagagaaagaaggaaatgggcggaaatatgaaatgcaaaaatggaattagaagaaatgaattatttcatcgaatttgccaaaaaattaattttaatttcccgtttggaagtgaataaaatcatttaaacatttgttatactaaaagagcaaaaagttgctactagagaccggaaatttcaaatttgtggatcccgctgcgggattggaactcaaaatactttgcgggacgggaccccgcgggattggggactgggatcccgcaaaatcccccgtcccgcgccggtctctagttgctaccaaaccccgtaataaggagtggtaaaaagacagccgccaaagaagcgccgtgaaagtcgattgtcacaaaactcggcatttgaccggccgttgtccaactcccagcaggtggaaaagttcagagaatacagctgcgagttggaaacgctgaaacggcctttgcgataccaactgaaaattgggggagagagtttaaaaagtggagcaaaatcagaaaaatcgtggcggttcacttcatttccaaccgttgtttttgcggcatgtcaaaaaagcaaaaattcattaaaaatgaaagcacggtaattttttttcagaaatgggaattccgtgctatccctgtacaaatgcctttgttacctttttgttaaaatgtttggttttttatggtaactcaaaatttctccagcagaaaattttgacacaaaaatcagctttcttgggactaattaatgcataaaattttttgtgaaaagataaaaagataaaaataagtcattatgaaagagaacatatcaatctacaaaataaaaaatagaaaaagtgaatctctcaacgttgagaattttttaatttcaaaaaaaatcgggtatcaaaacttatgttccaccctaagtagttcctttttaatttcacgtaaaaatagaattttcaagataaattggtgaaaaaataaaaaaactatttgtaggcactcaaaaaataaagtatgtaaaaatacaaatcgattcaaagataaagcttagtgctctcatcaatgcccaccattgtctctaatgaccatgttcaccgctttagtgtaagtgcagtggtcaccggctagaacagacatcggcgcttctcctccaccgttccgcggccccttacaccgcattatcctccgcttcgtatgaatcatcgtcacaactagagaccggaaatttcaaatttgctgatcccgctgcgggattggtactgaaaaattttgcgggacgggatcccgcatgtataaatcccgcaaatcccgcatttaaaatttgcgggatcccgcgcgggattgcgggattttggaaatttcgaaaaattttcaattaaatttccaaaaaacaaaaaatacctgtcattttaaaatgaagttttaggggctggcgggatgcattaaaaggggttaatgggctgatctatatttttaagggtcagagggttggagagagatcggcggacaattgttaatgaatccatccataaatctaactattttatttttaactcaatttttgcggcgcgctttttcaaaaacttttcgggaacagagggtccggcggtgccgataggcgccgccgggaaaattttttgaaaattttgtcaatttcttaatgattttgtccaaacacttttggactcaatttctaccgagttaataagtaaaagccggtccggcggtgccgataggcgccgccgggaaattttttgaaaattctagatgaaaattgagagaaaatggcttttatttgaattgaatttgtt

SEQ ID NO: 16901 - DNA, 1624 bp, Heterodera glycines
  misc_feature (1608)..(1608): n is a, c, g, or t
ttaggtaccctttggttgcatttggggcaatttttggtaggttttacacattttagcaagggaatatttaatattaattttgtaatgaatgatatcatttaacaaagaatttgtgggatgaattataaaataaaaaaaaacagaaaattatgtatttcaattaatgcctcgagaaaggcatttgaaatttcacgaaatttttggaataaggaaattttccatctaagttcattaatttctatgttaaatttttcatctaaagaaatctttcttttttcaggaaatgcatccgttttaggtcatttcaattaatttggatttgagcaatatctcttgaaaaaatgagtggcttttctaagactttgattattctaagatccgaaacttacaattagagaaaccactcgaccaaaatcgacaccgccgggaaaattttttgaaaattttgtcaatttcttaatgattttgtccaaacacttttggactcaatttctaccgagttaataagtaaaagccggtccggcggtgccgataggcgccgccgggaaattttttgaaaattctagatgaaaattgagagaaaaatggctttaatttgattgaatttgtttaaaatgtattcaaaaatatttggcattttgtccttaagaatttcaataaatagtcaaatttgcggatcccgctgcgggatttgaactcaaaattttgcgggacgggatcccgcaggtataaatcccgcaaaatcccgcaatcccgcatttcccaaaaaatgcgggattgcggattgggatcccgcaaaatcccgcgccggtctctagtcacaactgccttcctaaagcacagcgaaaaaacaattaaaaactgagaagtgcagcctttgataaaattttaaggcattttctaataagcttttagactcaaaatcaagaaacttgtcattttcaaaacttttttccggcggcatcgaaattgatcaacttaaaattttagttaaaaaattatgaatttttggaaattaaagaaaataaaataaaatttgcatttgattggttctctctgtggtgcaatggtctttgaaaaattttaatggaaaactatggtgtatgtgtgtggtggagggggaaaacgtataaccttcgtggagttacgcgctaccccccccccccccgcgagttttttattgaaaaatttttcattcctggggagaagaattcccgattttccccggccaagggcctgcgcccttttcatcccaatggttgcactgcatttaccccacccactgaaaataaaaaaagaaaataaaaatgatttttggtaggaaatatgaaatttaattgaaatttttgttgaaaacttggataagattttaattgtaaaaaatgtcttgcggtgtccatgaaaagatgcggtcacaaaaaagacaaaacccccgaaaaaaaattgaatttaatgaattatttaactcttaacaggtaattcgaaattaaatttaattctgagtgagcgaaggttaaacacagagtaaagcgtgaaagaagacaaatgtcgggagatattaatggaaagatcattgatcaataatgcaaatgaatttgcaaaaaatgngaacattgtcaaaaag

SEQ ID NO: 16902 - DNA, 2316 bp, Heterodera glycines
  misc_feature (109)..(109): n is a, c, g, or t
  misc_feature (149)..(149): n is a, c, g, or t
  misc_feature (233)..(233): n is a, c, g, or t
tcatttgaatgctttaatcaaagtcaaagaatgagtttgctgagaaaatcagtaaaaaaaaaaagattttctagcctgtaaaatattaagaaaatgcaaaaaatttcgnattttataatttcaattatactttttttttttgttagatntggtctcaatgaagaaagttacaactcaaaaactcgggctgagccaaaacgactcggaccccttcattttcacccggtaatatntaatattgattgatccgtttgtttttgcataaatacccatcctttcctccttgcttcgttcattctattaaaaaattttttttctttcaccatatgttgcgttgaccctctcgcttctatgacccaattccaatcaatattttatgttcgccttgtccatttcattaattgagtaaatttattatttactgcgtatttttccgtaccaggtgttttcgacagtgattgatttcgacagtgattggtttcgacagtactttttaattaatttctacatgatttattgtatatttgaattaatattaattaatatacactttgcaaatacaaaatttataattgaagtaagtaataaaaataagacttgtatgatttttttgctaaaaatttatcgctttcactttttctatacaaatatctcttgctggaatgagtcaaaaatacaacaaatttcttagataagattctcaaatcgtgtgggaaaatctgctaactaatgccgggtttgagtgccaaaattcaaatctgcaggctcttaagcaagaattcgaaaatctcgaacccctctgcaagtataagagccatgttcttataattttaattgtcaaaatttaacgagacgtatgccctatagaacaatttttttttaaataagctttactgtcgaaatcaatcactgtcgaaaccaacactgtcgagatcaccattgtcgaaaactaacagcacctatttttaatgacgcatagtgacttcagaatcgaaaatttcaatgcagaaatgcttttttgagctcctttcttcaaaacaaaagcaaaaatatttttttatgaatttttaaatgtatgcatatttttagcgcccttttttggcaatattaataattggtgtcccgacgaaaatatgttaaaaatttgtcgggtattttttctaggcttaaaaatgagctgatcacgaatctgatctcagattttgaaaatcattgatttttatctaatatttcccggcgctgctcacctgccacacattgtgccaaacccatgggacattttaaataaaattttaaaataaaataaaataaaaatatttaaattttcaagaattaatcaaatttaaaagtaaaagtaagttaagtttttttaacaggtttaacttaattctgtaagaaaattcagaaagtatccaagcaaatcgttttaagacaaataaaaaaaggattttaattaacggataattgatttaattcaataaatggtcatgtaaaaaaggtggttcaaaattttaccgtttctatctaaaaatttaaaaaaaagcattggggagcggtggtgccaatgtaatcaaaaattcattgccatgccgaacactgtgagagagggcaaatgcaaacaatcgtcttagcctctgggggggggatatcgattacaattttatccgggaatggattgatgaatttggaaggattacaaaatggaagcgcaatagggccaatatatatttttataagaaaaaatattgtaatttttaaaatatacaagagaaattcggtaaaattttatttaatttcaaattctgttaattcgataatttaatgtttcaaaaatttattttatataatattcaaaaggttttggaattaattaaaaaaccctgtgagatttttcgtctttcactacgcttttaaatatgcgaaaaccaccgacagcggacacacatttatttatctgctgtcttttcactaaaaaccccaaaagccagaagcaggccagataaagcatgaaattaattagaagcagtagtaagtggcccgggaccgtagcagcatgacactaattagatgtgacagctggcggggaggggtgtcaattagtcactaattgactgaccggggtactaattggtcagcggtcaagagggcactaattggtcagccgtagggtgtggggtagcaattaattaattaattggggaaacccaaacctattggacgttttcaaatttacatgtaatttttttggtaaaggaatattttgattgattttaaatgtgacagctttttgattgattgtaaatgtgaaagatgggg

SEQ ID NO: 16903 - DNA, 1143 bp, Heterodera glycines
gcgacggcgtcgcgttcgtattgctcccaattttacataaatgttcacaataaaaagcataataatttttgttttaaataattctttttcttttttagctcaaaagcttcccagctcgttcacaattttttattgatggcggacaaaaatttgtcagcaattgatggtaatgttttctttacattttcaatggtctataatttttttgttttctcagaagggtgtctgcgcattgacaccaattcgccaaatggagaagtgtccgcaccaccgctaccaacgatgatggcccgctgtttgcccggggccaatgcggaggacacatttgtcgtcgacgtcgaaagtatgaaacttcaaatttattattagaaaaaaagaaaaaaatttttgcagatacatcacactcaattaatctggtgaattattcggacaccagcagcaacgagacaacttttacctggtaagaatgggggggggagggaaaattttcattgaaaattataaaagctgttttgcatttcagcacaactgatcgtccaaaaagaaaagcggctgaaaaagccatgatgcttttgataaaaccgtaatggttttatcactcctttaattcggcttaatgtttttcctttcatttttgaagtcgatgtttccaccagccttatccccaaccgtccgctcttccctattgtgccattgcctaattgttaggggagactattcacccctatccagcccttccatctttctgccactgtgggttgggttttatacaaatattcttcaactgttccatattaaataaaatacgtcatggttttggtaagtaaaaattccgaaattataatcaaaaaaacttgaatagagaaccctgaccaaaaagtttctatggacaggttacactcttaatttgggttatcaagaaagtgtataagtcataatcgaaatgaaaaatttatcaacaaaaaagctgcaagcaacattaaaaaatctacttctctaatcatcaaactcgctttattctcgatcatagtaatggaagattgcacctcgaacattgagtaaatcatttactgacatccctatttctttctaaaaattttattaaacagaaaatcatttttaatttaattaatatgattatgc

SEQ ID NO: 16904 - DNA, 604 bp, Heterodera glycines
caatcacgaacaaccatcaagcattcccccatcttattttcccccttccaatttgctctgtcatttgtgcatccttccgcccattcttccattcgccaaccggaaccccaatataaatcaaagggtgaagattcaatcaatatagcttctcctgtccccagcaacatttttttcaacatctcatgctggacaaatttggcgaccaatccgcgcttcatcacctattatttatttttacacaattcctcaatggtccaacctcaaaggattttgttctccacaccaataaatcgaatcctttaacattgttattgcggccgagttttttaatgatgattggctcattcttaaactttaactatggaatgccacaaattattcaaacttcagcaagaatttttttggggggcggggggggggaaacgacgtgggggggaaacgacccgggggggaaacggcgggggggggggggggaaacgacctgctccggaaatgttctgatttcgggctattgtcctaattttattcttatttcttaaaattctcagaaaatttgtaattttatggcgtaatgtcacttagattttcaaaattttccacggcg

SEQ ID NO: 16905 - DNA, 873 bp, Heterodera glycines
ccccccccccctgcctacgcccttgattcagaccatgtatttttgggcccagttagacccggacctgccgcggggtcgggtatcgggattgtaaaaattgattaaaaatatttaaaaagaaagttttaaaaataaaactaactcattacgattttttaaagtcggaaaagtttttttacatcaacttgatcagttctttccttcatgggaaaaaatggcttgtagaaaattttagaaaaaatttctaggagtgaaaatttttaagaaagtatacaaaattctcgtttctgaatacggtaatttattgttattttaatttcaataaatttaattcgaaaaattatttttgagaaaaaatttgctccaatattttttaaatgtgattttgttttttttaattcattcattttttttataactttgacagttcgttttctctgcggtcgcttatctcattctcagcgctgcccgtgaacaaattttcaatgcgaattgagaaaaaatacgaaaccaaaaacagaaaaaatatttttggtttttggaataaaagggaaagaacaaacaaaccgcgaaatgactaacaaataactcttgatcattaattgtacgctataaatttataatatttttgttggctccggtttgctgcaatttccaattacgaacaaaaatcggaagacaatgacaaatttggcatttttttcggaatttatcgttacgacgaaattatgccgtttgactaattcgttttgccgttttatccgtcgtttgtcgttcataattttgattggccccggtcgggtcactcccgacgaaggattggagtcgtttaagagtgtcccgtcgtttggtcaattgccttgcagttttagg

SEQ ID NO: 16906 - DNA, 811 bp, Heterodera glycines
taatatcgtgacctgcaattgatgcgtcttggaaggtcggcggagagcggccaatgtcgttgacggtgaacagaaattctttggcgtagagtcgctgcatcagcatcttcgccttgtccccaatgcacacaattttgtagtcgacgtcggccggtttgttggccataatgttttttgcggtctaaagcaaataatttaaatggaaaaacaaccaaaaaggtctcttaaaagtagtttttttacttaaaaaaccaaaggggcccttttgtttgacaatttcttatatcccaaacccgaaaatttgaaaattcaaattttgttcagttagattagggattcggaactagtcaaaattgatgtcactgatcagcgacccgaaaaaaccgacaacaatttttaagacaaagtgtaatcaaaaaaaattccaaaccaaaagtgtctcccttaattaaaatcaaacacttttaaacaagcacacgataaggtgtgcttaaaggaaagtaagttttttgttgttcgatttcgggtccggtttgaaattagacagaatagtgccaattttgtgttagcgaacctgaaaactaaatacaactaaaggtttagccatcccgaatattacaatgacaaattccaaggggaatggacccatcacacactttccccatgtttttcggcttaaccttggcaaccgaagtgtgcaccgatccgcacagtccacggtcgctgctcatcagaatgagaagccgttttcggcccgccgattcgacaacactttcggcaactttcaccggctccgtttggtcccccgcgg

SEQ ID NO: 16907 - DNA, 1218 bp, Heterodera glycines
gaatttttcaaaaaaaaaaaataataaattttaaaaaaatatttaataggttaaatttttaaattttttaccatgtaaaaggtaatttcaaaactgttttttagtttattttattttttttaaaaagatcaaaatattttaagtaattttacattattttggatttttttttttgggaaagttacaccttttttttgcggcgcgctttatccaaagagaatttgagaaactgtggggaaggaagggtccggcggtgccgatatgcgccgccgggaatgtaatttttaatgtaaattgttaacaaattttgtccaaaaaatggaaaatttagcgattttgagcaaattttcaagaaaattaagttttttttgagtccggcggtgccgataggtgccgtcggaaaaaaaattgaaaatttctatgcaatttattaacataaattgtacaaaaattgctaattttttgaaaaaaaaactcagaaaaattccgaaaaattccgacttttcatcaaaaatttcggaagtcggaattccgaggccccaaaaattttcggaagtcggaagtcggaattccgaccccaaaaatgtcggaagtcggaactcggaagtcggaattccgtgccatccctgcagtgcatgaaaaaaagtaatttttagccatcgttaaagttaatatccatcctatatactaaagttgagtgtccttatgtaacctggcgttttgttattgtggcgtgctgttttgttttgcgttaaaaaatgatttgaaaatgaaaatgtttttgttttgttttgcgttaaaaaagcatttgaaaaatgaaaatgtttggttttgatttttcaatttgttttgcaataaacattcttaaaattgtacctatttatttgctttttatgtatgttcatagtttattaagttatttgttatataaatttttttttgtaaacgaaaaaatttatcagtatattgtttgagtttgatttagtggttgttgtttgtttgtttgtttattttgtttttgtgttctttacgtgaaataattatgtttatgcttaatgttatttgaacttttaatgaaatagaaatgcatatctttggtttgttctgtgactttagtgtgagacactaatgtgtgtcatgcttttgaaaaacattagtggtttgttctgtgactttagtgtgagacactaatgtgtgtcatcctttgaaaaacattag

SEQ ID NO: 16908 - DNA, 1348 bp, Heterodera glycines
agtaattaggaaaatcttattccttggcgtgtgaggagtttgacagtgatttgatttttttaaatttgaggcaggcgggtaatacctctgcatgtccctcctattttctgaaaaaaatggctcttatatgtagggtggggatttttaggggcgaaaaattccaatttagggacctaaataggggcaaaaaattcgcgaaataggggcgaaaataggggggaaaaagtttcaaatgtaaaggtgaaatttattaaattgccgttttctctatgtaataagttaaaattaaggcaaacaattttattcactgatagcagttagaaatgaagtacattccgaaattttcggggtttaagggtcgattcttaggggtgtatttttccaaaattttttgggtcgattcttaggggtgtatttttccaaaaatttttgggtcgattcttaggggtgtatctttccaaaattttttgggtcgatttttaggggtgtatttttcttttttattgcattcttgttaataaatttcctaaaaatcgcgaaataagggcgagaataggggcgaaacgccaaaatagggacaaaaacttattttaggggcgaacactcaaaatagggatttttaggggcgaacatccaaaatagggattcctagggtcggataggggcgttaaaacgaacatttcgaatcccgaacccgaattcgaacaaaaactcaaaaatccaatttccgacaaaattcacatttattgcccaaatcaatttaaatgcacgaaatttgtaatgaatgagattaaaaacaatagatttatggatttcgttcacaggggtacataacacttacttgagaccaaaagttaaaaaatacatcattataatccccaaagtgctttcgccacagaaagtaaagttcaacacaatcaaatacagcaaagtcccaaaatatgcaaattttttaaaattggcgtaataatcttgtgatagacaagcagatggtagtgtgtatgaatgttttctttgtgatgtgaagtttttgggtttttatcgttttggcgccgccgttttggcgccagcccaagttttcggactataacttttttatttgttaaccaaatccaataatcttggtatcattcgaaagcttaacatgtttagaagatatttctaaactattacttcacgattagacaattaccaaaaaagttataacatgaaattgcaaaaaagtcgaaaattttgaggttttttcctaataacttttttagaagctaagatttttgtttgttttttgtaaggctaatagagcttgtgaatggctttcgaatgataccaagattgttagatttagtca

SEQ ID NO: 16909 - DNA, 924 bp, Heterodera glycines
agaaatccacgagattgtcaaaaataccattcttcattgtgagttgtcgatagtacctttttatgcatcatagagaatttcttacgagttttttttgtgaaaatttaaatttttcaaaaaaatatttttttttcgtgagtggcgggaatttcaatttctttttttttataaaataaaattccttcagactctgaaattcgtggcaaatgcaatgagttgaacgatgcactcaagcagttagacctcacggctacaccacacaaaattcgcacaactcccagcaaacggcgttcattcatcgacatgcacggtggccatggaaaaaaatcggaatttcgaggccttgaaatggcagggaatcggacgaaaaatgttcgaacccggaatttcgaggcctcgaaatggcagggaatcgggcggaaaaatgttcgaatccggaatttgagacctggaaatggcagcaaatcggaattctgagggcaaaaatgattggtaaacggaataaactgagttccaatgcctgaaaatgataggaaaaaatgttcgaaaactggaatttggagacttgaaattgtaggaaatcaggattctgagggctaaagaattagaactcggaatttcatttgttcgaattcaaaattccgaggcctaaaaagaggaaatcggtattctgagggctaaaaatgataggaaaatggaatttcattggcttaaaatttagaattccgaacttcgatttgtaaattgattgtttctttttcataaaattctctttgttttattatgtcaattaaattttgatttttaaaaatataattaatttaaatttatgtttatattttgcatacaattaaattcatatatatatatatatatatatatatatatatatatatatatataatttatttattatatatatat

SEQ ID NO: 16910 - DNA, 484 bp, Heterodera glycines
cgccgggaaaaatttgtaattattaatgcgatttgttaacagattttgcccaaaaaatgcgatttttagcaaatttttaaagattaaggatttttaaggtccgctttaattatttttcttactttttaaagaaatgtcaaaaacttataaagtagaattcttcgaatggaaaaaattaaaccagaaaattgaaaaaaaaaaacatttataaacagtatgccaaaaagattttcgaaggaaaaagaacaaattttgattaaatcctaacccggtaaagcccggtcaaaaatgccgggttccgggccgggttgcattttcaaaaacgaccgggttccgggcccggcctctcaaaacccggtcaacacggatttttccaaaaatcgccgggccgggttgccgggcccgggaaaacccggtaccgggcccggcacggctcggtctctaaatcatttagactttctgaggttttttttctttttgaagg

SEQ ID NO: 16911 - DNA, 1912 bp, Heterodera glycines
tccgtgcacaacaaaatttcgtttgtagttaaattttaattttccaacaaataatttcattccaatttcaaaaaaattcaataatcatacacatcaaatcttttaatcactgttgtacctcttctatttactgttgtacctcttttaatcactgttgtacctcttctaatcgctgttgtacctcttctaatcacttttgtacctcttttatcacttttgcacctcttctatcactgttgtacctcttctaatcacagttgtacctcttctcatcactgttctacctcttctgatcagatttgtaccccttctaataatgttgtacctcttctaatcacagttgtacctcttctcatcactgttctacctcttctgatcactgttgtacctcttctaatcactgttgtaccacttctaatacacttgtacctcttctaatcacttttgtacctcttttatcacttttgcgcctcttctatcactgttgtacctcttctaatcacagttgtacctcttctcatcactgttctacctcttctgatcagatttgtaccccttctaataatcttgtacctcttctaatcagatttgtacctcttcctaaaaaacgggcgcgaagcgcccgtctgaggccgcgaagcggccgaaaaggcccaactaaatttaaaaacgggtgcgaagcgcccgtctgagctcaacaaatttaaaaaacgggcgcgaagcgcccgtcagagcaaaacaacatttgaaaaacgggcgcgaagcgcccgtctgaggccgcgaagcggccttaatagcccaacaaatttagaaacgggcgcgaagcgcccgtataagcccaacaaaatttaaaaaacgggcgcgaagcgctcgttcgagcccgcgaagcggcctaaaagtcccagataattttttaaaaattccaaatctccacaaccagagctaaaaaaaccgtagttgtacctcttctgatcacaattgtaccttcccacccgtggtagcaacatttttgcgtagacctgacatggatctgcggatcagcactccaaaaaatctgctgcagtatttggtcaaccaatacaacaggcagcaagcacggcaaaaccccaatgcccaacagaaaactgttgatgacattggcagtgttgttcggctttccgaacacaacgtaaattctctccaatattggaagaaaatgtatgaagattgcaacaccgtttttgcacggtgccatgacgcgaagaaagcgcgtctcttcattactttcacgaacaacagggaatggcctgagttcaaagagaatttacacaaaaacggtcaagtatttactgaccgttttgacatgtggatgcgtgtctggagcagcaaaatcgctgagttccgagaagaactttatgacaaaaagttcttcggaacaatccttggttacggtgaatcaatggagttccaaggccgaggaggcccacatgcccacattgtggcgcaaacagacctggacgcagttccatatgtcattcaggaatacatatgggcgcacattccatctttgcctgataaagatgacgacacgcccattgcaaaaatgcatcgcgaaatccgcgaaacaatgcatatgcaactgcacagatgcagtgacagttggtgtggtcctagcgacccaatttacgggcggtgcaagaaggggttcccagccccttactcaaaatgtacgattttgcgcccggacaggcccgcgatgtatttccggccttcaccaactgatggtggtgcccaattagaggtaaacggcctaatatacgacaactcacatgtcgtgccgtataatccttatattctgctacgttaccgagtacaccataatgtactgtttgcatatggtaacaaagcaaatattaaatacgcactcaagtac

SEQ ID NO: 16912 - DNA, 1368 bp, Heterodera glycines
  misc_feature (1306)..(1306): n is a, c, g, or t
aacaacgaaaaagaattgagtctcgcgagtttaactcagcagaacaagctgagccgtaagttttttcattttcaaattttatgaatttcccgaggttggctattttttcattttccgatcgggtagcccttgtatttgtttcctcgattggtcggaataaattgcgtttggccaaaactgttcctgctaaatttgatcaactaaggaaaaagttatcttaaagttttgtctcagactcatttggccctctccgtcctcccgtctgacattcgagaaaaagctgagtaacttcaaacactaattgattttcaaatcctctgcagggtcggacttttttatttttgtccggctaatgatcgaccattacggctttacgtccgaccaataatttcttttcttagatttgatcgaattgtgtgaagaaataaagaaaaggaaaaatttaaatgcggaaatattttcaaaaaattggaacaaaaagatggaattggaaaaagaaagggaagaaaaacaatgggccgaaagtgtgaaaaaacaaaatgaaattgcggggccatacaaaatgatacagaaaatgcattttgaagagcttaagaaaagcataggaaagccgaaaaaggacgaggaattgcagggaatgatcacaactttggtgcagggtttgccacaataatttaatttaaataaaatttttaagaaattaaaacttaagatttacgggcaaacaaaaacaattgtagagaaaatcttttgagccttttactgattgaagacagaaacgaatttttaaaagaaataattaacgaaacgaaagaagaaattgatcaaacagaattagagaagaatttggaagaattattaaatggagaaaagaaaaagaagaaaagtaaaaagagtaaaaagaaaaaaatcggaaaagaaaaaagcgaaaaatcaatggaaaacacaaaagacacagacagagaaagagaagaagaaaaacggggcagagagcaagaggaagaaaaaagtgaaaatggaaaaagagaaaactgtgacaaaaacgaaaataaaaacagtactaaaacgacggatggagaaaaggcaaaagaaacggaccaaacgacgaaaatggcaataaatgagcaaatgttggcggaagaactgaacaaaattggcacatttaaaagtggggaaatatttaaaattaaaattttaaataaaaggcaaataattaatttaagaattgtgtgatgagttaacattgaatgagctgttcaaaacatttatttgctcaccttccgtggagagacttcttataattgancaagcagcaatcatttgttaaaaagagcagagaatggaagcgattgaacagctcgaaaaagt

SEQ ID NO: 16913 - DNA, 2332 bp, Heterodera glycines
  misc_feature (2210)..(2210): n is a, c, g, or t
atagtaattttaatggttgcacgtggccgggaccgagccggtccttccaggtcgtcccggtttatgagcagcacaggtcccagtcccgataggaaatcggaaggctggaaataagcagtggcaagaatgtatttgtgagtgaaatctcgtaaaggaaattagttagaaaagaaaaattttaacgaaaaataatatttttcacattattttttgtttttttttcttggaattcccggttggtcccagtcccggtcccgattgaaaatccaagggtcacgatcatagcaaaattctcgtttccgtgtaattctaataattttatttaattaattatttgttcatttctcagttaaaaattttcttgggccaatttatcgttcgaaatttgcctccatcggcagagcattcggaagaacactttgaccaacaaacaaatgccattataaattctgtccgttgtgccgtggatggatgggtctgtcaaattaagtttaattaatttaaattttgcgccttttcaatttccgtctgccaagcgtggcgcccggcttctgctcaccgggtcgcatttgctgggcacccaaacttttgactcggacatcgatttgatttgcgttgtgccgggaaaaagcgtaagacaatcggactttttcgggaaagcggagacggaatgtaaagcgaacaaatgcagcgaggagaagcaaaagcaaaagtcactgttctgcattctttgtgaggtgaaaaaagaaaacgaaattcgaatttgagtaccgaatttttgcggagaatgtcagaaattcaaaaaattgactcaaaaattggaagtagcgtaaatttggtttgagttcttgccaaatgcataaaatgctttttgaaaataataattttattaagaaagatattttaagtaaaatatttcacataaataataataattaaatttaatatttctttcatgataatttttgtaacttcgtctctccacattattgagcatatatacatactagaaagattcttaatgccaaatgatcaattacaaaaaagaatttagaatgaaaatgtgagtggcatagtgaagatcaattacggcacagtgccaatgctcaaattgaaatttggtggctttgacgtggacatttctttcgtttcgataccggacaggaaaaatttgccaaatgttttgagcgaagaaacaatggaaaaatatttgaacaaattttattcggaagaaagtgctaaatttgacaagcaaatccgaattttgtcgagtaattttttgtgtaaatattcataaaatataaaaattaacgtttaagttattaatggaacccgggttttgaagcgtttgtttattttatttttgctaatgggtgcgctaataagcataaaaatatttctaatttgtttggggcttcgaagacccaatttttacatgcttaactttgtagagttcgaaagttttgctctaagtgagtctccccgttttttgcatatttttatcaaaatattttttctatcaaaaaattcacttttagttacataattaaaaaataatcattttaaggttattgttcaaatttatacataaaaaatttgttaatggaaggccacaaaactgaaaatcataatgaaaatgataatgaagaagaaaaatccgcaaaagtgctcaaaaatttacgtttaatggtaacgacattaaaattatgggccaaaagtaagggggaaaatgcatttccagtattatttgtactttttaggcaacttaatctattcaaataaatttggctttttgaatggggtcagtctgacgataatggccacgaaaatcattttgctttacccaaatgcgccaattttgtttttgctcgagaaattctatctaatttatgcgaaaaggtaaaataatttattattaattataaaaacaaaaacttagagaaacaaaagtgccaattaaactaaaattggtggcaaatgaatcagacaaaaaacattttgacgagaaaaaaattgccatggaagaagtgatgcgaatttacacgccatcatttccagaacaaaacacagcgaaaaatgtcactcactcgacggaaaaaattatccgtaaaaatatggacgaaggtggccaattaataaataatcattaaaaataaataattaaatattactttttggtgttaagcattgaatcggattaagaaaatgancaaagaaagcattgactggtcaattctgatggtaaattcagaacagttcactcaaaggtgaaaaccgatcaaatttattttaaatggtttttacttctcatattttcagttttcctttttta

SEQ ID NO: 16914 - DNA, 1539 bp, Heterodera glycines
tgaatttaaatagcaaagaaataaaaacggtaaattaattgaccttcaaagggccttccgcgagaattgtccttaaagttggccgccatgtctctttacggcgctgcgaaaatgtttctcgagacgggggagcacccggccgtcctcaaagaggcggtgcagagcccgggtttgtgcctccgggcaattagcagatgattaatcacaattagtcaccggaaaacgggctgggggggggaggagccttttctgttgggtcgattaatccttcaagtttttctcggtcctttccattggtctctctccacaggtggttcgaccattttcggcatccacgaattggagaagggcggcatgcgcggtttgctgatcaacgcggtggaggcggcctctgagcgctcccggcgaacgggcgaagcggcgctgccgcccggcagaacgtccgtaatttatcgaagcgaaatttaatgtcggaaatgcaatcagtcggcagagttcagtttatataatgccaaattctctcagagaacgaaacccttttaaaaaatttttctaccccctttttataccacctcctctttctttttttttttctttttcgcatttaatttaattgactgtcatgtacagtaaacaactttgatcagaagcgatcgaatcatcatttttcggtgggttcaaaccccaaaaacgaagcaaaaaataaataaatattcggtggaccgatcgatcgatgcctttcagctgtgacgatgaacaaagtgacgaggaaagctcacaatcggacggcactttctcttccgatgatgacgaatctgagggtgacgcgcgaaggaagtgacggcggaaagtgccggaggggcggcggaagaacggccgactcggcacgccagcgcaattttcattatgaaaaacaaacaaaagacagctaattagtgaagggcaaaccaaatggccaaggagacacttcaaatggtagcacgaattgaccaatttacaaataaaaaaagaaatggccaaaggagcggggaaccgttgcgcatttggacaaaagggtgcctaagggagaggaaggagcatcgatggcacaatttcttaatacttcctttttattttccctctttttgtcggcaaagcttctcttcctttgcttctgttgattttctcaattgtttaatttgccgtaatttcgtcgaacgtttctttcctctgcgaaatcaccgactgaacatataaaatcaaaacaaaaccttcgtttggcccattccctcgccaattttgtgacggatagcccccagggggggggggggggggggggagtgccggcggggaaaataacgcggaactaaatttcatgcattttcgtttcaatccgagtagaattttttttctcaatagtgtccttttattaattttttttgtggtggacggcgcttacattttttctcatcctcgtcgaatattcctctctctgttcccgtcccgtccctcgttccttacccctcccccctatttcgcctaatctcccatattccctta

SEQ ID NO: 16915 - DNA, 3072 bp, Heterodera glycines
caaaaatggaaagagagaagccgaagcgaacaaaaagcatcgtcaaagccctcgccccccccccccccccaattggcgcgcctttcattttgccatttaaaaatgaattgatgaatttactcattttgaacttttcccgttatggtgaaataattaattttccttttcacttttgtctttctccacaactaatcttttgggccttacagataattaagcaattattttataaggacaaacaattgaatttaattatttcgtttaaatacgtgcagtaaagcaaaatacttactgaattgtcaaatttgcctttttcaattaatgccagtgccaatttgtcttgtctgtggcgctgagaatgctaaacaacattacggaagttggtgctgcaacggatgcaaaggcatggcaatttggattttggactttcaattaaaattattctaatatgggtttattttgagggtttttttggcgttccatttcatcgaaacgccgttatatatgcctaaatcgaaactctgacattaagtgcaagttggaagatggtattgaccataccgttcactttgtggggtttaattccctttgcctttttcgggtcgtcgcaattgctgcagggcgtgccgcctgaagcgatgtttggaaattggcatggacccgaaatgtaagtcagtgggaagtccaaaagcaactaaccagcaccgaatggtttaagtgatccgcgactgctggggaaagtcgcccacgccgcaagggccgacgctcaaagatcggtgccgatcccttggggcgctcgattggaaaaatggaagagaaatggaccgaattggcactcccaacccagactgtgttgaacagcaggcaatttagcgactaaccaattaaacattgttaattaatttgcagccttccgttatgctcccgtctcaatgcaaaaagcaaagtgacgcaccccggccaaacacttcgaatttgtcatcctgcaatttgcaactgctcagcgattacctggagtgggtgcacaacattcccgagctcaacatgctcaacgaagatgaccgggtgaaggaggacgagaagaaatgaagaactgtcagatgttccctcacatttaatcccaaattttcttcagaattttttggttttgtgccgtgcgcgtccgtccgcttggcttctgttggcccatcatcggatgcataacaccgaaaacagaccgaacattgaattggacaaattggagcttttgttgcacaatgaaatcgtcggtccgctgcgcgaattggaaattcattcagtcgaattcgaaatattgcgaaatgtctgctttttcagcactggtaatttcaaattttacaacccgatcattggcaattttcggatttggagagagaattttaaaggttccattaccaagtgatcagaatcatttctgagcagttgggatgagagtacggtgatcagttatcactttccaccaattacttccaactgtcgggtcgtttcactttggccccagcaaaaaataatagttttcacatgaaatttaaaaagaataagaagaaatttagatggagagctgttttattttctaagtgaaaaagttatcatattttcggaaaaaaattgttaaaatttaataaaagtgcgaaatatttgctaaaaactggacgaaaacgttagaaagttgttcaaaaacagaattttttttctccaaaaatgcttaaactgagcttcaaaatattcacttaaatgcaaaattaaaaactttaatttaaaattaaaagataaaaaaattttccagtgccccaactgagtgaggccgggcggcggttggtcacttcagtacaaaatgcccaactgagaacactcagtgaattttcgctcagtcggattaatctcattgaaaaagccaacgaaagtccgcttctgctcagttccgtgttcaggctgaataggatgatgaacactttgttgacaattgaggtgaaaaagccggggatttgacaattggcactcactttttcattttcagaaagtcgccaatttcaaagggtaaattacacgagtgattaacatttttgatcataattatagctaattaattacccttgcatttgattgattgaataaaaccgcatgataattaatgaatcgacaaattaaataatttattttatttttaacaaaattttgtcaatatgtgaacaatgagcactgtctttttgattggcatcagtgctaattgtgcaaatgttctaaaataatgcgtcggcaatggtatttctgacacttattcgatgaaccattcggaaatttcctgaatttatttattttgttttattatggaatcttgcatttctcacaaaaaatgatatagcattggtttccggcaatttttcgttgattcagacgacataaattacgttcagaagagcgaatggaagcaaaacaaattcaatgccattgccattcataagaggaagtgcaacggtgtgtcaaaaacccgccaaaaatattctaagcagcatcaaatgaaaaggaaaggcaaatcaccgaattaaaaagtgccaaggaatgaatccgcaatatttccggaatttaaagagcaaaattggctcctgaccaataccaattagtgcagtgtccattatgcggtcgctctgttggaacagttcgggtgtaacattgtaagcacttccgctggcaatcgctcccatgcaaagatcgcccgaagcgatcaatggaaggcccgaaaagatgggaatgaacggaaaagggacgaaaagcgcatttagcctcttttggggttgaaaagcgaattgtggccaaaattaagcgcacaaattgtaaaaatggatcagcaaatactgcccaaagtgggaaaaatgagcaatttacgacgagaaaatccgttgaagcaaatcaaaaggcaaagtgaagtcaaagcctaaagcggtataaatatgtcatttaaatgtcaatttgaaaatgcaaatcgtcttgcggaaatgccatccaaaaagaggcgcgttgggagtcgcttgaagaaatcccgacattttcaaatgc

SEQ ID NO: 16916 - DNA, 4628 bp, Heterodera glycines
  misc_feature (3114)..(3114): n is a, c, g, or t
  misc_feature (4609)..(4609): n is a, c, g, or t
  misc_feature (4619)..(4619): n is a, c, g, or t
atttgaatttttatgttgggtggtcggtcccccgtcaccacagagcagttacatacatatcatctcaaatccccatcacttcacttcaattctttgatattttgatcaaacaaaacggggagggacaggggggccttaatgttcccattctctacaaattattacaattattatccagcaaaagtgaacataattaagtgcaatttggaatcaataaaaataaattgcataatttattttttaaaattttatttattttttaattcttcaaatttaatggagtaataaattcctcaaaatgagcaaaacctgcataaattggacattttctttaaatttaaattaaatatttaatttaccttttcaaaaaattattaatttaacaaaaatgattttttttttgtgtgaaaaaatgaaaaccaaattttttaaaatatatttggaattaatttaatcatttaatttttcaaacattattttgtgtacccattttgtttcaattttgtaaattttcttatcccatttttattggcctgtaaaacaaatccctggaaagccttgaaaaaatgagagaaaaaatttcccataaaatttgttgtggccaaatgtgggcgccttcgcctttttcgttctgtttggccaactgtacaaactcaacacacacacaaaccaccaaattgcacttcctgcagctccattttttcttcttcagacgcacatattttatttatttttttctccattccaaagggtccgtccaaatattattattttatgtgcaaaaattgcaaaaaaaaaattctataaaaattgggcattttttgttggggtctcaaaaatttaggaaattttaaattaaatttgctaaatatttttaaaaaaaatttacctgctccaccaaattttgtattaagggtttatggctccccttttttttttttaattttttgatatgttgagtttttggttttattttccttaaaattttcaattaatgatggagctaggctggcctaaaatttccaatttttccccactagactttttattttacatttttttaaaatttttaaagaaatttgtaaaaaaaaaaatctccatggctcatcaccaccaccctctgctggtgatccaaacagtccaatcaaatcccaatgagaacactgcccgaatttgtctgtcccccaacgacaatggccaaattgggtcggccacctgttccgaactgttccctgacgatgatcggacaacgggggccgaaagtgtggagccatttgagcccctgggcgattttccggtttacgaaaatttgcccgagactcaaacggacggcgagcaaattttgactgaaaaatctgttcgatatttggcttttgaaccaccaaaagcacaccaccaacagcaacaacaatcggtagcacttgcttctcgtcaattagcgatgctcaaagactgaaaatcccggggactgaaaaggacggaattgaaaattttaaaaatttagccaagtctcgcgaaaatgagctagagagaaagagagaatgttaaatttaattttttaataaatttttaaacgtaacataatttttttaagttagatatattttaaattcctaggattattttttttcgaattatttagccattgtttttaaaaataaatcaaatttatactttatttaaaagaagaattgtaattttattaactttaaaataataattttctttagtattttttcattatttcaaaaaacattaattaaatttttttaacaaaaaaatatttttttaatttttgaataaacaatattattatatttattattatttttatcacttttccaaaaataataattaatatctaaaaactactgtattttaatttttttttttttttaataattacaaaaataaaattaatttattaatatttaaaaataacaccttctctataataattttatttaaaaaaataataaaaaaacataaatttaattaattaattttttattctttatgtagcataagaccgtgccaaaagagcgcctacaacagcaagtccaagttgaagacaaagctgttcaagcagaacaaccacaacatcaccaacaacaacaaccgccgctagggcgacgccgcgactttttgttggtgccgcgcgattacggcgcggatttgcacgagtggtcatcaacgcgcagcgaccacgacgcgacagtcgcaatgccgcaaccgcaaatggagcagcaacaacgacagcatttggcaccatcggcagttgcggatggcacgttgtcgtccggcacttcgttggtgcgcaaatcaaatttttgtttattggacaaaatattaaattaatttgcttttgtgtatttccgccaattgggcgccaaattcaaatttgaaatgtttagccatcaccgccaaaatccatcctgcgccagccccaacagcgccaccagcagcaccagcaccaatacacgtttgaacggcatggcaatgagccgggccattattgggaggaccggggcgaaattggcataaccgtcgacgatgaggacgatgccgaagagcagcgggcactctacgaggccatggtaagaaaattctgtaggtcatattgttaccgtatatcggcaaacaaaatcccaaaaaaccattcgggtttgtgtagcattatgtaagccacactgttatcgtataatggcacgaaaaattcccgaaaaaattttttttaatttgtgtaaacatttcaattgtttggcattttgtctgcaaatttagcagcgcaatttggcacttcatcgtcagccctcgccccaccctgaattatatccatcggtgccgtttaacggcccattctttcgcctccacgaggtgagcccggacgggcgcgccacacgtccgctcaacgtcaacgcagtcccatctggcgccgcggtaaacgatgtgacacatttattggaaagggtcaaagtgcaatttgtaaatcgattaggaattgattaattgcctaattaggtgatagcccataatttggtcagcagttaaatgaaatctgattttcgcctgattgatcagttaaaagaaacaacaaaggatggagccgctgtntaattaattactaattaggcatctcacttgataagcacagtttgatcaattaaaagaaatctgatcactagtctgatcagtttattgattggcctgattagctaaataaaagactggtgattgatcacggaattatgacagtctaaggcaattcgatcttatcaaattctgaccaattcattggctaaagctgacctgtcctaatagaaaatggatttttgtatcaatggactaactcctttctgattgaaaattatgatcacttaggaaattccaaatcactgaccaggtcaataaaacttcggccggtcatcctccaacgtacgcgccccaatatcaaacgcgtccaccaatgtcacctcgccgagctgccgcttcaggccgaacttccaacggcggcggcggcggcattgtaaaccatgcaaatgcaatggcaccggctccccctccaccaccccctccgccgcccaccggatgggcgccaccgcgtcatcttcaagaacatgtaattaattgcaattagagagtccaatgtccattagtggtgatgcccaagagtctcgagagttccattaactcaaaaatggaaatttgtcggtttctaagtcttgggaaatttgtaaaaaatgtatttcctctaattgagctttaatggcagcagggggggggggtactataatagaggaaatacggtttttacaaaattttaaaaaatatccaataaaaaattatcgcccaaagatattttttcaaattgaacgaattttctaagcttcgaaaaaatcgatcgtttaaaaaaagtcagttctatcgatttcaaatcatagtcaacttgactgatggtatctatctgtatgtgagtgatgatctgatccgtttcatcctccgcaacaaattgttccgaattttgataatttttatgcttttcaaaaattgaatttctccccatttaagcggcatgccgacgacgacggcaaagcccagcaacaacagcagcagaggggggacgaggatggcggtctcgttgttgtgtggcctccatttccagcaactgatcaggaggaccagcatgacattgatcaagcagctgatcagcaacaacaaaatcgcccgcctaaggcagaggcgccgacgccgaaaaatgtgcggcgcgactttccggaagagtacgcgcgccaggaacgtatgcaagcggaagcggagcggcaacgggcggaacggaacgcgcggctgcgcgaaaaacaggtggcacattggctgggcgaaatgtatggactagctgatcaggaaaatggttatatattgattgatcagcgcccaatatttttcgttgatagaagaaagagaattgtctgtctgattaaattcaaagcagacttcaattgtgatcagtctcagtgagaattagatcagtccaggacagacctattgagggatcacactccaaggaatttgatctaagcagtccttgaaagtatttattgaaaagaatgantttaaccganttaaattca

SEQ ID NO: 16917 - DNA, 950 bp, Heterodera glycines
taccatttgaaagctcttgacgagctgaatccaaaaatcagaaatgaagtcgaaccgatcccatctgagcacctggactactaagtcccagttaaatctcgccccacctactggccgccgtagtcgagtgtgcggcggttttttagcgcaatactcgatattcaaggctaaacgattttcgtgcattatataaaaacttttttattttttttagtactgaagtgtccattttcatcaggactcagttgtcccagtgcttagatggcatcggttcgaatttatacctagttttttagacttagctgatcaagagctttcgaatgataccaaatttgtccgaatttgaccgttttaaagggtcaggggcccccatattcactcaatttttcgaattttgaaccggttttttggtttttccgcaactcgagacatatttttccatgcttagctcctcgagacgaatcgattggtatatcatttgacccttttttcacggggcgttcactatagtttatccaaaatttaaaaaaaaaacagaaagtgccaacaaaatgttattaaatccaccaaaattaacacaaaaattttttttaatgccattcaaatatataaaatttaatatttgcatggcaaaagtgagtttatggtcgtttcattcttctgccatctccaagcagaccacgaaattgttcgctaataatggccaacaagtcgacatggaccttacttaattcgtgattaaaacaaattggtgaatggatgaaggcatttattctaaatgtgtgatggcatttcatgtcaaaatgtgtcgtgtccttctcttctcttcctctccttttttctgtgctccctttttcgtttattcttccgtttctttccgttttttcttttcattcggaccccaaagttcgttctttttctctcccaattcatcagctgacattttggcg

SEQ ID NO: 16918 - DNA, 941 bp, Heterodera glycines
ttttcaccgtattttcgctaaagaagccatttttccgttgtccgtcccaaattgtcggcggcaacggatacttttcgcgcactttgtacttttccaatgggctaagtgagcttaaaaattcattttaaatttccaattttcaaattttatttgaaaatttctaatttttcttctccaattttcaccttttccccagcgtttgttcggcctccaaaaaatgaacgtcccaccaaattttctgcagttttggatgcgtttgtcgtgcgaatttgtgggttcccaaaaaggcgtacagatgattgaaattgcccttaattaaggcaaattaggggaactgggcgtccatttaatttaatcttagattataattcgttttatatttttaacacttgcacaaatgtacaccaatctcattgactatgtcttcttcaccgaatggcactaacccaaaagtctggggtttcctcggcccaggtccagcaggccatttttcgacaacctgtatttttgtccaggaaatccaggtccaacctaatatggaatccaggccatgttcaggctttttccaaaattctgagctctaattggggcgtatacagtaactttaatacttttttcggtaccgtatgcacccgattgtcttattaccgtatgtacgctgatcagagcgtgtgccgtgagcacagcttcgtgtattggaacattggacattgacagagagattttgttttgaaaattggaaaaatgttggccaacattgtccgatccctcatgctgttcatgcaactgaaagtaaaagaataataacgataactgatcaatgaacatttgaaattggccgattccttttcaccgtgggacatttgcgaactatttttgtaaaaaataaactgtttttgaggagtcacccccaactcatccatacccaactcatccataga

SEQ ID NO: 16919 - DNA, 1234 bp, Heterodera glycines
tgctcatcgtctgactgttccccaatttttccaccgcttttttttaactttttgctatggatggtatgggcctaccgatttaaatttaaataaaatttagatttttccgctggggagcggggaactttgctgttcgaaaacacaaatttgcaacttcttttagtctattttctgtggagcgatgccttccgtgaccaattccccgtgctttttgtctcttccgccgttttgtcaattctccaaaatggttccgacctgatgatccccggtattcgattgtttttttttgtggaatctaaagacaaatttcccctaattttatgcgttttgctcgaccctccgttcgccgacttcgaagcgaatgcgccgattgccattggaattatcggcggaaaaggcgacgaggtgggaaaatttccatttttttatgcaaaacaaggaaagtagttcgtccaattcagtacacgcaaaaaaagtaaaattctaaaaattcctaccggagttctgtttgtattcggatttgcccaacaattctttagttgcgttttggccctgtggcggttggacaatcgctgttttcagcggcggaaattcgtgcaaaacgacagataaatgagcggggaaaaggtttgagttgagcaaaattaaaaactcactaaaattaatattttcagcgattaaaattcttcacgtccatggcgattcactttggtttgttttttgcaggaaatatcctccttttttatgtttcacttatgcgaaaaattatttttttttgaaaaaggcataattttccatttttaaagggaattcggctctcgaaaaccaatccccaaaatggtcaccaaaattgacacgacagaaacttctgggcaaagtattagcaatcggcaaacgcacaatcagtacgaggtattaaattcgtgtaaaatctcaaatcttttgtatttttggttttaaacggtttaaggatgtccagcaacaacaacagtcatgttcatcgtcgccaacaaatttgacatcgcaaaatgaagatgaaactgtacttcgggagaatggagcaaatggtggcacaaaaatagcggagggggacgcgggacaggcggaaatggacgaattggtcggttttggttgttcatttttcaccgcattttcaaaaaatttacaatttcattacaaacattctgtttcgagcggggagggctatccccctcaaccttgctatgtgtggcat

SEQ ID NO: 16920 - DNA, 2073 bp, Heterodera glycines
  misc_feature (2028)..(2028): n is a, c, g, or t
cgcttctcactcacaagcagcctttttagtgcgtttttcctaccaaattttctcccccccccccttacaattagttaatttttcaaataatctctcttattttaaccaggtgaatcacagccatcccctggtccaatctgcgcctgaacctgaacaaagaaaggatgctgcacaagcaggggttcgtcctcaattgaaattgtcggaatttccattttaaattcttttcatttagtcgtcggccgatgcccaccttccgtttctgaccatccgggagaatatgttctctttgacggaaagagttatgcccattttccgaccttacggttggttttacttttaaatagctgataatgaggggggggggggattttaaagtcttaaaatttagtttctttctttttgaaaggctttagcaagggcgacattgtggacctgaacaaaatccgggccgttctgcttgactatgcacagcaaaaggttggagaacctggaaaaaacgtcaaacatcttatttattgcttatttttttcccttagaatttatgccgtggcgatggcaaacaaattgaacttgacgactctctgcaaacagttgtgcaacactttgtgtacgagaagttcgatgtcaacaaattggtacagaaagtagcatctacaatgacccaggcgctgctgatccataccaaagaaggcaaaaaaattgtgcaccgtggcaccaaaatgtcccatattgaactgaaggtgggcgagggccaatgctgggaaaattgtcaaaaattacaatgacttctggttcaagctataaataagcactgtttcacttttggcagattgagagacgggctggcaacaaagtggtcactttggtctccaatttggcttcttttggcattgacgcgagcgcgttggacagcgaaatccgcggcaccggcacatcgattctcgcaacggcacccgcctgtgaaggaccccaactgttggtccaaggcaacgaggtgtattcgagaatagtgttgtgcttcgataagccatctttcccccttttcagattaaccgaattggtcgtcttctgaccgaatttgggttgcctaaaaaattcgtcaagggccttgaacaaggcataaaggagtcaaagaagaaaaaaaagtgatgaaaattaaaaaaaaagatttgttgacccaacacatttcatttttgtgccttttttttattatttttaaaaccatttgtcaatgtttggtcttcacttttgggtctcaatacggctttggtcatttaaatccaacttttcatttatatcacttcagatcacctgaaggagtggtcaggtcttattggtgtatttgacttttttgatcagaattgaaagattataactagggataagaatttaagtattacttttaagtaatttttcaacggtaggggtcagtttcggttttatgaaaccaatgaatttaaaatagtctttttttgtgtaatttgtggcgctgatcacaaatatgacctttgtttttcaaaattcagaaccccaaactcgaacgaaaattcggaattcataaattacaatgaagacatatttttaggggttttcgaggtggctgaaaatggatatggcatccgttttgccctagaaaatacccgaactcgaacaaaaaaatcgattttttctcaacaaacactcggatgtaatgacaactcgtaagaaatgtaactcgtataattgcttgaggttaagtttcgaatttttgttcgggttaaggatatgtaattcattgaaacggatgtcatataaagcctaaagaaacaaattttcatgatttattatcacaaaaatttgcaaaggtcccaccccctttggttttttaataaattcaagataggttggttaacagagaaaaaagttaggctctacttcagtttatgcgtccaatcgttttttatgcgtccaatcgacttttatgcgtccaatcacgttttatgcgtccaatcattttttatgtatcaaattatgtttatttgccanaaataatggttttatgctttcatgagtcaaaaagtttgccacact

SEQ ID NO: 16921 - DNA, 1689 bp, Heterodera glycines
acattgaagaaaaatcagtccatataataatataaatttcaatttggtattcccggcaaattttttggccttatcttcagatggcctttggatgcgcagcccgaccggtgccaagtgatcaggctaacattgtaatagctcaaatgggccatgtacgagcccagtgggtccgtctgttgttgtccaaatggaagcggtgacttcaaagcgggctcaagcgctccgctgcactgaataccgtcagcactttcacacacttcataggcactgcccgtggtcatgtcgttgttgtaccaaacctaaccatgatttcaagacaaatttatagggctttaaattaataatcatcattagggagaccaaaaatatgcaccaaaaattgtaaaatatgcgcataaaaagtgaaaaatatgcatataaattttcccaagttgagggtaaattttccaaaaaattcatcaattctttaatgtaaagctacatataaatcttaaatttaactaaatatatggaaaattatttagaaggaaaaataatttttaaaaggttacagttttattattatcgagaaaatataaaaatttgaagtttttaaaaaagttttcaggttttagaggtcaaaatgcccgctttaataaagggggtaaaagatttttataccgtatctttcctgaaatatctcatgaaggattagaattatatagaaatacggtaactatcactcacttcgtaacgatggtggaacagcgagtgttcatcattcagcaataatttagacggaagccttggaatgatgtcctccgaatgtaccactcgatatttgtggggtaactgtcgaaaggatttcggaaaattttttttttttcaaatttcaaaaaatgcctcagcaaaatttcattttttgaataattttatattcctggtataaattgtaccaacgaatcaaagtgacgcgcaaattcgaggttgccagtccttggctgaccaaagctgatgaagcgtatttgctcggctgttgtcatcccacttttggccacccacgcggcggccaatgccgccaaagaaccgcctaatgaatggccaaagatctgttggtcgatcaacggattttgtataaaaaaaattgggagacacttttcgtttttggaattttgtaaaatccgggcccacatttcagagaatgggttacttttctgttctggggcctcattttcaaggcaacggcgcgaacgccaatggaaaggataaaataaattaagaaatggacaatatttaaaatattgtggctttcatacatccacattaacccggcacgccacagacggaaaagtacctgagatggacacagggacgcccccccaggggggggggggggctactcgtggaacatactccataacggaactgagtaactttgtttttgaatgttttgtcggcagccatgtgtaagccgggaccaccaagaggccctgaaattgaacaatcactttgggtaggaacaaaaagaacacaccaacaggccgaccagtccgcgggtggttgtaggtggacgtcttgttgttgtgatcgataaagaatggcacaccttgctctgtgatacgcatttcccagccttccggcagcggagcatccgttaacctaaagacagtaatccatgtaatcataaatatatttgcgctaatcactctg

SEQ ID NO: 16922 - DNA, 1060 bp, Heterodera glycines
  misc_feature (68)..(68): n is a, c, g, or t
aattcgatcaaattcaatcacaatcaaatcaatattttttattttaaatcaatgctgtggttttactntaatcaactcgcattggacttcatatcgtcggatgatcaatgcatcagcagcattattttccaggcaaatttgtgccttaatgaacacaattacagtatacccccaccccatctgccatatcgtaggcattttttttgtctcaatttatacccaaactgggattgtggaattagatcccggatatttttaattgatgggaattctgaaaattttctagagccctgaaacagaaacaatatctgcgcaggatttttgcaggaaccctggatactgtaactgtatttttgggggaaaactgcaggaacacgactcttttttccgctgttttttccttttcatcaccatttcaaattctgtttcagttccggcatttttcaaaattccgggctctaaaattttctatgctctccagcagtttcgtcgctgatgctgtgtcaattttttttaaatctaattcaaaaaaacgctcacttggtgcaagttttccgcatttgcggccgcaatgaatggcaatgccctgctgcgtgcaaattcgtccaaaaatccgaatttgctaggtggactaatgggacagttgtacgggtgccggatgcgctcctgtgagtttaacacacattatggtaattagtacggcatttttgggtgatgattcatgacggtctatttttccataattttgatattgctattttaaatcaaaaatcgacaccgtttgaagaagttttgtccccctttatttttcgtgggttaccaactgtaagagtgccaaaaaatattcaaatattcgttttttttaaatcactcttatccacctgctgggtacatttgctgccagaagctgtcagtgaccagccactctcacagactcggcccaacacacaccatatgaatagaaaacagtgaaatttgcgattgcgtattgtaattttggtgaatgagctccaaagggttcccgaagagggattatggaaaatgtgccactaatagtaca

SEQ ID NO: 16923 - DNA, 1420 bp, Heterodera glycines
agttagacggaaatgagtattttttttatcaaatggatctttatgctaattttcagcgcccaaacggggattttgttatgcctcgggccaaaattttcaaaaatttattcatcacaccgccttgaatttttatcattgctaattctcgaagcatttccactcacttttcttcgtcaacacaaatccaccgcacaattgctgcttgcaaattgcgtttaacatctgtgaacaaaaaaaaagagaagcatttgtcaatctagaacataaaagtttatactcgcccgccggtgggattcgaacccaagacctttccattccgtgcaattctctaacccactgagccacgggcgctcccttttagacattctcccatatcctttatctcactttctcccacacatcgcttcctatggcatcacaacaaaatggaaaaaattttcattccaagatgccaaataattttaaaaaattcgaatgccaaatttgaaaaaagaaaaatccgacaaaatactgaccattgtcagctttaaaccgcacagacggaaaccgcccgctccctccaacgcattgggggcggaagagagcagcaaaaggacgaacaaaaaggggagaaagcggaagcgcggactgccggactgtgaagcaatgcgtctgttgaagctgaaccagcaaggtgggagtttattgagagcgggaattgtgaagccgagatagaggagattaagaatttgtctatattacggtttgaaacaaagaattgtcccaagatccgagaccaataatttcacccgggagtcaaaaccgagaattgaacatgagatgaagaccgagaattgttccaaattactggatcaagaattggcgaatgatagcgagagcaagaattggcccaaaatctcgagatcaggacttgaaccgagtctgcgagagagagagaaagagagcgagagagatagagagagaaatagagagagagatagatagatagagagaaatagagagggggggggagagagagagagcgagagagagaaattgagccatagagagtcgagaccgagatgcaaaacccgagaatttttcgactaacgaactaacaaataagaccaaaaatctcgaattggactaaaaattacctgctgccgccgatggttgctgattgttgcgccgctattgtgccggtggtcctctgctgttgcccaacactgttcaatgccattgccatgtgttccagttcaatctaacaaaatgagtacggctggcggcggcacaaatcagcaaaaaatggaataaggagggctaaaagaattttttgtgtgtgtgacttttagtacagaaaattacaggttggctgtggcacaccaattaaaaaatgccaaaacgaaatgccaagattttctttcataaagtgcccttttca

SEQ ID NO: 16924 - DNA, 1664 bp, Heterodera glycines
ataaagtgccattttcacgcatacactcttacaaaacattatctgctttatttccacacccacgcaccaattcccacccccagcactcattaagctcacaatttaatggtgccacaatgccgacaaaaaaaaaattggtccaaaaaaaggccacggaaacgcactaccgtaatccttggtcctccgcccgcccgtccgggtctgtcacgcactccaccagtcacaatggcattttgcctgccggggtggcacacggaatgaatgcgtccccattgccccgccggggacacgaacaacacacctgttgctggcgcgttattaaaattgtgaaagtgtgtgaaatccgccgccgctcccatgggcggaaggggcgaaaaaatgagggtttgtttaactaagggtaaatgcatgtgtgtgcgtgcccccgggggataaaatgccgtccttcccccactgaactttttcccaggggcaataattaatttcatagaggaacaccaatgattatcataatgatgatgatgacgataattggtaatttgatggcgtaaaatatgaaagggattaagagggcaaaggaatgaatgggatggatgaaatcggatttataatgataattagccttaattaatgcaataaaaatttggataaacaccattggtcagcagttctaataggcattttgaaaaatggaagtatttaaatttatttgatagagtcataatttgaatttgctgtcgttgtcgtcgtcgacattttaaattataatgcacttttaaaacataaaaaatgaaaaaaaatacttcatttgaaaattgcctatttttttttgtcaccaatggacgccaccaaagacggcactttcgcttttaattgaattgatgccgtgggaaaataaacattttactcggctacttaaaagtaattagggaaaatgtgaacgggggggggggatttgtgtggcttttaaaaaggggagtattaagcaaaatgccaaaataaagctgatggcgatgaagatcatggtggtggcatttttgtgtttggaacgaaaataaacaaattgaaattggcatcggccacatgacaaaatgggaaaacagttgcagcagaataagccatcagcagaaaatgtcagtttactatttttggaagaaaaacatagaaaaatttttgaaattccattttcggtgagaaaatttttttctaaaattttgaacaattaaatgatggttggaattgacaaaaaaaaatacgtcaaagaggtaggcttcgtttatggaggaaaattgagaaaattttcaacaaaaattttgatgagaaaattttgtttaatgaagaaatttttttgatgaaaatgttaaagtttaaatttaaattaactttaaacagtataaaaaatgactacatatttttcaaaatgttgaaaatatgcaaccggaaaaattaggaatattaatttgcaatttttttttttgagattttcacccaaaaaatgccaattgatgccgattggcatcacaggaaaaaaaaattgaaatataatttattcattttgtaacatgtaatgtaaacatacttctttaagcgaacataattaaattgaaagcaagtgcaaaggtactgtaatatatggtaagggggctgtgttgttagcctttccg

SEQ ID NO: 16925 - DNA, 2800 bp, Heterodera glycines
  misc_feature (183)..(183): n is a, c, g, or t
aaatttttttagttttcccccccaacgtaaaagaaaaaatttggggactccaattttattccaagacgccaaccccttcccccgatggggttggtgggggggggaggggcgtcaaaaattttgtattttgggggcacacaaattccgttgcccgttagctcggatcgggcaacctctctttcncaaggacgggtataccagttaacaagggacattagggggaaagttccattaaattcaagaacatttaaaaattttgtcatatgcaatgaaaatgattaaattttacccaaatggtttatatttttcgccggaatgaagttttgattaattttgatgaccatattttacttttcacaacacttcttgcgggcgcttttcgaagacttgcaaaacttgaaacataaactttcggcaaggccataaattttcaatctttaatcaataggaatttttgtgtaagtaggcatgacttaaattatgccatttctctgaaaaaattcaaatgattatgacaattacaaactgaataaaatttgttccttgtataataaataattggcataatttacaattttaaatgcatcggaatttaaataaaatagtataaatagcagttatataatcaagaacggattttcgcaaaacatgtagataaaatagcaaaaaaaaattccataaaaaatgagaattaaggacaaaactctcactcatgtacaaaagaataaaaaattattttaaagattattttggacaaaaaattttacaaaatcatgcattgaattattttaaaatattttacataattattcttatatatcaaatttttcttctttgaaaaacttatttcggatgcaaaggggaatcagagaacccgattatataaattttatcaatgaattgcttttaaaattacatttaaataataaataattaattttacatttagccaaggtattttatcgtaaatctaaataaaataaaaattaatagaatagataagtgtgaaatactgaatcagataaaatgacgcaaaaacaaacaacggctgtgtcaacatcaccgacaaatcggcggagaatcaacgagcactgagagccgtgcccgtctggtgaaactgccgcagtgaatgtaatgtaaaaaagagacattaaaaatattacaaaaaattagtttattaaaacttaaaaatttgttttttaaattattacttgttgcgtattaaatgttaatatcttctaaaaataagttgtttttttaaattgaatttgaaaaaaaaaactaaaataaaaatctgtatcatgtaatataaaaaatttgaattaaatattttagataacaaaaagataatggaaaatgaaaacaaagcgctaaattttattttataagaattacattgatatcattaaaaattaacatgtaaaatataaaagtagataaataagagaaaaataattcctttatcgccagaattttaaaaatgtaataaaataatttcatagaaaacagcagctggaggtggttggaaaagcagaaatgttcttggcagagtcttaactgtaattagtaaacgatgcatttgacaaaagaataattaaatacttattgaataaaacaaataaatggtgaattaataatatcaaggaaggaggccctccatacattaacacaaatccgagatttaacaaaaggtatctatttaaaaataacaatataaatgcgacttgcgcaattcataaatgcacaattaaaaaaatatataaacatattataaaaaatcattcattcaaattttttactcacaacgtaaattttgtttatcagataatatttaaaacataactaaaaaggaaacattaaaagataaattcagaaaacaaataatttatacaaatcataaaatttctaatagattaatctatctggcaagtaagaaaattatataactaacgtcctttcggaacaaggagttaaagtgataaagtaaataaattaacaaaacaaaatatcaaaaatggaacattttacacccgaataactcaaaatgtatttgatttgctattatgcggtcgaaaattataaagaataaatttttcttgcattttatgcataaaacaccggattttttccaacttttagcacatattttggtatttttaaaaatatttaattaattttttcaacgcaattttgattgagtattgaaacaaaaaagttgtgaataagtttaataataattaataaaatttcttgtaaatgacacaataaataataaaaaaagtaacttattttatacataattatagaaaaggaataaataaaaattatgatagaccctaaccttatcctgcattatgctttcttctcctttcaacacagtgatgaatctgataattatgttatttattttctaacttaattaattttctgaccgggaaagaggaggatgtaaattctgaaatgccagtcttgtgcaagatggtatccttcttgagcattattagtacttgtcaaatttgcaaggactgctgcatggtggttccattcaattattggaaacagtggttctccattgttcacaataacataagtcctttaaataacaaaatagaacgaaataattatttcttttgcctattaatcaacttccgaaaataatcaaaaattggttgcgaaattggatttggtacttgtcttagtgcattagagccatcattaacatgatgaactggcaacaatgcttaggagcaagtgatctcacatttattctcatttccatatcagctctagagtccccggt

SEQ ID NO: 16926 - DNA, 3387 bp, Heterodera glycines
gtagaattgtagattatattcattataatggtattttttgtaatcaatttaaataatcattttatttaaatgtttttaccattttttttaattcattcgttaaaatttctttgtattattaatctgaataattgtgattaatttttttaatatataagatacaatataatttttttaaatatcatcgcttggacaaattttgatttaagtttttatgttaaagggtaatatcaacaaaatgtactttattcaattttctaaaaaaaaattgtttttatttattattagcatgaatttttgttatttttttaaatcggttcgttcattggtctgttattagaaataatacatgtaaatgggtttttattattttcattttttagtttccgttttaaatttcatttttccaaaattaaaattctgtaaggaactcaattatttttatatctttttataatttcctttatatgttattaatttttgtagtataaataaatatttttcaataattttgaaaactcttctatccaaaagggaaattaaacccaaggacaaacactgaaaaacaggaggttttaccactttgcaacatatatctgtgtagttccataacagcaataaataaataattttttgtttttactccaaaatttctcctttcccgccaatttcatatttacgtctcaataaaattcccaatataaaatgccaatcacggatcaaaatcttggaaaaattgaaaaaatctgtgacccgtgatcacggcacccccaaacccccatgatttcaatgacctgtgatcacggccagccctgggccatgatattttctatgtttattttattccgtcctgccacaaatggctgctttatctgaattaattttatttgtttcaaatcgcacaaatttcattaaatatacatgtttaataaataaataattattttttttctttaaattacttttacgccgtccccccccccctggttccccaaaagattttggcaaaggtgcgccgcaaaaaagaggttttgaaaaacaaattttttttttgctttaaatgaatagaggaatatgtaaattttggtctccaacccacttggtttctttaaaaacttttggatatttttccagcgattaaattcagttttttgttaataaatttaaataaaaaaatcattcagaatttttttttataatcacggatcactgaaatcacggtgtttttgtgggctaaatatcccaattcatgcactcaataacaattgtccaattacacattgtaataacattatttgtctgttaattaaaaattaaaacacgaaaaaaacaaattaaaaataaaattaaattaataaatttagatttattatcaccataattttgataaagaaaggattttaggttttcatctacttttctaaattacaactatttaggtaccgattttactattttaagcaagtagaatccgttgtcatattaaaaattcaaaggtgataaaaagagtatatgaaatatattaatatctaaaatatattaattcaatttacttacatatgagattattaaaaacaaaataaaatataaatgtaaagatcggattagtagtgaatattaattaaaaaatgtgaataagttcaacggtgaagaaaaaaaaaattaaattaatcaaaataaaatctcagagaatagatttatcaataatgacggaaaaatttaatgttaaattaaattagaacatttattgaaagtgtaagagaatttttatggtgaaaaatgtaaaaaataaataaaccctatcaaatgatactctgatcaaagactggaaatcaaaatgtcctatgataaaggaaattacttatggaataattcaatgatatttaaaatactagaaatatatttattttgttgaagaagattctgttgaatagaaaactccctattatacttccttaaatactttatgcataattcatagtgacaatcaatcaaacacaaatatatagaaaatcatatcactgtctttttcactaataccaattcagctgtaattattcaatttttttatgaatattgataagaacaaataattatattatatttttattctcacaaaagaattggatataaaaaagagacaaaataaaataaaaaacactcattattctgttattgaaaatattatttatttgaaaacaaaattaaaatatattaacgaaaatataaaatctataattatagacttgacaatattggacaacaccaaacattataaaggagggagtgaccaagaaaaatataaaatattttttaatttaggaacaattaattaaaaatatttatatagaagtcatgaatcaatctgaattgaaacaattaatgtacacaatctaaaaacttaatgtaaacgtcaaaaggtaaacaaaggaaagaaataacattttcataaaattctatagtattttataatattattatcacaaagtttcataaagtaacggaaaaatacttaaaaacaataattaataacaatattttaaaaatacattataaaaaatgtaaatgaaaattaaaattcaaaaaccgtgcaaagaattatttttaattattaattatgcgaaagaaatacaattaaacaaaaattaagttaatgaagaatgatttattttaaatttattactacgctaaccagcttaattatgattggttcacaaagtttgatataatcagaacagataaccatttttaatagaatttttgaaattattcataatatttttgtaaaaattatgaacaatcaaaaaaacttaatgagcgaatagaaaaagcaatattttaatacaaaaaaaattcatttaaaactttccatttaaatatatacttattaatatttaaaatatttgtaatgtaaaaagtgcatgaatatttggtgaaaacaattattttgttaatttttggtgattaatgccatcattttaatcctaaaaatattttaaaacaatatttaattgaaaaaaataaaaattagcaccaatactttattaatcgtggttggccacttcacaaaagtgcaaatttgggcgcctcacaaaaaaagtgaaaaatcaaaaaccttattttttctatgatttttattaattttttaaattaaaacataatttaattaaattgtgcttaaatacacattattcttaaagttttttggatctcgaataaaataattaaaatttacctaatattaaataaatcatcagcaagattacttttaattttttaaatattcaatggcgcccaattacaaaataaagccaaaggtagtatttaagcatcaatttattaaatttaaaatatttaaatttaaaaaattgataaaaaatcatagga

SEQ ID NO: 16927 - DNA, 2730 bp, Heterodera glycines
tggctcatcatcggcaccaagctttcgatcagttcttcgttctcgtcgtgtttgtcgtgcacgtacggtgggcatgtccaaaagaacttcacttgctggaatcggcggcacaaattggcaatcatctcgtattgctccatcatcacttcaatggtttctccgcccaagagtgaatctcgtccgacaatgatcagtgcggccttcactttgctggagagcaccacgggcttcaggcttcgcactgtctccgccaatgttccattttttggcccgatcaccgccgtttgatccaagatttcggccaattggtgggctgtcgaatctccgattatgacacgtggcaaggcgatcagttttgtggccttgtgaatgattttggccctcaatttctccagcacccacggtgtctctcccatcgcttcttcccatttcttcttctcagaatcggccaaatgattgagtccgacgggttcgtccatgccgatttttttgaatccgctctcttccaaagcatgctttgccacggagcacttttcgaaccaacactccagcgccttcatttggtcttcttcagttgggcattgtcctgtcgccacatagtctccctttttggtcacgaacagactgagctcctcttttggcgctccttcaattatcgatttgacaaaacttcttgcggctgtcattgatttgacagtcccggccttcaaaaggaacaccgccaaaagtgcctgaagtggagtcttcactgtgattgaacccaattcagcatttccaagcgctgggtccagttctgcaacacggagaatggcacaaaactcgtgttcgccttgaccgacgtcacacttggcattccaaccgaacatgtcctctgcttcgccttcgttgtcaatttccatctctgaaaaagaaatttctcttgattgcgccgccttttccgtttttccaatcattccttcgccaccctttaaattagcaattgcccctaattgctcataatgggccatttgtccatctgattcacagacttcaaaactcgataaaatgctgacaattaatgattttaacgcatttttaaatgggtttttcccctttggaagtgttgaaatgtccgggattcctggaggaattcgaattagacgctcaatcggaacttttatgtgctcagcatttctgttgtcaattgggactaaaaatgccgacgattcgttaatttctaggataagataaggcccgaaatgagaccacaacaatttcttgtgccgagatcggcgattcagtccgggaaaggcaaccattacgcgttgccccgcttcaaatttgttagccgtcactttcggctgggaatcgtaccaaattttacttctcattctttcttcctcagaattttccctcgcctcgttcagcatattcaacacattttcacgaaataattggaggtatgtatcgctgtcaattgtgtatgctgggttgacttgtaagggcacttccccatccatcggaaatcgagcgattttcccaaaaatcagggaaaatggcgaaaatttcgtcgttttagacggtgtaatgttgtaagcgaacacaatgtacggcaaacgttcatcccatgtccagcagcttgccgtcgactttttaagcatagcgattattattcggtttactctctcaacaagcccgttcgcctgggggtcatacccagctgtgagagatcgttcaattccaaaagttttgacgatttcttcaatcgttgaattgacaaattcctttcctttgtcagaatggatttttttcggtgtgccgtatatcaaaatagctttctcaaccaacactttcgcaactgcttcggctgacttatttcggatgggctccgcgattaaatatttcgaaaaatggtcgaccatcacacagatatatttgaactctgacttactggggccaacgtccaaaatgtcgatgcatagcaattcgaatggttctgacgttctaacgactttcagtggaggttcatttgctctcgcctcctttgtatgagcacaaattcggcagtgttgatgaattttcatgcaatctttcagcatatttggccagaaatactgttctgccaattgaagaaagagttttttggcactcatgtgccctgcgcattttccttcatgtcgttgctttaccaaattttcacgaaattcggatgggacgaaaagtcgcaatttgccattatcttcacataaataaagcagtccgtcgagcagcgtgtatttgtggcacgtttccttcaaattttgcgcctgtcttggatcgtccgggaagatttttttctttaaaaattcaagtatgtgcttcatttcactttattcggatgctcgactccacttttctcttttctcctcaattgacgcttcaacttcttccgctgtcagtaattttatcattccaattaatgctttatcttcctccaggagcggttcggcgattccttcgttgtttagttgaaatgatcgcgataaaagggtctgcaatcacattcatttttcctgggtggtattctactttccagataaatctcgaattcaattccatgagccatttgtcgactcgcgcatttccagtctcctcccttgcttttgaacatggggcagaggagaattggtgatcccgtgaggactcttcgtcggaacattgttataaaatgagcaaatttctttggtccgaattccctgctaacgcttctaa

SEQ ID NO: 16928 - DNA, 1907 bp, Heterodera glycines
tttcgcctactaacccaaaaacattcataacgcctactaccttaaaatatatattttgacaacgagtttcaccaaaatatatattctaaattggtttatatttagctattttattataataattaaatttaacctaaaaatacacgggagtaaatagatatttattaaattccaaagaaaaaataaaagtaaaaggttaaaaatcataaaagtaaacattgttaaaatcataaattcaatttccatcggtatcatcagtttcttccttactatcttcatttccacggacgtgaagtccctccacaaagccttgcattacgaggccgatcagatacaaggcgttcgtcaatccttcttcagattcaaagtcggcctcgtcaaggatccgcaccacactttgttctttgatgatgtaccgttgcggtcgttttctgctcttctggagacgttctgctcgtccaatgtccagttgcttgtcgatgtccttgatgaatgctgctatgaaatcactcagtgacggatgatgattaagttcacgctaaattaacaaaaaagtgtcttccaacggacaaatttttactgcaaattgtccatgcgcggcttccatgccgttgttcgttcgctcaattgccatttgagccctggtgtacacattccaaaacgagatcgggaagcgtggaggacagacgatgtcttgttcccagcgtagaataagctgcaagctgctttcttcggacaatgtaatcgtcggagttgatggttgtggtgaatgcagtccgaattgtattcgtccactgcctgtcattatggacgcctgggacacactgaacgctaaattatttaaaattgtattaattaccatgaaaatagcatatgcatttacgagttgtgctttgagtgcgacgtagaaagaagcgtccgacatcagcattgggtccaaatgcctccgctccacggtcaatctcgaattgagttgtgccaatgtaggttttgccaaaatacgccagccatccttgaactccaagcggtgccgcgttgacaataattgaaaaagcatgccaaacgtaaactggcggaatgagtgccaaagaaagaactgatatcttttctgtttttgataaatcgaaagcctgtaaagaaataaaaatcaaaaaaactattaacaccttgataccaaagacaaagagctccccggattgtttctccacgtttgaattgaacgggctcacaattttcttcgtcatcactcgaagcgacgtcaaaattgttcctttcaatttgttgttctgcgtctgtcctctcaacattcagtacgctgtcttcatttgtagcaatgcgaggcttttttactcgcttttgcagactctcaagtatttcgcgaacagttggcatttcttattagaatctgaaatttctgtttttgaagaaaatttgaaatgacataaaaatgaaatgaatgatttatttgatgcaaaaacattatagatattgtatattctctctttttattttctctttggcattatgtatttccaataggcgaaatgaatgtttttggtttggtaggcgaaatgtcagtaggcaaaatgaatagtaggcgaaatgtcatcgtgccactattttaatgtccctagcacattaaaaaatagaaattcgcaaattctaataattttggttgtaaatgtaaaatcactctagacatttagaatcaattgaaaaatgaataattttagcattttgattggaatcagttgtcaatggcctgagttataacgtgataaaaatttgagatacacaacttttttcatatatatcgaattgcttagcatttgcccttagaaaaagattctccttttcaaaatcttttaataaataccaaattgttcagtttagttgggaatgaagcg

SEQ ID NO: 16929 - DNA, 2482 bp, Heterodera glycines
  misc_feature (17)..(17): n is a, c, g, or t
  misc_feature (59)..(59): n is a, c, g, or t
  misc_feature (133)..(133): n is a, c, g, or t
  misc_feature (187)..(187): n is a, c, g, or t
  misc_feature (202)..(202): n is a, c, g, or t
  misc_feature (214)..(214): n is a, c, g, or t
  misc_feature (233)..(233): n is a, c, g, or t
  misc_feature (236)..(237): n is a, c, g, or t
  misc_feature (251)..(251): n is a, c, g, or t
  misc_feature (273)..(273): n is a, c, g, or t
  misc_feature (308)..(308): n is a, c, g, or t
  misc_feature (338)..(338): n is a, c, g, or t
attttctctccaaattnattaaaattttccatataataaaattcatataatcttctaantttatactccaaaaacaacccaaaattcaaaaaatttctttaatcctattaaatttacaaaaactttcttatantcattttaaaaatttatttattttaaattataaacccaaatatactattaaccnttttattacactatntttcttacaatncaacattccaacctataanttnnaaaatccatataanctatataccattccatacaccnacatccacttatattcttaatttttaattttaacnattcattccacctacttcaaaaattacatnacctctaaaatcaaaaatttagctgtgttttcacataaaattggtggctcattttctcaaattcctaattttgggggtcctggttcgaatccaacgtaaaaataaataaatttaattaaatttttaaccaattaaagattttaaaaatacatttttaaatatgaaaaatgcattaaaattatttgttgaaaataaatgtgttctgtcattgtaaagtggagaaaaattgatataaagtgaaaaaaagttgaaaatgagccctgaagcataaattttcaaatttcgaggccctgtaacttttgaagcaggcggaatgcaccgctaaaattaaaaattcacaatacaagtcgaccccgctctatccaatggtatatagcttatatgcattttcccactcacagctcggaatgttcccttgttaggtgtcaaaaataaattattaattaaatttaataaagaatttttattagaaaaataaaaattattagggacaaacctttcttctcggtctattggcggcgacttgggcatatgtcaactgaaaaatctaaaaaaaacaataaaaaaacggcattttatgatttaatgggggatgtaagccaaccccattttacagtcaacaacatttttgggggtcggtcaatacaagagttttgggtattcgaaaacttaggaaaataaactctttcagaatgttttgaaagtacggtttccttctattgtaaaaaaacaacggccagtttaatttctaaataaatcctattgttttagatttatttttcagaataatttatttaattttaaacttatttaaaactaacgaaatatggaaataagttattgtccactgtcaaacagacccacccaccggtttaacgggcggcgatgagcagtggtcgtcgttgtcaatgtgttcgctggtgcccggccgttgctccgtcgttgttgagcattccatcacggagttggaaggcggcgagcaggagccgaagttggcggaggaaagtttcccttcctcttccgtcgtgtgcgaagaaagcgccttggcctcctcaattggttgtcctcgaaagcgatagtgaccgaactcgggctccttcttcgcgtcgtaagtgtcacggcctcaaaaagacgcactgcaaaaaaggcaccgtaaacttaaaaacgtacaatgctctgccaagtcgagcagcaggaaacactcggacccgcaagacagacgtatcggcaccaagtgagggttgcagtccagcctgaacttgtcctgaaccaacttcgacacttgcgacggcagagccattcgcgtcgaactcggctccatgtcagtccttatgcaaattgttgatgacttcaaaatgcgatgggcgcataacagtggaggcgccgacctgaacatctgctggaacgcgttcgcatccgctggcacaacgaacatcggccgtattttaaactgaaaaagacaacaattggtcaagtcggcaatgcttgctccccaccttataatgatttgtaaaagtgtccacaaattggttatcaaatgcttcagtcggaataattagccgtgttggttcgggcgacgcttcgaattccttctcatagctttgaagcggtacacaatacccaactagccgccttctaaaagtgtttagcttcaaaatactgcaaaacggcaacagtacgttattccgacgtcaatctcgtcttggatgcaaaacagccggacatcgtggaatatttggctggtaatccggtcagtatcaattatcgcataagtgacattcataatttccgtgtcgcaatgcgtagtttcagttgtgttcgtgaaggatgtgcagagataataagactgaaatttggaaggtttcattggctaagttttatgatgttttagaaattcataaattaaataatcataattttgtacaaattttttggaaagaaaaataaaatcaatttgcagcattttatttttagatgctcaataacccaagcccgaagtctaacaagttttgtagtggtcaaaaaaaaaaaagattttttttctgatttcaggagactgaccaaactttgttcagtttttgttattcatgtagaatttttaaattcagaattcagtgttcagaccgtatttagggggggggggg

SEQ ID NO: 16930 - DNA, 756 bp, Heterodera glycines
cggaattcagtgcccctaaaaactctaaaaaaattcggaaatcggaattccgttctcacgtagtatgtacataccacaacaaccattcgcgtgacaatagaactgataaatgctgaccacttcttctgatgttagcacgccgagcggaactgtacaaatttttttttttttgaaagctcgagattttcaaggactcttagaaaccaaaaatcaatttttcaatccacactaaaaaccgcaaaatttcaaatgatatcgaagagattaaaaaaggggaagaataaatgtgaattaaaaaaaaacaacttttttaaagaaaaaacattgtaatattgcttaaattgttgctggcaatattcaaccattttataaaaagaaatcaaaattattttcttttatataaaaaaataaaaagtttttccaataattgttaactatttttttacaaatttttgttgaaaattcctcttttgagatgagcgggaatcgaattttgaacagtgctgggccgagcatggcacgacgattctctgctgagcaatttttggcattttgacagcatttggcgtcagcccaacgaagtgccgaaaaacgaattaaaatttaattataataaaaaacaaaatatttttaattatattaattattactgctttccaaattgaaatttctcctctgatttgcaactgatcacgctccaaaattttgcacaataatttttgatcaatttgcaaaaattcctccgatttgatcaaa

SEQ ID NO: 16931 - DNA, 2815 bp, Heterodera glycines
  misc_feature (6)..(7): n is a, c, g, or t
  misc_feature (1891)..(1891): n is a, c, g, or t
aggtcnncctttttcgatcagaaatgcgtccatgagtcgggaatggcattggcacaacagcaggcatggagttgctaagctctaaaacatttggaagtcggaattcagttccctcaaaaaattctgaaaactgagtcacaagcccttaaaaaatttggaagtcggagtcggaatcagtgcccctaaaaactctaaaaaaaaattcggaaatcggaattccgttctcatgtagtatgcacataccacaacaaccattcgcgtgacaatagaactgataaatgctgaccacttcttctgatgttagcacgccgagcggaactgtacaaaagaatgaatcttagagactttcgctgactctctcttttaaatcaacagtcaaatttaaaaaatattttccatgattaaaaatcgcaaaattcaattctaaaaaatggggtagaaacaataatttctatgaaaaaaagttttgttttgaaaaataaatttaaaacggttagtggcatatttaaacattttttttataaaaaaaaaattcaaaaatgggttcgtttgtttttttataataattttaaaaaatttcttattaattaattagcaatttacaaatttttgttgaaaattcctcttttgagatgagcgggaagcgaattttgaacagtgctggaccgagcattgcacgacgattctctgctgagcaatttttggcattttgacagcatttggcgtcagcccaacggagtgccgaaaaacgaaattgtaatattagaaagcaataattattcttaaattataatttttattattactgctttccaaattgaaatttctcctctgatttgcaactgatcacgctccaaaattttgcacaataatttttgatcaatttgcaaaaattcctccgatttgatcaaagtgtcggcatatttatcaatatatgcgaaacaaggttgagtgttgatcatctgaattaacaaattattaaactaaaaaaagtatccttgtaaacaagggctttcatggcaaggatttaaattctaaaaatcagtccaaaataaatgggaaatttggctctgaaatgccaaataaaaataaaacgaaaattaaattaaaaattgtttcttaaaaataagtttcaagtaccgataaaatcctaaaataatcaaaataaaatgtccttatgagcatataatgaattaatttaaatggctggtccacaatcaggacgttgctggggttttcatctttttcccccgaccctgaaattatcattcccgaatcccccgactttcgaggacacaaatcccaattttaattaaataataaattacttttaaaaaatatataaataaaaattctcgccttattcttgctgtttccttgcccatatgataaatgagcatctgccaaattttctacgctcgacaaacgcttgaaaaattttgccaaataatccgatttggtcatttcatttttgtggacattgccagagactgtaaaaataataattttatttttaaagtatttaaatttttatcaaaaattaaaaaaatatagaaaaattgtataatttttcttgtcttaattttggcattttcaaaagaatcttacagtactaccaaatttttctaccgttctcatcttgcgaaggcatcttttgcacccattccatttccatacttctcaaacattgcaattcttcaactgctgatggtggtgtcacattttcaaatgttcctaaaatattatttctaaccattggaaaaaaacaaaacaaataaataaattttatttaagttttggcgctatattttatcaaaaagtaaaaacaaaaggggagacccttttggtttgcaaaattttttaatatatagtcatgaaaatttattccctnggggttcttggggtccataacctcgaattagatgtcagattcgtgatcagcgacctctaaaatcccggataacataattttcatggttttttatcataaaaaaattttgaaaaacaaaagggtccctccccccttttgtttgtgataaaattcaaaaactgccgcttttcatatagcgcctaagtttttatttctttttcaattaccctgatcagctgtaaattcatcatttgttgaatcacgagaaaaagacatatttttttatttcctataaaaagatcattaataaaaaaataaataaattttcctaaaaaaatttctttccatacaaagaatttgtcgctatatggaaagtcaccacttttgaattttatcaaaaagtaaagggaggggggggccttttgttttgcaaaatttttttgtgataaaaaaccatgaaaattatgttatccgggcttttagaggttgctgatcacgaatctgacatctaattcgagatcatggaccccaaaaacccccattgaacaaaaatggtgactttccatatagcgccaagaattttctaataaattgcataaggttgccaaaaattatagttcatatcggcacaatcgaaccaattgcgaatagaattttcaaaaaatttatatcaaaggttccaaatttaaccatttcgtaattttaaaaaagttgtcaaattagaataaaaaaggtatctcgactactcttttcgtaccgccgagaatagttaaatttttcaaccatttttggacaaaaactgttaaaaagttttgtttaaaattgtctcaaaaatatttatgtatttaaatcaaaaacaatttactaataaatgagcaaattttctttatgcaatttttaaaaaaaatgggaaaaaatggattggaataaatggagattaaatga

SEQ ID NO: 16932 - DNA, 2437 bp, Heterodera glycines
tgatactcctcagcgcaagacacttctggcaattcttccaagggaagagagaagtgtctcccgggctgtttgtgatcaacacatcgtttggcccgctgataaatggcgagtccaacattggaccgccgaactcaaatcaaaaagttttctcaatgatggccatccacagcactaatctggaacaaatgccaaccatcaatgaggttgagcatttcttcaacctcgaatccttggggatccaggatgatcctgcccaggatgggctgtcatcggtgctaaccaagctccgacattctccagaaattctggagaagtacgatgccaccatccgcgatcaactgcaacagggcatcatcgagaaggcccaaagggctcctggacagcttgagcacttcctccctcaccatggagtgctcaccaaaaagctacgcgtcgtttatgacgcgagtgctcacacacgcggaacaccaagcctcaacagctgcctcttccgaggcccagtgcttctgccagatttggcaggcatgcttcttcggttccgttgcccgacttttccacttctcgcggacattcaagccgcatttctccaaatttcattggagccggaagaccgggaggtcacgaagttcctttggctaaaggacacttcaaagggactcccgacaacttggcaatatttagattttgccgagttgcgttcggggtcgacagctcgccattcattttggcggcgacactccgccatcacttgcaacacttcgactccccactgtccagggagatttcggagtccatttatgtggataatgtactcctcgagtgcgagactgtacaggaggccttggaaaaatacaaattttccaaggacatcctccaacaaggatgcttcaacctgagggaattcatctctaattcaaaagaggtgatgaaacaaatccctcaggaggatcagctggataagccgaaggccaaagtccttggccttttttgggacaccgagaaagacgagatcgtcttcaaatttccaacaactgatccattgaggccagtcacacgaagactggtcctcagccatctcgcatcgctctttgaccccttgggggtccttgggccatgcattttgccagctaaacgcctcttccaagaactttggaaggagggccactcttgggatgatgccctctcagaagaggactcaatccgctggaattccatccaaagacaatggaaagacgaggaaatcagagttcctcgccgagcaatgctcaatgacacacagtcaattgagctccacgcttttgtggacgcatcggtccactttattgaaaggctgaaagaaatccgagaatgtctcggatgtacctttcatttcgtccgtactggggacaacccagcggacctcgcaacacgcggagcaactccttcggagctccgcaaccatcatctctggtggaaaggtccaccttggctcgcacaagcgagtcaccattggcccagcgaactctgttttcaagtaacagagtcggatcaacagccagactcaacggagaatgttggtccgagtggtgcgtttctcgcacacactcactcaaaccagccaaatgagcaggtcttaattgacccctcacgcttcagctcatggaaacgccttatgcgaacaacaatgttcgtattaagattcctcgccttaatgtttaaaaggggcgaggaaacggttgcttcactcgcgaagcacagaaaggaaattcgccagatttccaagtctggggacttcaaggcggaagacttcgcactcgcggagcgagttctcatccgcctagaccagatggatgacgcttaagaattccagcactttaaaacagtgactggagacgacggaattctccgtctgaaaaccagactggagatgagtgagaagccgtacagcttctctcatccattcttctcgccaagcattccgctttggcaaagctgatcattttggatcggcaccaaaaaaggcatcaccttggagtggacaccactctgacagaattcttgagtgaattctggatgccgagtgcccgtttaaatgttaaacggactcttcgggactgtctccattgtcgccgaatgaatgcacaacagtttgcattaccgacacgctccatttcagtcgattggaattgattttctcgggtttttgaggtgtttgtcattcctttataatttactaatttaatatatttttgttttcaaaaattagcgaattactatttttatcacataacattaattaaattgcaaaagaaatagcaaaaaattttcacatttgctaagtttatttttaaattgttttctatgtgatttgttgaaattttatttttcgaaattaagttagaatgcatttttttataataacgatttattgcattttttaaataataatatatttcca

SEQ ID NO: 16933 - DNA, 1302 bp, Heterodera glycines
taaaaagggacggacagtggggaaaatgatattttaactctttattattaagggaaggggaaaacggagaaaaagagacaaaccaccaaaaggacgaggcacaacaaatcataaaacagttccttatgaataatttgataagagattaattaccccccccccattttaatgggaccttttgcatttcaaaggaattaattagtcgacgggaaacttccattgaaaaatgaaaaaaaaacggagagagaggggggagggaaatgccttttgtgatttattaagaaaaaatagcaattttaatggttggtgggtaaaaagggaatgaacgcctgaagcaaaaaagaagcgatgttgtgatttatgtggcttaaaagtgtgaaaaagtgagccttcgtcacattgttcgccccatcaatgcttttatggtggttttggatggaaaataattgtcttttggtggatttgctgatcaacaacatcctcccccatccgttccccccccctccatttattttgcatcttcagcagaacagtccaattcctcctcctctcttcttccccccccccccccccgccgctgtcgcagtgacacggcgtcggtgtcggagtgaccttcgtcctcccctccgtcccctcattctcttcgctctgtccgcctttaagctcttaaaaaatgctctttccccagggcattggggggggggggagggagggaacgttggcgtcgtcgctattcgttgacctttgtggaagggtaatgggaaaattgctggaggaggatggggcgggggacgggggggggggaggttatgtcatcaacaaatcgaaaatagcagcaaagggacggaggaggggggaaaagagtcactcaatgggcggacgacgagggggtaaaaaaacgcaaattgggaggccaatgccaaaaacggggcgcgcaatttcagtgtgaagtcgcttcttcgaaattgccgctcttccgaagaccttcgcttctctgctgacaatgaaaggggaacgatggttggctcagcagtgggcagcagttccgaagatgacctcagaatgtggaagaaacagttgcgcagcagaggctagacaatggacgggaattgaaagaatcgcctaatttacatttattattcgtcaggcgacagagtcctttttcgcccgtcaagaaaaactgtacgtttgggatattttaattttgagattgtcagactccttcagctgttttctggcgtattcggaaatgaaaaaggggcaaagaaatattttccccgttttggtcagcctgagcgggag

SEQ ID NO: 16934 - DNA, 2579 bp, Heterodera glycines
tccttttaagcctcactcccctccaactgacaaatgagcaacaaccagataaagctaaagacaaaaagtcactgctatacacaccgacagctaataaatttttttgctcttttttgtcatttaaaacgttttcaaaattataaagcaatatttcgcggctgtagcacagaattgtgcccggtaaaaactgcccagagttttaatcaatctctaatggactctaatcattagggctggtaaaaatatggatataaagtcgcgaaatatggccataaaatatggaccaaaaatcgcaaaatatggacataaaattgcgaaaatctcaaaatatggacataaatggcaaaaacgtcaaaatatgggcataaatttttcaaaattgagtgtaaaatttcttcaaatttattggttgaaattgcatatgagatatatttccaaattttttgactcggtaaggcgctttgacaaagacggatttcgttttgcaattagtcggtcaacattcggaaattggtctcgaattttttcggcaattctgtgcaatcattttagaagaaaaaaaacatgaaagctaaaatttattaatttttttagcgcaaaatcaaccacaaaagcgaaattttcgctttttttgcttatttttgacataaatttattaatttttaagaacatttaaatttattcaatattctcgagaaattttggcgaaaaaatgattttttgaaaaatttttcggtttttgggctcaaaaaggctaatttagctgctgggggccgttctaatagaggttttttgaaaaatgccaaaatatggataaaaatgccaaaatatggaaaaatatggaaatatggacatgaatcgcgaaatatggaaaaatatggatatagaaatccattctagaagcttcaaaccaagcttaaaacatgtttttcgtgcgtttcaggccttccacagtccaggaaaaaaaatatggatttccatataattcccagccctactaatcatcataaaacgaaaaatcaaaaaacagtttaaatcacgaaattgcatcaaaaatcagccaaaaaccttttaaataaaatttcggacgaaattttgttcgctactatttttgccattgtttcagcattatttggttccttttagctttttagttaatcttgggattttttgtcactaaaaatccgcgccctattcataaatactaatccatggggaggatttgaaggcaaaaacaggtaggtcctttatgataacatggaatttctatgatttatgcacgaccgatattgccattttattaatatatcaaatgtgtatatatgaatacaacgacgatgaatatgaatgagatttcacaaatatcgaataagcgaagcacaatatattaatgggcatacaacatatatatgttcagatcacataaggaaggatcactgttcacaaggggaacatttaggaagcattggaacagacaaaacacagcaatcggaagggacgggaatgatcgaagggatatgtgtgggtgtcgcgagacgtcgtcgtcgaacacagtcatttgcacgcatcacggcctggctattgctctgcttggctcgtctccgctgcgctctgttctcccagggcttcgtccacggtggatgcatcggtggtgtccttcttcttgcccttcttgtccttcttcccgtgcttgtccttcttgcccgctttgctgtcgtcgctcttccccgactccttggatttgtgtttgtccttgcgcttctcctcctttttgtccgccgctggtgctgctgctgcgccttcgcccttcttgtccttcttcttgtgcttgtcgcccttgctgccagccttcttctcctcctcgccggcggtcgtcgcttcttcgcctccttccggcttgggcttctcctcgtcgtcgctcttcggttggtcgagcatcgggccaaggtacgtcttccaacagtactgaaagggacaaaaatgttatgaaatgcaatttgaaaaaaatgaagaaagcgcagcattacaattcccgctccgaaggcagcagcagcgaggaataggtacgtggccattgcgttgcgttgggcactgaagcggttcggtggttggagtgtggtgacagaagaagtagaaatgtgcagcggagggaaagacggctccttttatacacatccgattctgctggaaggaattgaaaaaaattgagtataaaagaggggcggaaaatgccaaataaccaatacaatctacctatgtggaataaaaacagcttgccagactaaaacgatccccacccgaattttagtttttggtacaggagctcattttccggacgctgtgtataatgagtagggcgtgaattttagtgaaaaaaaatccccgaaatagttaactaaaataggggtccgcatcgttttggcgccagggtcgttttggcgccgacgttttggcgccgacgttttggcgccgagctataaaaaaaaaaaaaaaaaaccccaaatttaaaattttgtaaaacacaaaaaaacatattttttccgaaggaaaattgccgatggctggttgccccccctttt

SEQ ID NO: 16935 - DNA, 1730 bp, Heterodera glycines
atacggtacttaatccgtatcggtgtcaagtacgtaatacttatacttatccgtattttcgcaaaattccgatctctaaatcttagggcaatcgaatgatattaattaagtttatattaaaaactcggcgttatttttttgggtcggggtcacttcggcgcggaccatttcggcgccgcaaattttgaaatgctataacttttttatttgtcaattaactttagccaatctggcatcatttgaaagctctatgtgtgctctatattaacatgtcaaaatagaaatgaatgattcaaaattaaaaaaagttatggcacgctgcgccgaaaaagccagaaaaagtcaatttttgaggttttttggccataacttttttgtaaactgacgaaattttttgaaattttgtaggttactagagaatcacaagagctatcatgataacaaaaatatttaatttggttgataatgaaaaaagttgtttgcaactgcgccaaaaaggccggcgccgaagtgggcggttcccattttttggggtccccgactaatattttaacaaaagatttattaagtatattaaaattttaagtttcagattatcgaaaataaatttaaagtgaatgagaatcgccgggaaattgaggtacagtatatgttttggtacatatatataattttgatcagaaaaatttggccaaatttgcaaaaaacacaatgtttcttttgaaagaaaaaattttttaagcaaaattataagaatttgacgttctttcaaatttttaaaactaattctaagcaaaatttttttaataatttgaaaccaacaatttttacaggcgattatcagcgagacgaaaagcgtaatgccttttgtaattggtggaagagaatgaggaagaggaggaggaggaaagagaaagaatttaagggaatgaggaaaatgaagaaagagaagaattggcggaagagaatgaggaaggaagagaagaattggtggaagagaatgaggaagaggaggaggaggaaagagaaggaatttaagggaatgaggaaaatgaagaaagagaagaattggcggaagagaatgaggaaggaagagaagaattggtggaagagaatgaggaagaggaggaggaggaaagagaaggaatttaagggaatgaggaaaatgaagaaagagaagaattggcggaagagaatgaggaaggaagagaagaattggtggaagagaatgaggaagaggaggaggaggaaagagaaggaatttaagggaatgaggaaaatgaagaaagagaagaattggcggaagagaatgaggaaggaagagaagaattggtggaagagaatgaggaagaggaggaggaggaaagagaaggaatttaagggaatgaggaaaatgaagaaagagaagaattggcggaagagaatgaggaaggaagagaagaattggtggaagagaatgaggaagaggaggaggaggaaagagaaggaatttaagggaatgaggaaaatgaagaaagagaagaattggcggaagagaattaggaaggaagagaagaattggtggaagagaatgaggaagaggaggaggaggaaagagaaagaatttaagggaatgaggaaaatgaagaaagagaagaaattggcggaagagaatgaggaaggaagagaagaattggtggaagagaatgaggaagaggaggaggaggaaagagaggaatttaagggaatga

SEQ ID NO: 16936 - DNA, 1071 bp, Heterodera glycines
gaaggaagagaagaattggcggaagagaatgaggaagagaagaattggcgaaagagaatgtggaagaggaaggaagagaagaattggcggaagagaatgaggaggagaaggagagaagagaaggaatttgccagaaaacgaagaagaattatttggtaaacgaatgtataattccttggattacgcctcttttccaagttttagtgtatttttaaagtttattttaaaatttattattattattttcttaacagtgcgatgtttgtggaaagagatttgcgtttgcatcagttctatggcagcatcgccatgtccacacggcgaagaaaaattttttggtgaattacaaaacttaattttatattattgtattttttaaatttattattaatttaattttttgaattttattacaatggaccggatttaaatggatttctattttttcatacttatttcgacctaaaaagcatgtaaatcgtatttttagcttggtttgatcctttttatttccacatttttaatccatatttcgacattttcacaaagatggaaaacttttggaaaatatttccctaaaatcgaaaaattttgaaaaaataccaaaaattgtacaaaaaaaaattttaatgtgaaaaattcgcctaaaatgattttgcacatataaatccgataccaatttattacagtgcgatgtttgtggaatgagctttacgcaggcaccaattctatggaatcatcgccaactccacacggagacgaaggcgtatatggtgagaaaaaaaaataaaattaaaattttgggattttatttccattttctttaaacagtgcgtttgtggcgataaatttaagaccgcacggaatttggccagccacagaaaaaggtgcaagaatttgctcaattgggtgtgattaagaaaattagtttgagataaaaaggattatcttttgtcgtttgtttgtttgtctatgcccttcattttccttatgctatttttatttttctgtttctctgtctctcttatcatcgaattctctctctcccctcacagttttcttccaatttta

SEQ ID NO: 16937 - DNA, 2382 bp, Heterodera glycines
atatttagaataaacttttttttggaagataaaaattaatttaatttaatgcatattataaatttagaatttaaccaaaatagtgatggtaaaaaaattgattttaagaaaaaattttatattttatgcagttgtaaaagaattttaattaataatgagtcgtaaattattttttgtgtaatatagctaaaaatcaattaattatttcaaaggcggaacaatgtttggtgagatgcttttacaattatttagtatggttaagtattatgataaattactaagattttctggtagtgtatgtatggtatctgtattaattgtaattttagacctaattgttccttaattttttaccaattgaagattttatgcagaaagaagggttataatgaaattatatctatgaagcataatattggaatctgagaatatagtcatcaacttcaacagatttacatatgtttcagtagagtgaaatttataaattatgattaattaaggaagggagtgtataagtcataaaaaataactagcaaaaatattgtagagtgcataagacaaaaggaagtgacgaataataaatgattatgacatttgtttacagatttaactccgttacggtatgaatgatgaacatgaaaattaattctaaattatcagaaaaagaatacagattttggggggtgtaaactttttttattaaattaattaattctttataatagtcatagatatgcataaaaaacagaaacatatatataacgtgtggttttttggtagccaaacatcctaaggttcggctctccggtagtcagtacctaattaagctcggccctccagtcaccaatacctcgtaaggttcggctctccggtagccaatacctaattaagcttggcccgccagtaaccaatacctcacaaggctcggctctccggtagttaataactgagtttgcgatggtaaggagcaataatgaccgaatatgtgttggagaggaagggtagagttgaggaaaccaaataagtgaaggagaggggggtgaggtcactgcgtcatattatcctgtaaatcgattcctctaaaaggaacaaatggaaagaggctaacgccaactgttttcttaacaaaatcctatatttagagattttggtttcgggtttatttgaattattttccttttctccgtaatacactttctctactcttctatatctgtttactttcactgttattccttattaatttcagacctacatattgtctaaataatcgtttccattagctatttttcaatatcttttcttccaacactatgttttattctcgaaccgttatcttccaagtgttcatattcttgttctttatcaaactattctcttccctatacattacctaatgtttgccttactaactcatattaaattctcactatttaatattgactctcttcaaccacatttctgagttctctatctctatctcttacacccattattaattgtccttgattctatggtgcactacaatatcctcatatgatttcttcatttattcctattacaagacctgcttcacgcatacatttagcccttatctaccctttctcgtcacatacagtcagtcaactatttgtcaaacctactttctattctcggttcaatcttagattcaaaattgtctatttctcttgtttcctttgaatattacttattcaatggaattgtaaatgttccttccttattataattagaattattttacgttgaattaggcaaggagcattgtttgtgtttatgattaaaattaacaagttttatataagttaataaatattatgcaaaactttcaaacacattttatcctcaccctcaaaaaaaacatacaatacacacatacgaacacgcatagacacgcacacacgcgcacatgcatacatacgcatacacacgcacatgcatacatacgcatacacacacaccccatgtgtgtaatttttacacatttttgagtaattccttcatttaatcattatttttcttaatttttgctaaattgtatcttctattccttaataatttacaaattgtaacttctttcgcttaattctgcacttttctacctaaaaaacgatgttcccaaatgtttaataattttcaaattgtgtcttccgttgtttaattctgcatacatgttaatgtgtttaattatgcacttttctacctaaaaatgacaggttcgtgcacataataaaaattgtatcttccactccttaatatttacaaattgtgtcttcttgctcttaattatgcatttttctacctaaaaatgaggtccccaattgcttataattttccaattgtatcttccattgcttaattctg

SEQ ID NO: 16938 - DNA, 3484 bp, Heterodera glycines
  misc_feature (3334)..(3334): n is a, c, g, or t
  misc_feature (3397)..(3397): n is a, c, g, or t
ttttcttaattaatatttgcattatttaaattgtgcccccatttttcagtgaatggtcccgctgctcgaaggttaaattttttctttatatgttatgcctttttgtttatttgatcactttttttcaggtggcattctacggtcgtgatggctataaatacgctgctgaaaagtacggtatcgaaaaagcggagccgccaaccaaaaacttcaacgacatggacgagttcgacaagttcgggttcatgcacggtgagttttgttggcattttaaaattggtttggcattcaaattcgaaaactagctaaattttaaaaaaaaattagtcatttttgtaatgtttttaaaaattttacgggcatggaatcaattttatgccaatgatatttttattttacaaaaaaaaaattaataatttctttttctcagacatggtgttgctattgtttgacggttgtgccgtatgcaatggcaacaaagtgccgaatgtaacgatttcactgctccaacacatgccaccagtaaaaaataattaaataattatttttggcatttttataattttttaaatttaattttcccagggattgttggttgacgagtgtaaagaatttgttaaccgatccgggtataaataaaataaatattaaatatttgtgttgaatttattgtttgtttttcaagggaagcattggctctacagatggaaatggttgaaaaacaacaaaaatccaaaggcacctttgcatacggtgtttcgctgaaggaacggtacgataactaaaaatgcgtactgtacagtgtactgtatgcaatgtaaaaagtcaaaattaatttaattatttacaatttggcaaaaaataattcctattttttagcctctgtgttgagaagaaacccggcaccgagaaagcagaatattacatgcaaaagctcaagtgggaaataattatcaagatttaattacgcgaaatttttaagggaaaataaattttttgactgaaaattttcgaaatttccgtgttcgttggtacccctctcttagacctctcccacccaaattttctcactaaatttttccaaaattcgcaaaaaatttgtcgaaattatgtgttaatcagctgattttctttctgtattagatacaaataccgagtggtgctggaagtgaagcacacctgcggcgccgacggagagcaaaaaacggtgcttttatttttgttaattgagacttatttttgtacaattaataaatataaatgtgagggtaaatccgatttcatgttttttcttcagcattacatttggttgccggaaatcgatgtctttgataaggaaacggtggtgggccgcgtgatgcaagtaaaaaatgaatatatttttttaatttttattaatttttattaaaaaattggagaaccgtaggggtctggctgtgccgacatttttttggaaaaatttagccaaaatttttgggaaatttgagtgcgtgagatcttggaggggataacaacaaggagaatcgaaattttcaatattgatgccgaaaaatcggcacttttacgcttttgcactttgctatttttcagatccgccaactccatttggatttcgccgacatggaagatactgttgatttgacattgatactgtccggaagcgactccgacaaaagcggccaattcgttaatgccacattgatcccctacaaacacgaacccgtggtgccaccaccatcggtagggtgccattcaacaaaaacaattaaaaggtttagaccaaataaataagctaacttttagggttatggtatacttaaattttttattgtatataaatttttattaattatagcccatcggcctctaataattttatattgtactgtaacatggacgggacggttttgattgtagaatatattaaaaatattaaaaagacaattactttttatttctaataacaaaaaagtggaaaaaataggaaaaaagctaagtgggcggcgggggttaattgagaaggcacaactacggtaacacttggagtaacaaaatggcaactgcatcttaatttaaatttttcttcatcagccaaatccgccaatcgcaacaaatgtggaccatttgggagccaattgcacacaaattgtcttttccgaattgatgccgcaattttttttgaacgtctccaatgatgcgtttgcaattgcgtgccaaaagttcgcggccccaatctatactggcaaaaatttttcggcagatgattattatgccaacacttgcgcgcaagtgccaacttcgctgaactgcaacaagtcagaaagggcattgaaaaattaggcttatgtattctgtattttctctgatacagcccccggtggctccgtttttttaaattgacaaccctctcggggggggggggggggggcattattagagggggctcataaaacagtaactctgacaaatcaaaatcatttaaaatgggaaatatgccgagcagtgatagcactaaaaacaaaaagcttaatgtataaaattctgctttcgatacactatacatcccgtagctcagttggttagagcaaggcacgattgctggggtcgtgggttcgagtctatagatacttctatgtatcgataatatttttttttatgcacaaatgattagaaaaccacctaaaattcagtgatcacgagctgatcggctgttacaaaacgaaaaaagtgaagcacgtggtcaacaatgaaattgccgaagtttgccaaaaacatcttggaaatgttgggcaacagcaggcgcacggatttcgcatccgtttttgtgcccagcgtaacgcgaaggagcagctgatcagtgtggaatccattctggatttctcattctcggacaaaatgtaattattgacataaaaagtgattgtttttccaggacaaaggtccttttttgaaaaggatttccaaggactgtccttggcgattcgagccatattttttgaggatttttgccatttatttttttgtaacctattttttcgtcttataaaaataaataaattaaactgtatcatcattgtcaattaattatgattctcattaataaattttgcgttttttatagatacaaaagagagcacagttactcatacaaaccgggtggacacatcgcaatgaaggagaagatgccgttttttttcattgagttcggcaatgcgaagcagcacagtatgcttcgtggcacgggagacagtagcgaactgtcagcagaattggtaatttatttatttattataattaattaatcagctaattgataaattgcgttttgtgaggngaaagaacttttggcacaattaataatttatgaaggtttcgcctacccactcctaagaatttngacctaaaattttagcttcaatattcgggaggggggaatcgggaaatcataaaaaaaatgcatatattgaaaaaaatgccccccccc

SEQ ID NO: 16939 - DNA, 1679 bp, Heterodera glycines
gatagcactgtttcaacttttctgtccttttcagattggatacaatcagccaactggtttgatcgcactcgtggctatgccatcggtcgcaaagactttaccctcgaacgtctggaagaagcgtacaccactgagaattggcttgtccgcatttaccgtgtggtgcagccggcaaacagaaggacaatcaaatacaaagacagacaagtgaaaggacgccgtggaagtgcgaaaaaggtggagggggataaaagttggagccaaaaatcgaacaatcattttattaaacaaagccttgacaatttttaatgaattatacgaattgtcttggtaaaggttttaaaattaaaaagaaaattccaaaattttaccatcgaatgttctctgaacttgattttgtgatttttagacgaaagtgggaagaaaaggcgttttgaggagcgacgggaagagagcgaccgccgcgaactgagcggagccgtaaagagaatgaccactgattgtgagacgaaatgcaatgactaattttattttttgaataatgcgcaaacttttggactttcttttattacaactgaattttaaaatcagtcagaagtttgctaattgtaagtgttaatttgtgcgtgctaatatggtcatcatcctatcatctgcacttttgtcagggtatgtgatctttcaattggtccctttctgctttctcccaatgattttatttatttattggtttatttattttgccaatggtttcttttcctttccattataccgctttttcaaatttatggaattttatttgttcgttcgttgttgttaaataaaaacttaaagactgttattaacattatccgacaattattcccggtttgatgactttgatcatttcctccggtcttttcttttttatccgtctctgaccaatgccttcgtcattttgtctaagagtgcccaagtgatcgctaacatcgtcattcctctgatcagtgtgtctcccgtcctttttcccacatttattttttgctccgccgtcggctgttccctccggcgcctctcttcccggcacatttcttctaattctttcgtcgcttcccaccgtcgtttttcttcttcgtttgtcttccattgccatttgcaatttggcaccttaaaacgccattaattgtccatttttgctattgttggcatagcgacaaaaaatgctcacaatttttttactgcattgtttttcacacgaatggcacaagcgaattgcgcaggaaagacggattttgtccgtgttgaacagtcggacggtaagccaacccaaagaaagggccgttcgttggacgtgccgatggattggggaggaaatctgagggagtgccacgacggaatgagtgaatgcaattggatttcgtcgtttgaatgccattggctactctacccccccccctccccatctactgctgaccattgtctcctctctgctgcaccccccgtcgtcgatcagttcgattggatttcgttcgctgcccgtccaacagttttcctctcgcattgccattcctgtgtcacttttcaaaggatatagaaaaatggacaaggccgaatttcccgttttatggctaatggtttactgctaattgtaaaccgccccctgccgaatgatttgtcgtcggatgggccatttacccccc

SEQ ID NO: 16940 - DNA, 1029 bp, Heterodera glycines
ccgaaacaactcactgacccggcccaatcccttgacaattccagcggaaacagatgcgcgtgtcccacccaatgctttaaagtgcaatctttggaaatgaacagaatacgaattgttagcacctttcactcggctttatctgctgcccctcacaatttgcacttcggtggagagaaagagaacaaagagaagaaaagtcactggaggagcgattggtgacgccaaagtcggacgaatcgtcgaaaatcacacggattggatcgacgacgacggacactttctgatcgatgacatcggaaagggacggcgccgtcaccgaagagaacaaattgcatttggcgggaatattttggaggaaaagggcaaaaaatggaaaagaaacgatcggagaagaatgataaagccaaatattgatgatgaagaacatggaagggagaggaagaagaaatgggacgtatgatgaaaacagaaataaagggacaaaaggaaggggtggcctatctgagggcgaaaagcccccaggggaattgcgctttatgaggcgacatggccagagattgcggacgaattggagagggagtgagagaaaacgcgagagagagagagaaagagggaaatgaaatttattttttatttgaattttaatatgtaattcctaatgattttgaatgaattttcggcttttcattctaagagttcgttaattgccattcgtctgctgtctttgcgcatcccattgttcattttttttcctgtatcagcggatgccacaaatgtttgtctcgcgatagttgcttttctggtgttgcgttgcgatggcatcccccctttttttacatccctcggtaatagtaccgatggtaccccctttttcgaaaaatgaaatttttaaaatattttttcgattaaagtctgtattaggggttttaagggtcggagaatccgaatctgacattaatttcgacctaggtcgaaccccggacccgaaatgagcaaaaagtcggaaattcaaattttcgaatttctcat

SEQ ID NO: 16941 - DNA, 809 bp, Heterodera glycines
ataacttttttctttgtcatccaaatcaaagattctcccgtatcattcgaaagcccttcaaatgttctattagcctgcaaaaatccaaaaaatttcgtcaattttgaacaaatttatggccaaaaaggttggaaaatttggttttttgaatttttctggccataacttttctgaacctaaacgaaatttttcaaaattttgcaggctaatagaagacacttagcgctttcgaatattaccaataataacggatttggttgacaaagaaaaaagttatagccaaaaaaacagctggggcccaaacgtgccggggcccaactgacgggttccgtcgccggactaatttttggaccataaattttttctttctcaaccaaattaaaaatttttgtattgttcgaaagcatttgaaaaacactattaacatgttgattttcaaaaaattttattcgtgtacaaaaaaaatcaggacaaaaagagttcaaaaaactaggtttttgagttctcctggccatatttttgaaacttaacgacaattttcaaaattttgcaaactaaaaattaaacacacagagctatcgaaaaacatcaagaatgtttaattttattgacaatgtttcttccagcgacgttttggggtgcacccccaaaaattcttattttatttggtttttatgcttgtccggttaaatttttcttttccctttttggggggttttcctttatgataattttcaaaaaacttcaatttttcaatgaaaaattttttttgccaagcctagtctcccgctaacaaatttatccactgt

SEQ ID NO: 16942 - DNA, 1356 bp, Heterodera glycines
  misc_feature (11)..(11): n is a, c, g, or t
  misc_feature (54)..(55): n is a, c, g, or t
aatcaaattanggaccccggcggtgccgataaattatcgaaacaaaaaataacnnccaatatttataagtagatgtggtgttgcgacatttatacatattaaaaattcatattttatgagcgagaaataacaaaaagttcaatcaaaaggtctatgaacaaacaaaatgtaaaaacatcgtcttccttcatagcatatgtatatgcaaaaatattatatatagaaagatatacaacaatagccttgggaaaaaataatttataattttaataaattaaatgttccataaatataaaacaggaattacctaatggtgagtctaattgttgtgtcgtgtcaccacgacatttaatggaattgcatttgtgtgttgttggtgttgcgtgccgatagactttttaatgcaaaagctctccaaaaaagcactaatttcatcgcggtataaaaggctttaaaaaaaagtacaaaatttaaaatttatttgaattttcgaataataatcattatttatactaatttcacaattaaatttcgtttttaattaatactaatttccctattagatttaattgacactgattccaaattaaatttaaatgtaaatgatgaccaataaaatgtgcattagcactgttcgattaaacaaaagtgacacgaagagatcagaaggtgtgcacacaaccatgcttttgataaaaaattatattttatatattaaattaaattaattaattttttattcgtttaaaaattctaaggttaattaaaagtgccaaattgggaagaattgccaacttttcaattcttcaacaaatttggtgtcataaatagcttaaagagttctcaaactacagaatttttcataaaatttgtaactataaattttattgcactttatttcacaatattttcaaatttaaatatttcaaaatttgaaaatttttaattttccttccttattgaataaatcttttttacgtgtctatgtcgtgataagcagaaaagcatagccagatcattaacaaatttgatgcaaccgatacgcaaaaaaacaatacatgaaaattttttgagccatttttcatactcctaaataaaaaatatattataaaaaaacataaaaaatcaattaaaaattattccgaccaaattgacaactgaacatttgtgagacgttcaagtccaatttggaacatcaagcaaaaagacattagcacactgaagactggcactgcttgcaaataaaaacatgccgaatttggcacaaattaaatagaaaaataatttaaaatttttttaaaaatttataaattttctaagtttaaataatgatgtgcttttttaggcgctatgtaa

SEQ ID NO: 16943 - DNA, 4441 bp, Heterodera glycines
  misc_feature (4423)..(4423): n is a, c, g, or t
tcagattttagagccaagggaaattttagtaatactccccccccgaaattatagatacttttttggccactctttaaaaatggtctttttcgaacataaaggcaggcctaacggtatttttattaaaaaatacaaaaaaaatattaagtttcagagatttgcaccttttccatgtcacagcttagtccgaaccatctcttcgagaatctcaaatattttgaaacccgttttgatggagatgggtgaattttcagttatttataaaaaaagacatttctctaaaggaccttcggtgttggattatcatcgacaccagttcaacaaaatgagttcattgggtggcacagtgggataggttttgactcagatggtgacattatcggtaggagtctattgaactctagctagaatttaattctgacatcattattataaaggactagagcaatatggaggaccctctgtattgaagacttggacctattcgagaggggatgttattggtgtaggaattgcaactgatgagcttttctttacaataaacggcgcaatcataggtagacataacactattcgcgattttaatatattttttttggagtaaaaaataaggccacagaagaattggaaactctcgcctctcgccgaactctcgctctagttttttttgggactctcgcctctcgccgaactctcgtctttttggggactctcgcctctcgcctaactctcactctcgtcttttcagaaacaagttacacccttggggtatgtgccctgcggcaaggaaagaattgggtatatgcccaatggggaggagtcattgtgtatatgcccaatgggaggagtcattgggtatatgcccaatgggagggagtcattgggtatatgcccaatgggaggagtcattgggtatatgcccaatgggagggagtcattggggatatgcccaatagggagtaaagtcattgattttttcatttttaatttatttttacaaaaaaaaacaaatttttaataatattattttgtaatttagttagtatacaatattttttttgcatgttttcgttgttatttgggaaattttttgctatttaattaaatttttataaaatttttccactaaattctgaccaaaagtttttttttttgcttattatctgtaataaaattttgatctttataatttaacataatatggaagatttaataacatttgatctggtataaactcatgtgaacatcattatgatcggggatggggtctgaatatttgtggattgttctattgcgctatagtttaacataatacggaagatttaataacgtttgatcaggtataaacgcatgtagaacatcattatgatcggggtttgggtctgaatacttgtgagttattctattgagcgaaacagacacacggcaattagcatttgaacaacgatagcgaatcgtacgctcatcattccaactttcgcttcgaaaccattgatttccaagtattatgtatttctttggaactattgtattttctttctcaattattggttgatggtttgcgtaaattgggtcaaaacctttacggtagcatatatattcttttctgacgaatttccaggcctcttcggctctttcaacttcatcactacctcctccgccatatttttaaatcatatttagctttgttaattcatgtgcatcaaaagcggcatattgaaatcgtttcaattctattctggtatccaatccatatggaacccaagattttggacccagattccacgcaattgcacaatttgtccccttatttagaaagaaaaattttttaatattgcaagtttataaataaaaattaccgtactaaatccaaaatgaattgaccctgggagtgttaaaataccctccccgcctgtttgtaccttaaattttttttgtttgattttgttatacatttgtcatagttatataattttatttataaattatacaaattcgaccgttcgaacaaagcgaattctgtttttgataagaacttttgggtgtataagcacctttttctttcttaaatattcatcgttttttgaaaattctttcacaaaatatgtacttgctagacttttaaatttttgaaaatcagcagctgggatactatacctataaataaatttttagacaaaagatggttaatatgtatcttttttatatctaaccgaaatctaaagattaaaaaaacttaatttaccatattgttaatccttctgtattatttggcattataatattaattgaaaacaggtctgcgttctctgtatgggcaggaaaaaatgctgcacaacgcctaagatatacgtagaaatcggttattcctgaaacaggaattccgaatccttgcggcgggtccaaaatttgatgttctagtaccgcccctaacggcgccttccagtttttatcaatatgtttcggctcttgttcttgagcatatatgaaaactgtttccgaatttgcattttcaagttgattccagaattcgcttaaaagttgaaacggttaattcttcatttattataccccatttttttgaaaattcgccaccattatgccctgcccactccccgccgaactgatcaaggaaatagttgatgctcttccccctccaaaaacacatcggcttctgctcgtaaattttgttttggcatcctttgttaaatgtcggttctattccatgatgagaagattgtttcgcacagaccatttattaatgccaatggcccgaagaacaggaatttatttatttttcgatgtttttattccccacacaactcaccaaagatataaaaccaaaacacttgggaaattagagtaatctttctttttctacagcgaacagggcttaaaccaattttcaagggccaaggcgttcgtatgaacgaagtatgtgtgataaaagaaggagaccactgggacggaataaaatctgtgacaaaatttttcaaagtcaaaaacttctgtgcgagctgcgaagtgacatatgattggtctttgcgtcatagtgctatgtgtaagtatcgctttaagaagtgtctttgcgtcatagtgctatgtgtaagtatcgctttaagaagtgttatcgcatggggtttggatttccatgtgcaaatgtgtgtgccgaaatttattgcaagcagtgcaatcttaagttctacaacccggaatgttttgaagcacataagaaggcggcttgtaacgagtacaaaaagtgtgaaaaatgaggtgaagtgtgccaaacgcgatcgaagcacacatgtggggagaagttttgtcggctttgcaaagtttaccatcccgggcggcaatgttacatcaaaaagatcacagtccgcccgcagagagcctacagaattgtggcctatgaccttgagacaacggtggagagtggtgatcaccagccaaatcttgtcagcgcagcgcgaacatgcagcgtttgtgagggagaacaacgggaatgcgcgatttgtgaaggtccaaggatggtcacctggtcggcagaagacggcttggaacccatgagtgaatttgttaattgggtgatgggcttcagcagatttgaaacggttgcctttgcacattacggaggacggttcgactcgcatttcgtcttggccgagttatcgaggaaggaaattaaaacggagctgatgatggcggacttgaacatctatcaaatcaaagcaggaagggtgtgctttcgggatttctggatgcttagtcagaacaagttggcggatctccccaagaccttgggactgagcatcgcggccaagttgtactttcctcacaaatacaacaaaaatgggaactttggcaagagattgcccaatctaccccctttggaagactattgccctgacagtatgaaggaggaggaagcggtaaaactggaatcctggtataagggtaatttcgcaacagatttcgaattaggtaggcagaaaaaatattggcttcttaatttaaattggttttaaggggaacagctcagggtttactgtgaaaatgatgtggaaattttgatggctgcaattttgaagtttcgacaattgtttttggaaattacgggggatttggatgtgatgaaggacagcgtcaccattgccggggtcgttaagaagatattcagggcaaaattcttgaaggacaggcatattccaatcatgccagagggaggatacgagagggctgataatcagagcaaaattgcagtgaaatattttgagtggttagcccaaagaaaaggagtaaaagtgcggcatgcgtgtaacggaggaaaagtggaatttggtgggctgaaagtggacaatgtgataggggcagagaaaaaaataatagagtttcaggaaaagaaaaatgatattttatcaantattttaatgttaatcat

SEQ ID NO: 16944 - DNA, 2900 bp, Heterodera glycines
aaaaagcattttttctaggattgaaaaatgcgctgatcccaccaagtgagctcgggttttgcaaaatctgatttttatctaggatttctcaccaagcacttaatttttttttctaaaattttatttattattagaattttctttccgatgaattaaaggtaaaaaaaatgcgctgatcatgaatctgaagtttgatttcgaccccatctcatatgacccctaagggccagttattaaatttcaaaaaatcgtaaatatacttgagttctccagacaaaaaataactcattcgaaagtctttattggaaaaaacggtttttagggataattaaaaaccttttttttttatttatttatcgataaagaaaaaattggggtccgtatcgttttggcgccgacgttttggcgccagggtcgttttgggccgacgttttggcgccaagctataataaaaaaaaagaaaacacccaaatttaaaaattttgtaaaacaacaaaaaaacgtatttttcgcgaaggtaatactgccgatggttggttgccccccttttttgaagaaaattttttgttttcaaaagtcatgaaaacatgcttccaatggttttcagggtcgctgctcacgaaccaggcatccattgcgaccaattcggaacccggagccgaaatttgaacaaaaaatcgaaaataaaaaatttcaaaattctctttttgtttctaaaatagattaaaacaaccaaaacgttttggcgccgacgatttggcgccatgtagggaggaggtagaaatgatgaaatcgttataatttttctgacgaagtctattaaagagccggatttaattcttcatttactctttttcgctttggcttatgttctcttaattttgtatttaggtaatgaatcgtcaaattgatacgaaaaaacaaaagcctaaaataacgcatgaaggccgagcttcggccggtgggctgatcgaatgaaagaatgtttcggaggcggcacattctcattggcacctccaatgttcaaataaattgtttccatttcttcattttgttaatttttatatttaacgaaaaatttaattttttataatttttacaatttcttcctgccttttttttcatttttggcttggcgccaaacagtcggcgccaaaacgactctggtccctaaaataccaacttaagaagaagtatcctcaaaaaactacaaaaaaaaagccccttcagcctttaaagcaataaaaagagagaggagataatatatatacattaaaaataagggaggggggaatcggcggaaaattttgcgaaaggattcggcttcttttttgcttttaaaaacgttttttttgcggcaagggggacaggcggcaccgagccgccaaggaaaaacccggcattactcaaatcaaaattaattaaaaaatccgatacccaacatttaccaagagtgtcaaaaaaatttcaggattgatttttgtgcttaaagaatttccaccacctcagtgtttggagaacacaatgttgtggatgtcgacgaagtggttgatgatgacgagtgattgttgttctcggccggcacagaaggagcctgaaaatttcgcgttttatactaaattcaaaatttgcacagtctatccactgtttgagcagaacggcaaaaagaatcaagagacagtttaaaaatttaattttttttattttttaggcattacttttcaaacattcattctggcctgttccgaattctggacccgaattcgaataaaatataaaattcgagaattctgcattttcaactttttgttcggattcaactcagggctggagcgcgcacagaaaaaaaccgcggccgcgcatcgcgcattcaaattgccgcggccgcgaccgcgcatcgcgcaaaaaaaaaaaccgcggccgcgcaccgcgcatcgcgcattcaaattgccgcggccgcggaccgcgcatttaaaaacaaaattttcaaaaatttcaatttaatcaataaaattttcccaagtgaaagtttttttgaaaaaaaatttgaaaatttgactgcactttgttacgaaaattgcctatattaaaatatgtactcattgggggaggcattcgaagaatttttccattatatagaaatttttttttaaattttcatgcgggggggggggggaatcttggattttctgagtcccaaaattctggattttttttgaataaattaacaatctattaattttttaaatcgcgtttttgtgggcggttccaaaaaactttttgggaacattgtggggggggggggggctcgagtattgcctggatgctgtcaatcataaattgcttcacatgatgagggaaccactatagcttctaccgtctgatactatttttatatgaattaagtaagttatttaatgtatactttaataatagatgctttgcattggttgcttaagaccgaatgtaatcattttttgaatctcggtcaggactataagtttcattccagccttaatcgcggtcactcaatttcgacatttacttatctcattgtgcaagtaaatgggtgatttttaattttaatttgattaaattctaattatatgttgaattgcttcaattgtacttttcaatgcattattttattcttttaaataatattttttgatattatttgtttattttcttaatgaatactttcttttcaaagaattttatcgatatttaataaatctgaattcttttcagtataaatagtttttaaaaggttactgattattagaatactttttaatatttgtgttcactcgtttgcaaaaactttaaatgcttaaagaagaaaaaacctttccatccaattaaaatggatcaaaattaaatttaacctggtttttatt

SEQ ID NO: 16945 - DNA, 2344 bp, Heterodera glycines
tggcgccattgtgctccccacgcaatgcgcccggtccccctactgcactggcaacattcgtcaggagcaggagggaaccgctgagcggaacagaggaccgagcgcgttcggaccgcgcgaccgtttctgacagcggacgattggcatttgtggaccctggcgagaatttatgcgcgaattgccccaagaccggcacccaggacaatttaatgtcttcgattttgcagtcgatggatatggtaaagataattattattccccctaattattatgatcgattggtatctttgcttttcaataataattaagagcaaattggacaacattttcttggatgttcgacttttgaacactcatgccaccaaccgggactacaccatcgaagttgttggtaagcaaaagtactcgatccattaaaccattgcttccctcccgctgcccctaattgccactacatttgccactttattcaggtgagttcagcgtgggcggaagtggcggcactccgttcggtgcctttcccatgcaatttcccgactacgccggtgccaaaatggcggacattttgatcagcgatttcaccatcaattcgctgttttaccatttgcaaaggtcgcacggcatttaaaagcttaccaatcgctttccttttccttttagcgttgactttttgcgcattcgaatgggcccggaaacgccgaagtacggcgaactgatgaagaccacctgctcatcggaggaggacaccgggttggaggaccacggcgtggagacggaggacggagcggcggctgtggcggtgcgggtgaagcggcaggacgcgggtgacttgaccagcctgggcgtgtgtctgggcgacatcctgcccgcggtccgcgagcagtaccccaaccaattggtgtacgtcataatccacacaattcgtgcgccctcaattatactgagcagtcaaaacggaggtgagaagggcaattaatcaatcactgattggccttggcaggcgtcgctttgctgaatttcctcgtcgacgtcgacttttacattcagtcgacaaaccaaagagtgggcacaattcgaattgcttcggatgttcgcataaccattcgcacaaacggtgggtttaaatttaaatgcgaacaagtcactcactgatcagatcaattttatcgtggatggcatcgaaatttattccgcaaattccgtcccctttctcttcctcttcaggtgcccatgttaccggccatgccgatgtggtcagcatgcatttggaggacgtgggcaaccaactcggccttccgcaggacgcgttggacaatttggggacccttggcagggatttaatgcttaaggtggtcacttttgtgaacaaatcatatcgcacatttttcatttagtccatcaacgacaaattagagcagggcacttcgctgaatgtgcccccgggcactggcggaattccaatcgtaagcatttgggtgacccaaatcgaaatgcataaatgatggttgtttcttgccagaacattgtcgacccggtcccgcacattctcgaccatgccattctgatcgagtccgactttacgatggacaccagccaattgggcggatcagagccatgcgaatactgatcagatcaaccacacgcacgcactagtagcaccaccggcattcctttgatcgtttagtgatacgaaagtgacgggtaggagacatccgattggttttttggggagaaggggggcttaattcgatgaaagcggataattttacccgaaattaccaaaacagcgaaatcaaagcgcagtgagcgcgtaacccggtcttatcatccttatcagtctgtcctatcatttttatcatctctgtttttgcccatttgtcttgccttagcttttttgtgcaacccttctcttctcttcccttcctctctttctctgttcctccaattttgtttattatttgtttgtttttttcattttttttgtttatatttaataattaatcgcattttataggttaattttcttgttttccgcctttgtaattgcactttaaaagtcaaaagtatcattcccctttttctgccatttattattgtaatgatcttgccaaagtgaatgaatttaataaagaaaatgacaaattacataaataataaattaagcaaaataaattagttaaaatgaaagattattcttgtaaatacaattaaagacttcggtccaaatgagtccaaatgtgtcaatttattaatgactgacggggctaaatgccgggaagcctttgaatttctgttcaaattcgtccaggaattcgggctccatcttttcgtattgtgcagcaca

SEQ ID NO: 16946 - DNA, 1542 bp, Heterodera glycines
  misc_feature (1467)..(1467): n is a, c, g, or t
  misc_feature (1470)..(1470): n is a, c, g, or t
  misc_feature (1499)..(1499): n is a, c, g, or t
  misc_feature (1519)..(1519): n is a, c, g, or t
gaaatgcataaatgatggttgttcttgccagaacattgtcgacccggtcccgcacattctcgaccatgccattctgatcgagtccgactttacgatggacaccagccaatgggcgggatcagagccatgcgaatactgatcagatcaaccacacgcacgcactagtagcaccaccggcattcctttgatcgtttagtgatacgaaagtgacgggtaggagacatccgattggttttttggggagaaggggggcttaattcgatgaaagcggataattttacccgaaattaccaaaacagcgaaatcaaagcgcagtgagcgcgtaacccggtcttatcatccttatcagtctgtcttatcatttttatcatctctttttttgcccatttgtcttgccttagcttttttgtgcaacccttctcttctcttcccttcctctctttctctgttcctccaattttgtttattatttgtttgttttttcatttttttgtttatattaataattaatcgcattttacgggccaggacgtttgcgtaccgccgttttcgtacgagtggatatgcaaaaaaaaattgcattcaaataatttgttaattttttttaattacttttaatgttttgacagttaagcttttattaactacaaaatgaaccagcagcaagtaattaaaacaaaactaaataatgataaattggtgcatgatggtgcacagaaaaagaagtatcgcgatgccgacgcacggattcttcgtctcgtccaacgctataacgatatcaataacaatattgtccctcaaaatgatcacaattatgccaatgccaatgtcaatcccgaaaaccttaacaattttctcgctggtattttccgaaattatgagatgcgacctattttgtcccggattttgttattattataaagttatgaattttctacaaaattttatgaatgggaaacaaaaaatgataaattttggttttattagttcttaagtttttctatttgaatctgacgcttgtacaagaactcgtacgaaaatgtcccccgtacgaaaatggcggtacgaaaacgaccctgaccgcaagattagcatgtatttgtcagataaatgtatgtccttattttgaaaacttataatcactttcatatgaacatatgaactattgataatctttataaaaaaaaaactaaggcaaaatgtgtaaaaattcaaacacaatatttttcaaggctaaaaatttctaagaaattaatttaggataaattaggggtcccgctatttaggaaattctttaggattctaaaaataaatttaatcctccgaataaatttaaaactcataaaaaataagtaaaaatcagaaaaaaataataaagcaaaaagtggaaaattcaaataatattttcctcaaggccaaaatttctcagaaattttgtataccttaaagtatagcagttttcctacnaanatttggtgcgtcacataactaaaatgaantgatggatgatcatttttanaaaatttatatttttacaaaatt

SEQ ID NO: 16947 - DNA, 1645 bp, Heterodera glycines
tcacggccattaattttgggctccaagcgcaaataagtttattatttacttagtaatcagaacgccaaaactgcaaaacttaaaatttattggggattttcccttgtaaaaatgcaagagccgatctcgagttagaaaagaaactttcaaaaaacaaaagagaattcgatagaaaagaccaaaaaattcacttaggcaaaatttcaataaaattggtcaataggaaaaaaattttttcaaggacaacaaaatcaaatttatttgcaacatttttagcataaaaaatggtatctacacgtaataaaactggaaaatttatgaagctaagcaattctgggactgaagcaaagcgaaagcagaaggaatggcgccaggagcatggtcgcagagtcggttcgacgccaaaaagtgacgaaaattgaccaaaattaattttattttaaaacactgcatttttcagcgctaaagcagaccgaagccgagacaacagcagacggagagggtacatcgacccaagccgccgaaagtggaccatcaacgtcagctatggaccttcgtaagtcaaaaaagtcactattttagaaaaattaaggcccgcattcaagcccaaggccattgtcagcgactccgatcaggcgccatgcgcgtgttcgtgcaaaaactaccgacaaagcaacgaacatggatcttacaactaccgacaatgcaacaaacacggatttgacaactgccgacaaagcaacacacatggatttgacaacgatggataaggcaacagacgtggatttggcttatgaggacgccgcgacacaaaccgagcagttggacaaacagctgaaagagcaggaacaagtgatcagctttcttcaacagcaggtccgcaacagagacgcactgatcgctgatctgcgccgtcaattggaacagcaggcgaaggaccagccaacaagtaaattttgcaaattttagggtgccatttatcattcaaattgtttttagcatccacacggcgcaaaaagaatgctgctacattggagcagacctcgcggcgaaatctggccaagaaaatcgctgatgtgatcgatcgagatcggtcgcggtcagtgagccgatgtttgctgcaatctctgcatcgtgaagtacgtcacaaatttggacactacacaccgatgaagaaggaacaactccgacaacaacaaacaatccatgaagaagatgggctgcttttgctgtcacagctcgggactcaaaaagcatatgagaggatgaaggcactcttgcgtcttatcggcggaaaatttgatgttttcccaccattgaaaaaagtaaaaatgtttattttaattcaaaaaaaaatcttttttgggtgatcaaaatcaaaaaggagatctgcgcagcactccaatatgaggcaatttcaacgccgcatggaattggatttttttgttccgacatagccggggcactggaattcagattgtcctcggccaaggacaatctgatcaacttcagaccagacgaattgattttaaaattgagcggcgacaatggccaagggttcacaaaaataaccatttccttggcccatgcttcacatccaaattcctccggccaacaatttcatcgtggcagcatttcccgcaaa

SEQ ID NO: 16948 - DNA, 1585 bp, Heterodera glycines
aaaatggagagaagccaactgttgctgctcgagcgttgaccatgggattcgtggatgaaccactttttgcgatcaatcgaatttgaccggatatttttgggcgctttttcacgtcttccagggcattggaaatgccttgatcaaagagctcgaagggtcaacggaaagcgcggaaattgcgaacgaatttttcagaagcatccgggtcaggagggaagcgttcagaaaaaaggacatgacggggaactccatcagaaaagttctgattcatgcggaccaattggagagacgttactcctctgaatggccacaaatcatttgccaaaccctgggacaattggcaaagatacaaacttttacaaaagtccttttttatttggtttttttgaaaattaaaaataaatttaaggcccagcccatgtcgccacgggatctggacgaattggaaatgtcgattgatcaatttcggacatttctcaacgatcagccacggatgcgcactttgctcgccctaaaaccaaaggtccatttgctgttgaaccattttgtgccgttcgccagacaacaccaatttttggcacttttggacgagcagggtcataaataattttgaaatttaatccatgaatttttttaggtgatgaagcactgcattcggtgtggaggcgattggaacagctgtggaaaacaatgcctgacgaagaacaaatgcgtcaattgttggaacaccattttgtgtcaaattggcttctcgacacaggaaaaattgacgaaatgaagcgggccagtttggtcaaagattgattcgagataaaattccatttttaaggaccgtgaagaacaacaagaagaaatcggaggccagaagagcgacggagaaagcaatggagaagaacaacaattcgattttgaataaaaacagttggatgaaaggtttttctttgtttttacagaaaataaaattaaaaaaaaattcttggcttctttaaaagttgttttatcatttcacatatatttatttgctttaaaaacctcaaaatacagctataacatgcattggattcgaacctgagaccccccttttggtgactaactcacagaccactaagacaaaaaaaccaacttatttgcgcttggagcccaaaattgactcgccgtgtaatccaatccaatttcttcgcgctgcgcttatcacctgcatttttaaacattaataagattagcttaattgtccctttgttatctaattttgtcgtattctcgaaaccatcaatttgacgtcttcaaatgttccaaatggcaaagttaactaaaccagatacaataatattctaatgcccaattaaaataaaaattcaaatttaatttcattagtacagtaaatttaaaaaaataacatttccttttttatgtgaataataataaaataataatttaattctctgtcgaaatcagccactgtcgggaatgtcggaaaacagtaaaataaatgaaaatagttccctgtcgaaatcagtcactgtcgaaatccactgtcgaaatcggtcagtgtcgaaatcagccactgtcgaaatttcctggcacg

SEQ ID NO: 16949 - DNA, 3447 bp, Heterodera glycines
tagtagagggaaatttttccttttttgggcccattgcacattttttcttgccggccactcccccatcgattgtgagggtataaatgcccgcccattctccattttcttcacttgtctagtattctacaaatttttttctatatttttaggtctgttcactcttcagtaataaagtcttttgaaagggatttctgcaatttttaaggtattttaaggataagattctccttaaatcaaaatgttatttgtgaagagaagacattcttctctgtcacaaataggagccgaacctcgactaagattctcgcaaatttttgccaaaggcttttttaaacaaatttttaagcaattaaataatttaaaggctgtgcgtaaggcatcgtaaatcttcttacacatatcgagtaacttaaactcggtaggtagaggtttagcgcgcaacgactgcaaccgttcttttgccaaaggggttgttaggcgcaaagttctaatttttctagaatttttcacttttggcattctaaattaatttttaaattttcttatacattatgctattcaaaagaattataaaaataaaattgtaataacaaattaatgggtgataaaaaatttaaattattataataatgttctatttaatgaaacttttaaaattgtgaaattggtcccattgcctgaataattcaatccatttaatattaatcattgatttcttttatcaataaaaaattctgttaaatatttcatattattggaaaattttatttttaaaaatacttattttggaatgtgatactgttactgattatcacacattcgagaataaaacggacagaaatgggcacaatatgaggagggacgatcagccactaaaattaattcaaaacagctaaggcgagaacagatagggcgagggcactgatcagaacagatagggcgagggcactgatcagaacagatagggcgagggcactgatcagaacagatagggcgagggcactgatcagaacagatagggcgagggcactgatcagaacagatagggcgagggcactgatcagaacagatagggcgagggcactgatcagaacagatagggcgaggcacagatcagaacagatagggcgagggcactgatcagaacagatagggcgagagcactgatcagaacagatacgacgagagcactgatcagaacagatagggcgagagcactgatcagaacagatagggcgagagcactgatcagaacagatagggcgagggcactgatcagaacagatagggcgaggcacagatcagaacagatagggcgagtcgtgtagacccatggcaatccgaacgccgccctcccgcgcctcggccgccttcgagcgcagcatgtggtcacgctgcacattttcgattgtggccaatgtttgggcattgtccaaaaagtaaccgactatgcccaattcgctagtctataattgaaatggaaaaggacaattaatcataattggtggtttgtcaagccttaattcaatcagttaccatggaatacattttcggcttttccctcgcgcgaattgaataattctgaaaataaaagtgatgatttaatttggatttgcatatttggatttaacttggatttttgatatttaaatttaacatttgcattgttttaccgtcacttggagcatctccaacttttccatcagaatgagtcccgcgcgttccgtcctcgtcatcgttcgcaatttgttcttcccagaaattgttgcccccccccgtcccggttcgtttttaaaattcacaatgccaagacaattaaaacaaaacaaaagccagcagtgcctccgagagcgccgccggtgaagtgtatgaaaaattgaaattttttaataaaaaatgaaaaatttcttagtggggaatatcacttaatttttaggcgcgtaattaaacatttttccatgccttctaaattaaaatttatcttattgtgctacacaactaaaaaaaacaattttttttttgccattggaatcgaaattttggcgctagtgaaaaagtaacctattttgaaaattttttcacttaaaaatctgtcactttataactagcgccaaatttcttaatatgcccaaataattgtcatattcttgatcagcgacctctaaaacccccgggtatttggtttcatgactttttaaacaaaaaaaatttaccaaaaaaaccaaataggtcactttttcactagcgccaaaattttcaacccatggcaaaaaatgtttcatttccacacctcggtccacccactttcggacatgaaaccggcactttgttgtcgattcattctttggaattgatattttaaaataaaataaatcatataatttatctatgaataaaaatagaattaacaattttagataaaaattaataagattctcattgtgaatggtaaaggtctagaacacttgtaccaaaccaccaaatcgctactaatgcacttggctctattgcagttcacacgaccataaaatttttttgcaagtttagtgaaccataactttttcgagaagcattcaatcgtttcgttttcgtaccgaatgcccttttggtttcgttttcgtatacaaaatttttttaaaatttttgtgcagccctgctcttaacagcaaaaaagagataaataaatgtgtcttaaaatgtttacaattaaaataataaaaaaaaacaatttagaactccattttctttgctgattaattgggttgggagtttttttaacctaaaaattgcctaaaatcggtaggatgatttgaattataaaaaaacctaaaatatgatcaaaaaaatggggaaataagacctaaaacattctcgggtgaaactggtctgatatatatgaattaaaaaagtaacttttaacaattttcaaacgattttttttatcgtttttattgcatttctgtcagggaagccaaaacttgcgagaaatgtattccacagaatcgaaaaccgagaccgagaatgaccccgagaaacgatacaagaaccgaaacccaaaaacaatagaaatttctcgactcgggaatcgaaaaccaagaaatattaattaatttaaaagtattttttaaaaaatcaatgaaaaagggtaggtcaaccgcaattttagcacagaagtctcaacatcgaatttgcggtgcgtttttttcaaaaaactttctttttttgggggggggggtgtatttttaatgcgatttgataacagatttatcacgaaaaactgtttcctagtgttttctagccgctgatcacgacgaaaactttgagctttcaactttttgctcgaattcggtttcaagaaagaaattggtcaaaatggacgctggattcgtgatcagcaaagcctgaacattctatgaaacaatttttcgtttgtgatttgactctaga

SEQ ID NO: 16950 - DNA, 431 bp, Heterodera glycines
cccagggacggtcccaggattttggcttgggggggggcacctccccccgggcgacgacctttttttttttttttgcttttcacacccgttttttatgtggcgcggtttttgcaaaaaaattttggggtacagggggtccggcggtgccgataggcgccgccgggaaaatttttgcggttttaaatgcggtttgttaacagattttgtccaaaaaatgaccaaattttgtgattttgagccatttttagcagattttcattaaaaatttgtggattttttgaaaaatttagcgacatttcttggaaaatttgggtgaggccaggtctgtggggtgggggtaccagcccagcaaggaaaacctaaaattttcagccaaaatattatttttccttaaaaatttttggacccggggggggggggtcttggggggg

SEQ ID NO: 16951 - DNA, 2026 bp, Heterodera glycines
ggaggaaggtctgtaagtgggcaccaatcctttgaaaatttcgcctggaatggtcttagggagggggctgaatacgtaacttggttttttttacttacagaaacaatttggccctgtttttgctctccgatttgcttctggttggccccacttcccccgccgtcgattggcccgcctatcaccccaaactgttacacatggcgacaataaatttggactcacatcggccaattgtgtgcgcccatgtccgtcagcttttgctgaacatttgcctgtattgggcaagcagtgggtcgtgctccattaaccaagtggccaatgccattctgaaacattgccattcacccaattgcaatggccaaatcaattcaaatgaacaacaatgccaaaatgcgatggcaaacaacgtgatgacaacgccaataaaatggggcaatgccaatgccaaaaatttgactgtaaaaggagaggcccgtacaatgtccatggtgtttccgtcaaagaaagaactgttaactgtgcttgtccagcttttttccagcgagtaagtcacgtgaatcatggggaagagagttgggtgttggtctccgttcggtggaaagtagcattgtaaagcaaaactgttcattgttaagtcagcaaattccgctttgggagcatgaagaagtgagtccgttgtgttggaagccggacagtgtgaatcagttggagtgtttggtgcgtcttttggtcgcttaccttctcggctctatccccgatttggtgcttcattggaccaattttgccgtcgatttcgccatctccagcaacaatttgcatttggcaggtggactgttcgtgctcttgcttttccttttatttatttatttttcaggccgttctttccaaactgccggtgcccttggcctcagtccgagtccgtttttgcaccaaattctttcgaggcttaccgaaatggtcggcgatgtcagtgaggagtcccaaagttacatcaccgacttgttcatgtgcttacaaaatttggcccaaaatatcacaattgctgcacacctcgccaattcccctcaattacaatcatcctctatttcaactggtcacaaccgatcagtgagttatacccaacaaatttcgacacaaaatttgcaattcaaatcaccgtcacgaagaataacacagaaaaaaggtgacttggttatcgaatcaaatttatgtgtcgttgatttttgaggttcggacatgcgtcattctctgctcgttggtgccgaaattttattccccatcaaatcggatgccaaacctttgactcggagtcaaagtgcggcaacgcttaaattctctgaggatagcgccagcattttactcactgaaaatgacatggaaatcatttcgcaacttttgttcatcgctttggccatgacagaatccaatttggaaaacgaatttcttctcggactcagattcgttgacaaagtgaccaattttttggcaatttccattaaatcgcttttttagttgctgctcatttctgggaaagaacggctaaacattctcgagaaattggaggaactgatcgttcagcatgggtgggacgactttcccggcattatcgcacattgcttgaaaggtgccataaattgaaaattgtcagaatattttcctttccaggcactttgtattcgtccggttctgaatgtgccatttccgtcttttgcaattgtttgccgcacctcagcgaacaaatgatcgtctctaaacagccaaacgatgcttttgcgcttattgtcattgcttctcttcctcaatttgtgctcaacttagatttgcccacccaactttgttccaatctggcccaaaagatcatcttggtgctttaatatttctattttttaaattgaaatggtaagccatttttcaaatagtattgccaaaatcgaatttccaccgatgaattggacgtttcttctggcgaccatccgatctgcaatttgaacgctgttggtttatttgattgcctttctctacaatt

SEQ ID NO: 16952 - DNA, 3222 bp, Heterodera glycines
tgattaaagaggtacagcagtgattagaagaggtacaacagtgattagaagagatacaacgatgattaaaagaggtacaacagtgatcagaagaggtacaacagtgattaaaagaggtacaacagtgatcagaagaggtacaactgtgattaaaagaggtacaacagtgatcagaagaggtacaacgatgattaaaagaggtgcaacagtgattaaaagaggtacagcagtgattagaagaggtacaacgatgattaaaagaggtgcgacagtgattaaaagaggtacaacgatgattagaagaggtacaacgatgatcaaaagaggtacagcagtgattagaaaaggtacaacatttttgatgaaaatgtgctaaaaatggctcaaaatctcaaaatttggtcattttttggacaaaatctgttaacaaaccgcatttaaaaccgcaaaattttcccggcggcgcttatcggcaccgcagaccccctgccccctaaaaatttttttggaaaaaccgtgccacaaaaaaacgggtgcttataatgaattacgaatttggaaaaattttctaatttatgagccatttttcgaaccgagaaaactttttgcatataaactccttaaaaacacaattcgcgaaaaatacccaaaacccaaaaaaccaatcacatttagaaaaaaatcaaaataaaacttgccgaattggtaaattcgcaattcacttttgccgtcgaaatatttgtccaccagagcattgaaacgtggcgaaaggagtgcaaatttgaggccgagttgaagacggtcaaaaaaggaaaatatccatccaaacattgttacgcagttgctgaaaatgttaagaatataaaatagcaaaaaaaaagtaccaaatttatgttcaaaacccaaaaaagaagtgaaaaggtcttaatttgtaagcctgttcaataacgaaaacataagtcaaaaaaaaatttggttcccaatttcatatgtctcaatgtaaaaatgttgaaaaaatagaacttacgtaaatccactttatccatcaaaatgtttgtccactaaaacatcgaaacggggcgaaatgagtgccaatttgaggacgataaaaggaaatgtccacccaaacatcgctgggcaaccaaataaaataatgtaacacaataaataaaatttttagttgtaccaagttaaattaatgggtttaaaaaaattcgtagtaaaagaaactatagattagaactaaaaacatttggctctaatgcactttatgagtccaatcgatttttataagtccaaaggtattttatgagtccagaagctaaaatatataaaagctcagcgtttaggccattatcagaaaagatttaataatttaagtaattattgattattttcgtttgttgctttttttaaatgttgttttttttgttttctcatattattacatttaaaatacctttggactcataaaagtgattggacacaaagtggattagagccaaaaatttttgtttataaaaaaatcaaaaagttttgacaattttttgtgaaactggtattttagtaatttaaaaaatattaaaagcttacagcattcaaatttttcattgcgaattctgctccaccatcattttgcttttcccatcgaattctccactaaacatcaaaacggggcgaaatcagtgccaatctgaggccgagttgtagacggtcaaaaagaggggaaagtgtccatcaaatatcgttgcacaacacccagctgaaattgtgaaaaagcttaggtaaatgagtctaacttgaacttagaaaaccattaggggttaaatttggtaaagcaaccacgaaatacaaattaaaaagcgaaatttatcaacaaaaaatttctggaagtttcaaagaaaaaagttctaattttttggttaaaaatggtttaaattatttttttaattgagcactactggatgactttcagttcgttactatatatttacataaaacgaaaatttaaacattaaaaatttaatgacaattttcatatttaagtgtagggctgccaaatttataaaaatacatatatttttctcggcttctcaatgctctaaatatgctgaaaaaagccacaaaaaataattaaaatataaaaaaattgtttataataaaaaaaagcaaaaaaaaaattgtttgaaaaatgcctaaaaactcgcgacaccttgccgaaattagaaaatatttgaaacgtattggtattttttagcttgttatcattgagggcgcatcaaaagacaccgaaaaattctttgttttgttaagcctacgttaaaaacaataaatttcaaaattttttctaaattttgtgactactaaagacaaacgttcaccatttcgcgtaggcttggcgaaaccaagcgttcttggtgtctttagatgtgcctcagtgagataaagctaaaaataccaagaacgctggtttagcccaagcgtatgccaaataatttttagaaaataaaaaaaaattgtaaatatcaagacttgacgaaaatcataaattttgatattgctaaattagtgctcagattcgtgaccagctcatttttccgatcctagaaaatgtcttaacaaatcttaaacacactaaatttttttgcctattttgaatgtcgtcctgaaattaaaaaatgaggtaccaaaaagacaaaaatcttaattaaaaaaaacgccgaatttacaaaaagaaaaaaaattttagagccattttgataatttgaggcccattttagggcacaaaatctttaaaaagattcaaaaacccttaaaaaaacccggcattttaacaaaaaaatttttaatgacttttgcagaaaagtttttaattaaacaaattaaaaaaagaacttgccgaaatttttaaaaaattcactatctacattgaaatttttgtccaccatcgaatcaaaacgtggcgaaaatacacatccaaaagaactaaaaaaaattcccttgtatttttgttaaaatatggcgatagagcaacaaaatgtttttgcaaataaaaaattgaaaaaaaaataattgtgactattttcatgagtaaaaaaaaaagtggcataaaatcgctaagtaaaaaaaagagtaccctaaaagagcattttttatataaaaagtaaatcaaaaagtgggttgaccagtgccgtgcgcggccaccgaacgtcgtatttagag

SEQ ID NO: 16953 - DNA, 2770 bp, Heterodera glycines
aatcactaataatttctgatgaccttaaattggcatttaattgacaattactatgattaattaagggtggtcgtctcacaattcgcgtgagtgaaggtgaacattcccttgagaaatttttttgctaattttagcatgcggatgaatccgacgcggggatttactcatgcaaagcgcaaaatttggccggcactgacataaagccgcttacgttgggaatcggaagtgaccccccccccccccaatccgccacccatccatctcttttaattgtgacaattgtcccaaggtgccccttcaattgtgccaggccctgactccgtttttgctgagatccaaaggaccgttagcattccctgccgtgcttttggagtgccaaaaccgcaaatccgctggctaattaacggagagccgaacggcatgggagagagaggcgaaaaggaaagaattgtgcatttgccagacgattctttgctgataaaaggttccgagaccggcggaaggaacatcgatcatttgaaacaattaagaagttcaaacgacggaccaggccagcttcacatgcgtggcacggaacgaatttggagaacgactcaaacacatcaatttggtggtggtcggattaggtgggttacggtaggtggacagagaggaaacggtggcaaaatgaggaaggtcggggggggggggacgaacggcacggagtgacatggcatggcactcattaattacccacatgagcatttttattgctttcccatttcaatttgcaatttttccttttctagtgaggcccgtgttagcggaactgcctgcgcgaatggagctgatccagggcaaagagatgcaaatcaactgcatcgttctgctcggcacccctcggcccaaaattcgttggcttaaagtgccgactgtccgctgatcctttcagtccttcgcccattttcagaatgatcgtccgctgatcggtggcgacgacaaacgcacggcggtggacttttgccgaatgcttttctatctcttattgtttgcgattaaaggtgctccccgatgggtctttgctgttgaaaaacggctcaaaagaacacttgggccattacacgtgtcatgccgaaaattcggcgggaaacgcaacggttggggtggacgtggagctgatcagtgagtgggcaccgatcatccgatgcaattaataaatcattgatcaacctcaacccaaacgtgtgccaattccctttttggcttttttattttgccaaattcccttcgtttttcgttcatcctttttatcttttgccatttttcttttgctttaacaaatcccatttcattaatgccttttgtctctccctttgctccgtttgttgtgccgttctgtctttggcatttcccttcagtgaaaccgacaatggcaccttcgtccgcccttttgggtccgtccggcattgaggaaatggtggcccgaaaaggagcccaattggacattcaggtcgtctcatccgcttcttatttttaattgtgcttttctttttgtgcgcttttagtgccccgtgagagttccgttgggccaaaaaatgccgaagattttgtggtctttggactctgtgccattaaatgtgaactcgtcgcacttcgtccttttggtcagtttaagctcccttcgagaaattttaatctcgataagtcaaatcattcgctccgtgtgaacgaagtgagcagtgaacacgcgggacgatacaaatgcaaagcgataaacgaagcaggagaagcggacaaagccacgcttgtgaaggtcggtgaagagaaaggcaatggtcggacaaacgaaacaaaaaagtcgagactaacgaatgccaatggaaaggaatgccgtagataaatacattcccaatttgcaggttcactccccgccgaaaatcgccttggcccaaaattcgttcagtttgctccgtggtgattcagtgattttgccatgcgaagtcgagggagagcccgaacctaaagtcaaatggtgggcgacaaagccaatcattggcatattgtcaccccattcaaatgccaaattggcaggtttttgaatggggaggattttgtggacggagtcattggggaggaggggtcgttggcattggaggcggtggaggagcggcaccggggaatgttcaaatgtgtggcggagaacgaattgggacgggacgaacagaacgtttcgctggccgtacattcggcaccgaccattgatgggcacggcattgtgagaagaagacaaaactggcacaatttaatggcatttggtgccaggttcgttcattgatcgctaaccaaagtgattggttggagttgcgctgccccgcgaccgcacatccgccgccaaagaggcggtggagttggaatggacagcgaatcgactcacgagcggacgccaacggaacggtcactccctccggacttttggcacaattcgaaatgtcatcgaatggatcgctgatcatccgaagagtggccttagcacatgcgggcactttcgaatgccatgtttcgaacgtggccggcgaagaccgaattcactactcactgaaagcaagtggaaccaagcaacatttgccatggcttttggtccgattatttcctttaggtgcaaagtccgcctcggatcatttccgccgattcggtcgaaaatgccatcttcgcttcggttggctcttctcgggatttgctctgttctgctgagggagtgcccgagccgatgatcagttgggaaacggatcat

SEQ ID NO: 16954 - DNA, 874 bp, Heterodera glycines
  misc_feature (71)..(71): n is a, c, g, or t
ttcttttaatccatcggcaggtgtgcgcactacaaacattcggagtataaaaggcgtggagttggcacacncaatgccacataatcttttttgtcaccattatttggcggcacggcacgctccgcccaccatgaaaagcgcatagtaataaattataagcacaattaagaaataacacgacaaattggggcattgatgcgttcgacccccatctttgttttttgtatttaattctttttgtgtgtatgggcatttttggctcattaaaccaatattcttcacccccggggggcattaagcactcaaaagcatccgcttgcccttcctacgcgttgcgcttttagtgcttatttttacttacgcctcagggcactcacgcggtttttttctaagcaatgaaacgaaaaatgaagccaaaacgccggaagaaaatgatgagcaggtgactgaccaccaattaataagcgtaggcaacaaaatgcgtcacgcaaatgcgcaagaaaagccgagtcacctgctgcttttcgacgaattatttttaaaaaactccgcggtatacacaatccgattctcttgtcactttttgaattttgtgtttgcgtaatgccattaaaataaggttcaaaaatatatatatttaaaaatggttggtaaaagttatgaccaaaaaggttggaaaatccagttttttaagttttttggtcataacttttttgaaccttaacgaaatttttcagctttattcagactaatagaggacagttagtgctattgactgataacaagattgttggatttggttggcaaaaaaaaaagttatagccaaaaccccgctggggaccaaacgtgccggggcccaactgagcgagtccga

SEQ ID NO: 16955 - DNA, 2095 bp, Heterodera glycines
tgcacgttcgttcatatggcagtaaatattggtgtaactcattgacatttttgggtttttttgccttatttgccaaattgcccctggggaagaaagggtaaaaggagtcagtcagtcggtggtcggtcaatttgattgcgcccaattagtgatgctaattgctgccccacccaattttctcatttgatattttattttgttttatattcgtgtgaggttggataccatttattttttgcttctactgcagcttctccgtccgatgttgtcaactcgttagctttttctcccctattaaatcggcccccatctttggcttattaagcgcccaattcgttccctgaggggacgttcgtccaaacccaatgaatgaatggctcatccgtcgtccgcttcctttatgtgttgttgcttctttgtcacatcactcaggctttatcttccaattatggaaagcagttcttttcatgcatcatcgacaaatgtgttcgcccctccccccgggccgatctcccccttccccccccctctcgcctaattgctttaccgctttacctccccccccccttcctctcccaatttacttttccatcattttcatattccattttagtagttccagcagaactcctcctcagcagactcactttgtgtcctgtcttgtcgtcatattctccctactctctctgcccatttgggcccattaatccctcgggggtgggagaattcgtagcgcggaagtgggggcgaacacttctgacccctcccccccccccccgccgttccgctccccggggctcatccaatttgttctgcgctttccttggtggcacccacccgccgtttgctccgcctcccccctttctctgcagtgcagaatcatttttcagtccgtcattttcataatttggccaataatccgacccaggcggcacttggggggtgtgcttgacagacgacactttttatgtgctgctgctgatgccgtgactgcaatccctttttggaatttttagatattctaacgtcacttccattagcgacattcggcacatatttttggccaaactctgagaaattgcccggagcaccgcaatctttttaactataaaagcaactctttcttccccactgttccacaaaaatcacgcgccactcaacacacttttggttgaaacaatgataagcccctgcaacaaacagcattcatcctcctcttcttcctcttcctcctcatcttcgagctacagcggcgctgcggcattcgcaacacaacaacacgaagttggagcagtagcagcaccgtccgctggttcgtcgtccgcgtgccgtgcccatgcgacgccgccgtgccctcctccatcagttgctgttgagcgggccgatgataaagcgccggtgttggtgtcgagatcaaatttggcactgacgagctgcttctcctcgccctcctgcgcttcccatttcttctcctgtccatcctcaacattccaatgtgtgttcatcgccgttctgttgttgtgctgctccgtgtcgacgagcagcggaagagtgatgggccatcatcaccaccacagtcatcagcagcaaattcagcagttattgctggatgaggacaataaagctgctgcacctccctcagaaatgatctcaatgcttagcggtcagtattaaaaaaagacatttaaatttgtcgcaaattaatcactcaattgaatcccccttattcttttggaatataataagataatttaattaaaatatattaacaattagaaaaacttataggttttattaattatttactttttttgacatttctttaattttattaaagatttgtttccaataaaataaaattggatttaagaatcacaaaaatttatatcactttaaattttgtaaatattaatgtttttaggcgaattgcttctggccccgtcatcgttgcgcaaattggaaacggacgaagcagaaaatgtttgtgcgaaaagcagcgatcgggaggcgacaattgtccaatcattgagtgagtgggccataacacttttttcgctgatcatcactgatccaaccagaaatttaatttatcttt

SEQ ID NO: 16956 - DNA, 3574 bp, Heterodera glycines
  misc_feature (3544)..(3544): n is a, c, g, or t
tcgccgattttgtttaaaattatttaatttatttaattgccttctacttgagcgctcagggggggggtggctttatttcaagagatacggtaaagtgcttgatttgattggcttgggctaaatttgagatttcacaaatccccccgccctttttttctaacgtcctcctcctgctcgaggcccatttggcgtttcatgcccctgaatttgagttggtccaatgccatgtttccctcctcgtcgtcgttgtccgtcggctgctccaacttccgacgaatttccttccgtttcagcgcacttttctgcaccctttcgatggtttgttgccatctgtcggatgccaaaaattgggccaaattaattaattaatttaattaattaaaattcattttttaattaaaatccttttaaattttgaatttcccacggcttcacgtccttccgctgcttgcccttcacccgcaacacttcggccatcatcagtttggccacgcttcccagcggactgagccgcgcctgggaaggactgtgaagctgaaacatttcagaaaaactgttgaaagtctttaattgggtcctaattaacgctaacctcgtaatagttcttcttcactatcgatgtgtgccgacgttcgcggcggtgtgccgcgtaggcattggccaattcgaggcccaagggacgaggagggcccagggaattattcttaattttcgaaatagactttggcttctctgcgctgaaaagggctgacctaaattttaaaaatgaaattccatatgccaaattttcaaaaacaaacccacaaatttgggacttttttttcaattttccccattttagctgatatttttggctttttatctgttaatcctacctcccattttctatggagtaggcttttcgatttatcggttgcccttccctgtgctttggttgatcaaaattgaaatttcaatagaattttcggatcggaaaaaccggccttaataatttgttctatgtgctatggcattttcccacttgtcccccactttctgtcctccgaatgtgctctttttgctcagccaaacaagtcgcttttgcctccgttccgttttccgtcggctctctctgatctgtgccctctttttcatacggtaacggtcgaaacggtaggatttggcaaaggcctaaaacatttgtctgggcaaggaaattttgagtaaatattccctcaatttgttatttcccaattcactttcgcataaatttttcgtccatcaaatcctgcgcgcaacagacgcgacacacagcgggcgtgccgtggcaccgaattggcgacgtttgaacactcgccgaattcgtcctgggcaggtcttggcagcgatttcatcctgaaaatgccataatttgaaatttgtttttcaatttgggtcttcggacgagtgcactttttgttggccaccgcggcgagcagtccggacagagcctggtcaatccctaaacaagcagggcaatttgatcagataaaatggtcacattttggtacaaaaagggtcataaaattgattttaaaaaatggtttgttcatcaacggacagtgctggtacagctccatggtctgctccgtgccgatcggaatgttgttgacgcgggcaaaaaattccttccgcttcttctcatcaattgagttgtcctcttccgcagcaatcgtcgcagctttcggtggaaggcgatcttcttaaatcaaaaagtatttttctgtctgatcggagggttcgttttggatccgtgccgtatttgccgaaaattcggtgtgattcagttatcatgatcagtatttagtttgactgtctttagaagttggcatttcgccatcgttcacataacatttgccttttttccatccttttcggcactcaccgtttttggcactgtccattttaattttaattttttcaccttttccgtttaattctccgcttctgctgctgctaaaatttgcctcggcttttcctttcgccggcatttgccgaatcatttgccgcttttcttgtgacgaagacaaattaatcaaaaatgggaggaggaagagacagcaaagcagcgatggggaaggaagatgaaaaaagagaaaaaacatcggacggagggggaagggtactgtaggcaatttggcaatcaaaagcggggtacggtaacctgaaaaatatatttttaaaaaattaaaatgatactgagttgatcacttggagtttgattggaaacattaacctcaacagttgaactgattcaactgatcagtcattgtccatttgccgatttggagacgaactcggcaactgatcaattcttttgataattagtctttttgtttgtttgatccttttttgatagaattttgctccattagcattatccttatgataagcgacacttaaattatttgttgttcactcgcgcgcataacgaattaatcagtcggaggagcaaaatgagtttttgtgaaaatgaaaagcgaaatgaaacaacaaaaaaaaacaaattcttttgttgtgccgatggctttaataggcaaaaaatggcgcgagaataaaagcgattcattttttatttttgccgttggaattatttcggctgatcaaagagttgcgaaaaagacaaggcaagtaaaagcagcaaaatgatcaccaaacaaagggcgattgagtgatgtctttggtgtcaactcattcaccgtacccggcacatggcgaattattggacattaaaaattgtacaccgcaaaactgggcactttgtaaattgggtaaaactggcacattgaaaagtaggaaagaataggaaataatttttgtattgactggtctttctgtcctaaaaattgtggcttttatgctgatcagtcttgatggctctggtcctcccttttttggaagaatcccgaaaaattaagcactgaaacaaaaaaagggggaggggtcattagagaaaatcccatttaaaattttaatcattggcatggcacggcatacgccacaaaatatgaagtgagaagcacccgcaaaagggcagcagcgggggatggtttccgtgttgaattgttttttgttgcctctttttttggctgcaattcgttcggttaatttgtggcggcgtcggtgcccaatgaccggacagaaaatgcgaagagcgactgatcagaaaatttgatcaaaaccagcaaatggatgaacatgcgttcttttgctgctcgcagcacattgttccttcccaccaccgcaaagaccacccaaaaggacaacagaaaaaagtggcggaatggagcaacagttccgcctgcaccaatcagccgctgctgctgttgatcactgaccgtactgaactgatctgatcatttgccgatgatcaatgcggaacaaacaatgaggaagtgcgaaatatcaaaaataccaaaatttaatattactttcgttttataaaaagttttagggttcacagcaggggctgtgcagcagcgaagtaacggaagtccaagttccgacaatttattgcatcagaaantatgtgtccggtgtaccactgtgaatgggg

SEQ ID NO: 16957 - DNA, 768 bp, Heterodera glycines
aaaaaattttgttattttttaatgcgatttgttatcagaaatttgtaaaaaaaaatgaccaattgattaagtttggggtttttaggatgcttaaaatgaaagaaaaaaagttggaatattttttaaaattaaaattttaattaaaataatggtaaagaaaatgtgaggaatattctatccaagtggggaattgaacccaggcgaaaaattatgaaagatagaaagtttaaccactacaccacatgtgcatgtgtgtaatcccatgactaaatgaaataaaatttaattttttctcaaaaatttctccttcttcaccaatttcctactcttttctcgaccagacccccattcttaccagtgcaaatttttaccggcggtaccggtactagacaaaccggtaacggtaatttcatttttgaaaaaaccggtaccggtaccggtaccaaaaaaccggtaattaccggccagtaccggtaccggtaccggtaccgctcaaccctacttcgaaattaaggaattattggcgctatttgcaaagagtacccttttgaattctatcaaaaacaaaaggggggacccttttgttttgcaaaatttttttaagataaaaatccatgaaaatttgttatccgagggttttagaggtcgctgatcacgaatctgacatctaattcgaggtcttggacccaaagaaccccagggaataatttttcatgactaaatattaaaaaattttgcaaataaaaggatccccccccccttttgttt

SEQ ID NO: 16958 - DNA, 1230 bp, Heterodera glycines
attggaaatcgattgggtggtgcaaaaagtggtaatttgtatgacataatcgaccgatgaataatgaaatgaatccaaaagtaaagccccgcataaaatgttggaaaatgtttgctttgctgaccaataaataacattaatatttattcacgggagaagatcataagaaaaatgcccaattggaataatgagtcagcatctccattatcagaatcagcagcagattatttggccattcttcgaccaccaccaaatcgcaaatgttttcatgcatttttggtttttacatttttgaaaaaatcgaatttcgtttgtcttctttcggttaaacaaatccgggccatattgatgataattgatattttaaagtgagtgactgagagtgaaatctaattgaatcgggccaagaaaaccgggaaattcaagttttaataaggcaaaatcaagagtcacgacttcggcaacgattaaaatgacaaggaaatgtcggctctaatcgatagtatggtgtcagaatgtgtgccgttcttaccagtcgcggctttcgcatcacttccacggggacgccgcgaaaagcggccaactatttaacatttttgaaaaaaaaaactcgaatttcgtttatttctggggccctaccctactgatgctaatttacgagtccaaactcaaattttcgctatccgaagaactgattcctacatatttgaacaaaaaaatcacaaaatttcaggagggctttctctgtacacattgaaaaacgaaaccattagtcttacatttgtttattcacacacacatacatatacatacattcaaacatgcaaataattgaaatgacaacagttttttggggattgatcatgtgaatgggggtttacaatacaatacaacaatgggggtcagacgatccgatttctccacacgcatcgttcttcgggcagttccaccatccttctgtgtgcagttagtgtgtgtgtgcgcgttctgtccgttcgtctcgtcgtcctcaagccggcgggaagcgcgtgattgtgtggctcaggtccggcgcgatcagcagcgtggcgcccgtgttgttattgccggtgtagcggggggccgagaacagggtgatcaggtggcgatccgcgaagtattccacgccgcccgtgacgagctggaaaaaatgggggaaattattagtgtgcgagagtgaatgaaaagccaaaaaaaaactcacttgatgcg

SEQ ID NO: 16959 - DNA, 264 bp, Heterodera glycines
cggacatctacatttttgaattgaaaaaaaattggtaattactctttctttttctccatattgaccatcatactcatactccccccaccctttctcctccttcattttttttttcctttccttctccaaccctctcctccctctcttgatagtttaaactgaaggcgggaaacgacaatctgatccccatcaagctagcttctgcaggtcctgctcgagcggccgcccggggatcgatccccgatctagtaacatgagacaccg

SEQ ID NO: 16960 - DNA, 3013 bp, Heterodera glycines
  misc_feature (65)..(65): n is a, c, g, or t
ggataatggggtttcaacgatttgaaacggttgcttttgcccattatgctgggaggttcgattcnccactttgtcttgtccgagctaacgaagaaggaaatcgcaaaggggagcagcttagggtgtattgcgaaaacgacgtggaaattctgatggcggcaattttgaagtttcggcagttatttttggggataacaggagatttggatgtgatgaaggacagcgtgacaatcgctggtgttgtgatgaagatattcagggcaaaatttttgaaggacaggcatattccaatcatgccagagggagggtatgagagagcagagaaccagagtaaaatagcggtgaaatattttgagtggcttgcccaaaaaaaaagagtaaaagtgcggcatgcgtgtaacggaggagaagtgcaatttggggggctgaaggtggactgtgtgattggggcagagaaaaaaataattgagtttcaggtaaaagaaaaattatttcctttttaaacaatacttaaggggtgtgcatttcacgggtgtccgagatgtttttttccttggactatagcgccaaacggacggacaatggaagagaataaaagtagaaccgaaattcgcatggaaattttgagggaaaagtgcaaaaatttttcaatcggagaagtttgggtagaataaaacatttagaaatatttattaattgttagttttaggagtgtgatgtcagagaggaattgaagaaaaataaggagatgaaaaagttctttgaaagtgtgccggacaagggaccgatcaatttgagggatgcttatgccggggggagaacgatgcccttttgtttgtacgcaaaggctacggaagaagttgagatatcaatgttcgacatcattagtttgtatccctttgtcaattatggtaaaaatctacagagtttttataattttttccgcgcttaagacactccataccccgttggggtcccaaaaattgtagtgagcagggattttaatgtgaattggacagtgcccgacgatattccttatgatggactgctgaaagtgaaggtcgtccccccgaaaaatctgttacatcccctcctccccgtgcacatcgatgaaatgctcctcttccctaattgttggtcttgtgcaagaagggccaagaatgaatttgtgatgacaaaagatgtgaaaaaatgtaaccatcgtccagcgcagagagcatttttggggacattcacatcaattgagttgcggaaggctttagagctaggatatagaattgtgggattctatcgagcgtatcattttgaacagtttgacagtcaactgttcaaaggatatgtgcggatgtttttgaagataaaggtggaagcgtcggggtggccggcggaggtgaaaagtgaagatgaaaaaagagcattcatcgaaatgtacaaggcaaagtatgacatcggtttggattatgataagattgggtttaatcccggactaagaatgattacaaaattggtgagaaattataaaaaatctttaaaaaatgttcgaatttaagggtttaaacagtttgtggggaaaattttcgatgcgcaacaccctttcaagtacggaaattgtggccagtatggaacgttggatggaattggggagagacaatacaattgagtttgggcgcccagtaaaaataagcgaagagatatcaagagtcgtgtaccggaaaaaggaggagttcatcagggagcataaagtgtcgaatattgttttgtcattgtggaccacgagtgctgcgaggctaaagctgtacgagtacatggagcaggtctacaagaaggaggggtgtaaactgctctattgtgacacaggtgaaaaggaataaaaagaaaataaacaccaaaaatttagattctctagcttttgctcatcggaaggggcgctgtccgttggtggaggggaaatttttggggtaaaacataaattttgaaacgcatttaaattgtggttttaagggaaatgactcgagagtatgcggacagcgaaattttggagtttgtgtccgcgggcccgaaacagtacgccttaaaactcagaagaaagaaggatggtgtgatttggcacaaaaccaaaatcagagggatgacactggatagacgaaacgaatttaaatatgaattgttcaaagagatggtgttggactacaaagaaggggtcaagaaagtttttcactacccggagaagatcgggccgacaaacgacttccgggttctctcaaaagatgtacaaaaagaatatacgccggtgcagaaaaaaggaattattgatcatcactttaatgttttgccttttggatattattaatattttttttggataattttgtctcatgtttatagcatttaatattttaaattaatcaaatttgtttcctatttttagaatgtcaaagaaaaatttccaagaaacttcaaaagaattccgccgctcgaaaaatacaaaaaattatttcaaaaacagtcctaatttggaaaaatgtttcgaagaaatggagagtcacataaaggaaaataaaaaatttgggataaaagagcacgtgacaactttctattttaagtgccccgaaaatgaagatcccgaaaaaatgtttaaaaacatcctgaaaaaattaatgggggatgcaatgatccgtgaagctgagcctggctggaaaattgagaaaatttcagtggacctttattgcagcgccctgtcggaccccgtgatcctccctgcccgccccttccaacattcgaacccagacattgttttcaatgagttcatcacagacagcaatcatttggggaagtgaatttgttagaccagagaatttcaataattattgccacttattctttccctgttaaataaattttttaatttttttgatttctttatttttttgtttattacaattaattatttatttcgaccttttttttctttaataatttttcagttatggacctcctttaaaaaatattttga

SEQ ID NO: 16961 - DNA, 943 bp, Heterodera glycines
caaacgctaatttttgtctaacattcaccagaactcttaattttcaattcacaagcatttttctcatttaattattttttcattttctattgcaatctaaaaaagctggagtaataaaatttctcaatatttgtgtcactcataaattggacttttatataaattgcttaaaatggtatgacaactctcgatgaaattaattatggaccaaatttcagcctgttaagcgttggaaagagtttgatgagccttgctttttaagtcttgtggtgtcgggcaatttgctatgctgttttgccgaactgaatttgcgggattaattcggcaaattccacaatttctcccacgccgctctcaataaatcatttgggtttttataatttcaaaaagcatttttaatattttgggttttttgatgctttaccttttttcaatttggtcgtgtatttctttgattgtacccgtgctgtactggtgcgatgtttatgataatcttattttcggtcatttttgccgctgtttgagctttggcctcccaacgacaattccgggtggataaaaaagtccaacttttgtgtcttatcagtgatcacacaaaattagggcgagtttggtttactcccgcattttcctcgataaaaaaagatatcttaacaagtgctactcgagagtctcgcctcgagtcccggttcccaaatccaaattaagtgttaatttacatgataatctacctattttccttcaaatttagcgtgccatcatttgggcattctttcatacaagatcggccgctttttcctctcgtttcaattgcgcttttcatcccattcatttgacggaacttattgttaaaagtttaatttattcactatttgttttttatgtgcctcgtgccttcattttatgcatattcaaaatcttatttttttgccattttatgttg

SEQ ID NO: 16962 - DNA, 917 bp, Heterodera glycines
tttttcatcattgcagaaatgatatttgtatcacatatatttacattattttttattcctttttaattccattaaattcttttttgagatgtccatttatttccaaaccatgtaaattgcataaggaattacatttaattaattaaaaacattaaaaattggatcctattgtacagtgttgtacatttgtcaggtggcaattatagatttaaatggaatttcggccctagcggaaaagtggttgatttttttgaccagtttttatctgcctaaaactcgagaaaacaggtcgataatttgaattttctaacaaaatgcccctagagatcggtaaaattaaatttgctaatgcggttttgccgaacgggatttgctaaattaattcgataaaatttcgtaacccaaaaattccgtcgtttctcccacaccgatctcaaattccctcatttggttttaattattttaaaaatcgaccacttttccgatagcgctttattttcaattttttggtttttttgtgctttacctttttcaattttggtcatacagtggtggaaaaagtcgactcaaaagtgataaaatttgtaaattttaaaattttgcactttatttgacttatttattccgagattaaaaaccaccttatagttctttaaaaatatgaaataattcatgcttgtttaacttttgttgcggatcaaaaaaatcttttgcacaaattttatcagatcggctgagaaaatttttctggaaatttttgatggctcattgaaaagatcacaaaattctctaccgaattgcctttttatgctaaggttaccatttgaaaacattaaaaagcatcttgagtcaagatttttttccaccactgtatcttttcaatctttttgtgtcatattttctttgtttgaaacaaa

SEQ ID NO: 16963 - DNA, 988 bp, Heterodera glycines
ctagtgaaaattcccacacaaagcatacatagtcgaaagccataaaatatccaagccatgaaaacctctattagactacaaatttgaaaatttcgtttttcaaaaattatgtacagaacgaagtccaaaaattggttttctaacggattcgctcagataggccctagcgtttttggactacaacttttttctttgtcaacaaaatctaacattgttggttggtatcattcggaagttcttcacatgcttattgccttacaaaaagcaaaagattttctagcctgcaaaaagttattaagaaaaaacttgaaaaattttcgactttgcaattttcattttgctgggtattaataatttctttttatattaactcgtaaaatatgtattcatcaaaattttaaatgtgcatattaattttctaaatataggacaagactctcaaaatttcttctaattcgttattaggtaataatttttggaaaaaatcaaataaataggtaccttttgagataaatttaccatttttcagaaacaatattatgtatatatctcttaaaaatttcaggggttaaagagccgaattatattacgtaggggtcacgttttaattgaaaaaagaaaaaatattatctttagttgcgaacaaaagttgaggcttttttaagtgtaattttttgcatttacagagaactttacggttatctgtagggccgcaacttttagtgaagaaaaatcccaaaatagttaactaaaatagtgagtaaaaatcccaaaatagtgaagaaatagtgacaaaaagtccaaaatagtgacgaatagtgacataattttcagccaaaaatgagcaaaaataatttttattcactgggttgcagttgcaaatgagtagggccccaacttttagtgaaaaaactttttttttgctcaatttgtttgaagaaaggagctcaaaaaacgcatttccgctgtaaaaatgtttcatttggac

SEQ ID NO: 16964 - DNA, 1888 bp, Heterodera glycines
ttgtgaggcaaaagacgtttggacactcgcagttcgatatgttcctttgttagcagataagctcagcggtgcggaggcgtcgccggtaaaaaaggaaatacaatccattgtatgcgaaatgggtaaaatacctatggatttttaaatgaaaaagagcaattgaaaacttttcattatgccaaattagaaaaaaattcaaaaattaattaattcctaaattaaaaaactaattttgaaaaccaacaaaaaactcatttttttaaataaccaaaaaaaacttgcttcatttttttgccgaacttattcatttcgaatgtaactttgctgacgaagttgcaacggcatttggctgtcacaacacaggcgaaacgtcgcgattctctttcttcctttcgtttcagttcaatttgattagcctccctaatcattggctgacaagggaaaagttgcgtctctttcatgttgttcataaggactaaacaattatcataaaacaactttattaagacctgtgaattgggctgggattttaaagtttcactaaaatttttgtgggttatttcattttcagttaatattagcagttagccgccgctcaaattgaactccggtagggcgaaaacatgtgcaaggcgtacgccagctgaaactcacaccatacatgtgcaagtggtcgtgtcaaactttggaatcccacggattaccgggctttgtttattgcaaaattttttttccgttttgtgctaatatttattcaatgcttagccggcacaacagggaccacgccttccctcattaatcttttgaaatttgcctaaaacctcccgcctaaaaatgactattttgctgcagatttgttgacggtccactttgaaaagtcaatcttttttccagcttcccccctcccccctggttacgggcctacacccacgtccactggccaatcttacgcgtacgaggatgactctgtccgaccacttgcacatttatttaccgacttttttattttattttacaccttttttttgcggcgttactgtctgacgtacttcttgcacacatcgtttatgggtggggtcggtcgttttatattcaatgaattaccaaaatcccagccctacaaaacattacttttcttataaaatatccttgaccatttttggcaattaaagaacataacatcataatgtccttttccttccatatcactgaattgttcttccaccgtgcgatacgaaattgataaattgtccattgttacaagttccataaagcgacggtacattccgaaactaatgttgaaaatttttcgtcgctaagggcgtagccaaacaaggctgatcgggctatagttataccccgaagcgaaaataaaaaaattttcgagaaaaatgagcaacaaaaatgtcgtcgagtgggtccggttgagccccttctcccgcagccaggagtctggatacgcccttgttcatatcaacgtattatattattactttgcgactttatcacttgagttgaactcataagttttccaaaatgtctttgcacagcttgtgcatacaattgtcactttcaccgcgtggtgacgcagtaatttgcttggttccgttttgaacaccctgtgagacgttattttggccttttttatgatccaattcgtgttcaagtcggtacaggccggcgtgacaagccacccgctgagtgcgagtgtatttggccgagaactgtccgacatcgagtgagatgacatgttgcaaacaagtaaacaacaaggtgagaacgttaattgcgaaatggacaagaatttaatgattggaacctaataccaagaaaatgacaaatgacccaatccctacgtatgcattaaaattttttattacctttcaaa

SEQ ID NO: 16965 - DNA, 851 bp, Heterodera glycines
attttatatttacctaataatgtgaaaatgatttaatttaaaaaaaacttaattaattattttattttataaaaactaaaactcggaccccgaaaataagattttttaaaaactaatgtagcgcgaaggaattcgagatccaaaaatacacggttttaaataaaattcaacagaaaagataattgggttcttcaggaaaatcccactttttgcaagtgataataaaaaataaaggatttaatataaaaagccaacaaatattagcataaaatataattatataatatcagacacaaaattacaacattctacgcagagaattccaagacattccgtgaagtctctgttggagatgattggtggggaaaaccatgagtaaatttaaaaaataaataaaatttgatttggacgataaaaattgtttaaaaacataaaataaaatgatggaaatattaatgaataaagttgcaaaagaaaataaaatgataaaatagttaaatatttatacataataagtagggttgatcacgaccgattattgattatgccgattttgaacccccggggttttttttttgatttcagttaatgaaaaaaatttttagtacaaatcttaacccaattttttaccaaaaaatttaatcaggtatgtatcagggatgtgcctaggtttcgcttttcgcatttcgcttttatttttcaatttggcccatccctggtatgtatgtcatcgaaacgctttgagatcagaatttcgagctgaaaaaaaatcagagaatttttgcaaaagaatattatttttactatttatccaattaaaaaattcaaatattattttttcaccctcccat

SEQ ID NO: 16966 - DNA, 1229 bp, Heterodera glycines
tggacaaaaaaaagcaaacaatgatttgtggtggatgctcaatgtcgttattattcaaaaaccattataattaataggcgttatttgaaaaaccaccaaaataaaaaaaattttgcttataactttctctaagcaaataaatttttaattcttgctttcgtgttcacttctgatttatgagtatgccaagaatgatggcacaaacaacgaaagtggcacatttagtgttccatccgtccttccccccactttttcactgtcaaaatgaccgccaaaagcagcgaccaattctcaaattaatagccgaaaagcctggcaaaagatttctttcttttctgtccggcttaattgtgttctctccccgcccccgggggacttttttgctttatttatttgaatttgctgccatttgaacgtccctcccccgcccaacggccattagcaatttggcccaactgcgtttgctatggctttgggttgtccgtcgtacccgtcccgtcgtacaccccccccgccctcccctggagcggtataaatcaaagatcgcaccgaaaattcctccccgccccacacacccatcgcccgcgatcgttttgttaaatgcttatatttatgtcagaaaaagcaaagtttccgacaaggaaattttccggggatttttggccttggccagcattcatcgtgctacgatttttcctaaattcagcaacataagagcgtttcctaaatccaccgcgcggattttgaggcaaatggctattttctgctaactcctatgaataaaatgcaaaaaaacaacgaaaaagcacacttaagttgtttttaaatgcgtccagaaatttgtaaaatttataaaaattcatagcctaaaatggaaaatattgatcatagtccacaaactcaaaaatgcataaaaacggtcagaatcgatgtaaaaaaggttagaaattggccggaaaaatagaattgagggcgcgcttgccctttttcaggccgaaaaagtgccgaaattagagtgccaaactcagctgggactcaaatgaccgcactataaaaagtactaaaaagacattttaattaattttctagggtaatttgtggcgctgatcacgaatatgacctttattttgcaaaattccgaaccccgaaccctaattcgaacaaaatttaaaatttataaattaaaagaaaaaaaaaattttttatgggttttcgaggttgctgaacac

SEQ ID NO: 16967 - DNA, 4321 bp, Heterodera glycines
tttttttaattttttggattttcacaggctcaaccaacacgcgctgaacatgacattcagctttctgtgtaacactgcaatgtttcctggagttcatgagcgtttcatttgtgcgtcattttaaaaatttagaaaattttaaaaatttataataatttatttaaaaattcaatttttttttttaaattgccccccccccccaattttaagtcgtcactttggacgacaaagcgcgcgatgcgctgcacgagcattggccaaatgtgcgcgtttttcattggccaacaccgagcctttacgtaaagccacaaaaaaatttaaaaattttaaaaaattttttttctaaaattcagaagcagttcagttttgccgagggagcctatcagacggtaaaaatttaattgttttttttaaaattaattctgaacagcattgataggcggaaatttttttttttaaattaaaaaaatgattttttccgactaaaaatgggaacaaattacaataaccccgattacagtacgctaatgggtgctaccgtatgttttttacgttgtttctatgagaatttgataaaaacatcggcacattcaaatagcccgccagtgttccaaaataaacgccgctggggaaaaattaaaaattttaagcgatttttttggcattattttcaattaaaagaacaaaaaatttgcataaaaatttcagagatgtggaattttagagataagcccatttgagagcaatggagaatatgagctaaaattattataaatcccaaaacttaaaagatataaaaaatcaccaaaaataataatcaggactttttattaatttaaaaaataataataaattaaaaataaaataaaaaatcgatccaaattattactgttcataatccatggatgaagagagaccattgttctccgtaaacactttcaaattggcgcaaattgccttcgccgggaaatgcaagtgcttggaaagtgtgtccaatttgcgtcgcaattcggcacaaaatgccaacaatgtgtgttcaaccgaaaggcattcatattcgtcggatgatatcatcaaatccatgctgtcgtgccgttgttgttgttgtttttggacttgttggattgtacactgaaaacgaagagttgtgggaggacgggagttttgatgacattttggcacagttaaaaaaatatttgatggcattttttatgccgccatgaaaactcgagacaatttttacggcatttttctgtcgccataaaaacccgagactgattgctgccataaaaactcgagagcgagtcgatgacattctggcataattaagaaaatatttgatggcatttttttgtgccgtcacgaaaactcgagacagaaaaagcccaagatcaaacagttcatctaaatttgatttacattcatttttgttggcacaacaacgtccctgagcacactttgctgcccgtgcagctcttcaatgctgaactgcagttgcacactgttgtcacgtcggtggtgcacaatttgaaaacggcattcactgtcgaggacggcatttttggcgtttcgcaccgttttgagaaagttggcagagagttggcgcaattgttctggcgttgacagcagttggcacagtcggtgactgaactgcttgagaaagacgaaggacagctcgggctcggagctcacccaatcgatgataacccaaaaatgtggggaaattaagatttaaaattgctttaaaatttgaatttttaaagaaaattccgaaagggtaagaatttttaaaaattattcgggtttcttttctatggaactgctaatcagttagggctgggatttatttacaacaaaaaaaaatcccgaaatatttagacaaatatttaaaaaaaataccaaaaattggagaaatattgatcaaaaatgagaaatttagagcaactaaaaattgaaatttctcttctaattgaaattaaaagaaatatttatcaaaaatgattaaaattaaatttaaaaatatttttatacatattttatttatgaaaacccaaaagatttttttatttttatgactaattgccgttaaaacgaaacatttttggctaaaatgatgattttttcttgtatttctcattaaaataaaactgcaggaaaaaataaatataaatcccagcctctcggatcattctgatcaccccaaatgattaaatgatcggagggtatttatacttttttaatttaattattttgaaattgtaaaaaaatttcaatttttggcaccccaccagcgggtcaaaatgaattttgtgcagcagcgaaagtgccaaaatgtccggcgatgcaagcaatgttggcacattgttgttggtgttgctcaataatgccataatgttgctgttgcttccgctgctttccgacgcaaaaattcgttgaatggcagccattgtctgcagacagcgttcatcattttcaagcagtgcatccatgaatgcattcgacgatccggcatacatttcgttcaaattggcgacaaattggcgtagcgtttcaaatggcacaatttctgcttggcggaggggggggggggaatttgatgttaattttccgataaaaatagggtaattagcgataaagtactggcaaaaaaacgacagtctctctagtcaaagcgtttcccgcccccagtcggcttccattaattaaccgccgctaattaatagttaattaattctggcccttccccgctcgggaagattaaaagggtcactcactaccataggttttgatggtcccgggagatttactaccgaccctcaattttctcgtaaaatccaatcaaagtgagccctaaggcgaaatacagggcactgttttggcgcatttgcgttcgatcctcgcccccagcaacaatattggaagatgatgatggtgaagcatttaaattggtcgctgctgacaaatcggcggtcgtaaatgtttgggtgcgcgaaacgccgccaaaccaaaccctgtctttaaaaatttagatgtcattttaatgaaaatatgtactagggttcgaattggaccaggacaccaacgcctggatttttcctgaatttttcaggtccatgccatttttcggcaaaattggtttttcctggacttgaattttcatggccctggattttcccgagtttttcctgggcctggattttcatctgactggattttgccaggccgcgatttcccatggtttttcccaggcctgggttttgctggattttggcccagaaaatatagatccaggcggcttttttaaaatttctaattctcgtaaatacatttgtttttaaatttttataaattggaaaatgggaccagaaatttaatgccaagatccgtgtggccaagaaaaatagaggggacttggcactcgaatatagattttgagaagggtgccaagattatcaccacaccgtttgtgaagatggcattgcgcatgtcaatgaaaatgaatgccgaaatgcgtgaggccaatgggaggtggccaatgcgtttgaactgatgccgaagcaaatccaattggacaaaacgccacaacgatgccaacagcgagcgccgatgtggcgaatcgtcgtcactgattggtaagcagaagccctgctgttgttgttgatctgtgcattgatcgaaaattggtaatgatcagatcaggatgaaaagtgcgatttaaaattgaaatgatcagagcaggatgaaaaagtgatcgattggataccatcagtagggtaaaaagtgatcgattggatgatcagtagggtgaaaagtgatcaaaatttcggaatgtcatttggcttactgttgtccaatgaggccaacagtgtgccaaggcgatccgccaaaatgccaaagtcggcatctgacggtggaacggcacaattagaaagcgactttctcagctggtataagtcagacagagaaggcattgttgatgaattctaaatgatttaaaagcgattaaaatttaattaaaaagaaacgcaaattttattattacattttatttttagcatttttttcgccaagaaatgaccaagttatgcactttggatcagataatgcaaattttagcgaaatttgttaagaaaattgaatatagaaattttcaaaaaatgcaaagatcaagcaaatgttaattatatcagattaatcagaccaattcaattacatcgacaaaaaatctatcaaaaaaaaatcgctagaaaaaatttttaaattaaatttctgttttaaatattgttttttaattttttcccaggggaactgatccggggaa

SEQ ID NO: 16968 - DNA, 1421 bp, Heterodera glycines
  misc_feature (21)..(21): n is a, c, g, or t
aaaaattttcggaagtcgganctcggaattccgaggccccaaaaattttcgggaagtcggaactcgaaattccgaggccccaaaaattttcggaagtcggaactcgaaattccgaggccccaaaaattttcggaagtcggaactccgacccaaaaaaggtcggaagtcggaatttttgaaaaattttacagaaattttaaaatatttcataagttaactttaaagttataaatcaaaattactaaatataaatgtatttatgtattaaaaaattaatattaaaaattaataatcaaattcaacaattgataaattggactgcaaaaaaatcaatttcctaacattgtctcccttaatccggtttcgcaaatccgtacaaatgagcccggctttagaaaacaatctttcgctttcaactgatccacaaggtgcgctcagaaattttcgggcaacacgacaaagaagaggccattttccatgttcttctttcaacttccagtaatagaaaatacaaacagaaattaaaaacagaaattaaaaattctcaagaaaattaagtttttttgagtccggcggtgccgataggtgccgtcggaaaaaaattgaaaatttctatgcaatttattaacataaattgtacaaaaattgctaattttttgaaaaaaaaactcaaaaaaattccgaaaaattccgacttttcatcaaaaatttcggaagtcggaattccgaggccccaaaaatgtcggaagtcggaactcggaagtcggaattccgtgccatccctgatatccaccacgagatagaagaatttttccgcgatttgttttagtctctgcgaatcggagaagagccatgaaccaatgaatttggaaaaggaatagagggaaaaacagcaaatgatgaacaccagcaattacaactcgagaatgaccatcagcattcgggaatgccaaaacaattcctctccaaattctcttatcaaaatgacctcccaagaaaattgaccacccgagataaactgaacgaccggccttatcactatccaacggccaaagtaccactgaattttaccacattgaaaataagagaaagatgcgttatttttactacacacatatatcaattttcattaagcatagtgattttttaaataaaaatgactttttgggtcagtttgaccctgaggcagtttgcttcgggcaaaccgtggattccggctggttcatgtgaatacataataataataaaataataatttaattctctgtcgaaatctgtcactgtcgaaatcagccactgtcgggaatgtcggaaaacagtaaaataaatgaaaatagttcactgtcgaaatcagtcactgtcgaaatccactgtcgaaatccactgtcgaaatcggtcactgtcgaaatcagccactgtcg

SEQ ID NO: 16969 - DNA, 1071 bp, Heterodera glycines
acaaaccctatctttttggtatcattcgaaagcgcacagtctaacgaagctaaaatatataaaaccgcagcgttcaggcaattaccaaaaaagatttgattaattaagtaattgctgattattttcgtttgtaactttcttgaaatgttagaattctcttgttttctcgtattattacattattcagactttgcgctttcgaatgatacaaaaaaggtagggtttgtcaacatgaacaaagttattgtataaaaacccgggattgtcaattgattggactcataaagtgcattagagccgaaagtttttccttgtaaaacatagtcccgctggtcgccgccacgattatatacatatgacactcattttgccaaattcgaacaaatcccatcgaaaatttacttcttccgatacttacttattggagttccacataactgttttaaacatgcgaaaatttgtccaaaaacttaaaattaattccaaaaaaacgcatgattctaataagcaataattttttgttattttttacagtgtcgtcaagagttcaaaatgccggcattgtacgtgatggactccattcttcgtcaggccaaaaaacaatacaaacacaaaggtttttcatatttttcatatattttattttttttatttatttaattttttctcagatgtttttgccccacgatttgccaccaatttgacgaataccattcaaaatgtgctcacctgcgagtcggctgacagagtttgttcaacttattaatgaaaattttaacggaaatttttatttttggtttttaagtgcccgtttatggctcataaatctccgtttttctacttatttttgaaaaatttatttttagctaaaagttgttcgggtggtgaatttgtggcaagcgcaccaagtcttcaccgaagacgcgcttgagcctgtgctgcaacatttccgggcgatgggactcggttggcatttttgttttaattggaattttataggattcaaataaaaaaacaataataataaattaccaaccgggcagcatatggaaaatttttctaatgggattt

SEQ ID NO: 16970 - DNA, 2756 bp, Heterodera glycines
acagaaaaagtataactacttttaaatgaaaataattttaagtgatgaaaattttaaaataacttcgtagtatccgctagtcaaatctattttgcattaaactcattattttgagcaggagggagtccgagatagaattacacaaaatatgtgaatatgttcttgtgtttaattaaggcctttaagcgaatcttttaaccctttaataatataagcgagttgaaaacagtctcactataaatatgtgcttattttaaaattatgaatacctcttttgaaaaatgcaagtatattttaattggtgagtaattttcaaaattattagctaatcaagaaaggccaaaaattgtcctctattagtgaaaagaaaaaattcctatttttactccgcagtattcaaagtcaaacagctgcagacagaaaaagtataactacttttaaatgaaaataattttaagagatgaaaattttaaaataacttcgtagtatccgctagtcaaatctattttgcattaaactcattattttgagcagtagggagtccgagatagaattacacaaaatatgtgaataggttcttgtgtttaattaaggcctttaagcgaatcttttaaccctttaataatataagcgagttgaaaacagtctcactataaatatgtgcttattttaaaattatgaatacctcttttgaaaaatgcaagtatattttaattggtgagtaattttcaaaattattagctaatcaagaaaggccaaaaattgtcttctattagtgaaaagaaaaaattcctatttttactccgcagtattcaaagtcaaacagctgcagacagaaaaagtataactacttttaaatgaaaataattttaagaggaaacatcctcaacaaaaagggagaggatccggcaaattggacaacaacaaaattccgggacgtgcttaacgaagcagtccgcaaagaagtccaaatccaagaagtgatgggcgaatatggacatcactacgttcaaccaaaggcagaagttgtctcagcagcacacgtccaatcgcccataacagcaaacaaaaggtcacgaaggcctaatcaaccaagcacacaacggcatgagtcattcatcgcctcaacactggatgagagtctaaggcagcaaggctataagaagcaacaggacatgcaactagcaaacagtcggcatccacaagcgcgagaccaagcacaaagcatcaacaggattccgccctatccttgcacgttctgcaacggcaatcattggcacgacgagtgccaaaaagtgaacacactcaacgaacggatcggcatcgtcagagaaaagaagttgtgcttcaaatgcctgaaggcaaaccatcaagcatcgaactgctctcgaccgtccaagtgctaccattgcaaacgtcggcatcccacagcactctgcagagatcagtgcaggtctgagaatgacatcaatatgccaagcaactcgtacagtgaaaagaagccaaacgaccagaacggcaggcgatcaacagcgatcgaacaacagcagatgtgcaatgccgtccaaagcagggacaccagagcattgctaatgacagcaagggccacgattttcaatccggcacaaccaggcctcagcatgatggcaacagtgttcattgacccgggaagccaccgatcgttcatctcaagcagtgcagccaagcagttggagctgaccaaccttggaacggaagaatgtttcctcacaagctttggcgaaagagagccaaagagatacttaagcgaccgcgtcgcaatcggcattctttgtcctgacaacgacagattcatcttcaacctgaacgcgttgaagttcctgttgaacgaaatgcccgtactacaactgaatgcgctggaccacgatgggcttcagcagaagaagcttaacctgccaaatgcgccacggcaaccagacatcttgcttggaatggatgtttggcacgagctaaagattcaaccaattgaacaattgccaagcggcttcacaatttgtcaatcaaaaattggcaatattatcagcggaaagggtcgaatcgaactcagccaaccatccaacgtctctttcgtgatgatggtcaccaacaaggaatcgacaggcagtaaaccgacacacatgcagaaagccaaacaacatcgagagagtaaaacattgagaaggcatcaaatcaacaagctcttgtccagcgctgcaacgttacgatcaagacgcaagcgagaatcggtgcccaacagcacaacaccaatcgtgattgatctttcttccgacagcgaaagaaactcatccgatgtcgagatcatacaagacccagtcgcgggtcaacaaatcagctcatcgaacaaacattcaactgctccattacccaaggcactgcgaaggccaacagcaacaaagcagagttcatcaattgccaaacgaccagcatcattccgcaagcaaacacgaaaagcagctccttccgcaggaataaaccgaacacacgaactcagcagtcaaatgaaagccctgccgccaacagcaaaagaaaagagcgtaaaccaacaatgcatcatggccctgaccagaagtgccgatccaacgacgagtcaggatgactggaagttagcgaaatttcccaagcatttgctcgacaacaatcaataacacccaaccaaacaccaagcttcgaaaagacattaaactagaaaagcaaacaacacatgtccgcaatgacgt

SEQ ID NO: 16971 - DNA, 2272 bp, Heterodera glycines
gaaacttataaataaactcgaattgtaagatttttctttatacgttctccaacttcggtttttaaaattttttgggtgtgggggaaaaaccgtgtcccgacatttgcgcctttgtccaaaatctggttcaaaactaagttttttcaatcactgatcgcataaattgctttaaataaacgattaaaagtgattgtacccgatcatttgatcttcaaaaaatttttgaaaaaataataaaattttcaaacaaaaaattattaatcataatgaaccataaaaccgtgttttcttaattttaatgcttattaggctatcaggggttgaaaaaattcaactttgagtccgattttggacataggcgcaaatgccggggccgcaaatgtcggggctccggaaaaacaatacggcggtgaacggggtgggggaagcgaggtgcttcttcccaaaacggaatttattccaactttgtttgtattatactagtaaaagtttggtgccacaaactgtacaaccttggggaaatcaacatggcgttggtttacaaagacaaattgtcggtcagcactgctccgcccatggcgcgccaagcagctgctcacgtagccggatagccttgaaaaattggggggaatgatcagcagcagtgatcagacccagtcaagcccgaaaacagcagaaaaataatttagaggggagaattcgaagacttttttccaatttgacccctaaaaaaattgtgcaatttttcaaaattttagagtcaggcagaaagaaaaaaaattactttttagtaggttttcgacaaaaaaataacccattctgcattcttgagtcaaattttgaaatcctaaatttttgcagcaaattttaacaaaaaaattttcagtttcaggaggaaggcctggacaagaaatcacaccgaatttccgcaaaaattttctcccgctgttccgtcgttgtcgtcggcactccgtacaattggaggcactcatcgcgtggcaccccaaccgtctcgtccaacgacaacatttgaccgccgccattgcttttgccattagcagcagaagcggtgccgacgccgccagtgccaaaaagactgtccaacacctgtggcaaacgagtggatggaccgccgggtgtgcacagaacggttgaccgcttcctgaacagcacgaaaaccgcgattaatatgcttttttcaatgaaaaaaaatcgccgagaattgagagacaacacaaaattcggctctctacagtttagtctcccaaaattttttagttttttttaatttcatttttaacaatttttagagccattgatcaccacaaatccagaaaatccatttcaacccatttgaaacaccgattcttcgaacaggagatgcgagtgaaaataaatgaatgggccatcagtaaaatttaatcggtattgaaccagcagaatataattttgaagaaaaaatacagtgattttttgttcgggttaagcattcgaagatgggtcgaattggatgccggattcatggtcagagcagcccagaaatctttacactggtatttaaattttgaaatggaaaaaaaactatttgtggacgaacccggaaaaattttacgacgactttacgtcgttgttttgtccgttacagtgaaaattctttttttatttatttaaatgcacgaggcaattcgccagtggcgccattgtttgttttttctcgcactcacccgccactggcgctgtttgtgcaagtgaagcggcaccagggccgcgcaatggcaaatgcctgcacacactcgacaaggcgcagaaactcgcggcgcgcctgtcgttggaattccgcacgacggaccggcaacggcttgaacagatgcgcaacacggacagttgtgccttgctggaaaattttttttgtgtcattttaactatccgatggcacaaaattttaaatggacgaaaaattgggtaaaatatgaaacgattacgggtctggagcattgttcggtggccaactgttccccgttacggccaaatgtgagccgagttgcacagcgcgagtgcacatcacgggttgtaatttgtacgtcactgaaaaaaaagaaaaaaaagataaatgaatattttttaatattcccatgaacgggagcagcttttactctgtatgtatggtttcctctaagttttttaaatttacttaaataaattttttgaaaaaaaattctgcgttttcctttgtcctgtaaaacttcgaaaattggattgggtttcacaaaaa

SEQ ID NO: 16972 - DNA, 3662 bp, Heterodera glycines
  misc_feature (7)..(7): n is a, c, g, or t
attttantctcatatcatttgaaaattttaattttgtacaaattttgaatgaatttaccattttaaggcttggtctgtgtgattctgggcaattttgcgtccggttttgccggcgtttacgtggagaaaatgttgaagagtcggagttcggtgtccatttggatccaaaatgtgcagttggccgcgttggcaatgccaatttcgttggcaatggtcgcatttcaagattggcacaaagtttggcacaacggcggactcaaccagggatttgacctggtcgtgtggggagtggtggcaactcaaagtaaaactccaatagtaaattttattcaatattattgcttttttagccatgagtggcctttgcattgcggtaaatttaattaattaactcattcatataagcaatagtcccatttggatgtgtttttttttgttattttaaaggcttttgttgtgcttttaaaaaaacaaataaacgcaaaaaaatctattaaaattttacataattttatgcaaaaattagccattttcatttctatattttctttgctttaggtggtgatcaaatatgcagacaacattttaaagacgtttgccaattccttctccatcattgtgatcagcatcgcctcaatttgggtgtttgccagcatgccgaagccgttgttcattgttggcgctgcgttgatcatcaccgccgcgctgatctatgccaaattcccgtatcgggccaagcccaaggctgatcagcgatcgaacagcaactcagcaacggacagcggcagtgctgactcggacagcagcaacatgagcaattgtggcacggcaccacccaccggccgaggaggcgacagaatgccaaaggaggaggacaaagtgtcacggctgaccaaactgttcaggatgggcagatcgccaaccatggccaaactgacgccgggccaattggacgccaatggagacggaaatggcgtgcagaaattttagagagagaaatattttatcaataattattattaattaatttttatttttgtgcattttatatcaaattttgctcctctcttctctgtgtacatctttttaataagtgtgaagagcatttgacaaaaagttatcatcaatcaatgggtcattttttgttaagtgataacttcgattttgaccatttgtgcgatcgatgtgccatcattttgatggtgacaaataaatccatgtgttttgagtggagaataaaaatttgtttatttttgatttttaagcgttactttcggatagttcggtacagaacacttttttaatcccaaatattttcggataacagaattatttattaaattaaaataaatatatatgctaaaagtcacttaatgatcagttttatttttcatagaccattatttaaattttattctagcttaatttttaaaaactcaaacttttatttatttttttaattttccccgttctgttagaaagaggtctcggctagagcccggaaatttcaaatttgcggatcccgctgcgggactggaactcaaaattttttgcgggacgggatcccgcgggattaatcccgcaaatcccgcaatcccgcaaatcccgcatttaaaatttgcgggatcccgtacgggattgcgggattttggaaaattcgaaaaaatttcaattaaattcaaaaaatttccaaaaatcaaaaaatgctgaaaataaattttaggggctgtcgggatgcattaaaaggggctgatgggtcgactaagatttttcgattggatccgacggtaaaaagttgatcggaaatcaaattattaacggttcataaatttgactttttttttcttttcaaaaccacttttttgcggtgcaagaaatcggaaatttttcaaaaaatgcgggattgcggactggatcccgcaaaatcccgcgccggtctctattttctagagaccaaccaacccttttcgataaataaatataattaactttttgagcaatatattttgtaaatttttatacttcttagaatattcacggtttttgagtcgatttaaaaaataaaggaaattttccagaagctgtagcgaaattattgattgatcaactggcgtttgccattgatcgatcaaccgatcgattgggtaaaatactgacatttccaaactcacatacatacatattgtgcaattaattcccttctcattccctgtctttgaccaaaacgttggcattgtcccataagcaattttgatcaggaaaattgcgtacaatttttgatcagtcctttcttaattgtttctctgatcatgagcaatttaatgctgatcattttcttatcttttatcacatttttttctatcccagaatttgtttaatttttaaaaatccaattatccaagtgccattattctgtgttgcgaaattgtgccataaaataaattaaataaatttttcttcaatgccttccaacattggttaattggttatagacacacaacgtgtcaccgaattggcctaatgacggcttttatgaattgacatggaatatatattcgatggggtgacccttttgtaaatttgccctcataaaatttcaaaaaaaagtttttctattttatgataaacaaaataccaaaagaaaatgcattataaatggttagccgacttttgcgccgcgacacttgcgccgctcagcaaaaaagactcttgcgccgcggacatttgcgccgtgccatttgcgccgcgacatttgcgccgtacagcgaaaaaagacatttgcgctctgattaaaataaatttatgtgctttatagaataagaattgatagatattcattattaattcctttttcgaagcctttcatgtcaattccatattgaagtgcacgtaatgattgatcaaatcttgatcattttggttttcattgggaccatatgcgataacaagccttcgtattgcctgatcattaagcggcggattttaagcgaaaaaaaataggtaaataaataagggcataaaaattgcgaaataatgcgaaaaatggtaaaataggagcgaaaatttgaaaatcagtgcgttttttcaatgaaattaaattaaaatcgatgaaaataacttattgagaaaattaattatcgaagcaaaaaaataattggggtttctacagaaaattctttttttcagttttttgttagtttgcattcttaatcattttttcatatctttgatgaacctattcaatgttaagattttaatggttaaaaattgaatgtcaatctttgtgactagtaattttttcgaattttcaattagttatttttgtcgatggcttatagttttagtaaaacctattgataatagtggaatttttatgaatataatatttttgacagcgcggcgcaaaagtccatttttgctgtgcggagcaaatggcgcggcgcaaatgtctcatcacgttataaatagggtgaagaagatggcagttagtactagctcagccacagtttccaatcagacgcgggttcgggcccgctaacacgcaaatgtttttccgacttccgacttccgaaaatttttggggcctcggaatcccgacttccgacttccgaaaatttttggggcatcggaattccaacttccgacttccgaaaatttttagt

SEQ ID NO: 16973 - DNA, 1525 bp, Heterodera glycines
acaagtcgatgtaaaaaattcattaggacgcataaaccgtacttgagccgaaaataaattaggcaaacaagaatatcgtgacttttcaaaaacgcattaccgtcggtccattttcgtggcaattagcacaatttgccgagttccgtccgaatcgatgtcacacaacaaagagcagaataattaattgcgttggaaactttatttttatataatgagagacaaagtgaaaaaaaaacatttttatagtcaagaaaatcccattttaataatttacagaataacattttgatcgtatttttagacacttaattttataaatggtacttaaaataggcataaaaacacgaaaaaaagtcacaaaaatggatgttagaagcttcaaacaaggtttagaacactttttaatttgttctgatttcttaaaatattttcttaaaaattagctcaaaatcacaaaatttggacaaatctgttagcaaatcgcattaaaaattaccaaatttttcttcggcggcgcctagcggcaccgccggcccctaaaaatcctttattttcttaaaaatgactcaaaatcacaaaatttatacaatttttgggcaaaatctgttaaaattatacaaattttctaaatttttcccggcggcgcctaccgacaccgccggccttccgccccgcttgttccccaaaaagtctgaaaaatgcgccacaaaaaaaaattcttaaaaatctgataacacactttttggcaaaacatacaattacaaaaattccgaaacttttccaaattcatccgacatttatacaccgactcactgtacaatcagagatatttggaacatattacagacaaatcggatcaaatgggaatgatgagcataataaatacaatacaactagtgatcaattaatgtcttccgaagaaatccatccgccgcttttggccattgattcgctctctctgtgctgtcacatctgctgttgatcgttttgctgtctgaaaatggaaaaaacaattattattgatcaaattccaaattttttacccatcggtgccctccgccgcgtcccgcccattgtccgtcgcggttgcacgaaaaatgtccaccatttcggcatttccgctctcttccgccaattcccgcgcacttttgcctgaaatgggcgaataaaacgctcgctagcacaacaatttggccacttccgctgctgctcaccttccatgttccgttggtgaatgcccgcgccgatggccaccaaatgccgcgccacttccgtcttccctttgatcactgcccacatcaaagcgttgtgtccctccacgtcaacatgctgaaggtcggctccatgttcgatgaggaaattcactgaaaattagggggagggggtagattttttgttttaaattctcgggggtttctagtgagaatacgcgtcccattgacttttacgcgtcccaaggatttttttaatgttgagaatattttcttttctttctttcagtagaaaagtacaatggacgtgagat

SEQ ID NO: 16974 - DNA, 1597 bp, Heterodera glycines
tggtttgttggttgacttctgcggcccactcctccaccaccagacggcacacctccaaactgccgccaacggctgcgtcaaataagcggaaaagtatcctgaaaatttgagaccaaaatttgtggcatggtatttttgggtactgtaacagtaatcccccaccttcgaaaatccgtttgctcgacatttgcaccatgtgacggcaacaagcgcacaatgtccacctgaattcgaaatggaaaaaatgttggaaatcatttcgccgaatggaaatttttccctacatttcccttgtaacacgcgtacgatcgagtgctgttacaccgtcaccagtctgcagattgatgttggcaccattctcgacgaagaaatgtgactgtgggggaaaaaatgacgggaaaaaattacgcattttttcaaattttcgtctctctaccaatttccgtttgcgatctgtcacaagcgatcatcagcggtgttacggcagagtccgtgcccaagtcaacgttggcaccacgcgcgaccagaagacggcacagcggcaaattgacatggaggacagcagagtaaagaggcgtcaaatctgcacaaatggggaaaacaaaaatattatgtccaaacaaattgatcgccggaatccgtatttcgaccaattccgaatgctggataaaaattcgaaaaaaaaatccaaatttcattttcgagaaaaagaattcgaaattggtcgaaatggtgccggatttgttaacacagtgacactcgaaaatccatgctaaaacattcatcaacaacactcactcgttctgtgatcgtgcgcttcgaaaatgatcggctcattcggatctgcgcccttctccaactgaaaatgccatacaaaattagtgatttaaaccagaaaaaatgatcagtcactaccaagagatcaacaatttcgaagtgtcgtcgaaagaaggcacaccaaagtgctgatcttgttcgggtgacgcgctccaccggatcaaccgtccaccgcagcaaagtgttcagctcgtcggcgtccagcgaatcgatcagcacacgaagttgttggatgttgccatcgttgatcaggtcgaagaagcggagagtgcgcgtctcaaagttgtccacaacagcatcagccggagcatcagcagcagcgggaggttcagcatctgccttaattgtggggaaaaaatcagtttttgaaaaaaggaaaaatctgatgcagaatttgtgcaaaatatttttcagggggtgggcttcctgaacaatagtaaaaagtgactttgaaaacccggtggaatgatggacttcttaaaaaaactctaaaatgggaggggggggggggaattgaactttaaaagcatggcgttgcaatcacaaataaaacaaagatgttaaaaggatttacatgaaaaatattgcccatgcgaatcagcgcagttgaacagagacgacgaatgtgcaatggcaataatagtgaaaatggaagacgaagacgcaatgaaatggcggaaaatgataatgtcgcatgcttttatatgccaaatcactccctttttggcgtttcgagtctttttgtctaacatttggcttg

SEQ ID NO: 16975 - DNA, 4115 bp, Heterodera glycines
catggaaagagcagctcgagctctacagagggtatgaaagaaaaaatagtatttctgggacttttcagaaatcagaattattctccaatgtggcccaaattttaggcccccagccacagccctttgcttctcccagttttaagtcttggatttgtcaaataaattcaagacttcaaattaataatcaaaaattctcttaaaatttttttgaacccaattcaaaaaaggaaaaaaaattgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgagtagataatattcccaatcaaattatcgattgattttcgatcgataatttgagtgtgtctactttttttctctgacatccccttccacaaattcaaacctattggatggtctcctcgagagagagagagtacattctatgatttctctgactaatgaaatcgactttaatttaatttgtttttttaaatttattaatcgataattttatttgacccccccccccatacctattggatgatctttgatcccttcaaccgaaacctattggatggacttgtgcgcgagaatttaattaatttaaattttaattaattaatttaaacgagcgagagctgcgcgactatttccgataaattgtggaaaatcaaaaacatggtcgcggtctcgaaccgttgagagtggaagcgaggagcttaaccacttggccacaggggcagttgaaaggtatgggataattgttgactttatgatgaaaattccgttaaaatttattaatcgataattttatttgagcccccccccccaaaaaaaaaaggcaaaacatattgtaaggactgtacacaaataatcaataaacccaagcctattgcatatatcatatccgaagcagtaagtaaattagcaaaaaacccttttcttccggctgggctcgaacccataccaacttactgtgctaaccaattggccattttatgccactgggaaagcaaaatccaattcattaaattgtaaaaaaatgacgtcatcatgaaagtaaaaaatactccgccccttttcttgttggtcacgcccattggtttttgttttgctttgctaagaatacgactccaccttttggctttttagtttcttttttccgcctccattttttttgctatttaaccacagtttttctaaataaaaatcattcgtgttccattttttaaaaaattccatcctccttcgttttttccgatcttcctgcaatgaattctcttaaacgctttcaactcccggagcaaggaacacgacagcaagaggagttggattcagttgaaccgaaacacatcagcgatgtggtcaacttcaattcggccggcgttttttatgttttgggaaaagtgacaaatatgcagtaccgtgtttacaaagtccaaattaattaattaattaaattattaatttttctgtttttaggcatgcccattccgttccaaggggctcatttgtcgccgaaaattgtccgatgataacatgtgtgaggcttgcggccaaaaagcgattgcccccatccacacggtgtttgtccgtcttctgctgcaggatgttgaacaagcagacattgctcaacgtgtcaccatgttttcgagtgttgccgaagagtttttgggaatgaaagctgctgaattgctcgccaaggagaaggagccggagagccttgcgaaacatttggacgatttgattgctgtgaagataattgcgaaagtcaacattaaggttgtttttttttgcaatttattacatatttgacaaaccacaacataggcgaacagtcagacttacactggatttgattggattgtcaatttgttcaagaagtgccctggaaaaaatgacagtgatgtgccaaaagaaaaagatgatgatgatgatgacgttgatgagattgctaccaaaaaaacaaagaaaaattgagagagagagagagagagataacggattcattttgttgtgagcttcaaaaaaaaaaggatttaatgtgtcctttacttttttaaaaatccattaaaaatgcattttattgttgaagatgatgagacacaaactccaaaatggtcttgatgtgattgcaattttgttttttcttcgtgaattcaccatgagacaggattgcacgttgacaatttttcgtaatgagcacagagagatttgcagttggctctctatccgagtggtggatcgtcaactctccttataacaatccaattaacgttgttggaaaagcttggcccatatgcgtttgtcacgtaaccctaatttttcaaaagaaggaaaagcactcctaaatttagttttgatcttcatcaaggctgaaaggggatcatgtgaaaaaaattgaatatttgtgcgttaatcatttctttattgataaacttggaaaaataattgatgaattttttggtaattgataatttcgcaaatcatccatcatctcattggcatcacgctgagaaatatgtcctcttctcttaagaaaatttatcaaagaataccagcataaaatgaaaacgggaaaagcaatgagatagtgggcaagcaatagaagttgcacgaggaggttagaatgaacgcttttgttttcaaatgttagtacttgtatctctggctttaaactggcgttgactgtagtgtttaagaaggccatttttatggtggcattttttcgcattatgcaacttatttatacagttcattaactaagctttgaatcggaaacaatgtggcggttgtagtctatcattatcatttggtcaaattcacccagcactatcatttcaactccgccctcaggaattgcactattaaatgttgcgcgaatgctagttgtcccgcttcttaagagttcataccctgtgctatcgtcgagcgtcgatgtgagtggaattacgaaaaaggtccaaccagatttgaattgctcttttgtgatgtcgaaagaacgctctgaattagccatgccaagtgcctcatacatgtcaacaaaaggacggacaaaaatatctttggcaaagtcaagtttgtatggaacaattgggtaaatcatgcctccagcgtacactgcaatgtctcgaatgtcaaacggtttaaaattaaatggagagagagcataatttccgttaaatgccccgtttgcgacaagtgcgattgtcatacgtcgaggaattgttgcactgaatacattgtagtcaatttcaaacctaccttcacttataaagcatgatttgatttcagtttttcgcactgcatatgtggcgggttgtttttcaagcgttttgtagatgcttaaattcaaagatgactgaacatcaatcatttaagcatacagttttacgtcatggactctaacgcggtatttggtagtattgtttgctttcaatgtctgcatgatgaatgtgtcacgagctttgtaaattgtaaataaaagatccaaattgttcaacaaataaagttcttggtttcccaggtcaaagtccagacgtgaaagaaattgggctcgcttcccaccctcaaaaattttttaccgagctttaaagccctcatcagcgacgctg

SEQ ID NO: 16976 - DNA, 3317 bp, Heterodera glycines
aatttgatgtccagcggtgggtttatttgttttcattttctttttctctgatgaattgtcattttgaagatgttgaccgtgttggcggccttatggtcgcatttcacggtttgtgacaaattaattggccaataaaattcgtttcagctttttggagtatgccgataaattttgcgattgcgctttatttgcttaaccgcgaggcaagtggcaaaaaaggccgagggttttcagtcataagggactggaatcgaacacagaacaaaacgaagcgaggctcaaaagcatatttaaaaataattttacgcttaattacattagtgatgctcgagaccaaaaatttcccgagactcgagaccgagacaaaaaatccgagacttttctcgagtcgagaccgagactctcgagcattactaaattacatacgtaaattcttcggcatttgattttacaaaaccaaataattaatttgtgcctttgtcatttccgccttttctcctccttacaaattaggtcggaatggcttttctcgccggtgttctcgtctctcttctgctgatccctctgaacaaatacatcgcctccaaagtcggccaattctccaacaaaatgatgcaaatgaaggatgccagggtcaaactctgtactgcttccccccccccaatgtttttaatttccttttttgaatacagtaaccgaattgtcccggtcaatgcgtacggtcaaactgaacaattggacggcctttttcgaagccaaaattggccacctcaggtcacgtgaattggctaatttgaagggaatgaaatacctcgacgccgtctgtgtgtacctttgggttggtgctgccgtgggttggctgttaccgtatgttccaccgtaggcatccgcccctaccgtaatcatggtgctgatgctcgtcacttattccgtcgttttgggcgaattgctcaccgctgccaaagtgttcacgaccctttccctgatcagcattctgatcatgccttgtgagctttgtctttgtttcggtcgatcactttccttcctgagttcccttcagtgaacgccttcccgtgggtgctcagtgcgattatcaacggaatggtcagcaaacgacgctttgacgcattcttcgccatccgttgcggtgaccagcgccaaaatattgtcacccaagcggagggagggggtgagcggtcattccgttgctgaacactgaccaatgccatgccaatgtttaagtactgctcggacttgatggcaattcttttgcgtggaacgaaactaaaagcgctgtctccaatgtccattttaacgggaaaaaggtacaaaaaatgaatccaattggatttgtttattttccccgttaagggaatgctaatcggcgtcattgggccggtcggttgcggaaagacgagccttttgatgggtttgctgggcgagacaattgcgaccgaaccgtacgtgcgggtcagtggcgaagtgttcgacgagggatttgcctttgttggccaagacgtgtggctgagagaggggacgatcagagagaacgttttatgcgaaaggccatttgatcagaaaatgttccaattggcggttgattcgtgcgcactgtcctttgacattcaagtgaatgaaaagcctattgatcagtgacgggcaaatgaatgaatcaaattccttcagggaatgcccggcaaagaaaattatcgaatcagcggcgatgggatcactctgagcggaggtgactgactcttgggggggggggggggggtaattaaatttgcaaatactaatgacccttaatctggtcctagggcagaagctccgtttggctttggcgcgtgcggtttacgcggaaaagcgcgtcattttgttggacgaccctttcgccgcattggacagaaccgtcgcagaatttgtccataaaaactgtctgttaaagctgaaggaggcgggcaaattgatcattctgtgcacacaccatgaacgatttttgagcgacgccgacttagtgatcagactgaacggaagaggggagcctgatcagatcggtgggtggtgaggggcgagacgaaaagcaaatgactaagggggagggggtaattagtctaatgggggtaattggcttaaggaagccctgatgaggtgttgaccgcatctcctgccgatgcacaatctgctgatgggggaactctgaatgtaattggcaaaagggatgaggaagagaatgcggcgccaatggacgcgacggaatttgtgggggtggaggaaacagaggaggaaaaggaggtgaaccaatccatctaaattgcgcaattggttgtattattttgaaattcggggcttttttgtcgaagaagaatggtcttttttaattggggtcgcattaagtccatccaattcgtattgtcctaaattgtggcatttttcaggtcggtgcggtcaaaatccgagtttacgtcagttacgtgcgttccattggggtggcactgagtgtgttaattattctgtcccttttcggttcgtttgccaatttctaattttacattttttgaccctttccctgcccccttagcaatgcaaatgtccaaaattgggtccgacatttggcttagccgttgggcttccgccgtttcaccgctgcccaatgggtccgagttcactttccctgcggctgattggaggtgcatctccaatcgctttttccttcgcttgatgatctgaatcatttccttcccttttagttttcctcttttctcgcgtcccattcaaaaaatggtcccattaacgaatgctcagcaggaggaaaccaatttttatcttttcgtatacattggaatcgctgctctgaacaccatttgcactctgatcagggcctttttgtatgccttcggttgcattttggcagctaagcaaatgcacgaacgaattctccaccgaatacttaatgtatttaattgactaattagttgtccctatcaaaacatccccacaggccacgctgacttggtgggaccggacgccctgtggccgtgtgaccaatcggtgcgttttcggcatttcgcttcccaatcagtcagtcatttttgtccttttttcgactgtccaccgacgtgaaccgtgttgacgatgcgttacccttccaactgaacattctgctcgcctccctcttccccctcgtctcctcccttttggtcacggtcgttgctcttccgctgctcagtccctttgtgctgcttctgaccgttgcttatttcttcctccaggcacattcaaagacatccaatcattcccatttgtgctgtttagcgata

SEQ ID NO: 16977 - DNA, 1351 bp, Heterodera glycines
ttttaaagttttttccacaaattacgaatcaaacttattccaatttgcgaaaaccctgaagaatgggagtttttttgcaagtatgattgctgattatatgccatcgccaaatccatggcatttttgtgccgttttcattgaaaaaatcattaaccaaaatgttaatgtgtgctaaaacacaatgaaaatgccattttcatttgccgtgatgccatggcatttgtgcgccgctgctgtccactgaaatgaatggaaaatttaatatttattagggaaaaaaaatccaatttttgttttcaatggctcagagagaagattaggcagtggatcattggggagagtgaagccaaaaatggaggaccaacggataatccatccaaaaatgacccaaaactccacccctccccgtcgcgctttattataatcatcgccatcataattcaaatttgtgccaaatctcattaaaatggaatgttggaaaaaatgcatacccaaaaagcgaaaagtcgcggcggcacagccatttggcactgtttttatggtccaattgttggtctcggcacacaaaattctggtccaagttggcacatacatgcaatttatttgaaacaatattttaaaagtgatgccaacaaaataaagccgtttagcggattcatttagtcgaaataccaacaaatcctctcaaattcaatcaattttttcgacatttgcaagccaaaattccgaaacagatcgagcgtgttggaaaatttcgtaaaaatttaaagtaaatataagttttggcacttcgaataaagcaaccccaaatcgaattaaattttgaacagttggaatttcgctttgttgcaccaaaaaaacatttgtcagcacccaacaataatcatttgtcgtcaaaatcaccaaatggaagtacaataaaatgtttgtacatgacaaaaaaaactttcggccaaaaagacaattaatccaatgagatgtaaaaagtaattaaaataatttatacgcatcgcaaaacggtggatgagggaggatgtgatgataaagctgcatggccgcactgtcgaagaattggaaaacaaaaaacaaaacagagagaggaggaggaggagcatcatcaaatgtgttggccggcccattcatccagacagttaaaacacgctgaaaatgggcaacaaaaataagcgaaatgccatgggtaaacggcagagaccggacggaatcttttctccggcgacgaccttttttttgttgctttttgctattcaaagtacctttttttgcggcgtggttttaaaaaactttttggggggacagggggttcagcgatgaaaaagaacagaaagggtaa

SEQ ID NO: 16978 - DNA, 2225 bp, Heterodera glycines
  misc_feature (22)..(22): n is a, c, g, or t
tttcagaatcaaaaactgtccnaacaccacgtacgccttgtcgaaaccctgaaaaaaaaacaaaaattaacaattggaggcacttttacttttttgggacccgaaaaaatccaaaaagggatggaccctttttcagggatttgaattggttgaaaattcgagattaacgatcccgaaaactccgtgaatttttttactttgtcctccaactttttgccataaaccgggccgattccggcgacagcggtgatttccttgtcgcccatcggttcacccacaaaatccctgtgcttcagtgatgtggacataatcaaaaatatgcaaaaatttcaaattgttgaagagtaagcaagcctagaaaatttaaaaaaattaaggcgaaattgggtaaaattcttaagagaaaaagaaaaagatttcgaaatattgaaatcatcctatgtatcctcttttatccacaaaacaacgcaaaataatacctaatacaacgaatgttacaccgcgagggaaaaatgaaagcgaaagtttttgttcgtattttttgaattttttttttggcaaaatgtttgtttaaatacaagaaaataaaattgttttgtagagacccgacaggaacaaagaactttttacaggaaccctggtcctgaacctgcctatattttgaggagaagtttgcaaaaacaggaacccaacaaatccgctgatttactatccagcgtgatttccaaatcttgccctgttcctgtactttttcaaaattccggtctccaattttttgtccctgtgtctaaggtggaaaaagttattgcctatatgttcatcgactggacgcgtaaaagtcgattgggcgcataacctgcagtagagccgatttgtccttatctgcaacgtcctaatcttacaaaatcaacgtcaaatccaaaagacaattaagtcgatcatttttgccaaacttcggcgggattttctgcctggaaatttggcatttcttcttactgatattttaattttagttaaataattaaatattcattttaaataaaataatttgcgcaaatgaacatcagacaggcgaccagcgaagatctgatcaaagttcaggactgcaatttgctctgtttgcctgagaattaccaggtcaattattgcatcaatcaatcaactttaatcatttaattgacatatcatttcagatcaagtactacatgtaccactttgtgagttttttggcatttttatggatggcatggaccgaatttgcattttttggacttgaaaaccatgtaaaaatacgaaattttcaacttttattcgaattctgaattgtacatccatttggtttgaagccgacctcgaattcatagacccaaaaaaaaccttaaaattttacggatttcccaaaatggcttaattgttgatccatcatcctatattacctatctataaaataccaatttttcaatttatttacacttttttttcagctttcatggcctcatctttcatatatcgcggaagacacaaaggcaaaaataaattaattaaaatttttcattttttttgccaaaaattttcagggcaatattgttggctatgttttggccaaaatggaagaagaaatggaagacgacgagccccatggacacatcacttcgttggctgtcaagcgaacctttcgtcgactcggcttggcccaaaaattgatgaaccaaacggcacggtcgatggtcgaagtgtaagtgtgcaaattcaaaatttgtgaaattattgccacttttttttgaaattttgtcacacattttgccgcatttttgtattttgatctgaattgaattggtacaatgaatgagaaaggttgaccgagaaatttttgaattggctaaaagtcagaggggttttcttcggtcgatgcctggaaatttcttttgggaattttttcgaattttgaaaaaaatgcttggacctggacctggttccatatttgaccagggcatgcattacaagggccaaaattcaagaaaattcaacaattttttcctgcttttccagttacaacgcgcgttatgtgtcgctgcatgtgcggaagagcaaccgcgcggcgttgaacctgtacgcgcacacgttgaaattcgacatttgcgacatggagcccaaatactatgcggacggcgaagacgcatacatgatgaagcgccgattggtaaccgtttgtgaattggccgaat

SEQ ID NO: 16979 - DNA, 1352 bp, Heterodera glycines
  misc_feature (1283)..(1283): n is a, c, g, or t
actcacctgaccaatgacagtaaatttttaaaaaatttctccacccaactcattcggctcccggaaaatgcgtcagtaaaattttgatttcatcaaataaacaagttccttaggttttcggaatcattgatcacgagcccggtatccattttgatcaaattccgaaccccggtcccgaattcgaacaaaaagttgaaagtccaaatttttgtatttatcattgtatcactgacgcattttccggtcacgactcattctagtgttattttcaatgtttttgtttaaaaataagtgaccataaaaccgtcagcggtaattcgtcattaaaaaatgcatcagtatttcttggttaatgagatacgatagtagtaatgtgattttgtaaattacttacagtaagtcaattacaatatgtctactttttttgattttatcgaagttttattgcgtctaaaacagaattagattccaatctaacgcaaaaaccatccaacaatttgaccaattattctacaatacgctatgccataaattttattttttaaatactgtatcactgaccgattttccggttaagaaaatataattcacctttttcgttcaccaattgcgtcaacaaatttgaccggttgccgaaaacgatagaaaagtcatttccgcacacaaacggataacttcggagggataatttgattttatttataatatattattttatttttcaattacaccttttgtttgtaatggataattccagcagaaactctttgcgcgcacttttcggtctgctcactcgaatgccgtgccattcactgcttcgacggcacattaatttgtcacccttttggtctccttggcactcctcctgtcgcttcgcagcacatttcttggccacttcgttctgccagaaatttttattcaagttgaaaacactttgcttagtcataggttcattagaagggaatatcgtacatcgggaaatttcgttttaatattcactaatgcccctctttttacctctgcctgattttccacccgaaatttgaaaaacactttgtgagtgaggagccccgatatttgcgcctatgtccaaaatcggattcaaagttgaattttttcaagccctgatagcttaaacagcattaaaattaagaaaacactattgtcttctagtttattaggaacattaatttttaattgtgttgtttgaaaattttattatttttcaaaaatttattggtgatcaaatgatcggatacaatcattttcaatcgcttttttanagctatttaggcgatcatggattgaaaaacttaagtttgaacccgattttggataaaggcgcaaatgtc

SEQ ID NO: 16980 - DNA, 2079 bp, Heterodera glycines
  misc_feature (95)..(95): n is a, c, g, or t
caaagccggcattccccattagttttcgctcaaaagcttcccccagctcgttgatatatttcaagaaaattaatttgcttaaattttctaacttnggcgagctaagaagcattattgaaaaagataaaacttttgtctgttcattaaaaagaacaattgagcccggtttgcattttgatgctcatttttcaaagccagaatcaggaaattgactatgaagtaaaccagaggcagcagcagaacttggagcaaattcaacaggccacgggccgattcaacaaatttaagtttatttgtttttgctcaatttgcctgattttattacttttcctattgttaatgagtagggctggcaaaaatatgcacatgcatatttttttcctggactgtgggaggcctgaaacgcacgaaaaccatgtttttagcttgttttgaagcttctaggatgactttccatatgcatattttgcatatttgtgcatatttcgcgatttatgtgcatatttgcatatttgtgcatattttggcatttcgtgcatattttgatattttcacaatttttaagagaaattaatcgctttttgagttttacttgatttagcttaacaattactttagacgacattggaatttacttctgccgattcggccaatgccaccaaaaaaaacaaaatcagcttggattcgtgattggattaccagaattgatggaaatgccatttacacaacggatggacgcgccgtattttgtgaagcatgccaacaacaggtcatcttgcgacaaaagacaacaaaaaatttatattcaatacaccaggctccttctgaccgattttaccagctgaaccagcacaaccaaacggacaaacacttgaagaatgctcagcgactcaaggaaaagcaaaaccggcaaaaacaacaattgatccgaatgacgcggcttgtatcgaggactgtcaagagtgttttactgattctgtgtggcaggacttggcatacagtcaatcaaattttggtcgtttgagtcaggcaatcacaaaactggagacgcagggccttaccattcaagagtcgttggaaatttttgcgggcgtacaaaatgaaatggacaatgcaattggtgaaaaggcagaaagaatccgtgaaaaatttgcttttattgtcaaaaacaacgccggtcttgaaacgatttctcaattttgtcaaatactttcgggtaaaaacacccaatgtgaagtggcaccaaatcttgttccctattacaaatttgctccccttacctctgttgatgttgaacgttccttttccatttataagtcaacccttgccgataatcgaatgcgtttttcaccccaaaatttggaaatgtatctcatatgcaatttcaaccaataaatttgaataaatttagagaaattatacccccaaattggaaaaatttatatgcatatttttcagtttttatgtgcatatttttgccaaccctattaatgagttttagggattgctttttttattcttactctttttattcacatatcattttctttatacatatagtgagtgatgtgcgtcatggctgatcaataaaactcaataatgccctctttgttcgctaattttcgtggctttctttccttgcctttctcttccctattttttatattttcatttttcttaatttattatttttttaatatttcgatattcctccctcctaattagtaaaatgattgccattttcccgcatttcctcgcgctccttccgcttgccctgcttctaattgtgccgagtgtgtgtctttgtgccaaattggtgctgctttcgccctcccaaattggcttcccattgcccaatttgtcgtccgtccattcccattttatttcggcaattggcggcaaaaaaattttcgtcaaatttcggagcgaaattcggcccctttttgtcgcttttgcaacgctcgaggcgccttatttgtacgtggaccaatcggaaaacatccgatcagttgagcatgcggtcgttgaagaatttataagagagaaactgaaaatggatgcgaggaattttaaccgtca

SEQ ID NO: 16981 - DNA, 1517 bp, Heterodera glycines
attttgtattattttcaattgaaataaatttaaatttaaattttttttataaattttttaggatttttaaaatttcccggcccggtcccggtcccgtggcactctactattatgaattgggccttagtccttgaatatgacacggctttatattttcacaaactccccaacatcggggtgttcagccttaatttgttttattatttattgacttttcttctgtaaattcgagactgattgaggagcttaaaagcacaagttcataacttttccattattttggtcaaaaaatacaacaaactatcacaattagtttgttgaatgcatttgggccaatgtcttgtctccctcattaacagtaacaccaagcaaattcacgtgttttccccgtgaatttgggccaaaaatgattggcgacgatggcacaaatgttgccgccacacttattacatcatcagcacacccaaatacaaacattacgcatcttaaatgccaaaaacatttccggttggctgcgctgatcggccgctcgctgccaatgtgtgcaactgcaaagggaggggggcggagggcagacgaacgccggcgcgtgccattgggcgctgctgctgctgaaggatgagatggatggcattagcctttgcattagcaatcggccaaccatttttttgtttgtttgcatcagctggagcgatggatggatggcatctgtcagctgaatggcatgtgccgactccctcccccatattaatgggcattattaattaatcccttcccaaattttcttcctcttcctcctcatttgcaatttttgtttcaacttgcgcacatgatggaactgttgctgaatcaatgttgttttcgtgccgttcacgtgtttttctgttttgtttggcccgttgtgccagccggtgccattcacgtgcacacggcgcgcaaaaatgccactcccagcagcagtcagtcagcgccccgggggcgaacaaacaaacacatgaaccctccccccccccccccggaccctttatattcatccgatttcatttagttccttcattttccactgcttctgctgctcggttcaacagcatcgccaaacggactttgcgtccgatgggcgatttttttcaaatttcattttttaagttaacaatttgcaccttttaatatattatttgttgcataagacaaacaacatttagtgcgtcaatcatacggtagcaaacgaatttaatcagtgattttagctgggaaatggtcaatgatggctcagctcgagaattcactgcttatccgcaaaaaatcggattttcttgcacatttggattatcccctcgggcaattctcaaaaatattctcggtatttggtgactcttataagaagtgaaaacacacacgcatacaataattgtacacacgcacaacattattaatattttaagtatcatatggtcgctggaatcaaagtccaatggaggcggagcaaagggagaagagagagagagagagggggggga

SEQ ID NO: 16982 - DNA, 706 bp, Heterodera glycines
ccccgagcggcggggcgcgggaagtgcatgtgaatgggacagggattgccccttcccctcccccgctgctgtgcccaccacccacgagtcaggcggtgcagcagcacatcacccccccccccccccccccgcccaattccgtcgttgtcgtgtgactgtcccccccccacccgccgttttatgttgtcgacgattttcgcgtgttggggttgtgagtgagtgattcctccccccatccccgcgcctgttctgtccccgcaaaattacacacgcaggcggacagaatttttgagcggggtgacgcggggctaacaccgaccaaacgacggacgaggaaagaaagaaagaatcaaccaaacaaatgggggatgggcatgtgaatgtggtggatgggatggtgttggacaaaaataaaatgtgcgcaacgtatgatttttgaggagggagagaatttggaggggggggggggagaatttgcaaaatgatgataaaagattaaaaaatggttgccgtttcgaatgctggcatttatttgctggcattgaattttaaatttgaaaaaggggggatttgcaaaagattcatttttaagcagacataagcattaaaataacacaaataaaatttaacgaatttccattttcaagggcagcgcacaatgaattggagaagaatcggcgtgccaaccttcgcgggcacctcgagg

SEQ ID NO: 16983 - DNA, 3355 bp, Heterodera glycines
aactaaaaatatttttagttattttttgtttagtttttatttatttaattattttatttgcaatttttataattatttcgtaaattgtcgtaaagctgagttgtctgatagtgagctgtccccagagctgactggtcctgacgcgattataaaaatatttttgttttttcatttaatttaaataatctattctattctaattttgcatgggtttgccctttcagtggggaatggccatttgcacaatcgatggccaacagttttctttgggcgattcgctggcaccgttctgttttcagtccgtctcaaaggtgacagagacttgtaaaaggcaattaacaaaatgacagtttaatcaaaagagaaatgcatgaaatgttgtcaattttcggcactttttccatttggtcgactcaatttgggcttaaattcaaaaataaaatgcgataaaccctcgaagagattccggcaaaatgaattatttcgccagaattagccgttattttctacgaccctcgagcttctatcattttgtaaggcgttcaattacgccatcgttgcctccgatttgggtgattatgtgcactctttcgtcggccacgaaccgtccggtcgattgttcaacgaaatttgtttggacccaaacggtaaaaaacggcatataattaatgaaaaattatgccaattttgtttggcatttattttgcccatttgccccaaggaaaaccgcacaatccaatgataaattcgggtgcaattattgtcacttcactgctgaaaaagggcgtcgcaatggccgaccgatacgattttgtgagagactttatattggtggtgatgatttggaacactttccattttaaaggctttcaaggagtacaaaaagcttgccgggggcggttacatcggttttaacaatgccacgtaaatattttttaattgttgaatatttttaaattaatgattaaattttaatttatttgtaatcaaatgccccaatttggcacaatttggaattgctgatcacttttgattgattgggcttttgccccactttttgattgcattcccttctccagctttttgtctgaaaagaagacggctgatcggaattacgctttgtcctattatatgaaggtcagtcggtgccgaccgatgctttaaattggtcataaattcgcattttggcacgcgaaacaaaacaatcaaaacatttttgcacaggagaacaaatgttttccgcccgactgcgcgacacttcgcgaggaattggacttttatttccaactttgctcattggagacgcactgcgaatcggccgccgttatggcggcgacaatggccaacggcggtgggtaaaaagaggggggggggcagtaaaagaggtgaaaagggggtgccatttgcatgaaaaatttggcaaaaatggagaactattggagcgattcttacagcaggacaaattaccgtaatcctctaattgaatccatttgccatcctaatactgtagccgtctcacatagatgcaggtgtttgtccgttgacggaagaacgctgcattcagagtcgaccttgtcgagacgtactttcactgatgtattcgtgtgggtaagaaaattagaaaaattgaaaattgttgcaaaaaccgacaaaatcaaatggcaaatttgcgcagaatgtacgactattcgggtcaattcgcatttgatgttggtctcccggccaagtcgggcgtgtccggcggaatggtcgttgtggtgcctaatttgatgggcatttgtctgttctcgccacggctcgacagaatgggcaattcgacgaggcacgcgaaaattggggaaattttaaatttatttttttaatattttattgttagaggcgtcttgttctgccagaagctgatcgacactttcaacttccataattacgattcgctgttgcacgccgactccaaaaagatcgatccccggcgacggctgggcaataccgagactgacttggtggaacagagcatttaaagctaattaacgaaaattgatcagggattttggggcttgactctgatcagcacagagcccgagacccgccccgactttctcttttttatccgatcacggattcctgaatttaaactgttttttcagattgtcaatttgctttacgcgtccaaaaacggtgatttggaaaccgtaagaaggtaaaactaatttattccttgtaattagacttcctctggcttttttgaccactttcccattcccattccccaggttgtatttgcagggcgtcaatttgaacatttgcgactacgacgggcgcacgcctttgcatttggccgcgtgtgagggccatgcgctgctgctgaagtttttgttgaacatcgcccgcgtcgactacacaattaaagtgggacggggatgaaatgccgagcagaaatgccaaagtctaatactgaaaaatcaaacatccaacctaattggaccataatccaataaaatgcaaaaacaaaaagttatggtccaaaaaatcgctggcgacgtttcggcctgtttattttgtcctcctccgatactattcgagaacgaattcatagcgaaagaatttaattttaaaaataattttctcctctaattttggtcttgcccagtctcgagttcctttctgggtttcggtctcgaaatggtcttttcctcctctgccgttcttcaaacggttcaatgcttctcattttgaggaccgctggggccgttcggcgttggacgacgcgcggacctttcaccgcaccacttgcgttgcgctgctgttaaagacggcacagcgacggcgccgctcatacgaacagcgacagcagccgcagcaatgcgattcgccgtacaccgacgaattttccattggcgggttcgttggcggacggtgggcggaacaaagggcaccccgcggggaagaatgggcacaaagcgcaccgaaattggcatttaagcgaagcaatcaaatcgatgcgagacagaggctaattagaccaattaagaaattattggatcgacttttacccgtacattttttcttgggtttcgtaaaacttatcatcattagagatcgacctggaccaaatccaggcctggatttttgtccaggaaataacacgaaaaacctggatttcctggaaaaaattttagaattaattattttaagtgaccaatgtttttttcaacttatcaaaaatgattaaaaacttgtgggggcaaaaaggaaaagcgagcgcacaacctttgcgtcaccgaacagcacaaagtggtgcaattgattattcaatttattgggataaaaaaagtttggcacgtcataactcggcacc

SEQ ID NO: 16984 - DNA, 2467 bp, Heterodera glycines
  misc_feature (1506)..(1506): n is a, c, g, or t
tgtgagggatttaccaatgcacttgaaaacgaatttgtatttcgaaatgaaaacaaaaatcaactgctttttccgtgaaggcaaaaataaattataattcatcgaacaaatgagaatcaaattaacaaattgtcgtcctccggccgatttactgctccgtctcgtcattcgccgccgtggtgcgcagtttctccaattcttcgacaaattttttgaaacgctcctccaactgacggagtcgctcaaccgaagccccaacacggcccacgatatcttcgcccttctcttcgtcgttcgcctgatgcgctatctctttgaccttttcattgaacaactgccaattcttatgatactccgcgactcgagcctggttcttctgaaaaaaatggaaatataatcaaatagcaatgtgtctggtggtatttttatgttaaacccgggaaaccgacggcaatttccatttccaaatcatttttggaaaaaaattggcaacattagaggcggtaatatttagtgccaagattttcagaccaaacaatcagaatttttgattcccaaaaagatattaaatttcttatttatccggaaatttattagcattgacatcaatcggtgaccgtccacttcccagctgaccttggaacgcgccatgagtgcgtcaatctcgtcaatatgcttcttctcaccgtgtttcaacaaagtgccaatgagatctgcatcttcgtctctttcttcgatccattccctcaccccaagaacttctttgtcaatgatttgcaaagagtttttggagtgatgttgaattgaggatttgttaaagcacagctctcgttcgatcgcggccacctgagattcacagcggttcatatgattgaaatttcttttttttaaatagtcttaaattaagacttaatgctctttgctaaaacggaaaacacaagttgaaaacagatttacgattttcctaaatgcagctaaactgaggaacgtcaatttatgcaacaaaacacataaactcctcacataacgctatcaatttccgcttaccttcacttcaatctgtcgcttccgttcaagactcagtggacgaatgatcctctgacctgactccttcaattttgcaaagtttccagtttcgaaacgcgcgaccgaggcagacaatcgggcaacagcatcagcgtcacaagtctccagtttagccaccgcatttctcagagaatcgacctgttgttcggccaattcgctgctgctgtgccacttatcaaacgcaacaacctgaaccatacgctaataaagaaatataattaaaaggttgccctttggttagttcgtaaatcgggcagaaaatgcaaaaagtgccaaaatccgaaatttttgtatgagttttgaatttgatgcattcctaatcaaccacgaatcgaactacaacatattttttattaccattgacttttcaaacgcttcgatgttgcggctcaggtcatcgaacatcttaaaaggaataanagaattagctaaatctctatttcctaccacaaaataagattttctccatttgacgacgcggggaagcataaagaaacggacaacccaagaggagtacaaatattagtgaaatcataattagggtttgtaaaatggaccatttcaaaaagaagttcagtggggagtggtttaggggtcattagagcaaaatcagtcgtgggatggactttgatttgggttagaatgagtcagggaatgtgaataccgttgttttatacggcaaatggagggacgcgccttcccacggagcttttacggtgtttctgttttgcccacgttaaccttcccaccccactcaaacgccggggcaatgtgatgacagaaccatctccgcaaaacgtaaatgggaagggcggatttggatttttgaaaaaccaaaaacttcgaaaaaagaaccaatgaccacgtcttacacaacttttctatacagtgaccatgcccaaaaagacgacaccaagaaaacccattaaaacagctattatagtcagcaaatttacccattaacccttcaaattgacaaaatgataaataatagtgacctgctggttttcctcctgtccatcagtcattttgttccttttttatatggaaataaataattcaatgtgtgaagctaaaaaatggattgcattaacaatcaaacaaatcaaacaccaagacattttaagacaatgaagattcgaatgggtcaaagaaacaaacaaagattcataggaaaatgacaagaaagaacaaaactaacaagttcaaatttagaaaaaaaatgttttatggatttgcagtagagtccggcgggaaaacacgggaatcccgttcccgtcttttttgcctgatgggatttttacgggaacgggaaataggcgggagtcccgttcgtggatccagccccgttttttcgctttcccgttcccgtaaatttttt

SEQ ID NO: 16985 - DNA, 1432 bp, Heterodera glycines
  misc_feature (28)..(28): n is a, c, g, or t
attacatcacaaacaagaatagatatanttttgaaataatcacttcaaaaagatatacaaatcaaaaaatatatttttaaataaatatttaaaaatacattaactatttttgatattaaaaatattggaaaggttatgaatttcaaaaatccccgaaatcccaagagtaaaaacaatcaaaaggatctattttaaatattatacgtaattgaagaaaaaatatatgtattataaatcaaaatttaataaaatactttaaaaacacgagggataattttcaggaaaagaaaaaaaaattaaatccatctttatataaaaaattcacaaaaggaaaaacatataaaaaccgaagaagatgacttcattttgtataaaaaaataattatgtttttattatcagtttcgtacccataatcataaaatgaataaaattttaacaatttgttgccgcaaattcataacaggagagcatgtgcgcaataattgaattttaaaagaaaagcatacaaactttttgctttgttaaaggatcctatctattaataagaaaggttctttaatctaattgtaaaaaactttaatcaagtattgctgatatgattttaatgtgtgtaaatcatattgattaataattaaatagaattacattttattttataaatactgatgagattcatttagttttcattttaaaaattaaattcaataataaaatattgcttatttatatacaactaaaaaaatttttgttaattaaatacttatttttgtcaacagcatttgcttttctggtaaattaaaagtaatgcaaataaataaatattcaataagcaaataattactttaaagtttaaaccaactaagagattgctggtaaagagagaagtcacaccaaaaatcactttaaaaattttaattacaatcataattatacaataatgcatccaaaattttttttattataaaacagtgtcctttggtaatatttacatgaaacataaatatgtaaaagcgatttttctaaatacaaacaagaatattaaacgtttcttggaaatctggagcctctcttagcccatgtgacaagttacgtttagaaaacccagaataaaactaaaccaatacgaaaacatcagagaaaatataaagcaattcttttaccaagtgattaaacaaaacaaaaaagtacacctatttatatgcaaatatatttatgtaatagtaatttcaaatgaatgaacaattaaatttaatatttaagcaccagtaaaaaataaagcgtttcctatcataattgttggagcctaaatattttctaatttcattagaaatatgctaatatccaaaattagtttttaaacgagaaaaaagattactgaaaaaggtaaattttggtaatgaaatatataaatataataagaataaaattttc

SEQ ID NO: 16986 - DNA, 1834 bp, Heterodera glycines
caaaacttgttttttttaattttttgttttaagtcgctttttttggtggcgctgttttttcaaaaaaattttttggaacattgggtgcggggtccggcggtgccgatagacgccgccggaaaaattctaaaattttgagtgtaatatattaacagaacttgtcaaaaaatgatcaaagttttggttaaatttgcagttttaggctgtttaaaaaaagaaaaaataataatttttaaattgaaatattttttattaattaaaatttaaattgaaaaataatttaaagaaattattaaaaaaattctgtaccgttggggaattgaacccaagagaaaaataatgaaaggcagaaggtttagccagcagaccatatttgaattggagatatccaaaaatagagaaaacattaaggaaggaaagaaagagagatttttttttcgcgtaaatttgaaaatttttctggctgctcaaaagttcaatctttaggggtgtattttcaactctcgcctctcgtcccaaaaaacgagaggcgagagacgagaggtgagagtaccaaaaatggcgagagttggcgtgaggcgagagacgagaggcgagagttgtcccacccctgatatatatatatatatgatattataaacaaatataaagaaaagtaaataaatgaggaaatatttgtggcttagaatacatttaaacacgaaaggaaataaaatttttattcaagcaattataattaattttgcacgaatgttaagtacagtatgtgtataattatatatcagtactgtgatataataacaataacaggtataataaagtacataaatgttcaaataaaagctaaataaacttttgataaactataaaattttacttatgaaaaagaaaaaaaaattgagtcgaaaaatatgtaaatattattaaattaattaatgttctattctaacattgtgaaaagttaccatatcagtttttcattttttgtatatggaatacaataactaatttttagaatttgtttatcaaattttcaataaatataccttaatcaaataattgttaaatttaattatgcttactaattcttcattcaattttgtaattaaattcactttatttaatgcaccggtttagtcgtaatctattattttcgtaagataaaaataggtgtttaatcattttagttttaattacttgcaaaacaattaacaattcaataaagattatataataataaatttttaatttttgattcatttaaaaaattaattattttaataatcaaaacataaatataaaagttcaatgatttattttatgtttaataaaataatagcacgattaaattcatgtttgataaaacgttatacttttcaacttattttacaaaactcaaaaattaagtgaaaattaacagaacgatgcacaaatttttgtaataaaatacaaaaactcaccaaaattataataaaattcgttaattcaaaaactattaatttcccagaaatgtcttattaatttaaatgttattttcaaataaatcgtttttccagtataaagcaacgatcaaatctgtattagatttcatacaaaaatgtttagagtaactatttttcattaaattttatggaaatagatcctaaattacaacaaacgtagcgaatgcggttgtgcgattatttgattataaatagaagaatatgtgaaataaatattatctatttttatattaagtttggcaaaacggaattttaatgtgcgaccaaaacgagatttattataaaaaagattaacaaacttataaaaacactaaaaaaaattataatattag

SEQ ID NO: 16987 - DNA, 1003 bp, Heterodera glycines
gcagggatggcattccgaggccccaaaaattttcggaaatcgaattccgtgccatccctggtctcatggtattatagttgtcctaataactaagagaaaaacttttttttgttaggtattcaataaactttttaatttttaactataaatttcgttgttaaacctaaggttatcatgacaactcatacacaggcaactcgaacaatggcttattgttagactaggcctaagtttaggcttttgtaatttttttttcttatattagttgaatttctgttgacatcaataagtgtgcttagagttgcttttgcacttctcttttatatgcaaccacgcgaaaacggccacgcgaaaacggccctcacgcgaaaatggccacgcgaaaacggccacgcgaaaacgtcctggcccgcccaaacgcgtgggtcccagttgacccatagtgagcattaagcataaaacaaaatgccaactatgtacataaattttaaaattttagtggagaataatttgctttgccaaattttttggattccttcaaatttggaaaagggttcggaattgattgaaagtattatccgcgaaaaattgttacatttcaagaaaaaaattatgaaaatttcgctcaatttggaaaattttaatgcagtttttgagtataattggaagcatataaacattaaaaaaaagtgctaaacagttaaatctaaaaaattaatgctcaaaatcctttatttttctcaaaaaaatattttaatcgacgatcaattcaccgaagatactttaattaaaacagtgcaagagcattgattggaaacgcgataacaaacgaatactcaattcacaaccatcttaatgtttgtccacgtgaaagaaaaaagatacaaaggaaaaaatggttccaccataaaaaggctatctaatttaagtctacccggccaaacattctcccaaaatttaaaatatttaaagatttttaatttctaataaacttaattttgaa

SEQ ID NO: 16988 - DNA, 1285 bp, Heterodera glycines
tttgacttctcgtcaaattgttttgatttgattggttgtaattttaatttaaacagcgaatgccattgaaaaacgacggaatgactggcgaaggccaagcgaaggacgccactccgaccggcagggggacatttgctgatcgaattggccgatcagacaaacgcattcaatgcattgggtacggaagtgatgcgacgagtcgtgtcgatgggttcgattgaagacattgaggtctttcaatacaaaagaaggcacattatttgttggttggcatattttgccctaattgaagaaggtgggcccttcgctcgtccccggcctccgtctgtccgcccgcctggcgattcgtctgcgccaccaactgagtcccattcgccttggcgaccccctcttcgaagtacttcaatttctcccgagaaaaacgctcttggactgcgtgcaattggtcaatcggcggatgcatgccattgttcgccaaagggacgcgctttggccgcgttttattttccatcggttgcaaatggtcggcggatgggcggaggggcatttcgactgtttggccttatgcttccatttttcagttcggtgacgacgaactcaaaaggaccgccaaaatgtttctgttcaaaaatgccattcaattgaaagcgccgccggcggaactttcctccattttcacttcgcttccttttgtccttttcatttgcgttttgaaatattttttggcattcagaaaatcaaattcgactcttccgaccaaaatttgttggttcagtccgtccaattggtcgcccatcactcgggaaattccgaaaatggaagccctgcaaatgtctatttttttatcgatgtcgacgaatttgatgaagacgaggaggaaaaggatgcggacgatgagaagcgaagggatcgcagccgcaacggcacaaaattcttttttcgtcttccaaatccgttgcgaacgaaaatggcattgtccaactgcgtgtggttattccgcgagttttccaaagtgattagttaattaaaataaatgaaaaacgagggatgtaagcgaaagagaaaaagagaggaaggagagcgagagatacacaaatgagggagagatagagagggacagagtcaacagaacagagtcgtcaagaattttatactaattgtaagtattattttctataacgattttcattaaggcacacttcgaaagtgtcctctttgaactttaccgcccttccgatgcgcttcgtctcctcctttcccaattcgaccactttcgtcccaaaat

SEQ ID NO: 16989 - DNA, 2680 bp, Heterodera glycines
aaaattatttctgaccccccccccttcccacgagtatgtttccttgtgacaattttcaaatgcgtattttgagggacaagacgaacggctgaccatcgacgggcttctctgcttatgcgatggacaatggttgaacgcggacatcattgactgctatttggacctcatctgccgctgctcgccccgtgctcatttcatcccaacgtacgccattttgagctacgggcgcaagggcacagtgccgtcggaatggtactggcagctggccgagacggacaccattttcgcacctgcccatctctacaacaatcactgggccatggccattttggacatgagggagcggacgttgaggctgatggactccatgaaccacggatatacagacacggaaaaaaaagagtttatggagacaattatgtgagaccgatgactaaccattctcgagtttgtttatattcccttttcaggaatattctccgggacgtcgccatattacaaaaggtggacatcggtgacagaagcgcgtgggacgtgcaggagcggttgtcagtcccccagcagagaaacggaactgactgcggcatttttgcgctgcttttcgcacaatattcgctggagaggcgccaattggaattcggacagtgccatattccgtactttcgacgacggatatgccacgacataatctctgtgattctccatgatcaaaagtctccggttaacagaagcgacgaaactgtcgtacagtgcccatttgctttgtgaattttttgctcaaatgcctttattattgttccatctttgcatctcaactttattatttcgtgcttttacatgatgtataataattgcttttcagtaaaacgattcttaacatttgtttacagtgtcttttcttctgctaataatgccggtgtccccctcccttttcgaattttttgtcaaaaaagtcatttttcgtatttatcaaattgtgaaaaatttgattttatatatattcaaaaacaattaatatatcaacattccaaaatttccgtgtagaatttcgtgcactttctaatgagaaaataatttccgccttattttttggtctgtctataaatttgttttaaatttaaatggttcattttttgttggtttgtttgtcttttttcctcttttttttacctgaaattgcatctttttttctgtttgctttttcaaattcagcttcttccatttcgaaatgactgttctcagtttgtcagagatgttcaaagtgattcgtcgactttatgagttcgaattgtacgacgatttgctattattagcagaattaacatttccctctgagcccacaaaaacgttcaaccaaattggcgatgggaacggacttttggaggaggaccagcggggactgttcttctgctatttggccgacgcgtactttcaaaagggccaaacgaaccgggccataaaagtgagttttggatgagcaaacggaggacgggagaatttaagtcatgagatttagggctttgcgtaaaaagcagggctatgtttttttggctcttgcagtttaaactgttataaattaatttgacaacttaaatgtaccgcaattttttcaagaagcatatttggtagtccaaagggtcggtcctctattagcctgcaaatttcgaagaatttcgttatgttcaaaaaaatggccagtttaactttaaaaattattttcatcgccatttttgaccataaatctttgaatcttgggtgaatttttgtttaaacctttatatatggactcttggggctatcaaaggataccaagaatatttcattaatatgttttctacaaaaatttatggtgtttaaaagttgtcaaattattttattgtcgtgtcttttttacgttagcgtaaactgcaaaagagcccttttctaccattggattaattaaattagtagggaatctattctaagcaaaaaaaaatttggatataaaatttttgggcatactttaattctaactttgattagaattatgagatggcccttcgctgcgctttgctcatcaaacaaaaacggttaaaaaaccgttatgagtccattctgaacatggccgaaattcactttcaaatggcaaaggcattcatacaaaaccgacaagaggaagaggtaaccgaacgaacagtcattttctgaagtcaaagcaaatttcaaatttaaacccttaggcattgcgttgcctcgaggaagtgccacaaacggagataacgcccaaaatattgttcacaatggcacgactcagccacaatttgtccattgcactgctgcagagcggcagaacacagctgagcaaaaggaacaacaacgacggaccaagccaacggaccatcaaacacacaaagtaacgcaaaatggggggggggtggttaaggacttgagaaaccgggaaggtcaacggcttaaggggggaacggtaacgcccttcttttaccgtatatgctctaattatagcccagtctctattaatcccccagtctctaattatccccccttttctgaggaggttgaaaaataatcccccatgagctataattagagcaatacggtattcccccaccccacccgaatttttttaaagaatattacaagaccaatttcttttagtttaaagtttttttgtttttgtttt

SEQ ID NO: 16990 - DNA, 1531 bp, Heterodera glycines
  misc_feature (19)..(19): n is a, c, g, or t
  misc_feature (47)..(47): n is a, c, g, or t
  misc_feature (100)..(100): n is a, c, g, or t
accgaacgaaccagtcatnttctgaagtcaagcaaaattcaaatttnaacccttaggcattgcgtgccctcgaggaagtgccacaaacggagataacgcncaaaatatgtttcacaatggcacgactcagccacaatttgtccattgcactgctgcagagcggcagaacacagctgagcaaaaggaacaacaacgacggaccaagccaacggaccatcaaacacacaaagtaacgcaaaacgggggggggggtggttaaggacttgagaaagcgggaaggtcaacggcttgaggggggaacggtaaagccccttcttttaccgtatatgctctaattatagcccagtctctattaatcccgcagtctccaattatcccccagtctacgaggtgttttgaaaaataatccctctatcataatcccccagtctctaattatccccccttttctgaggaggttgaaaaataatcccccatgagctataatttgagcaatacggtattcccccaccccacccgaatttttttaaagaatatttcaagaccaatttcttttagtttaaagttgtttttgtttttgttttttctcaaatgtttatgatgaattacttagttttttcaaatttatccaaacaaaatcgctgtgaaaattttctaaaaatttttttgaaaaattcctaattgtggatagggcttgtctaaatcttctgtgtaatgttaagaaaactatcgtttcagggcgctgatcaaagaagtgcctgaagcgatattttgccgaagttttctcctctccaatggctcgctgaaaattgcttcttcaattctgaacgcaaaaaaggccgtttctgcttcttctgatgatgatccgtccttcatttcggagttcgttttgtgcggcgaggcgccgcgcctttgggcaaaagtgaaacaattggagggccaaaaacgctttttggaggcggcgcaacttttggacggtgtcgaagtggagaatttgcggttgatccatcaattcttggccaatcaaatgacagattccctcagacttctactggaccaagcccgtctctaccgaattgcgggaaacacaaaaaaggcgttgagctgttaccaacgagcgcacactttggactgcacaaatgccgaaggaatggacgcatttgcggcacttctcggcacagttagcgaaagttaaggagacgaaatcgaaaaaaggtttggaacagcaacaacagctcaacgaacggcagacgcagcgcgagttggacggattggcacacgcaatggcacagcacaacccgcgccgggccgagtcgttcattgtttttggatgggccgcccgacagtgccatcggacgcaggaggcgaagcaattcgcgcaaagggccgaacaattggcacaatggcgggggcgagaacgagcggaggcacttttgttgaaggtaacgaaccgccaaccaaggaaaatcaaaagagtggataataagaaaaaatttacttgtctaacctaatttaaacatgttttctggaa

SEQ ID NO: 16991 - DNA, 412 bp, Heterodera glycines
cgcggtgatgtgaacatttgctcgggcagttgccccttttttctttcgtcgacccgcgccaatcgaagggcgccgaaagtgaagcgaatgccaacggaaatgaaccagcggtggccgtgttcgcccaatgctgccgaatggtcgaagcacaaatggtcagtcattagagtcatcagcagtaactcatgaaataatagggggagggcgggggagatgggagagttggaggagagaggggagagtgaggggatcggagagaatggagaggtatgatagcggggagatatttgagattaattagaaacgaactagataacctaaaaatgcacataagtattttgttacaccgaccggattcaaactttgccccccccccaaaaaatgatgcctaagaatccccattcacacaggg

SEQ ID NO: 16992 - DNA, 418 bp, Heterodera glycines
agagcaaagagagaatggagagaggagatagaggagagaggggagagatcggagagagtggagagaggagagaggaaagagatgagagagagtggagatgggggagagatgggagagaaaggagagcagagagaagggaggggtaggagagaagggagagaggggatcggagagagattggagagaatggagagaggggagagggaggggatcggagagaatggagagaggggatcggagagaatggagagaggggagagggaggggatcggagagaatggagagaggggagagggaggggatcggagagaatggagagaggggagagggaggggatcggagagaatggagagggaggagagaggggagagtgaggggatcagaaagaatgagagggggcggactctagaggtccccg

SEQ ID NO: 16993 - DNA, 2533 bp, Heterodera glycines
tccgccttttttgcttttagtttcttttgtcccgccccttttttttgctatttaatcacagtttttctacataaaaaaatcattcgtccattttaaaaaaattccatccacgttcgttttttctgttcttcctgcaatgaattctctaaacgctttcaactcccggagcaagggacacgacagcaagaggagttggattccgttgaaccaaaaaacatcagcgatgtggtcaacttcaattcggccggcgttttttatgttttgggaaaagtgacaaatatgcagtaccgtgtttacaaagtccaaattaaattaattaattaaattattaattttttctagtttaggcatgcccatttcgttccaaggggctcatttgccgccgaaaattgtccgatgataacatgtgtgaggcttgcggccaaaaagcgattgctcccatccacacggtgtttgttcgtcttctgctacaggatgttgaacaagcagacattgctcaacgtgtcaccatgttttcgagtgttgctgaagagtttttgggaatgaaagctgccgaattgctagccaaggagaaggagccggaaagccttgcgaaacacttggacgatttgattgctgtgaatctgatcgcaaaagttaacattaaggttttttttgttgctatttattttgtatttgacaaaccacgccctaggcgaacaatcagacgtacactggatttgattggattgtcaaccttttcaagaagtgcccagggaatgatgacagtgatgtgccaaaagaaaaaaatgatgttgatgagattgcaaccaagaaggccaagaaaaattgatagagagagagagagagagaaaaatgattcatttgttgtgagctttaaaaaaaagattgagcatgtcctttactttttttttaaatccattaaaaatgcattttattgttgaagatgatgagacacaaactccaaaatggccttgatgtgattgcaattttgttttttcttcgtgaattcaccatgagacaggattgcacgttgacaatttttcgtaatgagcacagagagatttgcagttggctctatccgagtggtggatcgtcaactctcctcataacaatccaattaacgttgttggaaaagattggcccatacgcgtttgtcacgtaaccttaatttttcaaaagaacgaaaagcactcctaaatttagttttgatcttcatcacggctgaaaggggatcatgtgaaaaaaattgaatatttgtgcgttaatcatttctttattgataaacttggaaaaataactgatgaattttttggtaattggtaatttcgcaaatcatccatcatctcattggcatcacgctgagaaatatgtcctcttctcttaagaaaatttatcaaagaataccagcataaaatgaaaacgggaaaagcaatgagataatgggcaagcaatagaagttgcacgaggaggttaggatgaacgcttttgttttcaaatgttagtacttgtatctctggctttaaactggcgttgactgtagtgtttaagaaggccatttttatggtggcattttttcgcattatgcatcttatttatacagttcattaactaagctttgaatcggaaacaatgtgacggttgtagtctatcattatcatttggtcaaattcacccagcactatcatttcaactccgccctcaggaattgcactattaaatgttgcgcgaatgctagttgtcccgcttcttaagagttcataccctgtgctatcgtcgagcgtcgatgtgagtggaattacgaaaaaggtccaaccagatttgaattgctcttttgtgatgtcgaaagaacgctctgaattagccatgccaagtgcctcatacatgtcaacaaaaggacggacaaaaatatctttggcaaagtcaagcttgtatggaacaattgggtaaatcatgcctccagcgtacactgcaatgtctcgaatgtcaaacggtttaaaattaaatggagagagagcataatttccgttaaatgccccgtttgcaacaagtgcgattgtcatacgtcgaggaattgttgcactgaatacattgtagtcaatttcaaacctaccttcacttataaagcatgatttgatttcagtttttcgcactgcatatgtggctggttgtttttcaagcgttttgtagatacttaaattcaaagatgactgaacatcaatcattttggcatacagttttacgtcatggactctaacgcggtatttggtagtatcgtttgctttcaatgtctgcatgatgaaagtgtcacgagctttgtaaattgtaaataaaagatccaaattgttcaacaaataaagttcttggtttcccaggtcaaagtccagacgtgaaagaaattgggctcgcttcccaccctcaaaaattttacaccgagctttaaagccctcgtcagcgacgctgtcgtgtgtgcgtgtcgcatagtgaccagaagaagcgaggaagctttttttgacgttcatcggaaacgaaa

SEQ ID NO: 16994 - DNA, 969 bp, Heterodera glycines
  misc_feature (52)..(52): n is a, c, g, or t
aggtccaggtccaacatggaatccaggtccaggtccaacatggatccaggtncaggtccaacatggaatccaggtccaggtccaacatggaatccaggtccaggtccaacatggaatccaggtccaggtccaacatggaatccaggtccaggtccaacatggaatccaggtccaggtccaacatggaatccaggtccaggtccaacatggaatccaggtccaggtccaacatggaatccaggtccaggtccaacatggaatccaggtccaggtccaacatggaatccaggtccaggtccaacatggaatccaggtccaggtccaacatggaatccaggtccaggtccaacatggaatccaggtccaggtccaacatggaatccaggtccaggtccaacatggaatccaggtccaggtccaacatggaatccaggtccaggtccaacatggaatccaggtccaggtccaacatggaatccaggtccaggtccaacatggaatccaggtccaggtccaacatggaatccaggtccaggtccaacatggaatccaggtccaggtccaacatggaatccaggtccaggtccaacatggaatccaggtccaggtccaacatggaatccaggtccaggtccaacatggaatccaggtccaggtccaacatggaatccaggtccaggtccaacatggaatccaggtccaggtccaacatggaatccaggtccaggtccaacatggaatccaggtccaggtccaacatggaatccaggtccaggtccaacatggaatccaggtccaggtccaacatggaatccaggtccaggtccaacatggaatccaggtccaggtccaacatggaatccaggtccaggtccaacatggaatccaggtccaggtccaacatgtaaatccaggtccaggtccaacatggaatccaggtccaggtccaacatggaatccaggtccagg

SEQ ID NO: 16995 - DNA, 1403 bp, Heterodera glycines
cgaacgcctcgaatgtctttgaccattttgtttcgttagcagcgcgtgcgaaatcgccgcagcgcccaacgcaacgttttggtggctgcggaaaaatcaaaagactgatcggaatgaaactcagtttcaagaaccgtaattttaatcggggatatcaacggcagcacgaattccaaccaatttttcgtgatcggcagcccggatttcaaccaaataatggaccgatcagacaagacaatccaagttttggagcaaaaactgtagaagtgttccaattataatgaagtcgggcacatttcgcggacctgtccaaggcccaaacaatttgaggcaaacgcccataataagacccaagcccaccccgtaaacgtttcgagcaaaacttttgaaaattcaaatagaaatttaggttctacggagccaaattctttcatttctctttgacaaactttcatagtcgaacaacaagaaacaaaaacagcgattctcttccttctcaaattccctattaatccagaaatcctcgattaaatagaaaggcgattttgcgctcctgaaaatatcacacttcaatgcccattttgagaggtcaaaattctctcaaccagagcagatagccatggcatctggcatcacctctaaatgtaaaaatcctaagagaaataatatgtcgatagtgcacatccctccgtctcatgcgcaagcgctttagtgaggtataaaatttctcaaaaaaacagatatccatttttttgggatagagtataaacttagtaatagcataataaaactactaaggtatctccagggggggggggcaaggggaagaaaagccgtcacaatgcgtcaccaggggggggggatgttttttcggtgggacaaacctttgaaaaacatgggccaaaataatgcattgaattagacaatcataaaatacttttttgagctttatttgctaatgttaattttcaacaaaaaacattaaaaaagtgttcaaaggagaccgctattctattagacgaattgaatcttatctgtgagcaaaggaggaaacgaattcgtagttatggccaacaattaacccaaattccaattcttaccagtatacttttggacccgtacttacagggtcgggcaccgggtattggattttcataaaatcgggcccgccggtcctggtcttgaaaaacagggcattcgggtccccggccaaccctacttctacaattagattgactttttagcaattaactaatttgttgatttgtgtttcatattgagtgttgcaacgttatcaaacggggttttcgaacccgcattttcagaattccgagctctaattattaatctcctcttaggaaatggccaagtaaatctcagataatttttattcataaaaatat

SEQ ID NO: 16996 - DNA, 2765 bp, Heterodera glycines
tgcataaatgaaccaagaacaagacaatatcccaactttcaagcttgtgttggttggtgacggtggtaccggaaagaccacttttgtgaaacgccatttgactggagaattcgagaagaaatatatcggtgtgtcaaaataataaccgcgattctttaattttgtcgtttagctacgcttggtgttgaggtccatcccctcacttttcacacttcgcgaggtcaaatccgattcaacgtttgggacacagccggccaggagaagtttggtggacttcgtgatgggtattatatccaaggttaatgaattaggaatcacttttttttactcaaacatcatatattcttaggccaatgtgctattgtcatgttcgacgtgaccgccagagtcacatacaaaaatgtgccgaattggcaccgcgatttggtccgagtttgtgagaacatcccaattgtgctggtggggaacaaagtgagaagttcaacggttctactttacttaaccatcaataaatctcgcctccttttaggtggatgtcaaagataggaaagtcaaggcgaaaagcatcacttttcaccgcaagaaaaatctccaggttcgttttttgtctatatatattcataaagcagtaccatctttgtagtattacgacatttccgcaaagagcaactacaatttcgagaagcccttcctttatctggcacgaaagctgatcggcgaccccaacctcgaattcgtggcgatgccggcactcgctccgcccgaagtacaaatggatcccgctttggctgccaaatacgagcaagaagtggccgaggcagcaagcgctgaactcccggacgatgatgaggacatttgaagagatggaaggacggctgggacagattcctgggacagcaatttccgagcagacaaagttatgtccattgttttaactgattgtttgatgagtaaaggaaagcgaatgaattgggatagaattttgtaatttgactaaattttcctagaacatattacctcaggaaatgacaaaccgtacaaaaattaaaagaaaatctaaaaaaatttcttcgctgggcttaccctaagaatattttctttcgctatttcaacgacgatctgcaataaataataatatgaaaagtgcgatcggcagaaagatgatgtaattcttcattctcttcttcctctcttcctgttcccttttctgcttgtctctttgcagttcgtcaaacatgggaattgtcgcgcttcgccttcgtctctccatgacttcgtcgtgcattttcttctccaagttctctctttccaacgctagcgggcttttatatgatttcgaagattggtgagatgaccagtaaaattcggattttgtattcgcccgggcccagtctttgaacgtctgccggctcctaaaatgaagcaaaattcaatgcttgaaccaacaattttaccggttttctcgttggaagtgctcgaaatctctgaaatcgatgtccaaatcggtccaatctttatgccctcctgcaggtcccatgtttatatggttggaacgagtccgtctgaaatttggcgttctgccgaaatgggcttgcggtttcggagcagtgagcgtatcgtaaatttgtcttttctcttcggaaccaagcacttcgtatgcatcagttatctaaggaaagacgattttaaaacaatataatagaattaaatttctaaacaaaaacgctttcctgacaaagcactatcatttgattaaaaatgtaatcgtataattcttacattttgaaacgcctcggctgctttcgttttatccgtagggttcatgtcaggatggtgtttctgtacgacaaaataacaagtttttaagctgacattttaagggttcgcccacactttggtcagctcaaaaaatgccgttttgatatcctttgcgctcgcatcacgagacactcccaaagtttggtaatgatttttgtgggcagcaacatcattgtggcggttatttgaagttgaatgagagaatgacaagcaccggtggatgtacagtccaataagacaatgggtgcacttttcagggtaaaaactgaaggggagggacggaacgcgcacattggacatctccaacaaacgggctgaaaagatagaaaaagaacggattgatcacggattaatcaaaggaataaatagcacatgaaaattaaggcaaaacactttcaatggctaacaaaaccaaggcttttatttgttggtaaatttatgtcgtaaataaaacaaatgtaaaggcgaggagtgtcattattcaaaatggatcacatcaatacaatctccgtcctccaacccaagcgaattaggcgtttcatcatcagcgatcatttctgaaaaaatgatcttgaattctaacttaaaaattttattgataattaatccttctatatttaataagttttggattttgttccgatttaccaattgaacccaaaaggaagcgcgtcttggcaggatccaacgcatggtcagtgcaaaatagctccttcagtgaagcgaatgttgcatccttagaattaatttttgctttaaaatacctctccctcgtgaacttctctttaaatttaccggcaaaacgcgtacgatggtcggcctctgtcccttcgtttggtatttaagtgcgagccttttcccttcattctcttcgaggtcctcaaatgcgtccaattcaatttcatcacatttttccgatagtcccaatgtcctcggcgtgtccttcg

SEQ ID NO: 16997 - DNA, 1625 bp, Heterodera glycines
agtctttaataaactcctgcttacaatgtgcgaaaagagaaaaataataaaaaacaattatttcgtttaaaaaatattgaacgactcgacaaaaggctggattttattaaacgagaaattaaataatttaaatataataagaactaatttggcagctgtgccaattgtgcgtgcaagccgcctcgaagttgatctcaagaattgaaatttttaagaaaatgacgttgaaaataaactgcaaactttttaaattccaaatagtaaatatttagttaatttaaagttagaaaactgtacaagctataaaaaaagcggaaaaaattcttaaagcataaattttaaaaaataaggctaaatattcagaaaaaaaacatttcaagggaggatattgcgaatgaactctatgtgccatttgtataaaaaaatcgagaatatttaaaaaataaaaatatagaaaaggttaaaaaggagaaatgttaatatttaaaacaaaatttaaaattaatgattttaacaaaaaacgagaaattaattaaaatttcaatctatttcagaccttcacactaagaatttatgaatgagggaaacaagaataaaattaaaaaaaatcatagctaaaaataaataaaacttttggtaacaaaataaaataataattgacaaaattatagttctaataaatttccaattttaattcgtaaatcacaacgagaaaattgtatatggcctatttatgctaatgagttggtgatatttgtttttggttagtaacaaattcagaaaaatgatgcaaatacatattaaaacactaaacaaaaataaactaaaaatccaaaaatgcacaaacaaaaatgttttcttttcgttaatttttgcacttctatatactttcgcgttgttaagaatgagagtctaatttgtgagtgaaaattgcaaagaaatcagatgaaagaaaaatttaaaaatgccaaatttaaacttttctttcattatttaatttaattaatggttatttgttggaaaaaaattattcgtaaaaagtaaatagacacaaaatgtcataaaaaactcaaatatttataaaaatatgttcatatgtaatatgtagaaaaatcccaaaatatgtataaaaaaaagtctcaacttttgttcgcagacacaaaaaagaaaatattttcgttctctttaggctatagagaatccaggaaaaaacatgtatttacataaaaaatgaaccctgacaattatcaatgtttggatttagaattgagcttgtttcaaaccccaataataattgttacaaatttcacttaaatatgtataaggaattcttatttttccccataatttggcttaaatttttaaatctttaaaattgaaaaaagttaaaaatttattattttataaaaaattcttcctaaatgaaaatttattagctgaacttaagcctttgatatctgaaatcattaaaagtaatgcaaaagatgttttagtattttcttttaatcaaatataaatttaaaaaggttttagaagctgttgatgcaaagtataacaaattttaaaaaatgttaaaatcaaaaataccttaatgcgaattttatttttccgaccgtttccaacta

SEQ ID NO: 16998 - DNA, 1308 bp, Heterodera glycines
taaataattaaaaaactagaaagctaaatcatagacataaattaacagtaataaatatgggacaaaacaaataaaaataaactaataaaagtttatatatggaatacacatttttcccagattttattgagtaataaagtatgaatattgaaaaaacaacaaatttaaaataatattgtaaaactaaaataaacaaagagaaaaaacattattacacgcataatctaaaggttgcaagttttttttctaataaaaccttaataaacattggcagaactccctccagtgagagtacaccgtaacaagaggtaagtcatattgcagctaatgatataaaaattgaaaaaatgtatcatgaaatattaattttataaatataagttaaatagattcttttaattaataatatcgccatattatacgaatagaaaaaatgaaaatttaattaaaggacaaagcaatacaaggaatgatattctaaacacaaaaatatacgaatagaaaaaatgaaaatttaattaaaggacaaagcaatacaaggaatgatattctaaacacaaaaagttaaattaatagatgctcattgatcagatagtttatatagggttcagccccaagcttttgaggagcaaaatgtcggggaaaggggagtaaattccccgaaataatttgtcggggatggctgtagaaatttaaaaaatgtcggggagcaacaccttcgtcggggaggaaattttcataaaaagtctaaaaaaacaaaaataaaaaatccagaacaaaaaagtcttaaaaactcatttaaagatacttccatcttatttcaagtgcaatttacgactttcgtaatttcatttcccgaaacatgtcggggctgaaccctagtttataatatcaaataaattttattaaaatttttatctttttggtctttctgccgataggtgcaacggaaattttttttggaaattaatgcaataaaaatattttacgactttaagctttagcaaaattagtaaaaatactattataaaattcattgtcatcccttttgaaaaaaatgttgaaaaaatattaatatttccctaaaaaaattaaagttataaataatgatttaattttatattttattacaaaaaatctcataaaaaattcattaggaatttatagcgtaaaatatataaaaaatataaataatattattgtaaaagtaaaataaactaagagaaaaccgaaaattacatggataatcaattcaaataatttaaaatcttatggtaatgaaaataaataaataacttttgagaattt

SEQ ID NO: 16999 - DNA, 1711 bp, Heterodera glycines
  misc_feature (1701)..(1701): n is a, c, g, or t
cggggaacaattgccaaggacgaatctgtcgaaatccatgttttgaaagacaaggaaaacatttgtgccaattcggacttgcgcttgccgtccaaacgcaaatacaacgaacaattggaggagagcgatgggtgtttgatgtgttccggttgatggattgtttttccatttatttgattgtatttttgggcatttttttatttggctttaaccattggttttcgttaacatatgataaattgatattttgcttgtttaaaacattcccttctcttttggtgtatattgttaatacataaacatatttttaaaaattaccctttcgctttcaaagtttataaatgaataagtaagtgtaacatctctgcacctttttgatttattccgcctactatggaaggtgaacagcttgaaaatgatgaaaacgtttctccgagtcgcgtttcccccaccaatgcctttggtgttcaaaagagtggccatttgctgcacaattttgctgagcctggaccactgacgacaaaggttttgttgaccattgtgaaattcttttttgattgctttgctcattttcagatttattattacgtcgatgaccaacaaattccgttctccaccgaaattgccatccctccgtccaaaattacgctggcggacttcaaaaagtgtatcacgcgcaggaactaccgatattattgcaaagtgatggacccggcacttaacgcgtgagaagcgcaaagaagggaaacaaacccaaaaaaattaatcactcgtttattcagcgaggtgaagacggacattcgcgacgaaaacgccgtgctaaagccaaattcgaagaatggacgctttgaactgtttttgctgtccgagacacaacagacgcactcgtccgcctccactctccccatccaaaagctacaggttttgtcattttacgaataaaagatttaaattgaagcaataaccactttagcatgtcgatgccatccgtgcctctctcatggaaaaacggacaacggccaataattacattcttgacgggaggccaaaattcattgatgacagtcagtaaaactgattatttttgataaacttcactcctatttttgtaggcagtagcagccccgaggaagacagcaccaatttgcgtttgtttggcgagtcaaattttgagggcattacggggagcatcgacgacagcgactctcagtcagtgcaaatgattccaaatagcatgctgtttataaatgcctctcgttttgcaggtacaccaccgactttacgagtgtttctcagcagaatccacacgtgccgaagcgcaaatttgccatggcggagcgatggtgcggggaaagttgtgacgatggcaaacatgggcatggccaacaacaacaaagccaccgccatcgtctcgcctttgtgagtacgaacaaacgctacgacagcaacaacaaaccgtgttggacgcgcgagaagcggacgcgccgcaggtcattcacggcactttccagcacattcgaggacaccacggaagcatcaatgtccttggaaatgatcacggtgaaaagcctctgccttacatgatttacaagggaacattccaaactgtcactgctcagatcgctttaaaaccacttttatcgtgtagagcatagatgatttggtattgacaattttcggcttttttggctatggagccanaaaatgatca

SEQ ID NO: 17000 - DNA, 967 bp, Heterodera glycines
cgttaggccgtgctggccgatttcgacgattattctgccgtatttcagtggcacgtcggatgagttggccaatgaggtcgagcacaaagtgatcggccaattgatcagcgaaagacaaagaacgaaactcgcaattggggcccaaagagtggcacaactgttcaccctaaatgctaatttaagggattatcgctccaaaatcgttttgcttttctctaatccgttcccccattcattctccgccgactttttcctttccgattggacatcgtccgccttcgcgtgcttctcggattcgctccatcgaatgctgtctccccgttggcgttgtgctcctccttttcggcactgtctgtggtggcatttctctgtccgacggcgaccctccgcccgagttggtgccgtatccgtcgtcagcagtgtccgtttcgtgtccgtcctcgaagccctcctccgccaattggtcctcgttgcacagcagcagagtggcgggctgatgcccaatttatgaattagcaaatgccttggcttttcgtctccccccattcaccggttttccattgaatgtttgaaagtcctctgtgacggactccaaggcgagaaatgagccgggattgaaagcggagtagcagagaatgatcgcgtctgatctgtatttcaattgctcagagtcagtcaaccaattagttaattaattgccctcatttcccacttttgttggatggccatttggcgttcgcccgttttctccttttaaaataattaattttttctccaattttcttttctcactgtgcctgggtcggttatttccaccacaacctaaaaagaataattctcaatttgtttttttgttttttgttcatttattttttaccggctcttcgctgtctttgaattgaaacgttaaataccaaatgtccgcgtattgaatgtgctgttcaaacttttgtgctgctgaacacat

SEQ ID NO: 17001 - DNA, 1189 bp, Heterodera glycines
tgtccacttttcggtgtccaattttctggtgtccaattttccggtgtccaatttaccgggagccctctcggtctacctctctctctctctcttctctctttgtctctctagcttttctctctgtttctctctcctctccccccttccctctctgtctctctctctctttcccttttttctcggtctaccttctctctctctcgctctctctctagcttttatctctttctctctgtttctctctcctcttcccccccccttctctctctgtccctctctcttcaaccaccctctctctctgctttctcggtatacctctctctctctatctctccctctctctcttcctggacaaaattgtccattttttccaaaattctgatctcataaaagaacaaaaatacgctcaaaaaatcgaacttttagaatgcatcactaaaatgcaagactttcaaagaactcctaaaatttaatttagattaaaaagtttggtctttggtttgaaatcattctttttgatatgcaatttacacaatattataataataatgcgttaaatcagtgttttgttgataaaatgttatcagaagaattgccgtgggggcggtcgttcggtcttttgtttgtgcttcggatagctcaacgaaggcgccgtctaaaaatgggaagtttgtgggaaattaaatttaaattgcaattaactaatcttaaaataatagtaaatttacaaaaatttaaaattatttttataaatatttttccaatatttcccatcaattttgctcatttcattttaatttcccctcctccttctccacctgataagggatgatcattttgcacttcgcttcctcctcatagctcatccgatatccgcccgtcgattcgctgatcagcggtcggaaggcgccgaattcggcgccgctccgtgtgcaaatttcgtcggttgaaaaaatgcgcgggacaatgccatcggagagacgggacggcttcatctcgccaacgccctggggcgagaaaaagcattagcgagcaatgaatgataattaagtaattagtcaattaattgacaggaaaagtcttcagagttgattgtgatcaacgtaaacgaggaagaaatttatgttgttaaaaatgaattttgctgtgaaaagtgtgtcaatgtattttaagtaaaatatttctgcca

SEQ ID NO: 17002 - DNA, 1096 bp, Heterodera glycines
cctggaatgaaagggaattgatgtccggcaccgggaagatttttaaatgacacttaatatctgaagctttctatatttattttttctttttgtatattaattgcactctttatggcttcatctgtttgtcgacattttgtcccactgcgggacattttgtcaaaagtgtttttacctgcgattggagcagtgggcacgactcccatggcagatcgttcggaagttcgactaaatcggcggacgatctccgccgcgcgtacattttgacgggccgcgctccgtgccgcaccgcctcacgcccaatatcccaccaaaaacgatgcaaataaataattataaaaagttctaaattcattattatacatacaagtggcgctcatccggcggcatttcaatgacttccggcggagggcgcggcggtggcacccaacagcgccgttcagcgggctgctaaaacctcattttattatttattcgttttccaactttgctctggaaactgatcagttctaagtgccaaaagtcgatttttgcccgtttgtccctttccattttaaattgtcaatttccacctttttctttctccgccccttccgccgtttctttttgcgtggctcttcctcctcctcttcatcaatttcagcttcatcctcaatgttttccttgtcttcctcgtcatcaatctcctgatattcagcatataattaatccataataaaagattaaatttaaataatattattctctcactgtttcctccccctcttcttcctcttcgtcttcttcttcctcttcgtcttcctccccctcttcttcctcttcatctacttttctctcttccgcttctcctttgttttctttcttttttgccttaatttttgtttttttaatttcaattattattttttttacattgtaccgttttgctctctttctttttctcgtcctcttccttcacttcttttgtctttttcttttcttctttcggcttctccgtttctttcactttctcttcttttcctcttttctcatcctttttctctgcaacttttttctcctatttctcctcttcttttttcttattgtcaattatctt

SEQ ID NO: 17003 - DNA, 1293 bp, Heterodera glycines
agaggatgcgcaggttcggcagtttggttcatgagcttgatcgatataactcccctccctcccccgggccaaatatcctttggattcggcacaactggtccattaaaagtgccctcggggcacaaatgtgccgagccgacgacgccgaggtgttataaataaagcgggccaaattatgtgaaagtgtgacatgggtgactccatttatttcttgcatccagaaaataaatttattttttaaatttttcaataattttcgggatgaaaaatggaaattaatttttttaaatttaattatctaataaaaataaatagctaatttttgtctttagttcaatgatcaaatttcaaatgggaacaaatgaattttcgtgggtttgttaagacaattaagaaaaatcaacaccatcttttggtgacccagcttaaatacagttttaaataaacctttttttatttattttattttgaaaatattttcaaaataatttttcgctaatattaatcatttttttcgttaatagtaattatttttttatgttgttacatgaataattgtgctctcaagcatataattaaaaaaaaactaatgacaaatgacctaaagccccttacattttggcacccaaaaaaacaaatttacaaaaaaaaatttgccgtcgacaaaatttaaaatttcaaaaattaaaaacgcattgaatcaaagcctaaaatcaaaggacaaatcttagaaataagtacacatcgtggtgtcctgaaatagcaaaatcattctttaaccgtgtgtcacagaatttacttttggcacttttttccccttggcattgtgcccttcccccatttcgtcccgagttttaattaagtgttcttctgtgccggaggggacggcacacactttttgtgcccggttcagctcctccacgcctatttgttttgtcatttattgccgatactcgggcgacgaaaatttaatttttttttgtccgtttttattttttataattgaacattatgaattcctgagatagtttatgcacttgatgaagttttttatggaccaatttaatttttttcaagggcatttcaaacatatttttgttttattgtttggcctaaatgtttatggatggcactcgtgctaaatctgaaggacaatcataaaatttggcaattcttttaaatcaaataattaataattaattattttataataattaatactgaaaaagtgataataaatttttttttccaataaaaattataaaaaataatttctgaatttttcagaaaatt

SEQ ID NO: 17004 - DNA, 1306 bp, Heterodera glycines
tttaatttaaaataaaaaaattattttttttttgtgaaattttgcaattttttcttttacaaaacaattaatgattaaattaaaactatttagttattttaaaaagttaatgttaatactcattttggaattattattattatttttgataaaaattaacttactcgtatttcgtttgaaaagcattaaaaattagaaataaatctttaaaaaaacaatcatttatttttctaatatattctaattttctaactgaataaagacattaaaaaaaatttatattctttattgcgtgataatatttattttttaagaaataagcattaataatttataaaatttacaaaaaaacaatttcataataaaaaatataaaatttataattttatttatttttaattttatttatataataataaagtttaatgaaattttatatgagaacagccaaatgtgttaacatcattataaaagtgagaatagaaaaagaattaggaattctccaactataaatacatttatcattaagaatttccaaaaaataacaatgaataaaatgttatatgtgccggattttatcagtatttttaaaaaaaattaaatttatattcaacaaagagctaaatgttcatgaaattttcttttttacaaaaaaaacaacaaatgctatcaaatatacaaacaaaaaaattgaatagttatacggaaaaattaaatattattcaacaaagtctgtatgattcatgaattaacattggactagcatgagtaaataatacaaaaacaaaatagctaagagtatttatttttaatttctctaattaaaacaccaaaaataaaaaacaataaaagattcactattttaatgatattataataaaataaaaataactagcttcctgaaaaaaactcatatggagcaaaacttcaattcattagaacataaaataataattatattatatttaggttttataaccaatctctaaaaacgataatacataataacaaagatagattaataacttttttgatgatttttgaattaagttgctatatctttttaattaaaaaatatataaaaaaggattatttttaaattaatcattgtaaaaattttaatttcataccatttttgttctaaatacattctaccattaatgtaaaatagcataaaaaatgtatatataatttgtattttgttaaattgttttttgcatatttttttgtaattcagtaacataattttaaaggctgtttattaaacaaatttttattgtatttatcctttaattcctttccatat

SEQ ID NO: 17005 - DNA, 984 bp, Heterodera glycines
ttaaattttcaaaaaatttccccggcggcgcctatccctctaaggtactctcttccctcacccatacccaaaaaatttttcggaaaaatgcgccgaaaataattgttaaaaatctgattttttgattctaaatgcactgaaattaccaattgcttatgttttccgtaaaattgttaaaatccattttcggaaaggtataaatttctcatttctaagccggaattgctcagaaaaatagttggcggcgataaatatgttgctaaggcttgattttgttgaataaaatgcgatttaaattttggaagcgtgttttaaaaatgtccttatttttgaccctaaattataatgttgccggactagaagcaaaagaattttacgatcaattatattaaatttttttttaaattttgtacatatttatatttatttgaaagatgatttttgacattaaaattccttgtttcgataccctagccacttaacgaaataacatttgcgcccgttttttaatttaaattggcacaaaaattctctgaagaaattatttatcatttactgatgaagtgcataaatttgttaacttttatatcaccaaaggtttttgtgggatttaatgaatattgtaatatttacattaattagtcttcagcaaatgagattcaatattatttggacctcatatatttgttcatagttattattttaaatttaagtttacattttaaatagtaaagaattaatttattaaataaaccttgaataatatattttttatttatttgggtaaatatatatgtttttatgaattgcacatcattatttttttgatgaattagcttatgtagaaaagattttggtttttcttgttattttctttaaaacttttcctttatacatgaatcatttttgcacttatttatcccagcacctgaggaagcgaaaaaagaaaattattcattttaaaaattattgtttttttatcat

SEQ ID NO: 17006 - DNA, 297 bp, Heterodera glycines
tataataacgctgcggacatctacatttttgaattgaaaattattggtaattactctttctttttctccatattgaccatcatactcatactccccccacccttttcttcttcccccaccctttctcctccttcattttttttttcctttccttctccaaccctctcctccctctcttgatagtttaaactgaaggcgggaaacgacaatctgatccccatcaagctagcttctgcaggtcctgctcgagcggccgcccggggatcgatccccgatctagtaacatagatgacaccg

SEQ ID NO: 17007 - DNA, 2378 bp, Heterodera glycines
  misc_feature (2323)..(2323): n is a, c, g, or t
  misc_feature (2350)..(2350): n is a, c, g, or t
tttttcactttttatgtgcatatttcgcaatttttgatgcatattttatgcgcatattttgcgattttatgtgcatatttttggatgccctagtaataagtgaaacttcattgcacatacaggatcagcgacctaaaataagtttgtatcgcttcgtcgcaggccgtttcggcgcaagcccaagtttctggctataaattttttcattgacaaacaaatccaacaattggttctgaatttttttgtgaaaaatcgaaaatttctagaatttctggaaaaacttttttaatttagaaaaaataaataaaatttcaggttttttttctttttaagattattccattgactatttacacattatgcttaatctggcggacccatattgggaacccacctgcttaaactacagtcagtaggtatagaccggtggtctgtaacaaatacagtcgcataaattattatataaatattttccatataaaataaccaattttatttgattttggaaattattccctttggcaatagatggtcaaataaatgttttttatatttttcatctgttcaaagctcgtcttttggtgcgattggggcactcggccaccgatttggctgatcgttttgccgttggctttgtttttggcgacatgccaacggtttggcatcgcccgagtgatcagcagcgccaggcaaagacgcattggcaccgttggccatttgcacacgaattgtcggtggtttctgctgaaacatttacatgacatttgctgctggatataatcagcattaaatgaatgatagaaaagtgagtatccgataatttgattgtcattaaattatgaaaaatcattaattttacttaaacaaccgattattgttcctaataaaccagaaccccattttttcagggaccccatactccctcacattcgcccctctcatttaccctctcataagtgccattttgctgatcatttgtcggaggagatgacgtattattcatgggagcaagcggcggtgccgacaatttggagcagtacaagttgttgttgtttgaagtggtggcggaaggtgtcgtcggcatacgccgcctttgctgcagcaatggggtggcaacaaaagcactgaaacggcaagaatatgggacgaactcgttaaggagtcttattgtaaaagaggaaagctagatgaattttgaagattttcaccgagaaatttccatatttttccgataaaaatcacatgagggtaaccgcggcatttgacaaatgcgcagctggttttagaagcgagtctcggaaaattctcgaggcgagaaactctgatttttgcggtccctagctaactgatgaggctcatgcctatggtgaggttggggtggggaatttggaaattggcaaaaacccgggggtcgactgacaaatgagacagaccaatcatcatttttcggtgtcggcagagtgccgtcccggccgccgttgtgctcgtgcgacccgtccaaccgttcgcccattaccattcccatgttttgttcgtttgctgttggtccaccattcccctcattattatgttgctcatcaacatgcgcgtgcaaaacactgatcttcttctctctgtgctgctgctgaaatgtgttaacaaatttaatggttatcccaggcgaattcgaaatgattaattatttgcctaaattgtgtaataatgtcatttggtttgaatacatggcgatacggacaaattagggaggattaagttttggcacaaaatagtccatttttttaattctatactatcgattgaacaaattttgcataaatttttcaaggaggcgcctttaaaaaaggtttatcaattcctgggtttaaatcataagtttcaagtacgctttcgtgtcaaaatgttacccacaccagaccatcttggtcttcgaattttgttcaaactaaattgaactaattagtcctaattatagtcccccgaccaaccaatccattgacaactttctctcctccattccttcccatcgcaccatttttggttattcgatacgattttgccatggtgtttttgtgaagtttttcctttttttaatttttttttttattaaaacgaatcttttctctttaggcttctaccgtagtcgtcgctctcctcttcatttgatcgtaacggtcgcttctcctccgcaagttttgtcagctgctggtcaattcgttgcgcaaatccacctccatttttgtttgccttacaattttgcgctttacactgttaaaaatggagaaaaatgatcaattagacaattggtaacggacaattggcccanaaatggcagatacatattcatggggtncgattttatatttttccttcctcttttt

SEQ ID NO: 17008 - DNA, 1583 bp, Heterodera glycines
  misc_feature (20)..(20): n is a, c, g, or t
ttcacatacgcccaaacacntttggagaattatgacatttctttaagaaaaaaaaattaatcaaaaaatattcaagaaaaaagtcgaatgggaattattttaaaatgagctttaattaggagggaaaaaatttcaagcctctaaaaaactgcacgtgattaaatcataagcaaaaatattgtattgtaattgcctaattttttcaattaatcaaaatcagtgttatttaattttttccaggcgtggaattccctggtccttttttatcaaaaaaaaaaaaaattcaaaattatgcgaaaatttcctgggagaaaaaaagaattcaaaactttgacttttccttttgacaaaattccaaaaggggcgaaattgacctttgttaccaaaaaatatccttttgagactcgagaatgaatgtctgttttgatagtgcaaaacaatgaacggacctgaagagttcgcgattgtcgagcaggtcgatgaagcggagaatggtcggaccgtcgaccaacaaacaatggcgaaactgcgcacttttgcaaaacgctgcattttcctccaattggatcggcttcatttgtccctcataatggcaatgtctgcacgcgctcactccgcaggggatgtcgttgcgcaagtaaagttcgtgaacgcgctaaaaggattgactttaccaaagtattataagaaaattggcgtggcatttttatgacttggtcccggagttttgaaactgaaccgggacagaaacagcaaaaagccagttttccgtgaccccggtttcggtcccaaatttagcttgggattaataaatttaaaattttgctacgttatcgaggttttttgatggatggagaacccgacgtagggaaatttctggtattttatgtgatgaaaggggcccggaggtgaagacaaaccgcaatagaaccaaaaataactaatattataactacaaaatattactttgttgaatttgccattgcgagttttataaaaagttgttctgaagacccgggcttctaaaattgaaaataaagggcacctggacttaaaatatcatttaattataatttatacctattccgctttgctttacgttgagttccatgggtattttaaacttctatagacttcaagctgtcaattgataccaataaataggtcttgaccaaataaaaaatgttttaataaactggggatggtcattgattgtaagcctaaaagtcaattggacgcgaaaactgaattagagccggaaattcaaagaaaaaaagcaataaaattcttacacttgtatagaaatttttcaagtgaaaatgtagtagggctgcaaatttctagtaaatattttttcatcggtaggggacggttcggtgcccgccgtttcggtgccagcccaagttttggactacaacttttttcattgttgaccaaatctaataatcttggtatcattcgaaagctttatatgtatagaagtttttctaagctattgcttagcgagaagacaattaccaataaagttatagacatgatataacaagaaagccataatcttggacgttatatcttaataactt

SEQ ID NO: 17009 - DNA, 1440 bp, Heterodera glycines
  misc_feature (1434)..(1434): n is a, c, g, or t
agcttgtgaagggctttcgaatgataccaagattgttagatttggtcaacaatgaaaaaagttgtagtccaaaacttgggctggcaccgaaacgtcctgttccgttttttccttgggtttttttttgatgatctgttcaaaatagatttaaaaatagaaagcagcttttatctccattttcttcagtgcaaaattcttcaaaatattttattaaataaacatggaaaagtgtgttttctgcggtatgtttaatttgtttgatttaattaatattattttaaggttcaacacgaaaatctgcaccaaatttgcgattttttgggataccgaaagagcccggactcaaacgtattcagtggttttatgttcttggtgacagagaaattgggcccaaagaccgggtgtcgaaaagcgtttccatttggtaatttttgataaacaaatcaatttaggtctgtgcaatacatttccgcttgggaaaaccaaacagcgatccatcgcacgaaggtgggccatttgtgggtccaataaatatgtcttactccccgctatttaaaaaaaccgaatccctcgtggtgacaaaacaaaacaatttaaagaaatgatcgagttcagatttcgttccccatttgaatttgaacaatgactctcccgagtacatggattatcttgaatcattggacgattgcaaaagaccgatgggcacagagaatcgaagacgcccgataaagccactgattttgaagaagaaaagcaaaagcggacagcaacaggaagtaaatgaggaaattattcgttttcacaatggtcaggaaaatgaactatgttttcagtcccaatcagcctgtgccgcgccaaagcttttgccaattccaaaatcagtcgcagaatcagtcgatttgagagagggacaacccgtacttatcagacgatacaaaaaggaaagacgacaacaaaattgatgaacatttactttgtcattttattacctatttttttataaactgtcctttggcaatgaattggaaaacccatcgttttttttctccaatttacaattgcgattttccctaaccaaccgtgaagcgatcaaatcggtcaaaaatcaactgcaatcgaattagctccttaaaaagattagtcggaagcacaccgatttggttcgtccgttacaataaatggtctggcgttccgttcaaggttgcccccgagggcatttcagggaagggaaggggtaaatgcggataatctcataaatttctctcacacttagcgatttgcccctcgccaatgaaaatgacccaatttgccttttaatttaatcacatcatgtgaattatcagtccataaatgaacttccgttcagtgaatttgcaacattttaagcgaagggaataaaagcatttaaagattgtgattattttagcaaattgnaattta

SEQ ID NO: 17010 - DNA, 1932 bp, Heterodera glycines
aaaatgcttttcgtcataaatttgtcgttcctccttttgtttgtttgctcactttctgcatctgtttgttgttctccttcgtcttcgttcccattgttttgatgttgtacgcaattttgcgcatttcgtccctcatgacgcgaatttcttcgtcgagctgtcgtacgcgttcgtcaatttggtcggaagacatctccagcacttgggcgtcggtctgaaaaattgaaaaaatgaaatgacatagaaaaagaaaatgaaaagcaccaatcgctcaccacatctccggctgggtgcgccatcttctcgttgtgttacgcccgttagtaaaatatgagaaaaatgcatcacaacagcgacttttatacacattttggacgtttttttttgcattgtgtgcagttgcagtgcgccaaaatgtgcgagtttcctattttgaatatttttcaaattaaatcttaattcagcacgatgatacacaaaatatgagtacggctaccaacctagagttagaatgggccggcatcgtttcggctccaaagtttcggcaccaaaattttttaataaataaataaatagaaatttcctaaaaagacaaatttattgtgcagtttctgaaattttaaaacttttcatatttctcttttatcctttttgacactcatattcctcactcttttctctgtctctttctatcttctccccttaataattcaaataataaaaaatgttcgaatgtctaataagtcaatcgggtcctgatttaaaatttcgtaatcccaatgctaagccagcctaagttgaggcctaatacgatgcccaggcctaaacagctggcttctgattcaaatttttcgacactcggattatttggcaaccggacaggaagcgataatgttttatctcatttaacgtctgaatttgtgtttaatgccaaaaagtgctataataataatcacacaatgcgacataattattaaaaaaaaaaatttgcccaaaattagtcattttgatggtaaatatctgttaaaaaaggacctaaatttgttaaaaaaaaacattattttattaaaggtatcgcccataaataaaatggaattaaatgacagccaaaacagcaacggaatgccaagggaaaagcatgttgatctggtggattttaaagtgaaagaatttaagcttgaagtaattttttgagaataattgagtcaagcaaatatcataattttccacagacatttttctcaatgcacctggaagtaatgggaaagtacgacacgagggccggtacattgcgggactgtgattaaaattgaaaattttggccttgatgttgtaattttgaaaattttgagatagaaaccctgatctaactcagagtttcgatctcagttttgaaaatcctcatttcagccataaaaaatgatcatttgccactaaaatgctcgaactaaaaaattcgatttctattgttttaataaatggacaatctcttaaattagcttttaaattgctttttttgtggcgcggtttttccaaaaatttttttgcgaacattgggggggggggtccggcagtgccgataggcgctgccgggaaaaatttggaattttgagtgcgatttgttaacagattttgtcaaaacaattattttggccccctctatcgaatccctgtttattctttcgaagttatgtttttaactcgagaccggatcttctatttttacaagggaaaatcccaaaaaatatttaagtttggcgttacgattactaattaaaaataaacttatttacacttggagccaaaattgactcgccgtgatcaaaagaccacaaaaatccgcaaatcctcattttccaaaaaagcctctttgaccctctaaaagaccacaaaatgaagaaaaatcctctagatatcgcatctctgatctaa

SEQ ID NO: 17011 - DNA, 877 bp, Heterodera glycines
acggatttatggtaatctaagtgacaataaatgtcccattctattttttcgttaaaatttttcaatggtattaggggtaaaatgtttgacaatttgtgtctgatggccaccctccgtctcaactttgcgtagatggccagtccaatcagtgccgccatggaacagtgcggaatagtcggagtaaagcgcacgtcgacgaaagggtcggtcgggtcggcgctgacttggatcagttcctcctggagaacagaggaaaagtaaagggggggggcaattggtttcaatggaaatggatataaatttcaaaaaatgcggggactaaacggccgtgttaataccaagccgaaaaaacgggagcagttcgttccccctctccaatatcgtgtcgttcgccccgaataaattttaatatttttttcgaattttataataatttactaattttccaaaaattttcccaaaaatcctaaaattaagtcaaaaaaaaaacacggaatttctaactgtgccccttccccacttggacgacgttcagctgttccaacgtgtacggatgctcggggtcgttaatgtcgcggatgtgttcgaagatttcggtggcatcgatgggctcctccgtgccgtcgtccaacgccgtggccgcttccgccgccaacgcacggcgagctttggtcgcgtaaataactgaacaaaaaagggcaaatccattgacggaatgaaatgcgaaagaattaataataattaaagagtaagtgcaaccaattaattaaccattcgaaagtgatacggaagtgattaactaaagaaatccattatttatcaggatacccggcgcagcgttatcgagtcccattttgcgtcaaatcaatggctaaaa

SEQ ID NO: 17012 - DNA, 1118 bp, Heterodera glycines
aaaatggcatcgagtggacaaaagctgatccgcgttgaaaatgccaggaaacgctcgagcggagaagcgtatgccaaagtgatcgaccgggctgacatttcggcattttcctctttacaataacactttctctcagatctctctgctgcaacaaccccttcccactgatcggaaatggatccaatggctttttgccgaggaattcttcgccgacgaatggagccgaagggttcccgccgttcagcttcaaatcaccatcgtccgtcctccgccctccccaccgccacaatttgacaaaccgcggatcatactccgcctcaagtccccgctacccgcccacaaaacgctttttcgcgtgacagcaaagtgagtccaccgaataatgccaaagtccgcttatgctaacaaaaggccaaacattgagcccccaggggagggcgggctttccttctccgctcatttgcagccaaaagaataattgaattttggtctggcactcgagcagtgcgttagcctcggtcggttttggtcttcggccgccctcttccatttcaattagcgccttttggaggtcaatttaattctcttttcttcccattcaactttcgtgctgtccattcgaccgtttttaataaacaatttcgaattgaatgaatttattttgctgaaacagaagaaatttgaaccaataattttcaccgaatcttaaaaaaaatatatgactcaaaaaagcacccgaatttgtggaaaacgacaaatgagaatggtcagtgacgaatattctttaaatggcgggtatttctttcacttgtcattcgttgacaaggacaaagattaatcgagaaaaaaagaaggtcgtaatgatattgacgagtgatgatcggatggatggataatgaaggggggagaagggaggggctgactattcaaaaggtgcggaggcgtgatggatcatgacagaactgcttactgcgcgttactcggcacgtctccccacaggtttgtatttaattaaattttctccatcagggatttttttccattaggtcgaccgttatcgttctatagctctactccatttatagaaatttttgttgaaatatttgtcgtgctctgaa

SEQ ID NO: 17013 - DNA, 3110 bp, Heterodera glycines
cgcaaatgaatggcgaattttcagcgaattcctttgagcgtcgatgagaaagtgtccaaaatgaatttggaatcgggaccattgaggattcacgagaatggaagcatggaactgatcgaagcactgaactttgaacagagcgccgaatggattcaatcggtacaaattgacggaacgcataaaagtgagaaatattaaaaaatttagttaaaataatttctttattatcaagaccctttattatatgtatctttttgtggagagaataagcaaatcgaagttacttttgggaagggctcttaattagggacgaaatgaaagagaaaagatgcaattaggagaattattatagaaaaagttaagaaagggaaaaaagaggagctcaaaacgggggggggggtaaatttatggaaaagtcaggaattaagtttttaataaattattttagcacgccttcagaccattcgaattgacgtgttggatgtcgatgaaccggcagtctttataaatcgcccccggccttttctcgctgtcgtccctcccctggaaattctcccccggggcttccaagtgtttcgtttggaggccaaagacgaaaatggggaaggaagtgccgaaaaagtgactttcagactgatcaacacggagcgtaagaccaaatcgaaggcctcatttgatgagtatgccaaacattcagcaccgaattcatttactgtggacggattgagcggcgcaattcgcacagcactcacaaaatattcgcctgggggcacttacaaagttttcgtggaggcaatggacaacggaggggctgaacaaagggtaggtaaatggtggccatttatgctgtggcataatctgagagtgccttttgctaagagtcccaccggcgggcgttcctccgaaattgccgtcgtcgaagtgttcgccggggatcgtcctccccaatttctgcgtcaaaagtacgctgcgtcggtggctgaatcggtggacactgggcaaagtgtgcttcaactggagaccttctcattcccaccaattagcgaaaatgggacaccaaaagtacagaagtgccggaattcgttaactaattggatcatttagggcccaattaaatacagtcttttcgagaagggatcgaatggtgcaaaattcagccgggagacttcggattttttcggtatccacgaaagaagcggactgatttatttgaagaagcgattggacttcgatgacaaaacccagccaaggcttttttatctcttcggtctgtcggcaaaatcaaatccgaaaagcatttaaattttgaaggggttgccgaagaggacggaaaagagtcatccgttcccgtggaactttctgtcgtcgatgtgaatgacaacgccccccaatttgtccaacccgatttaatcctcttcaattcgcgaggacattcccacggggcacactatgcataagggtaatggccagagggatgctgtctcagcattttggccaccaatttccagtcgatgcaatcgacgccgactcgggactgaactcggcacttctctttgccgtcgatcacccacaattcatggtcaacggacggggcgaattgcaaagaaagccgggcactaaaccattggatgctgatcaggtgatgaagcaattagcgactctaattgacgacttccgagttcagttgcgacagggccactttctgtaccgcttcaacgtgtccgtgtccgaccagggcattcctccgctcatttcctccgctattgttcacattcaaacggaaaacgttaacgatgaagcgcctgaatttgttcctactgcgcaatatatggcgacagttaatggccaaattaaatttaaatgaaaaaaaagaatttcaggtggcagaagacgccctcgggggaacgccggtagtgcaagtgcaagcgatagacccggacagggaccaagtgaactacgcatttgtggacgaggaaggagacgaaactgtggtcaatggactgtttgaaattgaccctgacacaggttggacaaagcaaagaacggacgaaccaaccgcaaaacgatcgcctttctttttgaggactgattcggctccatctctccgttcggaatgatcagctcctttccttggactcgcccttaaatttgactgtcattgctcgagatgatggctcttgctgttctcatcggcggaagggactcgccgttcgtcacacgacaaaagcgacggtcagtgaacagacggacaaagaccgagctaattaccataataaagtaaacacgaacaaagatgattgtgccatttgtgtgaaggttcttgttggggtgctcgacttgaacaacaataagcccgagttccctcactgtgccgattattctcggatggcaatggtcgaagagggccaataccgcgtcaatgcctcgccgatccttcgtgtggaggccatcgaccacgacttgggtcgcaatgggcacgtgtcgtattctctttactacgcacgcagcgagtcgcggaagccctttctgatcgactcggacagtggcgaactccgaccttcgccttattttgtttttgatcgcgagcaaaaagtcgtcgaggaggtgaccatcaaagcgacggacaaaggcgaccgaccgttgatcggcttctgccagttcaaagtgcaggtgatcgacgtgaatgacaatgcgcccgctttcgacaagtcaatttatgagacttctatgggaagggcggcacgggtcggcaccgctgtgctgacagcggtggcggaagaccgggacgggccgcgcaacgctcacatcagctacgccttggcaccggacgagacctcgtccgcggaacacttcgaagactttcagtcgttcacccttcccgacccggaaattggcgagattatgctggccaaaaaggtgccaccagagaacgacagacttctcttctcaatcatcgcaacggacaacggatttccggtagcacaaagcaccgcggcccaagtggtggtccgagtgcacgaaaagcagcaaaacgcaccgcaatggcaagcgcatgcggagtgtccggcgaggctaaccgtgtcggaggacgtgcagaagaacaccattct

SEQ ID NO: 17014 - DNA, 892 bp, Heterodera glycines
ataggcgccgccgggaaaaatttgtgattttaatgagattcgtcaacagattttgtccagaaaattgtttaaattttgccaaaaagcttattttcttgataaaatagtgacattataccataaaatttcaaaaattatgagtttatttaagaaatcagaacaaattttggtcgctaccccaaaatcagaacatttctgacaaatcagaacatttttattttatcagatttggaccctccaaatcagaacatttctgataaatcagaacagatcgcatccctgaggaccgggacttgccgggacctgagaagccgggaccgggacctcgattttttttcgggaccgggaccgggaccgcaagaaaaaccgggaaccgggaccaaccgggaaattttaaaaattcaaaaaaattttaaaaatttaaaaaaattcaaattttaatttatatcaagtgaaaataatacaaaattatttggttttttatttaataaattaaattaatgaaaattttcaaacaaattttcttcaattatttcaaacaattaatcatttttggactaaatcatcgaatattaatagaaattcagatttgattttcacatcacttttttcggagcgctttttcaaaaaacttttggggaagaagtggtccggcggtgccgataggcgccgccgggggaaattttgaaatttgggtgcaatttgttaacagattttcaacaaaaaaaggttggtttttgggattattaagctcaattggtaggattttcatttaaaaaatgataaaatatgtatcaatttaaaaaaaactatgaggaatcatattttctttataggaaacccacgagtatacaaaaaaaaattgaaaataatctgatttatgtagagggat

SEQ ID NO: 17015 - DNA, 2129 bp, Heterodera glycines
  misc_feature (1147)..(1147): n is a, c, g, or t
gataattccgcgaaagtcctcgaagaaattccaaaataatatgatggtttgggtttatgtggtaattgtgatcattatcattgttcgggttcactggaatgtaattttgcaccaaattgaagaggcgcttgttctggcgcttggtattttggcgctttctgcggcggttcgagtccagcaacaaatgacgcatacttcccatcggtgcccttctgctcacggcggagaacgtcaatgaagtgccagatcgatggatgacggcaattgaaggcgccttgaagacggtgatgttctgcctctgcgtggttgtttgtcctcgcttccccattcaatgtgcgagtgtagacgttccactgttctggtgggaatgttggctgtgaccaagttccatttggccttggttgtccgatgtaattgttgagcaacctaaaaattgcacaaattgtcgttttttcaaaaataatcagtttaaccagtcaatgagcggacgaagtgcaacgtcattccccagctccgtatctaatgcgatgacagctgtcctgatacaatcagttggtcaacgcttttaggaaccacaggtggtgcattgacttcatgtcgtgcccttttaacgatcttaacaattcattcgctgtattgtctatcattaattgaacagtacctgtcttgaactattctgtgtaacgaaaagtcccgctggagacggcacattttgaagtgcctcggaacggatcactgctggcggttcatatgtggcgagcgcacgccgttttattgccgtcttgactttttgcacctcaacgcttgatgcatttgcaggacacgtatgcggagtcgccaaacgtatgaattgatcagccaaattcgtccagattcttcccttgcacaggtccttgaattcgcatctccaaaattttgtcatcccgtccgcacttgctttatcaaaagtgtaaaggtgcccttcatgcgtgattttagacttttgccttttagtatcaatttggcgattcatttcacctaaacattaacgacaaaattatgcaagatcacaaaaaatgaacgtgaaaatggagaaattaaatttaatatagactattattttattgacttcattttttgaaacaaaacaaaattttttttactattnctgcgtttctgatttttggcgccgaaacgaccctggcgccgaaacggcggcgccgaaacgacccgttccccctatcggcgcccccaaaatttttggaataagcgcgccgtaaaaaagcgttttttaaagcgaaaaaaagtcgtcatttggcttttaattccaaaaattgggcttttttgatgaaaatctgttaacaaatcgcattaaaaatttaaaaaattttcccggcggcgcctatcgacaccgccggaccccctcccctcgctcattcaccaaaagttttttggaaaaatgcgccgcaaaaaattgttataaatctcgtttttgatcccgaatgcactgaaatttagaatttgcttatttctccccaaaaattgttaaaatcgattatgggaggtggaaaatataatattaatacatttttgatcgaataaattgtaaaaataaccgttttgacgcaatttcgcaaacgttctgattttcgaccctaaaatctgattttttgagcctgctgttctgatttagaaaaattttcaatcgcatccctgtggtatagaggatagcgttgtgatggcataatggtatgttgatattaaataaatatttattaaaacaatggttcgctaagagaaaaatgttgattttcctttctctagttattagtgcctatttccaggtttttatttttggagtctaaaaaactaagaatttttgaaaaaattattttcatctacacttcagcacctattttggatttatgcgttgcagactaagagatatctatggaaccaataaaacaatggttaccgattcccatttttggttttattctttgagctgatactagcagcaattgtctcgttttacatcggtccaagccgttttgagcagttttgagttcgagacatatgatacaaatcttcagcaattttaattaggtccctaagcttaataattaatatgtatttactaatatgagtgg

SEQ ID NO: 17016 - DNA, 1741 bp, Heterodera glycines
tgtagaaaaggctagtgtaggaatcctacgctagttcattagtcagcgtaggattcctacgctaggtttttcaaaaatgatccgaggaagcgattttccactcccttttatagactttgagctcgagtatgataactacattagcctagtgtaggaaaggctagtgtaggaatcctacgctatgtcattagtcagcgtaggattcctacgctaggtttttcaaaaatgatccgagggagcgattttccactcccttctatagactttgaaggtttattttttttatataatcaacacaagtagaaacaatacaaatgcagaatctacattctacactatagaacactctacactatagcacctgtaaaagtgactgcggatgtgcaatttcgcttgtagtgtagtgtagtgagtctctacactatagaacacacctacactctacactatagcacttgtaaaagtgacagcggatgtgcaatttcgctgcgcttatatagacgtttggagagtagtgtagagtgtagtgtagtgagtctctacactatagaacacacctacactctacactatagaacactctacactatagcacttgtaaaagtgacagcggatgtgcaatttcgctgcgcttatatagacttttggagagtagtgtagagtgtagtgtagtgagtctctacactatagaacacacctacactctacactatagaacactctacactatagcacttgtaaaagtgacagcggatgtgcaatttcgctgcgcttatatagacttttggagagtagtgtagagtgtatagaacacacctacactctacactatagaacactctacactatagcacctgtaaaagtgactgcggatgtgcaatttcgctgcgcttatatagacttttggagagtagtgtagagtgtagtgtagtgagtctctacactatagaacacacctccttgcaattttccaccttaccaaatttcgaaaaataagcactcaaagaagcgtctgtggtatcaatagataaactaaatacaaaaaaataaggaagataaagtatcataaggcaaacccgccaacgaagattttgtggtcttttccattaacggaactgctgctgccaggggctacagacaattggacatcggttggctggttgccctcggatggaatttgtttagaagacatgttgttgttgtgggtgttgtccatctgactgtgctgccctcggatggaatagaaatatgatttcgctgtcaacgaaatattttgctaaacatataaaaaaattagcacctgtaaaagtgactgcggatgtgcaatttcgctgtgcttatatagactttttgagagtagtgtagagtgtagtgtagtgagtctctacactatagaacacacctacactctacactatagaacactctacactctacactatagaacactctacactatagcacttgtaaaagtgacagcggatgtgcaatttcgctgcgcttatatagacttttggagagtagtgtagagtgtagtgtagtgagtctctacactatagaacacacctacactctacactatagaacactctacactatagcacctgtaaaagtgactgcggatgtgcaatttcgctgcgcttatatagacttttggagagtagtgtagagtgtagtgtagtgagtctctacactatagaacacacctacactctacactatagaaacactctacactata

SEQ ID NO: 17017 - DNA, 1641 bp, Heterodera glycines
agcaggaatgggcgctgcttcgggtgccaattttgcatatttactttgaaaatttgtccttggcaaaaggccgatttgactgaggccagcggtgaggtgctaactgcgcaagagcatgccaaacatggcgtggttgaggcggcgcgtttggcggaggaattgcgcgttgagcaggaacggaccaatgtggcagaacgccaacgaaaactgttggaaatgcaagtgaaggtgatgacggacgtaacacatgcatttattggatttataatattggggaggaattgccgggaaatggacgcaaaaaagggcaatttggcgcaatgggcaggggaaaatgcaacaaattgagaactcaaaagttaaatggaaaaattaatctaaaaataatattttaaggaaatgcaaatcaaaattgaagaggcggaagtgactgcgcttaaaacagggccaaagatggccgccaaattggagggacagctgaaagcggtggaaaacgaattggagggcgagcagcgaaggcaggcggacgcctccaaaagtttggccaaagcggagagacgcgcgcgggagctccaatttcaggcgggaaacagaagagtgaaattaaattgagcaattagaaacggatgatgattgatttaaggcaattatgaaaaactgtcaaggattttccttgagaaaattgaaattccgcagtttcccaaaaaataaaaattgtcccttttaggcagaagaggagcgcaaaaactacgaaaagttgtgtgacttggctgaaaagctgcaggtgaaaattcgagcgcagaagaaactgttggacgatacggtacgtaccgtaatcgaaaagggtttttcgaagtgaatgttttattcaggaagaacacgcgaatatttccctgcaaaaatatcgacaatttcaaatctctgtggacaacgcggaggagcgtgcaaataccgcggagtcatcattggcacgcatgcgttcccggtcgagactggccgtgcccagcggcagcggaccgttggccaagtcggagacatttgctctgtgatcaaaggggccgagtgtggtcgaacttgatctaatcaatcgataccatcgagcttaatctaatcaatcaataccaatcattatcgatcgattactaatcattaggactgattttgattcaaaattaattaatttttgctagtaaaatttttttaaatgcaaatgtattagtttaaaattaatacaaagattaaaacccattttgaaaaaataattcccccctgctaattttattaaattgctttaattaaaagttggtcgtcttctctgtgcaatgctttgagatattgtcagattaaatatttaaaatcagtaaattcactaatttgtaagtgatttttttctttagacttttcttttgttactaaaccacttttttaattcgcaattaattctctttcttaattggtcaattaaaacaaatttcagtcgtaatgagttttaaaaaaaattatgaatgcccctcaaatggaaaagcaatgattggcagtcaccgccgagagtggcgacgattaaggaagatatcaatcggtcagacatttttcaaaatgccgaatggcacagcaatagcggggggcggggggggggggggg

SEQ ID NO: 17018 - DNA, 1952 bp, Heterodera glycines
gtgtctcatcctttgccttcacatcatagcatgtatttctcaaatggagagagtgctaaaatcagccttaatgaccaattgagcagcatctgtctgttcaatttctgattgtagaattgaggcaagtttcatgggacgcagctgctctaaccgtgcaaattcatctactatttcgttcataaatttctcatcagttggcgaacaggcagtatatcggtattctcgtctcactgtcctgacagtcgcgcaagttgatacgtaagtagagtttgctcagtggttcgttagcgtaatcatcccatgactcacagtacatattgccgttgagcatttctttctggcgagtcctctcggtcctccttcgacactctttgtttttcctcccttccccccccctctccccaccaaaaagtaaaactatttctgtgcgttgtgcacaatggcagggccaaacggccgcgccgccatcgccgactgtgcgctatgtacgtaaagttacgtgatgatttgattcgattcgtttggtggaacggggtgtgaacgatgacaacggccgattggggagaccgaagagaaaagggaaaaatggggaaaatgggggggggggggagaatgagcagaaagaaggcacataaattgttggaatgaatgctacaaaaaggaaaaaggggaacaacgatggccaagtccaaaaagggcaaaggaaaagcgacgggaaaagcgacggacgatttgttgggggagaggggggggagggcttcttttgcttctttctgcggaaaggacggcactcgcgggggaaatcaatctaatcctcaatgataaatttataaaaaccaaattgagaatgaatctgttgccttatttatcacttctcactcttctcattctttgttgcttgttttgccattcattatgcttttcgagtttctttctgtcaatgttatgccattgccctccaacgaaaaaataaataaaactgtagaacagagaagggcactcaatccgacaatgaacgaacgaacgaatgaatgaatgaatgccctgaggcaatgtcgccggggatggccagcggcgtttgtttttttgggttttggcaaatgccctcctcggcattcgcagttatccgtcgttcacatgcctcgggcgatttttggaaaatgccatttgcacgaccccctctattcatgcattattattaccttcttatctgattcgctttaacgctgagatgaccttcactaatttcccatttttgaacccattattttatgcccaacggcactaaaatatagacaaaaattaaatggcaaattctaagaattattaatgtgttctaatttcaaaattgttaagaaaaaataatgagacccactaatttaaaatacgtttataaattcaattttggaattcgtccatgaatcttctgccaatgggcggacaccaaaaaggaattgggcgactgagggggcgggggggcggatacgaaaccggcaaaatggagcatagggggagggcaatggtacaattaggaagtttgaaaattcatgaattatttatgtaaattatttttgggtgaaattacaaaaatcgccttcccccccccccctctccttttccccctttttcctcctcacagtgtaagttcatttcattcatttccttctgctgctgatgaaaattccattcaatttttgctttttcattgtgccaatttgtctttctctcttatcaaatttcatttctctctgtctcgttgtgtctgctgctctccccaaattgcccactctctcccgccaatcgttggtccgtccattccgtgtcggcccactgactgtggcggcgaatgtgtgagaatgagctgactgacggggggggggggggggggtcgggcaccccgcgagagactgttagagccatcgcccgccgtcccattcatctgtcctcttctg

SEQ ID NO: 17019 - DNA, 1468 bp, Heterodera glycines
aagaacgaactgagggaggacggggaggctatttatgcaatagactgagtggtcaaagaagggatggggcataacaactaaatgggacggaatgccaacataataaataaatcaaataatcaggcccatcccgaacactttatatatgatctcagataggcattcagatttgagcgcgtcaaagactaccaaattcaaaaaatgacaacaacattggaaactaaattttgaatgcattggttttagtttaggagagccaacctgtctttatccatttgtctaatggccgactgcatgtttcttgcatcgtcccgtacatagcaggccattttatttagtgaaagaccatttttttccaaacactcagcaatgttctcagcaataatttctccggtatggaaaaattcatccattggaaatgcaccaagaactgcatcacagcggcagaattttctgtcaacccaatgaatggtgacactaaaatgtacagtatttgaggtaataaaaataataaatgcctttgtaactgaggtgattgggttggttttgaccagccgtcactagtatttgcaaaaaaatccgcgccgacaccagattgaatttgttgccggatttgatcagccattctgggaattactttacgccgaaaatgctcactgcctgcgaattcctaagaagataattaaagataaattagataagttttaaatacaagactgggataggccttcttgcacaattcctttaagtccgcgtcatcgaaaacataaaaagaattgttttggcgaatcattattcgtgtaatacattcttcggcctcttccaatgcgtttttttgatcaccataaaattgtcaatttgcttttgattctaaaataaataacaaacaataatatttttaattatttacaccttttccccgtccttttggctcagattttccttgtttttgagttgagaaaattcatgtttatgcttaaactccaaatgcttccacattccttttgtcgacccatcggttcgtgccgttctttttccacatagcttacaaattgctccatcggtcaaatttttgttgaaaaacttccaaatctcagacattttctgttattgataaactaaataagaaaaatttgtcgttttcctaaataatagtaaaagacaaaattagcacaaaaaataagctaggtaaagcttaaatgcgaaatttaaaagtaaaaaatgtatgaaacataaagaaaacttggcgaaatgttcatcagttcaaatatttaaatcttttttccctttgactccaattttcttcactaatttttcactcagaccccattcttaccagtgcttgtttttcccggttcccggttgccctaccgggaccgggacctgagcttttcaaaacccgggaccgggaaccgggacctcggatgaccgggaattcccggcccggtcccggtcccgtggcactcta

SEQ ID NO: 17020 - DNA, 3397 bp, Heterodera glycines
  misc_feature (2865)..(2865): n is a, c, g, or t
cgctcatcaacagttcgttagatgccaattgttctagcggagagccgtacaaatcggccacgagttcaagctgtcaaaggggatgttatgagttggtcgacagttaattggaaaaacacacgcatttctgttcaatttcattgatcgtcacctttatggctattttatgttcccaatttgtctttgccgtgctatcgtcggtgatcatccgactgcccgactgattggcgccataaatcgccactccgctgatcagaacgtcccgatcggcggtaaagcaaattttgttctcacggcgcgtgcatcgcttggaggagagggcggaaaagcgctgaaattggagaaacaatttgagatttattcatatttaattttaatgataaagcgaatttattggcaaatgtcttttcacctgcacaatatgttttgagcgcgaattggcacggaaaccgcgtgccgaaaaacgacattggggacgaggacggacctaaagggaaattcgaatgaaaaatgcctttttgaaaaagcatttggcaaataccgtaagatggagaaaaacttcggcaatctcttcgcatgtaagcagagaagaacttgcagcaagaccaaattcgttgacatccatcaaagagaaactgaacaaaaaataggaagagaatgcaaatccaatttaaaatttaaataaaaaataaaataaataaaaatcaccgaattaattgcatcgttgggcccaagcatttgcgcaatgctttcccatgttcctctcggtgccgcgtcgcgcacattcggcctctgccccatgcctaaatgtttaattacgcaatttttaaaattgaatttcgttgcctttgccgcgttgaaaatgatcagttccgaagatgggtcgagctgagaacgtccgagaacgttgatcagtgtgacgcggtcaaatgtccgccacgttggccgcgtccagggccaagtcggtgttctgatcaatcacttggtagcactgaaaagccaaatttggcttaatgtttgcaatgaaatgttaggcttacatgaattttttcagattttttcttaccctatagaaaaaaatacatgtcttcaaagttttgagtttataattttggaacggagcataattaaaattaatgaagcaattaacgaaaaagcgaaaattgaaaagaataatattaaaatatatgcatattttgtcatcattttgtccattttttcacttttgccactttgccctgcaacttcccgattttcacctgttccaccgaaagtgccctcgtcgaaaaggcgcgcctgtgccaacggtgagacggcgtttgtcgcggtcagtcgcgcggtgcaatagcgcacgcattccgtgacgagcgcatcgatggcgtattttttggctgcgtaaagcgtgttcatcacattgtcatcagtcaattggccacggacggacagcgaacgcacgtcgaagtcactgtacacaaagtcaatctgagaaaggcgaaaatgggggggggattatttaaaatgacaaaattattaatttaaaattaattaaaatgccttccattaccaaaatggcaaatgccttcggctcgcagtcgggtgcacagatcacttgcagcccctgcttggccaactcggccgccagctgctgactgtcgccgatcgcctgcaccgttttgtgtcccaatttggcatggccatggaaaccgttggaaaagtgccgtttcccatcaaaaggaaactgaggctgacgctgctgctggtgatgcgagtgaacggcggcggggggaggtggaggatggtgaggcgtagtgaacacttttgggggctctaaaaggcgcggaattggcaaaataataccgcatttaaaaacatatttaaatgtattaaatttaaattaatttggaaattaaatgcaaaatgtttttcacgacgataagcaatttctcattaaatatgttcaaaattggcttcaaatcttccggaattggtcctcgttcgcctatatctgagcggccattttccgtttttttcgatcataccgcgcagcagatggtcgccctccagcgacgaggccaacgaattggagcaggacccgtccccgctgatgttctcggcctcctcctccctctcctcgccctcttcgtactcgtcctcctcatattcctcctcgtaatattcttccccctcatccgtcggctgtcaaataaaattataaattatttaaaatattatgcttttttatttccttttttctaattttcttacctgtgctgccttttggtgtcccgctgctgttgttgtggtcgattcatgcacaatttgtggcacttcgtacgcaatttgcgggatggcagtgccaacgaaggaagagcccaaaggaccgtaaaacatggcgaagaaaacggcagaactggcacccaacaccaatttgtgcgcttttaattgctgaacaattgatagtttccattctcgtattttccaatattttcaagaaataaaataaataattaattttgtgtttttacctctttttcctctccaaccacaaacgcaacgtcacaaccgacgtctttcagacggaaggcattcagtcgactcgtcagtgacacttcggcatgagaattcccttcagtggaaattccttcggcgtcatcggcggatttaaaaaaggctgaaatttaaattatgaattttatcatttgtttaccagcaaatccatttaattcattgacaaaaacacaaaaaagaatacggtgttgatcagtcaatggcgatctgttgttggtccgacgtggcgaagtgggctcgtccaacgaaaactgttgaaaactgttaaatgtcgacggggccgaagaagaaaattgngcaccggtggttgacacattggcaccgatatgtgaagccgaggaggaggaaccttcattaattagccaatacattaattgggtttcgttttcaattttcaaatatttattgcccacccccatttgaggaggtgccgttctcttttggagcagcacgaagatccatgccaaagaataaaagctaaaataaaaataaaactgaaaactcatcctttttaatatttcacaaattcttaaattgatttttggggacaaaaaatgaacaagcgaagaggggaagggagcaaaagtgagtgggtgtgatgagaagccgaacttaagccgttaaccgatgacaaaaggcaaaagggggggggggacaatctcgagtgaattttgtgatggggtcacacaaaaagcaggttaaattttgtcaacagatttatttgataaataaaaaacaatttaaatagttaatccaaaaagaaaaaatttataataaaaaattaatcttaaaatcgcatcacttttattttaattttgggcattaaaga

SEQ ID NO: 17021 - DNA, 2128 bp, Heterodera glycines
ctttctctgttgccattttcactgtttcattttgtatcaattgcacttttcgatggctttctattattactcactttatatgtctatcatgtctcgtcatttactttttttttaaattaaaaaaaaacaaataaaagataaaaaaattagagtccggttatagaccaacaattccaacttatgaattaggtatatatggacgaaatggatcaaatgctgaaacaccatcaaaaactttcacctaattactataggttcaaattttctctaaaatacccgacaaggcgaaaaatcgtttagggttagagggtaactgatgtttcaaaaattcatataaaaggcagaaatgagggaaccgaccagtggtgacgtagtctttggatccgtgaaaaattttggaatttttaatgaaatcgataaaaaaaaggtcaaatttgaccctttccttgatctagccactccctttctcgtttttccttttcatctttctttttttcgaccccctccccgtctcgtgcgttcaaaacctgccgaccccttgcacagatatgttgcttgttaataaaattgagagcatttcaacattttattacggaaaaccaataaaggaaaacaacacatttaaataaacggcacttataaatatcggaatggtcgagaaattggaaattaatggacccgaggcaaagatcaatcacatggcgactttgtcataactgtaaataatacaaatatcaatcaaaataagtctcgaaacatacgaatgaattgagtgaacgcctccctccaattgtgcgctgtgcgttcgccgttccaatttgacggcaccgcaattgactccgttccttaattcagaaattaattagtccattaaaacaaaacaaaaaacacaccagagctcggcgatggatcgaactccgatgtcctgaagtccgtgctgaatgccgcggagaatgtaagggacgaatttgaaaacacttccgcggtcgcgttgggcagcagttacgccttgggccactttgatatttccatcttcgctaaatgaaaaaagcaataaatcatttgctgacagtgaaagagcagagaccaagtgaagtatctgtcctggctgcactcgttggcttccatcgcgtccaatgagcccatgccgcggtatttcttcagtcgaacgcccgacggaccccagaaatactcaccaggcgcctgcaaaaacagccaattagcccaatggaagtaaatgggggatgacctcattagtcccagccaaaagaccgcccatcataacagtggaagcacccaatgccaacgccttggtgatgtaactaacagtcaaatgggacattgtgtaacattaggtcaattgatttaaaatagtcgggcgcacccgacgtcgcgaatgccgccatcggcgatcaccggcacaccgaaggttttggcaaagcgcgcaacattatacacagcggagccctgagcacggccaactgcacaaaccttgaattgggcaattgcataatgagaagaagttaattgaaactcgcccacctcctgagtgatgcaaatgctcccactgcccatgccaacgcgcaatgcgtcggctccgttttcaatgagcaacttcgcctgtcgcatggtcaccacattgccggcaatcacttgtggccattcgggaaattcggatttgatccagcggagcaaatccacttggaatttgctggacccatttgaagaatcctggaaactggaacaatgcgagcagtcgaacctgctgacacttgggcatgcccttggtttgtttgctatttttagtccgttgtacgcgttcatcttcctctccctctttccccctcgccctcccccccaactcacaatgaccaatacgtccacctccgcctttacgagtgctttcaccgcttcccgcgccttttcccgcgtggtaattgccgcgccaaccatcagctgtttctttgcgtcgtatgaactgcgtgggaattcgcgtgcctttttcagatcagttcgcgcgatcagagaagtcaactcgtcacgttcattcacaatcggcaatttccctgtttacaaaaacaaaaaatgctaatttagagaaatggttggaccgaatgccatttttgat

SEQ ID NO: 17022 - DNA, 1723 bp, Heterodera glycines
  misc_feature (59)..(59): n is a, c, g, or t
  misc_feature (102)..(102): n is a, c, g, or t
  misc_feature (104)..(104): n is a, c, g, or t
tgttaatgatggtcagattatgttcaattcaaagaatcgcctgggtcgttttgaagtgngcgtggattatgccaattccgccgtttcaactgaaagtgcctntnggattgcttttgtcatcccccaaaaaaacacttacggccattgcgattgccatttctaaaacaaatttggaagtgcaaaagtgaaaacaaaactaattaatcgaggccaaaccgctttcagtgactgtgtccatcggagaagaaacaagcggcgcactgagacggattttccttgtcaaatgcgtgcccaattcgacgtcagagactgggaagtcgatgtaaccgggcaaaatgtctaaagggatgaaaattcaaaaaaaaaatttttttccttttgttactgaagtcattgtacgtgagcccggtgccttggctgaacaattcgtgaattgtcaggccatcctcatcaaaatccagcccagtgtcagcacaacctttctttagactttttgggaccttttcaaattcgaccgatccgttgggattcgaagtgacatccataacggtgactttaaaataagagaagaggtggttaataaattacaaattaaatatgaattaattgacagaggaggaaggctctttttaatttcacaaaagcatcggacagattttctcttttaagctttagtcttataaggcgtcccataaaacgcccttagcaaccaattagttgtgattattgtctgttaaagaaggtcaccgatcaatggcaccaaaagaaattattactggaaaagagtattctcataaccaatggataggatcaatagattatgaagtataattaaactcaacagacaataattggcttttgttctttgatttgcacaacagtcataatttatcaaaatataaaaaatccttctcacaatcagacacaaagcaatcgatggattaggtgaaaagttcgtagtctcttctgataagaaattctcctcttaaagaaatggctgctgaactgattgtctgtcatctcaaaatcacgcgatcactttgacgatgtaaaacgcattattgccctgcctttttatcgagtattcctatgacggaaaatggtgctgctgctcttgctggtggtgttggatgggctgttcatgttggaagtgatgttgctgaagttgctcaaagttgccatcaaattgaagctgttgctgctggtaattgggcagactcatcggccgttgaagaaggttcatctgctgctgctgttggttttgctgcattagcaactgttgttgctggttgtgctgctgttggtcacccccaacggcctctcctcccccgaccatcatcgtgctgctgaacaacagcccagtgcccatcatactctcgctcatgcccatcatcatcctctgcggttgctgctgctgttggtgatgatgactgtgttgctgttgctgcacgtgcagtgagtggtgttcttcgacagtattctggacttgttgctgttcaatttgctggtaaatattgccaatggaatgactcggcggtggtccaggagtgctcaaagaactggagagagcatattgctattttgttaaaggcagatagaagttttgctcgcctcagttccgtgtccggcgttgccggtgcggtggtgcgtctgcgcttggtgtccgactacgccctccccaacaattggcccgcctctctgcactttctgtccagtggcactc

SEQ ID NO: 17023 - DNA, 1687 bp, Heterodera glycines
  misc_feature (81)..(82): n is a, c, g, or t
gtgcgcagcgactccgcctcgcgctgggcagcatgttgtcgaaatcgcccatctaaaaaaatggaattaaaaaacatgttnntaaattattccatttcgaatggtttgccttagggtcgctccccgagccccacagtcaggagcgaaaagtcggcgatcggggatgaaattccccgcccaaattatgctggagaaattgaaaaaatttcgggaccataacaccttctcttcggggaatctataaaaggtcgtaggtaatggaaaatttttaaacaaaatgtctcataaactcttaaaaattggaaatggaatttaaattttaaattattattttaaattttattccattttattttcaaatgatttgtctcctcacttttgttgcttcttctgctgctgttgatggttgaactgcaactgttctgtccttctcccacttttccttcccttttaaatgttacgcggcggtgacacaaaaaaaattcggccgttggaaattcgccggagggcaaacaaacgcgcgaaaaatgaaaataaaaatttaattaattgcattttcatttttaagctttgacaaagggtacagcagtgctactcaaaaactttttaaaattcttacccaaaaaaagtgaaaaggaaaaaaacaaaaatggcgtaaatagttggccaaatgagccaaaattcgcaactccgctccaacggggccgagccgttttttgggagagttgcgcggagtaaggaaaaaatggaaatgttttaaaatagtggtaaataatatattttataattaatggtaacagcaaacagacatttgcccaaaaatctaaccaaaatggaggcgaaaatggcggtaattaattttaattaatgctaacaaacatttgcccaaaaataaattgctttaaaattaattatttgaatgcatgttaattttaatttgacttgcttttgctcgatgcatgcaaatttatcaatgtcatttcttccgtagtgcgacatttgcggataactatttctcgattgaattgtcaaaaaaagaaaaaaaataaaaataaattcaatactcccaaacttgaaattaatgaaggtaggctgacacttaatctttttttgcatacttttaaaattttcttgatgagagagatttcctagagcaagatatttttagcttataattcaactgtgaaaattggcaaaaagaaatttcgctatatttaatatacataaaagtcagttcaagaattttataccaaggaaaattttttcgtgtttcattcactttcacgctttgggttaaccgagagcttaattttcatccagcctttcaaacaattaaactaacaaacaaaaaataaaaataataattctatgtttttccaaaaattgtccgtaatttgctgttattgtataaaattattgatccaaattgacccaaaattaaaaacgttcaactacagactatttttattaatggaaactaaacttcttattaataaaataggttatttcgatgttgattgcataagttgatcagattactctttaagggtggtgttcaagtcgggaaataacaaataaaactaatttggtcactcaatttttgaaaaaaattattattttttgctttttgacagtttagcccagatttagtgatccgcaaaagtcggtccgcaaatgtcggctaacc

SEQ ID NO: 17024 - DNA, 1056 bp, Heterodera glycines
  misc_feature (57)..(57): n is a, c, g, or t
tttgcaacgtgctgcttctgttgcaaattagaaattcgctaaaaccaagaaaacatntaagggaaattaaaattaattaaacaactaattaatcaatcaacagataattaattgattaattacagtgcggcgaattcgatcattttgctgaattttgaatggccctccaattcatataatgattgtctatctcttaaataataattatgataggcttcttccatgcgagtgtgaaaagaataatgatgaggttcatcggctttgagatcattaaatgctttttcgccaacaacgaaaaattcagcaaaaatgcccattgatcggaaaataaattaaatgttttaatacgcaataaaaatctaaaagaaaatttataatttaattagtcgaattttcggataaatatttgtctttttgaaattcattttcctttattagcataaaatttgtaaaaaaaatttatgtgttcttcttaaaagtttgcaagaatttttttgaaaatgaataatcaattttttaattttgcatttgtacatttttcatgcttttctattctaatattaaaaaaaaatgttaaataatgagagagacataaagcggtgattagagagggcgagagagaaaaacgaatcatttacccctacaaatttttgagttttaacagaaaacaaaaaaaaacttatcgattggttgccgaaattttgtggaaggcgcctgatgaaatgcagaaagaaaaacattgttttatatgcatatgttttacaccactttcactgttttgtttacattttctagaaaaaaaaccaaaggcttttttaatggaaggagcagaggaggaagaatgaagcgaaccaaaatttccaaaaaaaaaaaaaaattttatcagaattgaaagagacaaagcgaactgatggccaatcgttgagaattgactgggcaagtttgcgcaaacgatggaaagaaattgttgctccactatcatttcgtcactgtaaaaatttttaaaaaattattagagtgaaagaaaatgggagagtagggaggacttttatagga

SEQ ID NO: 17025 - DNA, 1815 bp, Heterodera glycines
  misc_feature (1549)..(1549): n is a, c, g, or t
agggcgctggggcccatcatgaagtcaatggcaaaggcgctggggcccatcatgaagtcaaaggccaagggcgctggggcccatcatgaagtcaaaggccaagggcgctggggcccatcatgaagtcaaaggccaagggcgctggggcccatcatgaagtcaatggccaagggcgctggggcccatcgtgaagtcaatggccaagggcgctggggcccatcatgaagtcaaaggccaagggcgctggggcccattgtgaagtcaaaggccatgggcgctggggcccatcgtgaagtcaatggccaagggcgctggggcccatcatgaagtcaaaggccaagggcgctggggcccatcatgaagtcaaaggccaagggcgctggggcccatcgtgaagtcaatggccaagggcgctggggcccatcatgaagtcaatggccaagggcgctggggcccatcgtgaagtcaatggccaagggcgctggggcccatcatgaagtcaaaggccaagggcgctggggcccattgtgaagtcaaaggccatgggcgctggggcccatcgtgaagtcaatggccaagggcgctggggcccatcatgaagtcaaaggccaagggcgctggggcccattgtgaagtcaatggccaagggcgctggggcccatcatgaagtcaatggccaagggcgctggggcccatcatgaagtcaatggccaagggcgctggggcccatcgtgaagtcaatggccaagggcgctggggcccatcatgaagtcaatggccaagggcgctggggcccatcatgaagtcaaaggccaagggcgctggggcccatcatgaagtcaatggccaagggcgctggggcccatcatgaagtcaaaggccaagggcgctggggcccatcatgaagtcaaaggccatgggcgctggggcccatcgtgaagtcaaaggccaagggcgctgggtacccaacagaagtcagaaggcccagcagcaacagcaactccatgggaagtgccaaaaagtctgccgaggatgcagacaacacacaagcgctggtcattccgccgggaatgtcgcagctcagcgagctgcgactgtccgatggtcggacagtttcaacgaaatgagctaaagatgggagagggcacaaaaaagggcaacaaacgagcaaagagcaaaaggaaaaggaggtgcagcgaatgagtccgctgattaatgagcacgtgaaggggcaaaatggagcgatcaaaaccggcaacaacaccctttcgcgcaaatgtggaccgatggaacgcaaaaagaggagcccgatcagccaatgacaactcagcgagtgcatgtgaagaaccggccgcaacagcgatgctctgacaaagaaaaggaagaaaaaacccccatacgatcaccccatttcttattaattaattgtagcccaaccaatttggatcgtatttaagccccgtaaattgtacatttcatgggctccgatcgtacaccgaataaagagaaaaacccagcaattgggtattcggtagcccctccccctctnccttcctctcctacccccaccccgaaccatggacgacgaactgtcccgttgcggcttgtgggccgagccgcaacaagtggcgaccctggcagggacaaactttggtggggtttttggagatttggtagggaagggggagtagggccccacgggttttttgtaacccgtggcgccttgcgcgtccggcccctcgggttttttttaacccgaggcgcctccctttccgcgctttccggccccttggattttttgtaacccaaggcgcc

SEQ ID NO: 17026 - DNA, 3245 bp, Heterodera glycines
  misc_feature (3133)..(3134): n is a, c, g, or t
  misc_feature (3148)..(3148): n is a, c, g, or t
  misc_feature (3170)..(3170): n is a, c, g, or t
  misc_feature (3183)..(3183): n is a, c, g, or t
  misc_feature (3192)..(3192): n is a, c, g, or t
ttgaaataaataaacttttaaacttaaatgtcattacatacatttttttctcctcctttccatatgattttaaaaaatcgataaattccagacagtttatcgtaacgtgagagtcattagtgcgtgtgacacttttattataattaccaccaaaatttaaagcttttttggttgctttttattttgtgcgaaaaattgagacatttaaatgagtcagcgaattgctacttgctaatttgaaaatgtgttcattttaattcaaaaaattttagtcaaattaaattaaatttctttatctggaaagatttttgatttaattttttaaataattaaaaaacattttcaatttttgtccatcactgcacatgcataattcatatcaaaattattattttttttaatgaatctgtctgtagctttttttaattataagcttttcaagaaaaacctaattttgtacaaaataattattgcaattactcaaattatgaaccgtgaaaatgatgaattaaatcaaaagtatatcaagcccatcattaaatttatcgcccattaccatgccattgactttaactagcggaaacggcacagaaaaaaaagtaattaaaaaatataaaacacctgctgtgaagattactttaacgcttatctcgttaatgttaattgtattaatttaaaattcaatttaagctcacggaaattgcagcaattatttggtgtaaaagaaaatcatttaatttttttatcgctttattaaattccgaaaatcgaaaatgaatgggcaacaaattgaaggactcaatgaaaattattcctattatcaggtaaagtttaattggttcttcaattacgttagccaatgctttttcagctgtgggtccaatacaaagactctggccattccccaatgctcatcttcacggcatcgctgctcaatgctatcgtcgtccccggcattttgatgaacattggcatccttttgatcaccttcaaatacaggcaaaagcttactcaaaaaggctctaagccttggcataatgtttccgattacttttccccgcttattgtccctaaattacgcttaatttgatttcgtttaattatctgttccaatgtttgcattttcgcttttctgttcttgagcttggctttccctttcgcagctctcttcgtggcacttcgagctttctgttggcattgactgccctttttgagactgtccaccaatttggccatttatttttcctctgcgtttccctctccggccgcaatttcgtcccctatttcactgcgttcaaattccttgtcgttccgttggtcggctgcagtgcgagtttggcattaatcgcactgaccgggctggacagactcatccaattggcatttgaaaaatggtgccgaattgcaacattaataaattgattaaattaattaagaattggcattaaatataaaatgcaatttcaaaattaaggcatgcaaaagtgaatcgcactgtttacctcggcacttttgtgcttgtttcgctgtttttcggcactttgatgggcctcaaatacgcccaaattgccttttgccaccccaaatggccccagacaggcacaattagcgatattttcctgttcgagtttaagcccatcttcttctctttcatgctgatggccaattttatcgcaattgttttttatgtgttcatttgggtggtggtcaaatggaagaaatgcaagtttttttaaattcgaaatttgctttaattggcaattccaaattttggcatttttaatttcagtcggcagccaattgcccaccaatgccatcaaatcaaagaccaacaccaacgcgcgtttgttcaagtcactggtggtgatcatttcgatcagcatcggctgctatctgatcagtgccgtcgtccgactgttcgttttgccgccctggcacttggaccaagtcaaagtgtggtttgtggagctgtactttggcattctgttgaatgtcggcgttgcgctgaatgcgccggtgcttttcatttgcaggtggcaaaatttttcaatttttaaatatttttcgattttaaattttaacgaataattaccaatttagcaaggattaccgcaaatgctttgtgcgtgaatttgcacttctcagaagcaaattggcaaaattgcacaaaacatttctaaaaggtgcttaaattcaatcgcttcctaacattatttaatttataatgaataaaatttatattttttgattttgaatttgaatttagccgcttttttaatggtggcaaacgaaaggaaattccgttcaaaaaccgttggaagcgcacaagttgaagccggcccacaaatgaaaacgaaaaattgtggtgataagtagggcttgtaattatatgcacataaaatcttaaaatatacgcatgaaatatgcaccaaaaattgcaaaatatgcacataaaaaatgaaaaatatgcatataaatttttccaaatttaaatttcggtcattagaggtccaaatggctgctttaaaatatgcacataaatcgcgaaatttgcagaaatatgcaaaatatgcatatggaagggtgccgcgtcgttgcgcgaaacccgcaaaaatggatatttcgcgaaaaccgcaaaaatttataattaatttatttaattgttattaacagggattcttttttatgtaaatacatatttttttcctggattctccatagcctaattagtaggaaaaaaactttcttttttgtgtttgcgaacaaaagttgggacttttatttacatatttttatacatattttggactttttcgtacatatttcgcaatttttcgtacatatttttcataatttgaggaaaaagcatggatggcggtttttatgcaccaacatctttgaagaaacagaatttgctctttccgatatgattgaaactattggaattttttattaaaaaatttatgacgattgttcaaaattcatagattttttagtacccaagaggtcaaactcgcaaaaaatttactaagaagaaattctttggcgtgccataaagccgcagtccaaatggtaggtcgttaatcctagagaatcactaaaatatgtatttcactcttaacataaataaatnntgatgtaatctttnattataatcctataagtgatgncccacccatttgnaattattanctttatctttaaatgttataataagttatgttaagtattaaatagatttggat

SEQ ID NO: 17027 - DNA, 1221 bp, Heterodera glycines
  misc_feature (1181)..(1181): n is a, c, g, or t
  misc_feature (1191)..(1191): n is a, c, g, or t
attctgagcaaattgagaggccgccgcaagtttcggcgccgcaaatgtcggccaattatcccccccccccctttttgccgatgcccaccctctctcagcatctctttgaacgtgccgttcccatcgatcagtgattttaaagtatcaaagtgccattgcccaaattgttcttgcatctctctgtccccttcgtctatttctttacacttcttttcctctttgcttttttccatctttttttcttttccctctctcttttttccttgctgttcctccccctctttatctcccagtatcagcgtcaatctctccagccattccctcccttttcgttcgcccattttccgcccattggccaatttctccaaaaatattttggtttcgacacaaaataggcgaaattttatttgcaattccaatgtctcgtggccaaactcaaagtcaaatgtttggtcatatgcaatttccgttaaaagtaaaatttctttttggtacgcccctaaaaggcgcttttcacccgccgaagcatgggacaacaggaaaaggttcttgaaagtgatgtccaaccatctcgcgaatacgaaaatgtccgtccttaaaaggccttcccattggagggtttggcacgcgccgaaaagcacgtcagaataatacgaatagagcaagttgtcatcatggaacactgaacaaaagcaacagtcaaagaacgccaattgatcaatcaatagacaatgaatgaatgatatggccaatcaatagacactgatcaggcacattgattgagaattctttacactataagaagatcagagaaggaagcgctcactggtctgttccttctgatcgctaattggtcaatcaatcgaaagtcgactgatcaggcccttatacaagcaatccaatcgttcactgacctgccgggcgaagaagtcgtcccgtgtccagcaactgtctgaacatgtcgtggtccccgtccaaatgcttccacagcttcgccttcgcccctgactcatctctgatgaatttgacaaaccaatcgctcttctccaccgtattttttatcagtacgaaattgaccttcttctgctcgcttcgcatctgtccgattgcttctctaattgccgtcccttcgctttcgtcgcattcctttgaccaccatttggcaatttccgtctcgcttntctttctgancgcattttcccgcaggaaattgcgcaaatg

SEQ ID NO: 17028 - DNA, 2136 bp, Heterodera glycines
tggcgcccaaattgtccgttcggtgttcaacgaatcggggaaagcgaacagttcgcgggcactttcttcattataccaaacgggcgacgaaatttccaatcggcgcaaattgagcaaaaatgggccattggaaaggacggacggagaagtgacggaggaaagcaaatcgaagtaagcggaggacaaagcgaaggcatcggcatctgttggatggagaagggcattgaaaaagggacaaaagtgccaaaaagaaagacgaactcaagtcaaaaaagaggggacaaatgaatgaatttgttatgagaaacaaaaacagctcaaaaaaggaaaaaaatgaattaaaaatcagtctatttacagatagaccaaagaaaagttggacattttgcccatgataaaagtgacgctttttggccattttttggtcatttgtccaattcgccgttttcattgccttttttagcttctgctaagtcctcctcagtctgttgttgttgttcaattggactgttcacttcggcggggcattccaaataatttttggtttcgctcggtttttgtccataattttctttttgttttgaattcaaaatttttatttctccgccagtgcaaataattcctatgcattgttctccagtttgttttttgtccctttaaaatatttttaaaattttaatgaattgattaatttcacatttccgccgcaactccgcgcaccgttttcacgaatttgtcgtaaatttccgtcgttttttcaaattgtttttgtaattgctctgctgatgccattaattattcccctccccctcccttttttggcattttacccgattgctccccaatttgctttatcagtttccatccgtccgattgtgcttcttcccctccgtctttttctgctgattcgttttccttccgtttgcctttttcccttccgttcactgaatttgccaattgaattaattattattaaattattttaaatgcatcattagtaattaattccttttgccttttattccttcacttttgcttctgctactctctgcgtccttttcctttgtttcttcaaatttattcactgtaaatcgcataaattcttcgatcagtttgaaatcgccctcgaataaattctcaatttttttgaacagtttggccgaattaactctttaataaattgcctgtgaatttgggccatttgcccattaaactcactttccttccctaaattttcgcataatttttagaaactgttcataattttgcatctcatttgcgaatttgcttttgaccttttctaagataaaaaagcactaatttttgaatgtgactaaaagtgtgttttttttaccaaggaacagcaaagcgtcattctgaaattttaattggaatttaaatgccaatgccaatgccaatcatcccccccccgcccaatttacaatgtcaatttctcgcttttccttttccgccaattttcgcttctcttttctttttcccatcgtttctttttcgctctcctctttttgccactgttcttcatttttattaaatccttttttttaagtgcgaattgactaattgcaatgttttctcttttttaaaaatttattaccattgaaaatgttccaaaattcgtcctcaaatattcccaaatttccctcggcgaattcgaacattttgcgcagtctctgccggacacgcgcccttcgtttgaactccgtgcggagttttgcgtcttccaccagcgaatccgtcaaaagtgccgcgtaattttccaccaaaattcgctgtctttgggtccctttttctgtgttctttttgccaatgtttttctccaaaacttccaaaaagtcgtgcattggcttcagcgaatttcgctccaatttcttttggctattttcaaaatccggcaattttttcaaatgaatcccaaatattttccacagattgtccattttttcttttaaattttcgtcctttatatgatccacaaaatacgaccaaattttcccatataaaagcgaaagttcaaaccaaagttcgcaaaacaaaaaattttgggagtccaaagaatagccgaaaagaccacttaaaagggaattcagtgaaaagttgctgatcacatctgatcga

SEQ ID NO: 17029 - DNA, 1470 bp, Heterodera glycines
tttatgacacacatactttaatgaattcttgtccaaatagaaatttgtagaaaaacatatatttaaaatgtaataatttctcacatctcattatctttttttctgtgtgatttgttagaaaatcaatacaaattgacgctgtttcgtcgaaccttttgcactgctctcatttgtcagcacaccatttggcttggcattgattgccccatccaaattggtcgttcatctactatttttcttctcatttcaatttaagaaagcttaaaaacatagctcccacatctgaggctttagccccatttgtggttttttgataggtcgatgaggctaaattatcgaaatgaggcttttaggctttttatggttttctgagaaattttgaggtttttgcggaaaatcgccagataaattgaacattcatataacatacgaacatttaaacgtgttttgaaaaaaaatgtaaaaatgaggcttttgaaaattttaatcatggagctctgcttaaaaataaatattggtaacccccccccccctcctctcctcaaataaaaatatcatgatccgaaaaaggaaaggactataaaaaaaaatcaagaaatatttctataattctaaaatccagaaaaaaccctgaccagaggtgttattttacctggaaaaccgggcatttgcccggttttgggggtctgtgcccggtttttgcctgctttttgaatttgcccggtttttggggttttgcccgggttttccaattttcttgatttcctttcattttttctagtttttatttttgctttttatgcaaagtcaattatcaaaacattatttagaaaaaaagttatttttaattttactattcattttgatacataagatacttaataaatatattatacaaaaatatctaaggattcgaacctgtgacttaaaaaagatttgacaaacgcactaccgctacaccaatagcttagtaagaaaataaaaataattatatcttttctaattataaaatgccaaaactttggcacgccatatctcggcattacaatagaaactagaggtgatatacccacccaccaagtttcatttggaaattccacggtcacttgccgcccatcctttgtgagggcctcagagcagcccgacaatagcgagcaaaaaattatatatattatcaaattatgatttattgttgctggttttagaaaattatcgtgtaaacaaacaaaaatgttttttattaaattaagatgtaaaaacataacaataaattcgaagatgcttaaaatattgatcgcttcatcaaaaattaacaagaacttaagaaaatagaatgaaaacaaatttttttttgtaaaaactataaattaatggccatataaaatggaaaatgccaggacgtatgtaatggacagaattgacactttaaaaaatagagtgataaagaacgaagatggcaaaaaaaatata

SEQ ID NO: 17030 - DNA, 1099 bp, Heterodera glycines
gggggggggcctagatacgcccttgcttacgagattacccaataataccgtctaggtcacaagtggcgtttcggagttggatcggcggcatttctttttttcgacctcattcatcaactccaggaattccttctcgagaacttcatccgccgtaatggcgttgattgaacgggaaatctcttgttgttgttcggtaagttccgctttcccatcaagaatgctttcaccgctttgtatttctcgaggctatcggccgttgcaaccacaatgctggcttttgataatttttcctggttaaaataagaaaatatatttatagacaaaattacaagtttttatcccgtctgttttagaaaaattttccagtttccaacctttcgtaattctcgaaattttcatttcccttcttcgcctaaaatctcagaattcaatttttttttaacctaaaatttcaaatctgtcttcattcttcaaaatttttaaaatttccttttcccattgaggggcaaatcgcggcagaggacgaacggagggtcgaatttcgacaatgtttgggggggggggggttggaaaaaaccgggcacccacaattataatcaaaaaatcggtgacttttttggtgggccaaatcatccaaaatcagttcctttggcacccacaactaactttgaaagagtccttttgaatgttctgctgtggatcgatgttcgtctgctgcggattgatcttcgtctgctgcggattgatcttcgtctgctgcggaatgatgttcgattgaatggtcgtctgacaaagagggcccgattgctgttcaatcccaaatgccacagacaactgacagtgttcagaatcatacgaatcgtctatgcaacctccagtaaaagtacggtttgttctacaggtgcgttaattaattggattaataattgtttcccatgggaggttatgtacctcgaactaggaaaaaaggtcgtgaaaaagccatttcggcaaatttctccgaacttttcgacgtcctttttgttgtgccgcagttcatctacttctttttcgagtctcaatatttttgcctgattttcctcattttctacagcacttt

SEQ ID NO: 17031 - DNA, 3458 bp, Heterodera glycines
  misc_feature (10)..(10): n is a, c, g, or t
  misc_feature (68)..(68): n is a, c, g, or t
ctgactgagntttctttctcgagaatgccagtcttggcgataccatttctcgacggtcggtcaactgnatagggagattttctcaagttcaatcacgatgggccatatgccacatgaaaagttttcaatgctacaatgatggcacaatgcaaatttggacagttttctcaatcacatcaatgacggcataatgccaatttgaatttttttttctccaaatcccatcaatgatggcataatgccaatttagacagtttgctcatttttttggcattcccttctctttattggaaatctcgagactgagtttccttttctcgactcggtgacacatcatccccatgctttgttcagcatcaaccatcctcctacaacaagtacgcgctgtactggttgggccaatggcaaaacacgtacacagcactgtcaccgttggccgttctgtttctgactctggagcgctgtttcatcatcaaattggccacaacgccggcaacacgggaaaaagttgagcgacggctgttctgggccggcattggcacattgttagccgctttcatgctcagcacattgtttttcatggacgaactgccgttgaacatcacggagtgtaggattttgaggaatagtttttttttaaatttttgattcaaatttactattttttttgcaatttcctttggtcgattttcgaaatttctcgggctttcggttttggtttagggcaaagctgaacaagtcaatttgttatatagtatgtagtatctgtgattaggtccaaattaaaattggatccaggattcaaggacgccttccctgaaggcacaaaatctgttgttcacccaaaaactcaaggatttccctgaatgcgtaaaacctattcaccctaaaacaaggaattcactagtggcatgaaatccgttcacctaaattcaaggactttggcaaaaaaacctatccacccaaaactcaagcactttccgggatgaaacctggtcaccctaagggaaaaataaaaatttccaaaaaaaacaacaattttttattttgcacaaaaatagggtttaataaaaatgtcaaaatggcgcagtgatcaaatttaaaaaaaatagactaataaatatcggctcagtttcagtaaatgtgatcggttgccagtcagtgtcttgtgtgatccgcaaatggggcaacatgccacaactgggcatcaaaggaactgccggcattttgaacattttctgttgcatttatttcctttacagtttgcacaaattgcagacaagccgtgccatgatgaaaatggtaggccaaataggatcttagcaaagaagtcaacattttttgttaccatggactggtacagtaggccagggatgttgcgagaacaaaattctattaagagaaacgagaaaagcgagacaaaaatgcgagaaaagcgagaccaaaagtcaaataaaacattgactttgtgaagggatgatgagattggagatgggagaattgggtgtgatcagttgggttgacccaaattgccaaaaacctcccctgcgttcattagtgcgcacttatgtatcagaggagtactcaataaaaaaagaatgaaaaatcacataaaactaattaatgaaaatcgtgagaattttgcgtataaataataggaaaatttcaattttctaatttttttttagaaaaaccatctcgtcattgtgacaatatgcttcgcaatatgccttgactttttccccgcatttctcagcatcggcttaactattgtaagccaatttcggtcaaattagaattaaaaaatgaattaaattcaatttaaaagttctatatattattaaaaatgcaaaatggactttcgaaatgaaaaattaaatttttttcgaagaaattgatttttttttaaattagctaattttctttaacaaatttgactctaaattttccagatccaagttttcttattttttttttgccaaaatgtgtctcaatatattcaaaatttggtgaaaatggctaaaatttccgttttttcccaaggagccaaaaatttaaaaaaaaaaacactggcaaaaattttttggccggaagagcaaaaaaaaaaaagtgtccctcccgattttttttggcctgttgcaaaattacttatttagttcggctctggcttgctctcaaacgtggcatccaccagcactgtgttggactcgctgtgctgtgccatttatttttcgctagtgtttgtgccacccagctggctgaaacggggtggtgccaataatgccaatgccattggtggcacaacaaatattcaacagcaacgacaacactcgcaactgcaaccgcaacaacgcactaatcgaattgcttcaactgttagcatgatgagtccaattattgtgccagcattgaatcgccatccgccgattagccggtacagtgacggaatggtacaaattggtacggtatcggcaacagttcgtcatggaacatagggggaggggctacgtggtgaacacagaaaacaacagcaattggcacgtttgatcaaaacatacttttctatgattgatcatttcactgttcagaattttcccaattttggattcatgaattctcgttgaaatgaatggatttaattttatgaattttaaatatttttcaatttttccccaattaatttgtactgtatcttatagaaactgttaaaaataaggtaatttaatacaagaaacattttttttttgtattttaattataatctgtcttattataaaagctcttctgaaaaagctttattttttattgagcaattttttttttgaattttggaaattttttattttaaaaacatcaaaaatatttcaaatttattttcttaaattttatttttctattattatgttataaatttattttgattgatcacttttgttgtttgctgaactgaattcgctttaaaagccatcccctcagggtgatgaaaaacaatgattggaaatgataagcaatgccgatcattaaagcagctaatagtccaatgccggagcccaggaaaacgatggcaacagctgcttccaacacattggcagcgtcgggatgaaaatctaaaattaaaattaattaaaatataaataaatttattaaataatttaaaaaaatatactaatttaatgactataaaaaccattcttttacatttgaatttttttaaataaaattataaataataatatttttcaacattcatttattttattaataagttataaaaatagaaaaaaaaatcaaaattaattaaaaaataatttaaaaaataaaggtggcaataaaaaaagtaaaatattgataattttatatgtgaaaaatattacctccaattccaattgttgccatggaagtaaggcttaatgatttttttaaaaaaacttacattcaaattttacttttttaccaaa

SEQ ID NO: 17032 - DNA, 1787 bp, Heterodera glycines
aggtcatcgttggcattggcacaatatttttttgcctttttttatcgttttgccattcgagcactcatttatttttttgaatgggctcaattttaataattttgctgcaacttacagtcggacgacgacaacatcggcaacagaagcggagggagagacagacaaactcacataaatttggccataaaatatgaacaaaaagccatcaaaaaatatcggcaacaattggaagaaaatgaacgaaatgatgcggctttatgacaaatatttttttatttcttgccaaatgacatgaagcataattaaaaaataaaaaggaaaaggaaaattgaaatagaaacgtgtgaaaaaaaaataataagaaaatatttttaaaggaaataatttttgaaaatacccaagtaaagtttggtcggaattatttagctttcaaaattaaaaattgacaaggtacaaaaatggatattgccaaaactaaaataaattctgccacaatgcttaaacgatgctcagttctaaaaaaagagttgaaatttggaataaaaatttaaaaaaaaattaaattttatattttactttaaaattttaattcaccttaattttttattaaaaatgtaaatataacaaaatattattaaacatttttttcgccttttatcgaaaaattcagcaacaaaaaaataaaaccatttaaggccttttttggactttttcgcgcttaaaaatcctcaccctactaatcagtgatcatttaaattttttattttacgaatttattttaatttttttctgtctttctgtctctatctctgtgtcactcctaaagtggtgcagtctctctcctcctcccccgtttctcgtccacctgtgtgtgcctaaaagggcacatttgaatgttgtttccctggggggggtggggggggggctaaatcgattgtccccggtcgccggaggatgttctgcgcgttgtttggcgaagcgagaggaattgtgcacattttcattttcaatcccattgagctgcgcagtttccgcgtcggtcgcactgtttgggtcgctggagggggcggcggacggctcaaggacaaacggcgtggacggtggcattccctccggcgaaacaacaaaactcccctctcacctccacttctaattccttcctaattcctccgtccacgctccttcttccccttcttttctcctttcctccctttcttcctttttccctttcctctcctttcctttctattcacttcatttagttttcatttctctttttatttcttcttcctcttccttattatcattctttttccttttctcctctccctcctcctttttttctcttcacccctcattttctttttgtctctatgttcttctattttccaaatttcttttttcatttttcattcgtcactttctttttttttctccccccccccctcccttttcccccttttctctctatttttcctttttctcttccctttttctgccatttttctcattttgtatcgccctaatgcgctgctgcgattgatgttgttgacctttctgcgcatcatcatcatcaccatcacacatcgttatctgctcatattttcgtgtaaatccatccaaatctcagacggaaatgtgcgcaataatttatgattgattgcccaaggcaaataaatgcaaatgctaatcccccaatgccgagtcttcgtaattaatttcttgttttccaatctcggctattgatagagccttgacctagttgggttgtgtcacattttgctact

SEQ ID NO: 17033 - DNA, 1274 bp, Heterodera glycines
  misc_feature (41)..(41): n is a, c, g, or t
cacccaatgcatattatttattggctcctcagtttcttccnccataccaatgccattgctttgtgccattttttcccgcgcattgtttcattcataattaattccacccacactgtcacaattcatccttggcggtttcaatatgtgtcaaaaaaatgccaaaaaaagatttcccacgtgtttcccccattttatattatttaagagcaaaacaattctcgagtctcggaaaataacgatatatctatttaaatggtcaaattgccaagtaaattctctcccccgctttttattgcccctctctccctctccctctctctctcccttcgtttcggtaccgtaatgatacagtagtctcgtttttcttcaaattttttaaaagcaaccccaatccctcgttgagttgtccaatcacacggtttgaaaacggtggtattagtccattcacttcgattgtatgcatttcacctccgccgacccctcctcgtcctctgcttacaattcgcagcagcgctttccgccggtcggcggccaattccatggccatcagccccagtcgcagcacttccggcatcaatcgcaacagaatggcgcgggggacagcggggcgggccgaagctgtcctcagctgacactcattctgatcacggtgaagagcagcattagcccgcaaacgttaattggcttaaataatacaccattcaatatactcgagactctcggctttgaaaccaaaatccgccagtttatgtaaattcggcgaaatattaatggataaattcaaaattaaatttaaaatttaacaagttgagttcatcaattttttgtttctcagttgttcatgttgttgactgcaattattctggccgtgattgctgtgatgaacccatcttggcaaactgtggacattcgcgagtttcaggcggaacaccatgtgagaatggaataaaatattattgttttttacaactttcattttcaaaaaagaggtaaaataaattaatttggaattttaaacaaatattttttttcgtaaattaaaacacaaatcaaatattataaatgttttctttcaaagtgtaatgatgcattttttgtttttaaaataaattattattttactgcttcaaaattattttcgagttttttttcattgtctttatattttttagaactgttgctgtgctatgcagtaaaactctgttcattatagctttattgtaacacacagtaacacatacttagtacagtaacaaaaattactcacctcagca

SEQ ID NO: 17034 - DNA, 2211 bp, Heterodera glycines
atcagccacattgatccccaaaatggtccgcagaaatcgatgtgtattcgttgccacggtctttccggtgattcccacggatgcaatggcactttccgctcatccggcgcctcttcttggcaaattttgcatcttttccggatcatttcgatttccttgtcaatgcctggccaccacaccttctgacgtgccagggccttcattcggaccatccctgggtgggtcgcgtgcaaaatttccaacatttttgtgcgaaattttgacggaataattgtccgatttccaaacatgatgcacccttccattaaggcgagctcatttcggatgacatgaaaactttttagtccttcttcgacttttgtggccatcctttttcgataaattctttcacttttcgaagaatttcatcctttttgacttcttttgcgatggcactgactgtgaccggcaggcatgaaatattttcggcctgaacttgctgaacttccagtccaacacagtcgatggttgtctcttccggacacggcaatcgcgacagaccgtctgcattgccaaattcttttgtagagcagtacacaacttcaaaatcgaagttcatcaatgtcagtgaccatcgatgaagtcgttttgccgcaacaatcgggagctctccttttggcccaaaaatcttttttagtggctcgtggtcagtttgaagtacgaactttcgaccgtacaagtactgcttgaatttgtcgactccgaaaatgattgccctcgcttctttttcaatttgcgagtaattgcgctccgaagaatttagcgttcgggaggaatacgcaatcacaccaacttttcctttttcatctttgtgaaaaatgaccgctccaactccatagtcggacgcgtcagcggccagaaaaagtggtttttgcgggtcataatggaccaaaacttcggttgatgtcaaaacctttttgatcccatcgaatgccttttgttggctctttgtccatgtccatttggcgtcatttcgccttaattcattgagtggttctgaaagcgttgccagggatggcacaaattttccataatagttcaccattcccagaaatgactgcaattctttcagatttttcggctccggcattttcaaaattgtctcgattttgccaggtgacgcatgcagaccttttttgtccacaatgtgtcccaaatattcgatttccggtttgaggaattcacatttttcacgcttgactcgaagtccgttctcagacaaccgtttaagaacctggtcgattcttttgacatgttgctgatcagtgctgctgtgatcagaatatcatccagataaactgccacgccatcaatgcccagcagaacttcttccattacttgctgaaaaattgcgggtgccgaagcaactccgaatggcaaccgagcgaagtggaaaagtcctttgtgcgtgcaaattgtgagacaactctttgccttttcatcaagcaaaagttgtaaatatgcgtccttcaaatcgatttttgaaaatttttcgccaccattcaagatgctgaacagctcctcggggcgtggaagagggtattgatgcacatccaaccaaggatttaccgtgactttgcagtcaaagcacagccgcagcttgccatttgcctttggcacaatgaccagcggagtggcccattcactggttgccactggctcgatgattttctccgactgccattggtccaaaaccttttcaacttcattgcgaagagaaaatggcactggtctcggcttgcatcgcttcggttggcatccctccttgaatttcagcgacgccatctttttgcatcgtccgactccgtcctggaaaacctccggatattgggccaaacatgcgtccaattcctttttgttttccacggcacgaattgccggaattccgaaggctcggttcaaatcaatttccagttccatgatcaaattgcggccacacaaatttttgtgcttaccacttatgacatgaatattggactcaatcgttctgccttcgtgcgtcactttcacctttgcctttcccaaaatgccaccgatggcttttccgccataggctaccaatccttgggatggttccaattttgggcttccgatgcatttccaatcaatctcgtcaatcactgtgacatcggcaccgctgtcaagctcaaaatcgacctttcattgtgaatg

SEQ ID NO: 17035 - DNA, 2348 bp, Heterodera glycines
cccccctccccgcgactcaccccttttgtgcccccccaattgtgccatttttccctttgcatttcccctcgcattttgtccccattgtcacaatttccccccattgtatttctcacacatttcttatgtatgggtttaattacccaagtttgagccataaacttgtggaatattttggtgcaaattcttgggcggcaaatttgggcaattggcggcagcgaaaaacggacaaatcggcgcagacccctcccccatctgcgtcaagtggcgaccctgggcacttcaacggaccgtgcgtggacaaaaagcggccgaacagacattgcgcacaggagcatttgggattagtgagtaaattggggggaagaggaaattttgagatttgggcagcgcaaaaaagggaaaaacaggggacggtaggaattgaacccggaaggttgcccttcggattttctgtaatccgtagcgcttcctttggtcccagagctgagtcccgcgaattttttgtaattcgtggcacttcccttgccaatcagcgcagccccacggattttttgtaatccgaggcgcttccctggtcccatagttcggcctcacgaattttttgtaattcgtgtcgcttgccttccccagggtttggccccacggattttttgtaatccgaggcgcttccccggtcccatagttcggccgcacgaattttttgtaattcgtgtcgcttgccttccccagggtttggcccctcggattttttgtaatccgaggcgtctttttccttgctcagttggcccctcgggtttttcgtaacccgaggcgtgttcctttctccagtgaccaacccctcgggttttttgtaacccaaggcgtcccccattgtgagcaggtcgctcctagggttttttgtgacccaaggcgcctcccgcttacacggtcggacccatcgagtttttcgtaactcgtagcgtccttcctcatacattgtaagactcttggtgggtctgaagtcaaactcactttgtccactgtttgttcaacttactgctattttgtgaccccgaaccccacacaatttgttcggaagtcgggtagcagaacccaaaagtgagcaaaaatgtcgggatttttgcgtacaaaaatcgcaatagagctaaaggctcttgagaaggcgaaaacggcaacagaattgtatgctgagccggaccaaactctgacctcattggaaaatgcaattctcctggaaagcgcggcagagagaataaagtcagaggtggaggcagtgaatgccaaaattgagcaaatttggataaccgcaagcaaatggcatgacgtcatacaaaaaatggacaaggacgaaagaaaaagtgagcagacagcgtatgaacaatttcaaacaacggagaaactgaacacaaaaatggaagcagccaacacaaagctaacagagcttaaggacctggagatgaaggtggaagcaggagcaaagctgcaacgctccaaagcggacagagacgcgcgagtggagcaaagagaacatgcaaaagcaatggcgaagtcaaatgcagaagcagacaaagggaataaccgtgcgagaggcaatgaaatgactgccgcattgtaccaattgccaacactaagaattaagccgtttgggggagacaaacgggaatggcccatgtttgaagaagcatttaaagtggctgtggaccaaaagccaggaagcaaaacggagaagctaaatttgctgaaatcgctggttgagcgagaggccgcattgctcatcggaggcctacgcctggaagagaaaaattacgaaattgccatgaagctgttaaaggacacctatggagacaaaggcgaatatgtaaggaggttgcacacggagttgtcgaacctcaagcgatgcttttcggtggaagacacaaagcatttttgcatggaattggaacgcctagcaagagaattggaagcagcggaagaagacattgaagggccgccaatttatttaatgcttgagaagaagctatacaagcctttcctgcgtgaaattctggaagagaaagcaaaaaatccagacttttgggacacgtcatccctccgaaaggccttaggaagtgcattgagcaaagagctagcaatcaaagaagtcatgagggagtatggcttcgaaggcaaagaggcaaatccagagcatggattcaaacggcaattaaggcggaacagattcggaggctcagtcaatgtagccacaacacatttcgggaaacccaatggagagcgaagaaaaatcccggaacaaaaaatgccaagtccgaggcaaggccaacgaagtttcagcagactccacaaaa

SEQ ID NO: 17036 - DNA, 3027 bp, Heterodera glycines
ttgtgatactgtagttggtttagacgcggacaatggagtcggaggctctaacactgggtgagttggtccactgctgatttttggttcttcctgctttgtagtcacatttattgatttatttgaaattggcagtggaggaataaatttttgcttaacactctgaccaggtacattcgacactggtaatggagacgaatgttttgaaactaaaggtattgacactatggcactctttacttcgtccttacttttagttgcgttaaatggtgaacttgaaactgacggtgtaggaacaagattttgtgaatctctctgattaggtaaatttttattcgcgtttgtaggttgtgaaatattctgtgttgtatttgtttcttcggtttttggctttactacttcgggttgtttttcaatttttggttgcttttctgccggtggctttgtctcatttgttaaagactgttcgatttcttcagtactttgctgtgatttttgtccagctcgtggtggagatgttggtactttaaggttaaacgtgacattagaagcggaacttggaggtgacgttggcactctcgcacttggaggcgactgtggctgagatgctgccctctttcttcgtgaaccatccttaatgagggcttcaagagaatcggcatgattctttagggctgctttaagataatccctcaaatgttcaattgttgtgtttgaagcttttgggactggaattctgacaactcttaaattctcattgtccaatccatccgtaaaatgaatgttaatccattgttcatctagtgtcccaatagtggatggccacgaataagcataatttatgctgtgtagtccgcaaacccaagagccattgaaataaattggtttcgggaggcggactcgaaatttatttggggcattatcagcatagtctgggctattacttggtaaatggacaaagaatgtgttagacattttattcaaaatataatgattcggtgctatttttacaagtatttatacaagttgtgtctcatgaatccattctctttcgggataaccgataaatttaactaatacttccatcgttccatcagcccgcttccgctttcgaaaaactcgctcaattctgtatgccgtctcagcttccttacgtacgggagtcaattcttcagggtaaaagaatcctttaaacttttctccttttgcatcacgtaacttataacgcattggtttcgtatgccgtttgacggcatcaatttcaagaatttcatcgccgtagtttggtatgtatcctttctcaaattgacctttggctatgctcattctcaccgtctggtcgggcataaattttggtctttttctgtgcttaccaaaaagtgctctgtgctggtctgcaccaaacattctttcccacactttttgagaatttttaaagttcacatcgattggtcgcatgccatgtacacgaatcggtgaattgttgattccactaacaattttgtcgattacattcacccagttgagagttttgagttgagcaaaataacgatagacacgatttttaatttgtcgaatagcacgctcggccaatgctgcctttttctcagagtgtgtgctctcatatttctcgacttcctcttcatcaaatagctttttcaactgctgatttttaaactcggtgcccttgtctaagaaaattcggtggggtttcatcggcattttggaaaaaacactcttaaagccctcaaccatgtcatcggccttctttgtgcgaagtggtgtaacaaatatttgcttagaaagcacatcaattacaaccattatgtatcgattgccgctgttgtgtcgagaaagcgattgaaaatccgccaaatccacctgacagtctgtcataaagccagcagctgttgttcgtgaacgagggaagttaatacgtcttggacgcattaaagtgtatgtgcgatgcccctccaaatagtgttttacatcctttttagaaactttatggccaagttcctttttggcttccaaccataatcggtctacgccagcgaatgcggcaggcgattttgggtcattgtagagtcgttccaacacattttctattgatttttccatttctgtggtctcaggcgttgagttttcggaggtatttgtattgttgattctggtggggccgttgttttccgcttgactcctctcgttggaaacggaagcatcagtccttcctgtgctctgcctctcggctgtccagttcctctgattttttgtgatttccggtttaattcctctctctgcgtctgtctctgccccccagtcacaacaaaaaggaacttcaagtttttagctctgaacttgagcgcccagtcacaaggaataataatttttgcgccttctggtttggttaccttcgtcggctcgacttttcagtgcctacgacttacgcacctacttcctcctttttattttggccccttgaatgatgggatatgccgtggcggccgtgatttggaataattattccaccgccaggaggagtcgaacttgaagttcctttttgttgggtcggataggagaagcttggaccaacataatatcttttgtgtttgtctaaatctccaaaccgatacgaataacaatggaaaagaccgaaatttttgaaccctggactgaatatattgtcctggctcggggaaacgaagttttcccgagtgaacaaaatttcttggtaaaaggagtgcaacaccaataccctggaattatagtgggtcgaactttggttgctccgggagaaagcaaaaacgtaattttacagctaatgaatgcggggaaagcaccagttaaaatttatgggaattcacatttggctgacttagaaacaattaaaataaatgcgttaccaggtgatgaaatctctcctaaagattatattcccgccagaggcgagatggagtaccaaacttcctactctcccaaaaccgggatcgaatcgcccctcccgcctaaaagactatggattgaggggac

SEQ ID NO: 17037 - DNA, 905 bp, Heterodera glycines
gcacaacccctgaaataagcttaaatcccgcaaaatttcataagcccaaaaatcctgtactttccaaaaatgtcgtatttagatcccgcaaaattcggcacgggattaaaaaaactaactcatatttggcttacagagccgccctaaaataaagtattaagtattaattagcccttttttgttgaaatttttgccttttgcccaaaaaaaaacttgatattaaaaaccacctgatgttgtactgctgatgtctttcttcgcttgatttttcgttgccattcaatgccaccattgtttagtgatccttctttttgttccacgctatttttggttcttggccaaatgttggcttcatctcgggtgccattttcgcgcatttgttccatataaaaagtgccatacgcggcggaattcagccggatatcagccattggcaatggtgttggcgttgtgaatgaaacggcactttcctgagattttaaattaatttaaaattacaattttatagtgtttaattttttgttattttatcaaagaaaaatctaaaatttacataaccattttttaaataaattattgaatttcttttcacataacttttgactccgaacataaacaaacaaattttttccatcgaattttcgaattattccaaaatttaataaatgatgcgcaaactttttaattaattaaaaaataagtttttttaaattttcttttactaatggcgtttgtggaatgctcattgaagtggccatgccttgttcacgctcttcaagcaaataacaacgatttcgttgtcttgaaaaataaaaattaattatttaaattaaattaatcttattttttaatttatttatttgcccaccttgagctgagccgatgaattctcgagcatcgatgca

SEQ ID NO: 17038 - DNA, 996 bp, Heterodera glycines
ccccccccccccccccgaaacccaaaaagtaaaaattttttttgaaattttaagcaattttcttaacaaaattgcattaaaatactcaaaaaattttccctgcggcgcctatcggcaacgccggaccctcattttaccatatttttgaaaaatgtagaccaaaatggcaaaaaatattaattttttgtcgaaaaacggcgaaaaattttgtaaaatacaccccataataagggattttaaaaaaccaaaaatacacccctaaaaaaaagatcggattgaagtgatcagtttttattgccgctgttcattattacctatgctatttcctttttttttgatctgttccgatccgcatatctttatttttctattaattttgtctaatgcaaaaatatgagcacgaaagcccaacttatgtaccaaaaaatcatagaattggataatttgggaagcctagatttattaattttcaaatttttaatttaaaaataaaattttgttcattttatatacctaacacggggaagtgatttcaaaatgtttccatattgaaaagtgatgctcattagtgacgagacagcaagtgtaattcgggccggaaggcttcggtggtcgagaaaaaatgggatccaactcatcgccacggcctgtaataaaaatgatttaaaaattatgatacttttaaatttaaatattttattttaaatttacggtttggacggggaaatacgatttgaaatatgtagactccatattgtcgattcaagaaaaaattgacggttaactaaaaaaaaatttcaaatataattttattatttaattaaaatttgttttataaagtttttttaatttcgaacggattttgttatgcttttttaattgtaaaatttttaaatttttttctaaaaatttaaaaaattctttttgaatattttgtttcgctttgatgatcgatttattattttttgatcagaaaatccattgaccctgccaggc

SEQ ID NO: 17039 - DNA, 1503 bp, Heterodera glycines
tatcagggatggcacggaattccgatttccgacttccgatttccgacagggatggcacggaattccgatttccgacatttttggggtcggaattccgacttccgatttctgaaatttttgataaaaagtcggaaattttcggaaattttttttgaattttttttcaaaaaattaacaattttttacaaattttgttaataaattgcactgaaattttcaaaaatttcccggcggcgcctatcggcaccgccggaaccctaaaatctaatttttcttgagaaatttttgcctcaaatcgctaaatttggtcattttttggacaaaatttgttaagaatttgcattaaaattataaaaattttccgcggcggcgcctatcggcaccgccggacctcacccgccatgttttaaaaaattttgaaaaaatgcgccgcaaaaaaaggtaaaatttttgatgaaaatcattgaataattttttaaagcaaatatgcttttaaatagatcaaaaatttttgagtcactttttacttggttaagaatttaaaatttagcctattaaaatatttagaaaatttttattatgttttgttttttgaaaaatttccgatttccgacgtttttggggtcggaattccgatttccgacgtttttggggtcggaattccgatttctgacttccgaaaaatttttgggcctcggaattccgatttccgaaaaattttggacccccggaattccgatttccgaaaatttttggggcctcggaatgccatccctgatacatatggattaggtatgaggacgcgcttgttcattctattcctgatgtcaatttttcatattaattttaccagtttttgtctaaaaatatatcggaacacttatttatcgttttggaaattttttaaatttaattgaaattttttcaaaatttccaaaaatccgcaatcctgcgcaggatccggcaaattttaaatgcaggattgcaggattaatccggccggatccggtcctgcaaaaaattttgaattccaatcctgcaacaggatccgcaaatttgaaatttccgggctctattaaatcggaacaggacgattcggtgccgccgttttggtgccgccgtttcggtgccgccgtttcggtgcccgccgtttcggtgccagccgtttcggtgccagccgtttcggtgccgccgtttcggtgccagggtgggtttcactgccaatatgtttaactactgcctacttttctctttttctcattattagggttataaattatatggactaaaaaacgccaaatatggacataaaatatggactaaaaaagcccgaaatatggactaaaaacctcaaaaatggccaaatatggaccaaaatatggatttaaaaatgccaaaatatgtgttgtaaaccctcaaaaatacgaaaaaacgtatgtatatttaatatttgttaaaacagacttaaaaatacactaaaaacagccaaaaatgggtttaaca

SEQ ID NO: 17040 - DNA, 2280 bp, Heterodera glycines
tctagagtccaccaaaaaaaaaataaaataaatggataaactcaataaatttgcgctattattatttaatcagtaaattcgaactaattttgaaatagcaaaaaagggtaacatacgtacccataaatgttgcgaaagcagcgccaaatccctccttggcaatttcccaaaagccgccaaactcctcatcatcttgctgaaatagcgcaaattgaaacaacatgaatagagcccggatgaaattgacgggcccgggcatacaattagacaatttggcccggtaaaagtgtcgagtggcgtcaaagtccgtcgtccggactctaatgaattacattacaaaattgagaacccgttccgggaaaacagatttgtttaaatctcaaaaattgtaatcgggcccatttggttgccctgacacttgctatatgatcactgaatttttgaggaattatgccaccattttactttttccatgaattcaagggcaccaatttacaattaaaattggccaaaataaacggaatgttggcgacgtgcctcttggaaccaggtcaaataggaatggccgacagcggaggtgatgagaatgtagaggagcagcgcaatggcacctttcatcggcacgaggccccaacaaatgccaatgcacagggccagcagttggcgtccccagtagagcacgtccagcaactcgtccttgtccgtccaggggctgcgacggcgcaatgcctttgaaacctatggaaaaaagatttttttaaattttttccaacgataattcggaattaatgaacaattaactgaaaattcaagcaatttgctttatatttttctcgtttcctaaatgaattttttcggtttttcaatcctatttttggcaaaaaggcgaagaaagattacagtgaagggggaaaaatttttggttatgatcaacaaatcccttatttttgaaaaaaataaaaggtaaaaaaagtatttttgctgttggggcccccagaaaattccaaagggtggactcttttgaaaggaattgttaaagatgtcagattagtagttagcgatccaaaaactccccatgagtaagttttcacgacgtatgtaaaaaaaagttggaaaacaaaggatccaccttttggaattttttggggcctcccaacagcaaaaatgccgaaattcttcagaggaagacaaattgaaaactatacattagagaaaagtttaaatcgcgaaattcttacagtttccgaaagactctgtggttttccatggccttctacttgtccattcctttttggggtgctcatctaatatttaatggatttgtgctgtaattaggggagaaaaaatatacaattaaaatacaaaaacaaagaactttgggtttttaaatatagatgaaattttaggatttctatattaggtaagaagtgaaaacatttgagaattttgtttcgaatttcaaaccaaacaaaaatgtgaatcatcgaaaatttaaatttataaacattacgccaaaaagaaattttttgaattttttcagaaacaacgttttctccgtttctaaagtcgcctgctagttcgagaaaatcgaaaagtttaaaagtatataattatttttttattttttaatcggctccattaactaaactgaattttttaactaaaactatattttttagctggattttttttcgttgtttaaccgtttggtgcttccgcaaacaaaatgtacattttccgcgttctccaaaccgtcccctatagcaatcggccgccggtgctcgacataatcgccaacattcacagctatttcacatgcaatttggtcagttcagttacttggcctattttttggcgcttttaaactaacattttaatttcccggggcgggatgtaattttaataatccaaaataattttttggcgccaaccgctctcttcctgcatttcgggttttcattgttttctgtccgttttcaagctgatcggtctggcagtgctgctcagctacaagcagtttggcggtagtcccatcgaatgtatgacgccggccggcttttcaagggcatggaacgatgtaagaacactgggattgttgttgtgcaagtacttttccggaattctacttcataccgtcttgaaaatcctattttttcacaattctaggctctccaatattgtaaaagaattcattacggttcttttcgattaattgaaaaatatgtaaaaaaaaactttagtgttttttgagaagtggagggggctcaatttacatacaaa

SEQ ID NO: 17041 - DNA, 1003 bp, Heterodera glycines
ttctttaagagaaataggaatgcattgagcaatctcaaatcaaaatacaaaaataattattgaactcattaattaattggccaaaaaataaaaaattgattctttttaatttaaaataaaattatgtttgaaatattattgttgacggtattaaaaaagagaattgtcaagaaaaaaaaaattaaaatggactgaaataaggccattttggaaaattgattattaacaaatatttatttttttaccacaaaatatttttaaattgcattaatttattatatattaatatttaagaataagcatttaatttcttgtaaagatgaaagtttttcgttctaaataataaagcatttttaaattgttatatattttgtatcttcaatatgccttgctttaatttctgtatttaatttacatttttcttttgaactgtaaatcataaataaagtacatttttttctaatgttaaatctccatccgtaaaatgttagattggacgaagcttattcctgtagtctcctgctgcttggttggtgatttttcgaatttctattccgtccatttggtggaactaaaatttaaaatctgactttttcacttttcttatatttttgcaatttatattttgttagaatttaatttatacttttattttttatcattagtttaaagactattaattagttttattttaattttttaattagcacttacaatttagctgtatctgtttattctaattttttcgcatatccaaaaattatttttttaaataaataaaacgttcctgatgcgctgtgggtgcggtaagaagtacagggtgcccatgtgacgggtactattaagtttattttgttgattttagatttttattatttaattatgactaagtaaggttcgtttcaacgtatggagataatgaataacatatatattacatatttagcaataaataatcgtttctgataattatatctaattttatttaatattctgtgttttt

SEQ ID NO: 17042 - DNA, 1044 bp, Heterodera glycines
ttatcaattttttttttatttaatgttttttgtcaacaaattttttttgctttggtttttgcttcggctttttagcctactaacgatacccgcggcgagaacgcaccaaagctttgggtaccaaaggagccgaggagttctctgatggttaaaggaacaacattgttccgccccaccacacgccacacccccctcatttaatgtggcgattaacttacctgaatttggctccttttaaattatttttttaaataaaaaatggatcagaaataatttaacaaaataagaaaattattaacttgaataatattataatttttatttattattaaattttatttttcaaatcaattctagtttttgttggtgtattcatttttagttcacgttaagaaaaatgacataacttctcaaaaaaaatttttgtgaatgtaaaatttatttttctttattttaaaatctcttgccacacaatgtttttgattttcctttctttttgtcatccaaaagttttatttttaagcctttccatgatttacagcgagaaaatgcaacataagtttgtccatgggcaaatggttcatcggtataatcaatcccaatttttgaaaaagtttgtgattggcttttgtttatcgtaaaagcaaaagcaggtttaataggaaattgatgcctccgcaaaggaaatggaaattttttgtcttcaagtaaagtaatccttggaattaatgtcgtttctccggttttatccccacttttaatcacacaactaattacatggtctcccatttcttttatttgcattcttgtcccattacacaacccttctcgaacatttaaatttctcaacaacattatcattgaattagttttaagctctattttatgatttggaaggcttggacactttaaagaatttaaaatttcatgtgagataggaaaatcactgtttggatcgctttcatcaatacttaaataagtgtgatattcccccggcaatctatttgattatattttcattatattcgtctactattgaattaa

SEQ ID NO: 17043 - DNA, 781 bp, Heterodera glycines
ttgaacctcttctaatcactcttctaatcgctgttgtacctcttctatttactgttgtacctcttctaatcacaaaggggtgagcataggatttttgagtggaaaaatttttctcacaaaaatcttccaaaaatatgtctttaggggttatttgggccgctgatcacgaatacgtgatcagattttacttttgacatcgttagacctcagaatccctgtgtgattggggattctgggacatgttctgaggggggggggcaggttcggatccggacggtgtaacattatttttttgtgcatttttacgttattttcaatgattttaattaatttaaaatattttgttgagttaataaataaaaaattatatttaatttaattttttttttgataaataaattttataagtttaaattaattatttttttatgggagcgcccgtcctgaggccgcgaagcggccgaaaatcccccaaaaaattaaaaaacgggcgcgaagcgcccgtcctgaggccgcgaagcgtcctaatttccctacaaagtttaaaaacgggcgcgaagcgcccgtcctgaggccgcgaagcggtcgaatgtcccttaaaaaattaaaaaacgggcgcgaagcgcacgtcctaaggccgcgaagcggccgaatgttccccacaaaattaaaaaacgggcgcgaagcgcccgtcctgaggccgcgaagcggccgaatatgcctaaaaaaattaaaaaacgggcgcaaagcgcccgtcatgacgccgcgaagcggccgaatg

SEQ ID NO: 17044 - DNA, 2330 bp, Heterodera glycines
  misc_feature (34)..(34): n is a, c, g, or t
aaaaatttcgattttttcccgggaaatagaaaanaatttttggcctcagcgggacatttgagtcccggggcccataactcgtcaggagttggttttagccaaaaatggccttagagctaaattgtagagctttcgaaactctatcgaatggtgtactacatgatgtaaaattttcaaaaattttcgagctaggccccctagaaattttcggaaattttttttcggacgaaaatgggggtgaaaaatatttttctggggtattttgaggtgctgagcacgaatatgatgtttgttttttgtttcatgatttttggaattttttaaaaattctttattttttggcaattttttggccctcgggattttgacataatatttgaaaattcataacaaatcgaagggttgatcaattttacaggaataaagccttaaaaatagcaaaaaatcgggagaattttatgggatttatttggttttataatgttcaaaagaaaaaaagttattccagaatttctggaaattttcgatttttcagaaaaaaattcataactcggttctgaaaagtcatactgtaaaagtaatatacaaaaaaaatccgcaattttttgctctattatataaattttatttggcatttttatcacttttttgagagatgttacaaaaacaaaagtgattttggggttcgggaccaaaggggtgtgaccaggatttttgagtggaaaaatttttctcacaaaaatcttccaaaaatatgtctttaggggttatttgagggtgctgatcacgaatacgtgatcagattttacttttgacatcgttaagccctcagaatccctgtgtgattggggattctgaggcatcattttgaggggggggggcaggttcggatccgcgccgtgtacattatttttctatatatttttgagttgtttttcaatgcttttaattaatttgaagattggttgtaaattttaaatttttttttaataaataatttcattattattttttatctgtaaaaaataatatcatttcaaatttcttaaatattcaatgcattcgatttttattctttaataaaaaacttttccttatttatataattttaaaccatgttgaacctcttcttatcacttttgtacctcttcttgtcactgttgtacctcttctaatcacttttgtacctcttctcatcacttttgtacctctttaaatcacatttgtaactcttcatcaaatttgtacctcttctaatctctgttgtacctcttctaatctctgttgtacctcttctaatctctgttgtacctcttctaatctctgttgtacctcttctaatcactattgtacctcttttaatcacagttgtacctcttttaatcactgttgtaccttttctcacactgttgtacctcttctcatcactgttgtgcctcttctaatcaatcacagttgtgcctcttctaatcactattgtacctcttttaatcacagttgtacctcttttaatcactgttgtaccttttctcacactgttgtacctcttctcatcactgttgtgcctcttctaatcaatcacagttgtacctcttctaatcgctgttgtacctcttctaatcactattgtaactcatttaatcactgttgtgcctctttgtttttaattaatttaaaatagtgatttataaattaataaaaaaataatttttaatttaaataaaataatttttgataaatgctttgtattaaaattaattatacaaaagggcgcggagcaccctttgaggccgctaatcggccgaattaaaccataaatataaaaagggtgcggagcgcccgtcctgagggcgcgcagcggccgaatatccatcacaaaatttaaaaacgggcgcgaagcgcccgtctgtctccacaaaattaaaaaacgggcgcgaagcgaccggcctgagggcgagatatgcctgaatgtcccccactcatctaaaataacggcggatcagctcgcgggcactgccccgaaaactgaaaaatgtattctttcaagttgaccgattggggtactcaaacaattatggggagcaaaaatccaacgcagaattaaagtacaggctatagggaagctattccggaaggattcggtctccccataaatctgggcgcatcggttcggagggactgccccgaaaacaaaaaaatcgattatttcaagtgtccgtttgcggtactcaaacatttatggcgagcaaaaatccaacgcagaattaaagtacaggctatagggaagctattcccgaaggatccggtctccccataaatctgggcgcatc

SEQ ID NO: 17045 - DNA, 795 bp, Heterodera glycines
ctctgaaacaaaacaaaagtatcaaaaagacaacaatttgaccgcctcttaagttgctcaatcagttggcactccatccgccgctgcctccccaattcgaatcgcctccaccgccacctgcccaaccggcgccagaaccaccgccgcgacttcctccgctggccttgaaaccagcaccactaccggagccacctccaccgcggtagttgctgcctccgccggcgccgcttccgtaactgctgccaccggagccgcctcctcctctggtgttgcgactagctccagctccaccgtagctgtttccaccgccgtagctggcgccaccgccactaccaccgtagctggcgccaccgccatagccactaccaccaccaccatagctgttggagctaccgtaccctcctctgcttccgcctcccgatcctcctccccctctgaagctgcctccaccaccggagttgaaagcggaacgattggcaccagttggcgcaaagctggatcccgagtagccaccgccaccacctcctccacgaccatacgaccggccacgacggtctccgtaaccgttatcagatacattgttcgcaaggttggcaagttcgactggcacattctgaaaattggataaatttgatgccaaatcgtttcaattcgatatgcactcacttgtttagcctcttccaacaccttgatgagatcacgagcctttggaccgttgtatggagtaaaaaaagtgatagctgtaccctagaaaaaaacccgacatgtataccggaatattctctgtaatgatat

SEQ ID NO: 17046 - DNA, 2198 bp, Heterodera glycines
agtgacttctttgtcgtacaaccacttatcacccgcgtcattattggaattcggagccattttccgttaagtatataaccttttatgtgagcaattttttgttaacaagtagtaagaactttctcctgttcacaaatcgaacatcaatttggacaaattcctaattcataaatcgaacaaaaagtaaaatgcaaatttttgaaacccacatcttcgatttttgttgtaacttccctaactaaataaaatggacacaatatgctaaataagtgccaaagtatgttttgaaatctgggcatttttatttttagaacaagggttgacaattcagcgatcctatgaaaatagagtagagcgggacagggacctgatactgaaaaaacgtagccaaaaagtccagggttttcaacccgaaagtcccagtcccggttttacccaaaaggcggagttccgggatctgattatccaatatatgagaatttgatttcaagatgagtgtagagaagaatggggattgaatatttacacaccgagtcaaaaaacgagacatgtgtcaataaagagagagtgcagagaaactttttttctctaacttttctctccttttggcgtactatctaatattttcattattaggaaaaataatattcacttctctccatataactttttttctatgcatacaattttcaccatattttgcatatcgatagagaaaaaaatataggatttttcaatcgcttttttaaagaaaataatcgctttattttagtctaagatttaaaacaaaatttcgaacgcctatatcttttttctaactcattaaattgcttggcttttgcttagaaaaagcttcttctcatcaagagctttcgaatgataccaagattatacaatttggttatgaaaaccctccaaaaataattcccaaaaagcgtcattttttaattttttggacaaaaaaataaaaaatattcatgttgcacaacggactcgaacctccgccctttgtccctttactatctcacaaaaaccactccgccacacatgcattcactttttgaactaggggctcaaaattgactcggtgtgtttagtaggtattttcttagttcagcggattggtctgaatatcatttttttttttttgagtttagggaattttttttaaatatttgctgttatgtttgctctttcaaataaattttttaattttattttatgaaaaaaaatgaaatccgttgattttgatgatttaacaagccataacaaagcttaaatgtgcttaaattaaggttgctaaaaataaattcaaccttaaagaaggactttttgtcttaatcaaatggttcgaattttgttgccaaacggtgagtcggccaacgtcagtccttcagaaagtgttgaagaagcgattaagcattgcgttggtggagatatttcatcgcagaatgactattgtgagtttttttaatttaatttaaaaaatagaatttgaattctcccttttcagcattggttttctttggtcgcaaattaaactccgaccaacgcttagctgacattccgcatttggacggcgagtcacgctcagttcgattagtctgccgaaaatcgcccggtgttagcattgaaaagaacctggcggatgtggacaaactgcggtcacaatgccgaactttgtaccagaatcttggcgaggaacttcagcaaaaggttggaaggaccaacaatttgttttttctccttatgtttaattacaaagctggagacatatatggtggacgataacaatgccatattcaattccattctcaaagaccatcccgaacttgtgcatgatccgatcgcccttcccattgtcaaggatttgcgactgctggtgcctgccatcattgaggtggtccgtttaggagtgaaattaaacaaattattaaagaggaaaattaaggcttttttggaaacttaagccatcctactaacataaatacaataatttaaatataaaattttataatcctatcaaattattgttttttcaaaacgtacattttctatttattggacagaaccataaatttgcctacgagcgtcctgtttgtgccaagattttgaagaaaactttgctccaattcggcataatgcagcaagggcccgcagattcgtttatggcacaacagggagccaatgggtttccg

SEQ ID NO: 17047 - DNA, 2751 bp, Heterodera glycines
ccgatacacacgcattatacggccggcattgcctttgtagtggcctcgggtgacagtcacctcgtcatcaatgcttaatcagtggattattaaacagtttataggttaatttgcccgcccctttgtaccgaatgggcgtagaacgcactccgtgtttattgcgcaaatccttcgacagcggcgcggacataatgcgacgacggatgtgcgagggcgcgttgaaatggcgtttgcgcgatttgcgcgctgaggaggagacgaaagggttcagcttcattttgaaagcaaatcaaaaactgaaaataattttttgtcgttaatcgaaaactctgtcaaatgacaattatgtcgaaaacttctaacattaaggagtcaaagatactttcaagtaaaacgtaactaaatgtacacaaagtgcaataaagctatagagcttcttacagccgatcaaaaagatttcattccctataatagttttgggtacgatgaacatgatttgatcaaaaatagacacaatatgctcactcggcctcgacaataataattttttaaattagtgcgctatttggcgttattattaaattattgcgtaaattcaaaatagtaggaaaggtagtccatgtacagtaggtacaaaagtatatgaagaattttgtgctctttttaatgagcctattggatttttccagcccctaggaatttgaaaaagtcgtagaacgttctgtaaatttcgtcctcctgtttgtattgcttttaaatgatcaattcctttattactttccttattacctttgtagaataaacatcccatccagtttatttacccgcttgtatgccccaacccgaatgagctcctcaaaatgatagatgatttgtcatgggtttattcatgataatatcaatgtcgaaattatgtaactaaattaaaagtcctattatatacaaaaaatattatggcatttggccgcattcggaggaaaaaaacattttctaacgcattgagaaaagtaatgtcaattctttgacattatgagcttgattttttcgagtcgatgtcgtttctttccccttcaaatgctatttataaattatgaggagtgatttcgatgattgaacagttcgtacatcaatagctcataaagactgtttgtgatgccccaggtaagcaatgagcgactgaaattgagctgagcaccgcgatacaacgcacgaattgagccatgccgttctgcgaggatttttttgaacataaaccacggagtacaaaagtcaatgccaatgtttgactaaaacaaatgagtgaaagcgtttacaaaagacaggaaaacggacttgcatccgacttttgatgacattaaacggaaagaaaatggtcgaaatgcacgccccgagaatggcaccggacagaaaatttgcgcacaaatgttgcgttttcgttctgctctcagttgaatggaaaagctttgacagcacaaattcgcggaacggctcacgcaaagtgaaaaacattacattgctacaactaaaaaataataatattgaaaagatattttgattaaaaattttaacaattttgaatttacccattgcggagaacgatgacggaaaatcctcgataaaatctgttaaggctgactatattaaaggctaacaaataaaaatgaattgcccactcttttggtgcataatttctgtacataatcctaaaggcttcgccagtgtttttgaatttgtcaaagtgtttgctcgtctgcagaagcgtttgtgttctctccaaagggcataaaatggcttccgtagcaccggctaatgcaataaaagcaaaagtaattggaaaggcgacgatatttggcattggaaaacgaaatgaaattttcaattcatatcccattttatatttttctgttttcttccacattaactttaagctaatcgaaccaagaaaggcggaaacagcgtgacaaatggtgaagctggacacatttgggtcacagccaaaagcgtgttgatacttttcaaaagttccaaacctaaaaatagcattttttaaataaaattctgtccaaaaggtacataatcgaacgcgttgttgtcctctgaataagtgggggaagaaggccacggtaaaggaggtgtaagccctcacgacggagctgaaaagagacggtcaaacgaaattcttcccatattccatccttattaagtgtgctttaccaacttcattctgtccatagcccaaatttcgaagtttcgtgtccgtccctattagtcccccggtgtttggcttatcatcattcacctgttttatggcatcaacggcaagaacattgtgcaactgttgtcggaaaatcagtttggtttgcggaaacaaaaggcacgtctctatgcatccggcttaagggataactaatgcaaattttatttttttttaaattaaatttttatattttaaaatttatggtcctagttttccctcataaataacaaattaaattatcggcaatggtcaagaattggtgtcccgacaaaaaaaaatgtttaaaatttcataaatattttttctaggctaaaaaatacgctgatcacgaatctgagctcggatttggcaaaatcattgattttatctatgacttttaatcaagtacttgattttctaaaaattaaaaaaattaatcgggcctaaaaaactcatatgttgtagagcacaaaaagagctttcgaataagctattgaaggtctggagaagtcaag

SEQ ID NO: 17048 - DNA, 2156 bp, Heterodera glycines
cgcttcctaagttgggctaaggatgacttggagaatggtgcgcgtctcccgaggggattgcccccccccctcccctcccttttgcctcacatccgtcgcttttctgtctatttgctcgtcattatccgttggccaatcctcgccaaatctctcctgctccgttcttcttataacaatttttgaacttgcaaacattcatccacttttatgacgtttttcccttaaattcgtttgaatttattttattaaataaatttccctcccgggcgaatgttccctccccccccccccttttgtctgtcattcctttcgcatttggccaaacattccttttctttcatcctttctccctttcttttaagtaaattcgggacaaaatgtcctaaagtggacgaaagttgagttcagtatcaaattgcaccctttggcattttccctcccttctccctccagcaaattcggctcccttccctccccggggcatcggctgtccctttaaaaagtgtggcgccccaatgccctggggcgattgggcgacgacttttcctcggcaaattattgcgtcaatcactttggtccttctcttttccatttgcatggtaaacgcagaaccgataagcagcgccagaggaagcggaccgatgggaaggcgactgaactgtctgagctgtgtgcgtgtggacgggggttagttaattgcttttggcttgtcaattagctctcgtccctttcagatacaacaacgctcgaccaattccgagtccgtcacggccttcagcagcccaactgcgacatggagacggtgcagtgcgacgtgcaccaagacacttgtgttagcatcacaatgcaggtggtgtttacacaattacgttgagggtgaacatttgtcgagattcgaaattgacagagagatcataaaaaacaaaatttctgaattaactctcacttttgttctctgcctctctctctctctctctctttaccctctttttgtttaggtttcgcagcgacagttttggattggaagtggttgtgatcagcgagtgaattacgactttccctccgggggccgagaaggctgtgtggaaatgccttctgtctatcggtccgtttttcagtttttcctttcgaattttcttggggatttcttccaaaaaccttaactgatttctgccacaatttccttcatttttttcgttttccctttagaaattttttccccggttttatggaggaacggaggaccctccaaagggtttgtctgtgcagcgcaaatctctgcaattcggcacggcccaccgccgcctttctccgatttcttcccgttcttttattagcaacactttctctccttattcctttgctctttttcggaacggttgaagaaacaatcgaaaggcaccgataaaaaaagcgataaaaattttaatttttacgggttcaaaatgaaaataaaaatgataaaatattttttgggtcgtcttcatttttcttcgttctttctccatttctttgctcattcgaaaattaatttggccaaatgagtccattgctccgaaggttagcagtttagagaaattgaggaaatgatgacaaagttaaatgacaattcaaattagtcgagtgcaaatgccatgtcaattaatcattgcaattgagtgtgccgtcgtcattcgaaagtgttcttttggtgcctttccattccatttcgagtttcttctgttccgccgtctgctgacacctgctgatgtcggatcatttaattgatttgattgatccgctttaatgtgcttctgctgctccttttcgctcacctttccccgccttcggttccaattttgaagtgtcgtgtaattgtcgccccaattttgctcctcattttgccctttgccattgccgcgacttcgtgtcaaaaaatgccgcgggaacatgaaagggtcctccaaggtcggcaacgatgaaagtgcgtcccaatcatctttcagctgttttctcagagtgaaaaattctcgcgaattccgtgacgccaccgaaatggccatttccttgagggattggcttaaaaggcaaagaatggccgtcggtgctcactttggccatttcctcgaacactctctgctccgtctcccgatacattttgacgtattggctttgca

SEQ ID NO: 17049 - DNA, 816 bp, Heterodera glycines
ttaattaagcgccgctggttttttgaccattgcccttgaagcgcccttttgctgtgctttcgtcgatttcatcgaaagaattgctcaattttccgagtcgcgtgcgtattggcaaaaggcagcactttatggcgggatgggtatcgtccccattttgctgtgtgccgggactgagactattttgggtgccgggatgatatgcgcttcgggcgtcgcctacggttttatggcattgggaaagaagtgggtttaatttgttgcactattgtcaattgacaaaaaactgataactacaccggctctgtttttggttcaattctaagtacgtttttaagggctgaccgtactacgatgttaggcggtgctaataccgctggacaggacccggcatggagcccacaactgaaccaaccatttccacaacctgccggattcaatcagccctaagtgattgaagagaccgatgatggatcattttcttattccaattctctcattttgacacttacatttgaaccctaaaaccctttcaaaagcccgctgtaaaattgtgcatttttaaaggagatgaatcgacattggcaatgcagacccccacttttctagaattaaaaatacatcccatttctgtcctattgtttagtcactgattgctttgcctcatattatatacattgataacggcgcataaaacaggtatgtgaacaactttttacaaagccatgtatatttgtaaattcgagaatggaaattatagaaaacactacgaaggatgaaagtagatgagaaatattgcaaattgagaataatctattt

SEQ ID NO: 17050 - DNA, 1349 bp, Heterodera glycines
tcaatctgatctagatcccgatcagtcaatctgagcttttcctgatcagcccctgtctcggctacatgccgatcggttcataaatttggcttatcagccccccaatttcgagtccataacgatctaccgatcaactcccaatttcaaatcgataccgatcagccccaatttcgagtccaaattgatcagccaccaattttgtgcccatccagatcagtcccctcgagtccatcaggatcagtcccaaatttcgagtccaacccgaacaattcccgatcgtgacccactcccaattccattttaaattcaacaccatggccccagcccattgtgcttctttctgacctccttcaacatgttgtagtcgttgtccagtgccactttggtgatcgctaaggcgccagcgccgctcccagcggcgccgtgccaacggtcgctcattgtgctggcgcgccgctttggcacggcatccaccagcgactgttgcgaggacgccttgtggcatggcggcgccattttctgctgcatggacgtcgaccgctgttggcgctgaagcgcgacgacttcaagccgttcggatggcattgaaccggtggacagtttcaacgagccgcactttgcgatgggcgaggcggcaccggaggaacactgctgggctgcggccaacgcaacaatgtccgtcgattgagcctttttgtgagattttttttggaaattttgattttcgttggggttaggggggttagaatttgtggtccctccctcttattctggaaaattttgggagggggttcacaagaatttcagtgtgtttttttttgctgggttttctttttgaaaattttctaggcaattttttgaggtacatgaaggtggtcgaattgagaaatttttttggttagaaacccaaaccgaaaaactcttggaaggaaaggtttttttttttgctagctgggcgattttttgagtaattttttttttcagaaattttctagtactatttttggaggtccctggactaagtcaaactgaaaattttttcaatttattgagtccctatattttgaggtattttttgcgatttttttctccactttcaaaaattttttcgccccaaccaaacgaaaatttagcccaatcgccaacgctgaagaattgacttgtattttgatcttggaatttggaaatttaagaagcaattggcggggctgggggcggctcttcaaagttcaaagcgttgtcccgccgccccaattagcgcccattatcggcccattgtttgttggcatacgtccgcccgcgcgctaattgagcggcggcgggcggcaccggcgtgagcccaatgaccc

SEQ ID NO: 17051 - DNA, 682 bp, Heterodera glycines
  misc_feature (76)..(76): n is a, c, g, or t
aaaaatatgtatttggcgattttgtgacaatctcagctgaatttcaaaagcaagacaaataccgattattaaaatntaaaaaagcgccgattttttttatgactcgagactgagccggcattattcgagaaattgggtcggaacttttgttgagcttcaacccgagatcgtccccccccctcccgctaaaaaatattaaaatttaaaaaagcgccgattttttttatgactcgagactgagccggcattattcgagaaattagaccgagacttttgtttggcttcaacttgagatcgccccacctcccataaaaaaatttaaaaaccgccgaaatttttttggttttcttccgttttataaaggataacagagcacacagtgttcttcatcatcatcattttccactttaaattgaacattttgtgcctcttcattcacactttctggccggtgccggccgatgattttttgtgtcccccatttggcccgaaaagagcgcggattgaattcaattttggcacccctccggggacgcggaggggagggggccatccaccaaattcgctcttttgactctctcgtcgacggatgatggcacacacaatgccgtcccgaccgcttccgtttttcatttttagggcattttgccgaccaaaaaaaaaatatcaaaaatccattaaa

SEQ ID NO: 17052 - DNA, 1441 bp, Heterodera glycines
  misc_feature (1339)..(1339): n is a, c, g, or t
tttatgataaaagaaataaaaagcacataaaattattattctgtataataaaaaaattaaagctaaaataatataaaattttttgactatttggcataaggcaaaaattgaaaaaccccgacctcgaaccccgacgcttcaaccccgaacgtgaattttccaaccccgacgtcggggttgcaaccctagtctaaatgaaaaaaaaagttttgggccatttgtaaatccaaaaatttttcaaaaaaattctcagaatttttctcaattgaaaaatgtagcagcctatcctccttcgatttgcttaaattaaaaaatcatttgtcattttattttatatatttaatttttttggatttaggatatccatttggctatcggtttttattaatcatcacagtgagcacttttgcttacctcacaatgtttggtttagcatttcttattaaaaaattcatggacattaaatcgaaaaagtaaaaaataatttattttttatttctatttttaataataataattttggtttattgtttaagcattgtttctcctcctctcaaatcaacaaaaggatgattgaaatgaataagcaagtttctcgaaatctcatcattcaggtgttaaagaatcaaccagcgtttagaataattaattttttatgttctttttaaaatacgccaaattgcgttttttcttctacaataataaagaattatttattcatttcgtgctgattttgagccacttcaaatctcataaacctggtctggatttaagaaagcgttgagaaaaaaaaataattaaatttcattcatgaaatattgtttttagtaatttttcaaagataaaaaagaggcttttagagttaccgtatgactccaagaatgtaaaatttggtttttcttacttatgcgcaaagttagacaaaattttgtcgggaaaatgccttcggtaccaaaaatgtctttaaatttaggcttcaatgcctctcatcatttatttttccgtcgttttcctgcttttgcttctgctgttcaaaattgacacaaaaggatggagctggctacagtactacaacttactgtcaaccattccgatgtttttgcccgccgttttgaatccaattgtgccaatttgcaccatcaattattatcgtcatgtgctcgtgtcggacgtaaaacgttttggtatatggtgtatcaatttaatttttagcattttaaaatgtacacataaaaatttcagggaattttttgaaagttttgtttcatctaaaaattggtcaacaaaacatgaatgaaaatgagccgaaacaacagcaacacaccagccagcaagatgngcaattaatgtgccaagaacgcaaaatatcgaaacgcaaaattaattaataaacatacagattttctgggggggggcccccacacccccccccccccccccc

SEQ ID NO: 17053 - DNA, 1700 bp, Heterodera glycines
cccccccccccccccccccctccgattctaccaataaaaagccgtttttttcgtttgctttaaaacttctttgcgtaatttctcgaacatgaaattattttataatctttttaaaatctttttaattattatattttaaaaaatcgttttttccaacttcagccagcgcatttcttaaatccgccaccaaaaaattctctttccttgacatcctaaatatttttataaatgtcttctatccgaattttattggtgattatttgactaatataaagttacggggtaatccaaaatgagttttcaataacatcataatttcgaatgatttatgaaaagatggctttaaagaaataaacatttaagtgctttttgtgaccgatataaaattaagtaaagacaacttttcacacattaattattggcgaaacaaaataattaatactaatttattaatccttttcctacaccaactatgccaaccaaacccaaacagttgaaaaataaatgaatttgatgcacaaatatcgtatgaatatcaccggcgtgcgtcgcgacttgtacatggcacgcaatttttgccacaattaaacattcaggacaggggaagcaggaaaagattatttcgaccaatttgatttatacgacttttttcccgaacctttttttgaatagtgaaatagtcagataaactttcattgtgcaaattaatggtgtattatttcaaaatttatttaactaagaaatagagttcggaaattctattactaatttgtaagtgggaattaattttagcaaattttcaactgtcaataaaaaaataaaaaatgacgaaatatgttttaattttaaaacttatgaaaaatgtaaaaaacaaattgaaagatgaaaaagatgaaaaaaattagtcttcttgcatttcaattatgcttcttttcttctccaaattgtttcttccatctcataataaatagttccataacttagtccttcactttaattttgttgaataaataaagtccttagaaagctatttttgatgcagaatacctaggtattacatagaatggcattcgcgtcaagcgaccattcctttttatacccgacaaacgccgactccgactttccccccccccccccccgacgaaggtaattagtaatttgttttggtttgagtccgttattaataactaaaaatatttgttttcacttcttataatatttacatccatatctaattgtacgcaaaataaattttacaataaattaaaagtaaaaagaagccgcaaagaatgtaaaagctgtgccaatccataatttttttacatttaaattcgtaaatttcgaaccgcaaatgtgcacttttttcgggggaattttcctttgtttgttcacctgcgacattgaaagcaatttgacaaaaaagttgaagaaatgtgtttaatcagaagacagcgggcaaaaagttaagcaaaaaaagttgccacgcttcgaaaaaggagaataaaggcgggaggaaacgaagtaaaaccatagaaaatccatacaatttacaaccctagttatatatcattcgaaatcggatgaaccgcattaaaaggaaccattaaattttttccaagtcgttttcaaaaaataaaaaattaaatcgaattttttgtcctagaacctcttaataaccctgggatccagccggattcata

SEQ ID NO: 17054 - DNA, 1065 bp, Heterodera glycines
tccccataaatgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataaatgtttgagtaccccaaacggacacttgaaaaaatcgatttttttgttttcggggcagtccccccgaaccga

SEQ ID NO: 17055 - DNA, 2191 bp, Heterodera glycines
ttttctgaattttcttcgcgaaaattcaaactttgccttaaaagtgaaaaaagtcatgaaaacgtcaaaaaaatataaaaaagaaattttgaaaatttttttgaatttggccaataatttgagtgccaaaaatgatattttgtaaaaaaaaaaaaatcgaaattttcctaaaaatcgccaaaacatgtgccaaaaaactaccgaaccccaaaatatgtacttatgaggaaaaagtccaaaataaattttttatgtgctaaaaactcgctctgattgaaaggaaaacaggtaaaaatgctgtttttgagcttcttatgagataatagcatatgcgcaaaaaaaaagtaaaaacatattaatccgttcactgataataggcacaaaaaaaaattgaaaaaaaaagcatgaaaaaaggcatttaaatttttttttttttaattaaggatttttagagagcaaaacacgcaaaacttaaccaaacaacttaattttggtcattaaatgattaataaaaattttataatgtttttcgaataagaaaatttttaaacctaaattttttatcaagaaaaaatatcaaatttgacaatcaatttttgagaaaatttttcacttcttagggggtatattttctgaaattttttcaagtcatttcttaggggtgtattttcccgattttattgcatttttaattgaatttttcgtaaaaaaaacgacaaaaaggcaccaaaatggaaaaatgccaaaaaaggcatttaaggaacgaaaatcccaaaaaaggcaaaaaggcataataaaagtcaacgtagaagcttcaaaccaagtggaagtctctattcatcattttctcccctgtttcgtccacgtgttaatcacgcgcgaagggaatggacgaagaaattggggaaaatgggcggggaagagaggggacgggggcgggggtaaaagtcaatttggccgttctcacaatcagcgctatttttgcacgtaccaaaactttcaattattattctttatgtgctaaaatgcatcttgctgctaattgttttattaatcattttgtaaattaatttggtaattgtttgttaattactatgctaattatttttcaattaatttgttattttaaataaatgaattccttaattttttgccattttcattttgtcccgtgctcctccaatcttcaacagttcaatttctttttcaacttttcttatcccttttccgaagttttggcataaaattccggcgtcgggacttagccggcgcgggaaaaatgcccaattagcaaatgattattttgaaaaatatattatattatgccataaaagggagctttacgatgacacccaagcctcgatcatcgaccgcctccttagccctaatttttatttcaaagtaaaaattcttatcaaatcttgggtgcctatcggcgcaattaggtgtcagtcaatcaaagctctctcacctctctcactctccctctcttcatttctcgctctctctgtctctctctcattctatctctttctcactttccctctccctctcgcttcctctctctctcatcactctcatcagattgttatttattttacattattcttttaacttttcaatcacttaggggaacattatcattaagcaaagagaggggcgattttagagaaaatttttcggtgtaaagtttaagaataaataaatttttgtttattttataattttcaactttcattgattttgtggagaagcgggaccggcaccgggaattcccggtcctccgaggtcccggtcccggattttgaaaatttatttcccggtcccggtagggcaaacgggaaccgggaaaaacaagcactggtaagaatgggggtctgatttgtgagtgaaaaattagtgatgaaaattagagtcaaaggaaaaaaattaaaataataattaatatgttctttaaaagtaacactgcccaagtgtgcaaatggcctaatggctagtctacttgactttcccttcttctttcccctggttcaattccttcacagaaattaaaatatcttgaattttgtttttgtgtattcgttggttttcctagcgttaaatatgattcctcatatttttcttttaacagacatatgtttatcattttttaaagaaaatccgtacaaattgagcttagtaatcccaaaaa

SEQ ID NO: 17056 - DNA, 2424 bp, Heterodera glycines
ccccaagagttccgcccttagacagtcaaagcctatatgagctcggcaccacatcagccagcatccataagagttcggtcctccggtagccaaaacccccaagagctcggcccactggcagccaatactccgaagagctcggccctccagtagccaatactcccaaggactcggccctccggcgaccaacactcccacggacccggcccttcggtagccaatactcataaagattgacctccgatggccaatacacatttgcgttttcgtatttcacaaaataacaaatgtcccaccatttttgacccgggcggcggctgtttcttctcgcctgctcctcctcctcgtccttctttggcttttcctccactttcgcttcgtccttctttggcttttcctcctccttcgcttcgtccttctttggcttttcctcctcctttctctcctcctcctttttcttcacctctcttcaatttttctcttgcttcttccgtttccttttcgtctcctctctctcttgtttcttcttcgcctcttccttcgtcctcctcatcttctcttctgtcttgttctcctccttcttttcctctcccttcttcccttctctttttttctcccctctcttcattgtttccgttttgctcctcctcctcctcctcttctcttctttcctcttctctctctctttctcccctctttccattgttgtcgttttgctcctcctcttctcttcctcctccatttgctccgtctttgctccctcctccgtctttctgcccacctcctccgcccttcttcttgtttcttcctccgctgttgtttcctctgccgttctcatcatcgccaccatcatcattttcattccctccaatcgcttcatcaggtgcaacacattgttgccatgctgcgtcaaaagataaattgtgtcgggctcctcaaatatttttttttcgatgaccaatttcaaaaattgaaacaaatttcgcttaccaacattgctaggtctagcaacgtccaaccatcacgaatgttgcgatgcgttggtaacacaggatgccatggagtctcgactcctgtgtccgggaaccgcaccaacacgaactcgtacttcttctcacacacggcgcatgtgtggacgaggtgacgggctcgctccaaatgggtgaagtagttctcgttgctgccatcgaagaggagccggtacaacgcattgttctgctgctccaacagggtctgtgatgggtgccggtggtcccccgggcaattgtcgtccagttgcggtgttgcctgattcaaaaaaaaaatccaaaattaatacaattattgtcatttttattttaatgaaaaatcacataaaaaatttcagcgcaaatttaccgcttttcgcttttccaatttgcgctgttgcggttgttgtgcaacagctttacgggttgaaggagcgcggcgcgttggattgcggacggaaacggaggaggaggatggtgcggcggcatttcccttggcctacaaaattaacgggaaattatttaaaaaaacgaatatttattattttgataaaattaattaattttttaaacccacgcttttgcgtgtaatgggcaatttttttggtgctggctgttggaccagtgcagtgtcggtgcccaggccggttcgattcgcaacgttctaaagtattaagaaaaaaaatttttttcatttggtacaaatttttctcattaaaatccatccttttcactggcggaaaaggacttgaaaaaatttcaaaaattttaaacacttaaactgaccattggtgctttcatggttggtagtgccctttttttcctgctgggaagttcatcctctgacgatgaacttgacgagccgatgggctttgatgcctaaacatgttaacgacataacaaaatttagtcatttacttacgaaaaatacaaatcaaaaatttattcatttactcacatttttaagtcgagcatacgttttgcccccgggcgccattggtgttgaacaaatgttgagaaaaatatggaaaaataacacacctaaaaataggggagaattatggaaaaggtcgtttggtcatttaatggcaatgagtaaagcggtgagaaagtgacggcgttcccccgtcaaatcgatatgcattgctctgtttggacaggggtggacagagaaaagatgagaaatatccctctctaccatcccaccccgctccccgcaaatttgaatgcccccgcaaatgtcacattgttgatcaatcataattttccgatccccccccatcagaaatttgaatttcatccctcatctgtcacttcgctgaccaatcaaattccccctccccctcggctgtcactttttaaatcaatcaaattttatgtcaaaaaagtgcaagacaattgaaaccgttcaataggt

SEQ ID NO: 17057 - DNA, 3459 bp, Heterodera glycines
  misc_feature (3445)..(3445): n is a, c, g, or t
attcggaatcttgtccgttattgacaaaatattccgtcgcttgagcttattttttaatacgggcgtcctcaattgttgggtatttgcaccgtctcgataaaatgtttatttgtagaacaaataaattaaaacaatttaaaataaaaatgggcgaagtcggaagcggaataaataaattggaggagaacaaatatttaggcgaagtgaaataagtgcataaaaagcaactaaatgaatgaggggaatggacatgcaaaggacaatataaatcaatagtgtcttacataataaaaggaagacacaaaaatagagagtggggaaaatggagaggaaaagaaaaagacaaatgcaaagggaaaataatgcaaatgtgttctttcatctctcggggttgaccacccgaacactaatgtcataagaaattcaagattttctttgataaaaatgaagattttctcattttatcagcagaataaaataacagatcttttaaacaaaataaatattttatttttaataactaatttaaatttatgtgttagcaacaaattttgtctcatttatcaggccaacgatttttgctgtttttgtgctaataagccaaggctgtcaacatatgcatcatatgtgatgttttagcttcattttgaagcttctgagaggccgacgaagctaaatattgaggcataaaaatgtaaaaaaacgaaaaaaagcacaaaaaattggaaaaagagtttttatcaaattaacaaaaaaaaattaatattctctatttattgtttcattcctcgttttttggacgcctgaggcggtcatttgacacctatcaactgattaaaaaaaattattaagaaataatagattttaagagattgatctagatgaaagtttaccaatttctaggggttatttaaaaaaaatatttcaagacgattcttaggggtggttttttcgtatttattgctttttcattaagaaaattttcaaacaatactgaaaaaggcaccaaacgccaaaaaaggcaaacgaaaatcgcaaaaaaaaaaacgaaaaaagtaccaaacagttaaagctagaagcttcaaaccaaattgaactttaagatgaaaacatagaaatttgttagcaaaaaaaaaacttagcccccagcaacaatttttcctgctcaaatacaaaaatttattatggaatttaaaaaaatgaggctttttaaccctggatataaccgtacgtttttttgccgaaaaatgatgtcataggtaccggatttaccaagcaacctaatcacccttcttacgtacatcggtcaccatgattccaattgaattgaaattctttggtgaatgcgttgctgttggggtcaagatttatttgtttggtatagtcgtgaatgacctcagcaattggcagttcaatgatgttataaaaataaatttgtatttttttgaaattatttttaatgttttttttcatttaatataaattctcgatatggcgttatcccgccggaatacaaactttgatggatttcataaaacaataaaatttgactcttttaaagactaaagaaaatatgttattagggtaggcattttaaatggaaaatggcacttttgcgcgtccaataatcaatgacattcttagttacttaggccataacttttttcttacttgatcaaaacttagattaaagatagaaaattctatagaagtttttgtataacttaattttgtgctaaaggtttaacagataaaaaattattattgaatatactcaaaaaattgcttaattccgtgttttttcattgcaatttttcctagcatttgttattttcgtatatttctaaatcccagagactttaagctttcgttttgataccaagaatgtagcttttgaagcttttgatcaagtaagagaaaaaagttatggcctacgaaactaagtatgatcattgattggccgcgtaaatgttttattggacgcttaagctgcaggtagagaggagcccttaaaaatgttcagtcctatcacactgatctcgcaattaagtgtaatatttataataattatttattcatcattttattaccaaatttttccttgcatttgttcgaatcttcaccaacattggcgttctgcacagattgaccattcgatttttgctcaattctactggcaaattggaccattggtctgtgatgttgcccaacagctcaacacgcgtcccaaaacggtcaatgtcacactgaattctcaccctaaatacatcattttttaatataacctaatttatagagagagcactgattgtcgtgtcaggtgatttcgacagtgaattatttcgcttactctttgtgtctaattgtgatttcgacagtaaattgaattcgacaatgagtgatttcgacagtgaagttcggcgccgaccggttcggcgccgttgcaaataatttttctcattacccatcaaattaaatatatgttggtatcattcgagagctatataaaatttaaaaaattttcgtcagttaaaaaaaaagttatggccaaaaacctcaaaaatcaactttgagcttgttaccagatttgctatcgtgaactgacaaagaaaaaagttatagcatttctaatttgttggcgccgaaacggtccgcgccgaactgatctcgaccctattttaagggggggggggggagagagacatttaatttggatttttgttttgaattttttatgaaaaatggtgaaattcaaaaatttaaaaaattaaatggcttttgtatatgaaatgaaaattttcaacatttaagctcacttgtatgatttatctgagtacggtttcttcactgaaattttcagttgattgttagcaaaaacatttgtcgaacaaatgagtacaagtgtaaaaagaagaataatattcattgatctttattaaaattttgcataaatattaaaattattcattgttattttgattgcctaaagcaatatgtttcataatgttaatgactacctaaattcgtaattacctccccataaatgccacgaacacaaattgatttattttatggttttgtaaaaaaagccaatttcatacctatgtttacgtttgtgacaaataaattttaaacaaaaaaaaaataagtaaatatatttttattttattaaatcctctatagaattgaagaatgtttctcggcacaaatgtaattcatcagaaagtagttgatgttagtcaaaaaccatcaaatgcaaaaaaaaaaaattccatatatagagaccggatttctatattttttttctacggcttagttatggcgtgagaagcccacaatagcattttctccgaacaatttgatttagagcgacttaaaaaacatatgaaaaatacatattttggcgttttggcatatttgccaggaagtggaatttttagcacantattttagcatttt

SEQ ID NO: 17058 - DNA, 1934 bp, Heterodera glycines
acatttttgtagagcatttaaatgctatcgaatggtgtactaaatgatgtaaaattttcaaaaattttcgagctaggccccctagaaattttcaaaaatttttttggggtcgaaaaagggtgtgaaaaatatttttctggggtattttgaggtgttgagtacgaatatgatgtctattttaagtttcataatttttggaattttttaaaaattcgaaaatatttttaatttttttggtccttggaaatttgggttaaattttgaaaattcattgctcagttaaggtttggtcaatttaagtgaattaaagctctaaaaatagagaaaaatcaggagaattttatgggattaattgaaatttatatcttgaaatgaaaaaaagttattcaagaatttctggaaaaatccgaattttcagaaaaaaattcagaactcggttctgaaaagtcattctgtaaaagtaaaatactacaaaaatccgcaattttttgctctattaaataaaatttattttacatttttatcacctttttaaaataagatacaaaaataaaagtgattttggggttcgggaccaaaggggtgagcataggatttttgagtggaaaaatttttctcacaaaaatcttccaaaaatatgtctttaggggttatttgggccgctgatcacgaatacatgatcagattttacttctgacatcgttaagacctcagaatccctgtgtgattggggattctgagtcatcttctgggggggggggcgcaggttcgaatccgggcggtgtacattatttttctatgcatttttgggttatttttcagtgcgtttaatttatatttaaagatttgttatttttcaaaatatactcctatgaaatgaaaaaaaattttctcaaaaatttactttcttggcaaaaatttttaattttaaaaatttttttatgtaactattttgggttttttggtcttaaaaatcccagtcctactcatttgcaactgcaatcagtgaataaaaattatttttgctcaatttttggctgaaaattatgtcactattcgtcactattttggacttttttcactattttgtcactattttggcactttttcgtcactattttagttaactatttcgggatttttcgtcactaaaagttgctgccctaataataattatcttttaatatagaatttcatattttttttaaattgaatttataaaaattaatttcatattaatttaaatatcaaattcttgtacatttcaaaattctctttttaattaataaaaggaataattaattttattttttaaaatttataataaattgcattcaatttttgtacctcttctaatcactgttgtacctcttctcatcactgttgtacctcttctaatcagtttttaccccttctaataatgttgtacctcttctgatcagatttgtacctcttctaatcacttttgtacctcttctaatcacttttgtacctcttctcatcactgttgtacctcttctaatcagtttttaccccttctaataatgttgtacctcttctgatcagatttgtacctcttctaatcacttttgtacctcttctaatcactgttgtacctcttctcatcactgttgtacctcttctaatcttaaataaaataaatattattaattttcaagttgttttttattaataatttaaaattaaaatgcattcgatttttaatatttaataaaaaaaatttccttattattaaattttaaatcatgttgacctctttcacgttgttgtacctcttctaatcacttttgtacctcttctaatcaccgttgtacctcttttaatcacttttgtacgtcttttaatcactgttgtacttcttttaatcactgttgtacctcttttaatcacttttgacgtcttttaatcactgt

SEQ ID NO: 17059 - DNA, 2369 bp, Heterodera glycines
gttggccgcgttgcgcggcgtccccgtgcaattggtgcgaaagccgcgactggtgagaacggcacacattctgctgacattcacatttttgactatagccgacattttcttgaaattttaatcgcgtcaaagtcgagactctcggttttgccctaccaaaacttaaattcagtcgtttgtgttttcagatggtgatcaacgacagcgatgatgagaacagcggcgatgtgccgttgagtgacgaggcggcacaactgctccgacaggtccttccagggcaatgttcaaagttatgggactggcaaatcagtcctgtcgattgggatggcactttcggctgattagtttgatccgggagtcaatgaattgcgttttcccctcaggttgaactcggctacgctcaaaattcggcaacaaattgcgacaggagttcccaaaagcagcaaacaatggccgacgatcagtgctcaggcctaaaaggcacttaaaagctagagaaagccagcaaaaattcagtataaaagcaacagtgtgcgatatgtttttaatttcagaaatattctgatttggatggtccaaatctgacaaaaaaacattgataaatccgaatcctgtgtgagtttatgcataaaagacaatgcattcacatgtagcgatataatggaatatacaatggaatacagcagagaaatacatattatgctttacatatatcgtttcatcgcattgactgttttgttggcaccagcatcattcattccactcgtcctctgcttaagtctgcatgatggcacttccgttcttctgctgctggcgatgaatgacgacattggcacattccgtggcgacatctttgcgcaatttctgatcggctgcggcgactgaagcattcacgggccggtttttcagcaacgaattgttgaagaaaatctcgaagacgaacgtacacaccatgacgatgctgaacacctgaaagacagcaattgaaaaacgtagaatcaaatgggaaaagcacggcaaaactcaccaaagtgaccaacggcacatttgtgtcatccgcacggaagttgatgcaagaccaagaaggcgtccaatagagcagcaaacacgacgagaaccaagcagaggcactccagcagaagacagaatagaaggcagtgcaacagtcgtagaacttaaaaatgaaaaacaaattagtaacagacacaatggcaaattttgacaacacgcaacacgacaaaaactgatcacaatttgacaaaaaatcgctcggatttcgactgaaaagcaatttgatcgcgcaaaacaaaaatgatcacaaatttcaactgaaaagcaatttgatcgcgcaaaacaaaaatgatcacaaatttcaactgaaaatgatcgcgcaaaacaaaaatgatcacaatttgatcaaaaaatccatcgaattacaactgaaaagcaatttggtcgcgtaacagcaaaactgatcacaaatttcaactgaaaagcaatttgatcgcgcaaaagcaaaactgatcacaaatttcaactgaaaagcaatttgatcgcgcaaaacaaaaatgatcacaatttgatcaaaaaatccatcgaattacaactgaaaagcaatttggtcgcgtaacagcaaaactgatcacaaatttcaactgaaaagcaatttgatcgcgcaaaagcaaaactgatcacaaatttcaactgaaaagcaatttgatcgcgcaaaacaaaaatgatcacaatttgatcaaaaaatccatcgaattacaactgaaaagtaatttggtcgcgcaaaagctaaactgatcacaaatttcaactgaaaagcaatttgatcacgcaaaacaaaaatgatcacaatttgatcaaaaaatccatcgaattacaactgaaaagtaatttggtcgcgcaaaagcaaaactgatcacaaatttcaactgaaaagcaatttgatcgcgcaaaacaaaaatgatcacaatttgatcaaaaaatccatcgaattacaactgaaaagtaatttggtcgcgcaaaagctaaactgatcacaaatttcaactgaaaagcaatttgatcgcgcaaaacaaaaatgatcacaatttgatcaaaaaatccatcgaattacaactgaaaagcaatttggtcgcgcaaaagctaaactgatcacaaatttcaactgaaaagcaatttgatcgcgcaaaagcaaaactgatcacaaatttcaactgaaaagcaatttgatcgcgcaaaacaaaaatgatcacaatttgatcaaaaaatccatcgaattacaactgaaaagtaatttggtcgcgcaaaagcaaaactgatcacaaatttcaactgaaaagcaatttgatcgcgcaaaa

SEQ ID NO: 17060 - DNA, 1319 bp, Heterodera glycines
tgagggtaaagcgatgattgactttccaggccgtctgtttagagagcagcgccattaataaagtccacttggcccccaaatccttaaaagtattgaaaaacacaatcattttcttcattaaaaattagcgaaacaaaaagaaaaatagcgctaatttttttatcgacttacacccaaaatttcaagctatgagaccaagttgtggaaattttccccgccaagtaaaattttaaaaaatagaatgccaattaattccttacttcaccattaaaaattatagaaaattcattcttaattaataaaatccaattcgcagactagtgcggtgtcgtttcggcccagtccaagtcttttgtacctattgttggatttggccagcaaataaaaaagttagtccaaaacttgacatctcattacgattttacgggcactcccccaaaacatcgccgcaaaaacaaaaaaattttcgatttatgtaggctaattaatttaaaaaatattttttcttaaaattaaaaaaaattgcggcggcttttgtcttgcgcccgattttacgtattggtcctttcgtttggttctacctgaatagaaacaagtgccaattgtgtcggatgccacttggcccgtgaaatcgacttcgatagccgaattgatggctgtcattttgctttgttgcattatcgttgtcgttttattggtaaatccggcactcgcaaacactgaaaagcacaaattattattttaaattatttgtcacaacttacaaaacaatgggttgttgtccattagctcgtagaatttgtgagagcccatcgcaaaacaaacaacgactcgacccgggaacatgcttttcttgctgttgttgatcacgttccggtcgagcagttccataattccgtcgcttaccatttcactgtgtacgccttggatttgtttgttgtccttccattttaatttgtttcccctttctgctctttacccaagtctttgtgccctttcaattgttccaatacgttgttcgggattgatccgatgcccatctgaagggttgcgccgtcctcgaccaaattctccgctatcagtttgccaatttgcttctccgcttcggtcgagaccgcttttggcaactcataaatcggcgtttccgcgtcgacaagcgcgtcaatttgggaaatgtgaatttcggcgtctccgaaggtgcgcggctgcgttttgttgatggaagcaatgactcttttcgcgtttcgagcggcggcactgaagggaaacattttgccaaatttagtgaattgggcggcaaatgagtgacctggacatgt

SEQ ID NO: 17061 - DNA, 2099 bp, Heterodera glycines
  misc_feature (23)..(23): n is a, c, g, or t
atcgtaaataagttacaatatancaaaggaagtacaaaacaatagacatcaaatgatgtgagaattgattagactcttagtttcttcagggacggctcttcggcagaagcgggtgaattgcttccgctggtgtccaatgattttccggttgagtccagggaattgtttagcatggacacgcgtggagaagccgccgcggcggagcagcgtcgttccgctcgtctaccccggtccaagtcctccttggaaagcctgcaatttgaagcaaaaccgtgacacatcaacaaaaaagaatttatatttggcactgccaaaaataatttttcaaataaaaggaccatttgatgagattcctttggcgcgtgtaagaggggtgaattctcatcgtttctttgaagtccttcagcacggacgcacttttgtaaacggtgtccgtaaatccctgcaactcttctgtgagatcaatttttttcgtaagttgcttgttcaggtccaatccgatgaaccacaaagtgcacacggggttccttaacaatgaatgaaaagttaaaacagagtgaatcatcattctttgtcagttcattttcattttttggattttgtaatgccacgcattttaagcgtgggtgggggagagataatttattagttcgtgagttgaataataataaattactcgtaatcgatgtcgagctccaatttgtatgcgggtttatactgccggggattgacatggcaaagattcacgcaggaattccgctcgaaggacgccaccaaatggcggattttggactcaaccaacccgcaaaaattcaggtggtcctcctcattttcggtgagacactacacggcaaaagaaactcgtacggtcggacaccacagcatcaatcagaataaaattgtgcataaagcaatgcgaagcatattcaatctctactctgtgcacatcatagagtaaaagagaagtggagaatgaagggagacagagagagaggggggggggggaattcgaggcttctctgccccccccccaatttaatgattcaaattgtgcctccccttccctacccatggcactgtgtcttttggactttgcttgtgtccctcccttaatgccttcgctttgcccaccttctttgaattcattggtcatcacttgtctcgttgaccttgtcacattaaatgtggaattctgttctgggaaggctggcgtaatgattggcatcaaatggtagcggtccgatgcgcgtgttctcggatcccaaatcatgtcaatgaaatagggtatgtcaatccgcggggtagcgtcgacatccttcagaatgacgggatgtggccaatccctgtgagtcagaaaaaaactactgcacttaaaatttgtatttgacaaattaatttttttttgccactgtagccaaaaaaaagtttcaaatttactaagaaacactcggagaagccgctgtatgttagctggggttcgtatgcccttcgtacccaccctttccccatggatactgtcccacgccggtcgaggcttcccaccgtttgccctttgtccataccatgcagaaaaaacgaggaaaaatttctgcaataaaacagaaggtgttgcatttggatacaattgacaggtccgggcgacgagaattgcccaagaaatgccgccaagaaagcccaacacattggaataaatgccatggtctgcgaaagaggcacagtgaatgaatggaaaatgtagaaaaaactgacttttagcccaaagcttaacggctctaagaaccaaaatgaaattcagtcgatttgggaccaatcgcaaaatttcatcggccacacgacaacctgaaaatagaagattgattcaaatggaaagaaatgatcatattcaaggaaaaaggaaatgaaaaagagcaccattcagagaacgaatgctcttctcgtccaagttcttaagcaaattgtcgtctgagagttcctggtcttcctttatttctttcaacgccaaacgagcgaataaaatgtcgagttcaatgccatcgtagcgcagtttgatcagaggtacgaaggcgtcctcaactttgtggaggtccgccgttttttca

SEQ ID NO: 17062 - DNA, 2882 bp, Heterodera glycines
  misc_feature (89)..(89): n is a, c, g, or t
  misc_feature (110)..(110): n is a, c, g, or t
gctcaattgccgtgctatcttttgctggtgtccacgcagcacggtcacctcacccgcgtcatttgaagatgaaaattacaaaactatgncgaccatgcccaaaacatgcncatggtaatgcggtgacgggtatctcaattgttgtccgtcctaagctcattaaattatccacatctgtcagggcaatgttccatgtatccgggttggtgtacagccgattgatattcctctccagttcaacatgacatgcggtgtcccggttatagccgaaccaatgttgcgcaggtgaagtcttggaaatggtgcggaatgaacggtcaaaaaagtttggtgggtccacactcagctctacattaatccattcgccggaagatagatggagaacatggaaaaaaattacgataaaggcgatcagcaagaaataaaagaatgacgacatccttctgttctctcaatgaaagaaacaatgtggtaccttctccacttttagtcggccttttatacatggcgagccagtgtacgtacataccatttaactagccagtccgccatcccacgcgttttgcgcaacgtttcaactacgtcgcaaaacggggtgccggaacaacgactggccaagaaatagacacaaaaatggccgcaagcgtccgatgaagggaactgaatttgatgcatgtttacctgcacatgctgaaacttgttgagataggcggataaatcgggatttggtgccacacctaggctgtcaaagtattcaatttgcgttgcagatggcacgtaacaagccacccaatgctctccgcgtgtgccctccttgtctgtgtttacaaccatgcagtgggggtagcgccgcattcgtttctgcctctcaagaacaggcggtattttgtttgatgcgtaaacgccgatgaacttgccgcttgtaacacgcagcctccttagtagcacatctatttgtgctgaattcatctctctttttcccactgtttaaacacttccgtccgtgctcaacactcggtcagcgttgatggaaaggacagaatcgaactcgccaaggatcaacatttcgtaaccgtcctcttttataggcttttcaaattggaccttaagcgtacacgtgccctgacggatcaactcaaagccgggcgtatcatccagcgtggaggtcatcgggattacgaagaaggcccatccgctgaggaagcgttgcatcccaatggacaccgtttttgtgtctgaatcatccagaccaagaccggcgtacatgtcgacaaaagcgcgcacaaaacgttgctgtgcaccgtcaaacgacagcaggtatggggtgctgggaaaagattgaccgttggcctccgcacttatcgctcgaacattagcgtgttcaaatttgaagggcgataactttcgatcgccagaataagcgtctgtagagacaaagcagcaaatcagacgacggggcaaggttgaagtgaacacgttgtgagccaactcagtcctgcctttgcccagaaaaatggagcgcatctcaatcttacgcagcgggtatttggctgaggttgactccaactgacggctgattgccaggttaaggctaggcgtaacgtctacggtacgaacatacagacgcaaatcgtgcacgcgaatacggtattccttgctgttttcctgcaatgttccgtctgctttctttccggggggcgtaagcaggaggaaagaatcactgttacgatgaatggtgaatatcacgtcctggttgttcaacatcaatgcactctgatgtgcaagatcaaagttcagcctcaccatcgtttcgcattgctttccgttagagaatcgcgctgcacgggcgatgaagccctcattggtggcactatcttggcaatcatcctcatcggtataatagcacgctgcctcatggaaagtcttacgaatttcatgggagtagcccagttccttcattatgtagtcccggtaatggtaataaatggagctgtcgaacacttctataccggaaatgttaattttcagtgagcggacaaagctgctgccaaagttttgggttacaccaacgcgcttatcctccggctccgcatcactggtcggaacccattcacctgcggcatttttgcgctcaatagagctgagcaaatacatgtatgttttgctcaagtcgcagtactgactgtccgagaacaaacggaacagatacgggccggtctgattaagtgccgacaagggcaacaattcgcggacattggtcctatttatcgccactttcgttggcggaagagaaaacagtgaaaggctaccctcaaggccttcaacactgtctttgtgaattttctttattacgctcattattgttagttttatgccactgaatttattaagtgaacgtcaagtagacagaacatccatttacgtgcctatttatagattttcatgtgtgtgtgtgccctttgacaggcgcgctaccgtctattttaaggcgcaaatgtgagttggtctatagcctgtcttttgttgcctctcaacgaatgcattggcaatggcaccttcacctttttcaccggtctcttcctcttccttgtaggggctcccttcccgcactgcttcaatttttcagccaggttttccatcccatgttttgcgtgtgcctgaatggattccttgagggcctttccctgcgaaagatcctccataatccggcttccggcagtcactccctcgcgtgacacagccttcagcatattggaagcgaccggcatcaggaagcgggcaacatttctcaatagaccagcaccacgctgatgaggtgtaccaacaaaatagtgcatttctccccctcccataaagtaaacaagaagaggtccccagttaat

SEQ ID NO: 17063 - DNA, 2394 bp, Heterodera glycines
tattgtaagggtgaaactcttcaataaagacaaatcttggaaatttaaggacagacagatcatagaaataaggacaaatgcgatcgatctctctggcccttttccaggacgctcgagcccaaatcaatgaacgaggcattggcgcaggaccgtccgaagaagtgaccccatggcgcagcatgaagggcacatttctcaggatggtcaatgcgaataaattcaagagaaaacagttggatttgtatcgcaaaatgatgaactcatgcgtggacggattggtggaaaaatcggagtgagtgggaaaattgggaaaatttccccgttttttttttcttgattccaccctaatttccggcatagaaatcatttattcttttaattttaaaatatttcctaattagaattcgaccagacagaaagttggtaatgcaaatcggtccaagagatttgaaggaatttgatgatttactcaaaaatggaagaccatttatcaagcgaattgtttttaaagcagattatggaattgatgtgtattttttcatacatttaattgaggtgaattttttttgtcaaatttttgaaaatttaataattttttacaatttttgggcatattctgccgactttaatttaaaaagttcgactttattcattagaaaataaaatctaaatttttttcaaaaaggtttataaaaaaaatttaattttttttgtgtacataaaaacgctgcgccaggaatctatataaaaagtgacttttttcatttttttttgttttttaattttttactttttggaatttttttgaaagaatttattaataaaaaaaaattctttcggtagcaaattaaatttttcgtgagatgattttaagccttaggcacaaaaatgctagaattttcttacataaaatttcaacccttccctatttttaattactgttcaatttgccgacttaattcaattaatttgactgaattggcataatgccatcaatttttggcaattatttcattttgcccaaatgttaaggcccttttgaatcccttcacaagcgcaaacacaattgttgaagacattggcatcagcacaccgatcattggcatttgggaccgagacattttggtggaaacattaaacgagaaatattttgacgaaatgacttacaacccgggcgaaataccgcattgggaggtacggtattacagtcagtatgaattactgtagatttagattaggtcaaggaggatggttagacacctaagtttacgaaggggctcaagacttgtaaatcaaaagataattatgcagaaattaagaattttgggggtccgtttggtgccgaaagataaattaggtactcagttgtacgttttttcagtaccagtcccggtcccgtacaactctaatttagagccaattttttttcattaagctaatatgattttgtggtccttcctacgtgccaaaaggagccgccggaaaattttgcagcttttacatccattttaatctctgctttcaccaaaaaatgaaattgttaagaaaataagcaaaaattttcagaattttcctcttttgcccttcactacgaccccccccccaaaaaaaaacggtatgatttgttgacatattatgacatgttgtcttaagtgatcttggctttcgacaaatactgactcggaattacagtatgatggggggatgagtgattgagattttggacaaaaatcacactgtgctgtacagtttatttcggggttgaaaaataaaattttctgttgctttaccgtagggttaagccccgaccccgagctccccggtccccgaccccgatccccgacatttttgggcctattcccccttccagctgttgcgtggacggattcattatcggaaatttgagcagcgaaagagtcgtgccgggccaaattgaagtggtcctaaagaggggaaggtaaaggtgacgacaaatgaaaacaaagaaaccgacactctctccaccaaatccatggccctcactttgcacaaatcggactgaaggaaggcgttgaaaagtgtactaaaattattcgattacaatctgtttaattgcatgtgttttcctttgcttacgattttcccgcatttgtcgacccgaccacgtaaatgtcacttcgaattgagccccgcggactgacccatttttgataaatattctgaaaataggcatttattttgggcgtataaaaaagatttatgccgtgatcagatcctcaacgccaaatcccgttttagcactcaacagcaagtatttgagaatgttgaattgctgtgcgactccgggctttgtgcatggccgccttgagagagggcgagaaaatggcgcaaataaacccttgtggaagtcggggg

SEQ ID NO: 17064 - DNA, 624 bp, Heterodera glycines
ggtgcaacataggtcgtttcgtaaaaactgccaattttactgatttttcgagaaaaagccgtcataacttttcttaaacacaaccaaattaaaaaatcttgatatcatgcaatagctcttggcttgttctattagcctaaaaagtttcagaaaatttcattgagtttccagaaagttctgacccaaaatattaaaaattatgacggatttttctcgaaaaatctgtaaatttggcagtttttacggtgctgtgtcgaagtgtcaaaagtatcgatgatgggtgatcgagagaggcgggtcatttcaggatagaaaattaatttaaataattaaattaattaattcatttataattgaataacaatcttttaataataaatatatttggctctattttagtatacacgacccttcaaaaaaaacgagaccatcaaataatttgacaaatttaatgcaacccaactttttttacaagcatctaaattaagcatccatggtatcatttgatagccctaagcatcctctattttcctgtaaaatttcaaaagatttggttgagcttcaaagaagttggatcttgtaaatttcaaaaattggttccttaaatatttttggctacaactt

SEQ ID NO: 17065 - DNA, 2361 bp, Heterodera glycines
  misc_feature (19)..(19): n is a, c, g, or t
  misc_feature (2250)..(2250): n is a, c, g, or t
  misc_feature (2271)..(2271): n is a, c, g, or t
  misc_feature (2344)..(2344): n is a, c, g, or t
agaccgagaccgaaaaccncgagatccaaaaaaacccgagacttttctcgagtcgagactcgagaccgagactctcgagcatcactagttgttatgatcgtgctgataaagagaaatggggcgacggggatactgtaggagcagccaccgtaaaatggggcgaaattggccgacaaagctgtggtggtgcaagcaaattgctgaacaatttacagaccaacgaagaaaccatggccaacggcatcgacaagaagggctcggcggcattcaaattggatggacacaaatgccaacagcgacaaaagcagaaatagtgggagcaacagcaacattcaaccaatccgtgagtgcaaaatggataatttatagctgttcaaattggcaatggaagccggtttattttcaagttttataaaaatggattttaaaaaaataaatatcgtatgcgtgaaaaattttgaaaaaattttgcagactgccggtagtcctttagccaaaatattaccctgctaagtcatgtcattatgaatgacaacattgaacaaagttaaaaaatcatcttgttcaaaccattaaatttttgtacataaaaacttcagctaatattaattaattattaatgctaaatttattttatttttttacgaaatcttgaaattttaaaacatggtcaaatccggaaaaatttggtatcattcaaccatttttaggcaaatgcctaaaatttgatacgtttaggataagcaatggaaaaacgcgtttttagcttggtttgaggcttctacgaatgacttttataatgcatatttttgtcaatttctggatttttattacttttgagtctatgccctccgattaatatttccgttattcctattaataacccttacttacattgtaaaaatttctttttaaggtcctccaaggcattctgatcgaattattggaatttcgaatcttgacaagatgcagcatctttggacgtcaaggtcagctttaagccgtttgctaattgttcgaatttatcatttttattacagttccccaaatttggacaataaacaccgcgaagaattggcaccgcctcatcaatgttggactccttttggcattcaaaaggtcgaaatcccgtcacaaattgacctttcaacaaattaccaccacgattcttcgctcaatttgaggtataatttttatagcgaaaaaattattattattaattacttatttcatttaaaaaatgaaaaaaattattttatttcatttaaaaaatgaataaagtgagcaaagggatcgcattgacacacttacaaatgcgaaccatcgagaagagaaagatgaggaggaagagctggtcaatttgtacagaaaatttcatctgaacgaaacgaaaacggtggaaaaagcaaagtaattaatgaataattatttttgtatatttttaaaacactttcgattattgattgatcttgttaattaggcactctactattaatgaggatgatgatgatgctgacaatgataatgatgtcggaggattcaatgagtttgttggcccgacatgggctcagatggtcaggcgaaaggtaaagcgcaaatgttttgactgtgctttcattcatttgttttgccattgatcagggctcgcaagtgtccttatttctaagatttgtccttattttcaggcttcccctaaactttttaaattttttctttttaatgatttatttcgctgatttttgagaaaaaaaatccttaaatgaatctttttaagtaaaaatttacataaaaatgttaccaaaacttccaattttcaaaaaaaagaggtgggggggggtcatatcgaagggtaaaagagagaaatttctgaaaaataaatttagctgatttcttaacaaaaacgttaaaaattctttaaaaaatttttcccgcggcgcctatcggcaccgccggacccaaaaaatttctcttaaaaattagcccaaaagtgccaatttatattgctcatttgacccccttttcagtcctatttgcgccaaaagtcccattcatcgccagcaatcaacagaaattgttcgacaaaatcggttgccggcggcaatttgtgaagaatttttggcaaaaaatcgcgcccaatgtccaattgatttgattcatttgttacaaagtgtttatgttgagaaaatgtgtaagaaaatgccaagatactggtcatgtttaattgtaatattattccatgttatatgtttnttttatgtatgttgttagatncggacttttattgtatacatatacataattttacgcatattcccatttttcgaaatggttaaatatttgttangaaagcatcgaaatttt

SEQ ID NO: 17066 - DNA, 3373 bp, Heterodera glycines
  misc_feature (102)..(102): n is a, c, g, or t
  misc_feature (148)..(148): n is a, c, g, or t
tttttgaagaatagcgcacttgtcagcgcctcattcccttttagttcgggaagtcgatcgagaatgagcacgtactccaaaatgctgatcgggggttgtgcncctcctgctggatcggccataacatgtcccgaagttccatacccanaatttgggttcgcattttcataacgcgcgggttggtttctcacgaacaaatttcccgggttttgttgacggtaagcgcgttcttcaaattgcgcataattttgttgatgcgttagccgcggttgataatcggcgttttggcgttgctgcacattcattggccgacgcgccggtgcgaaatgaatttgccctcgctgttcgaggtgttcggcaacaacatttggatgcgccgcaaaattttcttccgcaaagaaatgctgttgaaatgccagttgacgatttatcgccaaattctcttcttgctgacgaatacgtgccgccgcaacatttggggtcgaggtaagatgagggttgaactcccaattatctaccagatccaaatgggcgattcgctggtccaaatttatccccaaattttgttgctggatgtttcgaccattttctcgacccaaattttgttcttgggagttttcgtgaaacaccgaattaccatggctgtccaggagagcactttcatccaattcgcctcgattttgcgcgtccattccgtttcgtggtctcggaatttccaaaagtcgctgatgaattgcttcgggtcctaaaacagacgaaactgatgaaactcgactttggcgatgttggttttcgcgcaatggagcattttcaacgacgaagtgctgttgctgaactcgctgttctccttgcgtatctcctatgccttcatttcgcacttgtatgccaaggtttagcgccctttgtcgcgttaacggcgggcttcgcattaccggcaccattggtgtgtgagaatttgttttctcgttttatggttcaaagctttttgacttagttgtctgcttttccttcactttcgtagggatttgtttccccgtttttgcaaattttcaattcacacgatttcggcgagtggtgataagatgaaaaggatttgtttcctttttaacaaattcggcgatttctcttccactgtctttacgggatttgtttccctcttaaacaaattcggagattctttcttccacgtttgactttagggatttgtttccccgctttacattcaagcactcgtaggatttgtttcccgtttttttttgttgctccttttcgcgctttacaaatttcgaaattgccgttgatctcacctcttttagcaggagcgccacgtcgtacaaagtggagcacgttgtagtccacacaaaacaattaggaacggggaattgtatcccaaaatccaaacacaatccaaacaaaaatccttttacaatcaaaagtccaaacagcgaagaaaattcacaaacatttaaaattaaccaaaaacgagcgaatatccaatctgaatgcaagtgaccaggaaaaaaaaagtcggcagcggaaaacaatcgataatgaaaaggcgggagattcaaaattgagaacgaacggacaaaaataaatgagagggaaatacaattaattaattaagtcaaaaattgggaataaaagaaattaacaatcttatcacagccaaaagggttggaggctcactcattaaagtttggccttgtattcaactgaaacccaaggattatcattttattccaattggttctgagtcaagttgttttgaatttatacctatatcttttaaaactcaagctggtgaagaagcaggttttttaaatccccagacaatgaacattgtacctttttcacgtaaaactaactgttttgaaaatagagaaatagcatttcagcttgacaatgaggtactgatgattgaccaaatatcagcacgcttatcaaagttaaatgtactgagggacgacaatttggaatggaatataaaccctattccacaaatcccaaatcatgcatttcatcatttagttatgtttaatgtcacagatatcaactttcatgcttttattcataatttagtcaaagtaagtgacataacttaccaaattcatcaacatgatactaaattatcttctgctttttccaatacttggcaaaaaacgagggatgaattacagaaggaaatttttggagattggtcttatatttggaaagtaataatcactattatttctttgatttcattgatcgatgttttgttaagatttggaatttttgcactacagatatatctgggaaatggtcgtttaggatcacttcttttaggaaaccaaacaactaggacagctcaaaatataattcaatcattgcctcaatcatccaattcacaaccctcccaatctcccattgaatcttttgacattaaatttgttcaagttaataaaattccatccccttcaaagcaaatgaactctcctcagagagacagcaaaagtgaaactatttgtgaatcactatttatgcttcgttcttatgctgaatttaaagaatttggatttattcctgcaaatttagaccttccgattttcctaattaagattaatggtgttgaatttagagctttagttgacagtgcttctgaaacctcagttggctcagatcgaattctttatttagcaagtgtacccaaaagtgcacaaagggaagttaatatccgattcagatcgcttggaatgaacccactcgaagtttcgggtgattcattagttggaaaaatagttgcatgggctcatttagcaaaaggtgaagatattttaggagaagctcctttattgtttactgatcattcggtttttgaaaacgaatgttttgatttaataattggtgccaatttaatcgatcgttttggtggagtcacaatccttccaaaagaacgaaaaattatttttggttgcactctcataaataatgttagggcgatatctcccatttctcaagtaaatgaaatttcagtagcagaaagtgaacaaagtgtcaaaaaaacggataccaacttcggaacggttcaaaagaaaggggcgttttaagcctcactcccaatccaattcaattgatgaagaaagtggaccaatcacctcgctttgaaaagatttctgttaattttcttggctcaatttcacctaattgctcaattattacatcacgaattaataatggtgaaaacccaagtctggttgatactggagctagcattagtgtagcgccaaaattgatggctcctatttggcaatgcataccatatccaacatttgtcaatgttataagtgcctcgggtcaacacttgaacttatgaaaaagttctgttgttttt

SEQ ID NO: 17067 - DNA, 2173 bp, Heterodera glycines
atagaataaaaatttgtcaagtcaaattcccacattaaaattaataattggttaatttgaagtgtgattcatccatcgttttgctgcccttcgctctcgaatttcaaatttttttttgtgatcacagaatgccaatatcttctcattcattcgctcttcactgcttctccgttctgctgtttcatttgcttttccttttggaattttttgccccctccggcgatgtacgaatggtagaaaaagttgccaaacaaaaccacgtagctgatctccatcagcaagcagtacacataggtcatcggtgctttaattgtgccaaaattaagtgtttttttttcatttctaatcgactgtttttatagtaagaaatttaacgaaaaattcgatgtttgattttaaatttttggaatttggattattaaattaaaatccttttcgtttgttccaatttttgatgaaccaaaaaaaggaaactcactggtgtccacgtgggacccgaccaacagtcgcacaccgacgtgggcaaggatggccaaagtgatcagaaactgggtgatctgagaggtggtcaaacactgggcgaaccaagcgggcagacggatgcggcaggcggccaaaaagtaataggtgtacatgacggcgtgcacactgaagttcagccacacaatccatgtgttgaacgcggtgttgtccacgtaggacatcagaccgtagttgagcgtggccacgtggtggtaccaatgctaaacggggggacaaacgacactcatgtgcggatcagtgggttgatcgttatatcatgtgatagcaagacgtaccaggaacatcaggggcttcttgcgcaggacgatgaagtaagtgtcgcccaactcggcaaatttcgacatgcagaaccaccaggtccacaagccggtgaatccctcgaagaagtcgcgacagttcgtgtacgagctgaccagcccgtaggtgccaatctctctgagcagcgcgtagctggtcaccagacagccggcaatgctaaaagtgaaaattggaaatccttttaaaatttcttaattaaaaaaaatcaaattcaatgaatggaataaaattaaattactcaaaaaaatctaatttctaaggatagaaaagggaaattataataaaataatttgtctcaattagtgcaacttaatcaaaaattaatttaaatgctttaaattgatttattaaaaaataataaatatttgaaaaggcaattctggcacacctaaacatggccaaccaaaggttccacagtctgaggctcagcgtcagttgcatcggtttgcggtccttcatgtaccattgaatgccaaagattgtcaccacatatgccgtggtgatccaaatcgcctgcaaagggaaggaaagcaattagccaaataaaaacaaaaatggttaaaattattctcgggcattggtacttttattctgacaattttttgtgcatttatacatttaacaaatttgttcaaatatatttgttcgcaatttaatgcatttattttagatttaaatttttatatattttattttaatatttattttattccccattttattgcttaccggtccttgggtgtaagcggtgtattctcgagcagccgcatagtcaaacggagaagcgagagaaacgccgaggaaagtgttcggggtggacaattctgctgccgaagtggaagccatttgaactcttgcttaattatctctcattagtgatgctaattaacaattgaaatgacccaggggcaacgccaaaaaattttttttttttgatttatggttcaaattaaaattatgctttctattggcagtctctagaaaagattggcatttcattatccaaatgggcacaattgccaatctcaatcttgagaataacacaaacactaaacgattagcgagtgattggtttagttcaataatttattagcagcgaattttatatggacaaaatttgacagcaaaaatggtcaaatcagtgaactaacaaagcatcagcatatcaaaaaggtgggaagaacaactggtgataaatgtgaatgaaatggtgataaaatgatatgataataaacggggaaaaattaaaaaaaagaaaaaaaaatacaaattaaaagagaaaaaggaggagagagaagaagaatcttatcat

SEQ ID NO: 17068 - DNA, 1733 bp, Heterodera glycines
ttcatcaatctccaaataatcaagaagccatcttttattccgcaaatggtcgttgacgagtttccaaaattgcaaatttattttggcaatttttacaaatgcggtagggcctttatgatcgcacatttttactacttcttggcaaagctcaatgggcctaaatattttattatttttaaaaataaaggtaaattattttaataattattacatttttttctttggttgttgctgatcggccattgtccaacaatttaatttaacaaattaatgaattactgcttcagataggacacactaacctaaaaaaaccgaatagattagatgaattatcaaaatgggagaattaaatgttttagaagttcgcaattataaaaaacggataaaaagaattatttataaaaaagatttgttctggtatattttaaattcaaatttgatgccatttgttcatctcctttctggggtcataattttgccgtttttcaaattataaattttattccatttgttcttttttaggtcataattttgccgttttttaaattcaaatttattcagtttattaatcaaatattattccgtttataattttgccgtttttcacctcttttatggcgtcataattttgccgttaatttattggcgttgacaaaaaaacgaataaaaactaactagatttattctctgccatttttaaattttcctattctatttaatatgtatacctatctattttttcttactttttggttcggtttgtctgagctgatttccatgtccgcatattataatttggctctttttcctgttttataatatgaagattttcaaaaaaaattcactattataataccataaaggaatgggagttagaaattttcaagaaaatagattagagctggaaagaccagtatcgggaccggccaagccggggaatctccgacatcccggtttttgatttatttttttctccatttttgcatatattttcaaaagaggctttgaggctttttgtggttttttgagaaattttgatgatttttgaggcttttggggaaaatcgtcagaatttgttaaatttcatgcttaatttttataaattggcataatgtttggcaatcacttaataatttgggtttttaaagagcatcaaaacgaaaatctcacccacatttttttccagagaaaaagccgttggctttgttttcaatatttttctaaaacccgattctgacatccattttcgcatatttggcaaggaaggatagaataggatttagttaccgtatttcttcgattataagccccggggcttctattgttcaacccccctccaaagggggcttatattcgagggggggggcttttattgttcaacccctttcccttataaattctcaaaattttttgctttttgcataatggtacaatttaaatcttaatctgaaatttttgaattgaaaagatttttcattttttggcccttggaaatttaggcgaatgtttgaaaattcataattcacttctaaatgaatcaattaaagtgcaaaaaagcattaaaaatagagaaaaatctggagcattttatacttttttagaattttctatcttcaaactgaagaagttattacataaatttggaaaaattcgttttttgagaaaaaaaaattaatagcgctgttctgaaaaggtttttgaaaaacacgaaattcttcctctataagcttctg

SEQ ID NO: 17069 - DNA, 1333 bp, Heterodera glycines
agactttgtgccttcgaatgataccaaaaagataggtttagctcgaacctaaacaaagttattgtataaaaacccgggattgtcaattgattggactcataaaatacttttggactcataaaagtcgattggactcataaactgcattagagcctaatttttccaaatgtcaacaaaaatgccaacaaaaagccaatttaaaaaaatttccattttttttgcgccgctccctttgaaatgcaccgccaaaaatcagtccaccacaaattcacaagacattttttgtgcatgtgttatgatgttacaacaacaacaacaatcattggtctcctcaaaaatgatggacactctctctgtttttcttctgttgttcggcgatgttttttggtcgccgttctttacacttttaaaaaaaatgtttgaaaatgtaatttttatttatttttccccatattttttgaaggtcgtcgtcatccatcaaaaaatcatattctctgatcagtcgctcattgaaaacacctctctccacatcttctcagatcatagtaattgctgctgctgcttgtcccgtgcattttgccgaaatttgcgcaatttttttttcgctgtgtgtgaactgttggcgttgtgttggttgcacgccacgcgcgcggatttgatggatgaacgaagggattggggcggggcgggggggggaaagagcacagagaataaaatactctgctgattgactgactgatcaaagatggatgaattttggatttgattgatcaactactcattcattcacttatcactatcactactcttcttaactgtgacaaaaagagggggagattgaagattgatcagaaagctttaaagaaaaaaacaaaaataaattaaataaaataattaatcaaaaatgatggatttgtaaagaacagcagcagagccagggatcaaaggcaatgaatgcggcgactcaattcattttttaaaaattgttttgttttttaatattgcaatttttaataattatttttttttaaaataatgacccgcttttgaaggggttcatcgagatcgggatttgagaatatctcatcctgactcagattaattagtcagaaaggcttttgaagtattcagctccgttaatcagtttatttagcataatggaaccaaaattatcacgatttttgggctattttttggtgcacattttaattgcccaattaacgctcctaaaaatttatggggtctgccaaattttgagattaggtcgtttcccccatcttattttagaagccttctttaaatttgcttacaaaataaaacaattaattataat

SEQ ID NO: 17070 - DNA, 1600 bp, Heterodera glycines
gtccgtgttcaggtcccggtcccgctcaactctagtcaaaactgctttcatagttgttacaaattgaatccagtttgatttcattcacaatggtccaaagaattctccattttttttgttcgcaaaatttttcgaaaaatttcattgctttcaaaaaagttaagccaaaaaatgcgcaaaaaaaaattgcttttacgcccaacatttttgggcttaattttttgaatcttaacaaaaaaaaattttcggaattttacaagattaaagcacttagtgctatcgaatgacgccaatttattaaattcggacaacggcaaagaaattttatcccaaaaatcgagccctccagttactataaaaatggcaataaaaaaggtacacactttcttcattcctcccaagaaaatttttaaaaaattgccaaaacctaagaatttttatgttatatatttaaaaaatataaatgttcgaacaattcgaaattcgggtcgctcgtcgcgttggaagcgcgtgcactgctcgaagacgtggcgcaactgtttgggcgtgtcggtgcgcaagtcggcgatgctcggcctcagccgtccactgccgaccatccagaggatctgttgttgttgtgtttattgttatggttttgataaagtaccattttgggcgccaaaatcaatggcacagttcgtacaaaacggaatttcgtacaaaaaattatttttttttttgaaatttcaagtgaatttttttttgttagaaaattggaaaataataaaaaaaattatataaaattaacttgtacaaattccattgtataaacgaagtggcatgaaattgccaatttcagtcataaaattaatccaatatatttcccaattgaaatttagagagaattttccgagaaaaattcaaaaaaaaaaacaatattaaaaaattatttaagcaacttgttattaaaggcaaaatcattttatgaaacaaataaatgcaatttttgaatcgaatttcaaagaaaaaaataatttctttaaagggaaaattcaaaggcctgaaaattaattcactgaaaaattaaaaaaatgaaattttcgaaaaaatatttgtttttttggcacacctggtcccgattcttgatttcctcgtatggcaatctggaggtgagcagttcgtacacgcatatgccgaaggagtacacgtcggaccgggtgctgtacggctcggggccgtccatgcgaatcacttcaggggcctggaaaaaacggtcaatcaatggcaatttggacacatttttttaaattttacaaataaaacctcgaattttttttcctaaaaaatattcaacaatttttttgcctgaaaattgaacaaaaaaaattttttttttttgctaattttcaagtttttataatagcaatattctatttcgcaagtgccctatctaacaataagtaaaacatagtgccaactttatgccagtaaatttttatgactaatttaaaaaaaattaccccgttttggcatttttcttacaattcggtaaattttaggcatagcaaaaaaatgttttctcagtgtataaacgacattttttttttgttgctttttt

SEQ ID NO: 17071 - DNA, 2118 bp, Heterodera glycines
ttattatgcaattcttcggtggaataaactttacggctctatgtgacccaacaaccacctgctgctgctgccgtagtgcctctggtcatccgcaaatcaattaatatgggcgggcaattaattgcatcactaattcatttatttcatttaacaataatacataaattaataattatgccgtttagtagttttctcattaattagaaaatattacatttattcataattatttaatgattccatttaaaaaagaattactcaaaaatggcacccaaaaaattcatgccaatggagttaatcgtggaaattgtcactttcctccaatttcgtcggcgatgggccaatgttcgcgtgtcgagagcatttgatcactttctgcttgaacaaattggcttctttttgaccaaaacgaactcatcggtctgtgacaccaagcaatatcattcttgaatttatatatttttttaatattttgccattaacccgttggatttgactaacaaaattttacagaattctcggaaataactgtaaaaaataaataaataaggtgcaatttacaaaatgtattaagaaaaaaaaaatttgttttttaaattaagattttttgaattttaaagcctcattaatcccctttccttgcgcttacactataaaattttaaattagggcttaacatttaataataaatttcaggccaagcaatgcttaacagagtttggacaaatggtcaacaatttaccatcaaaacacaagagaaatgtttttaatgaaagcgcgcgtgaattaggtgtaaaattattgtttggaagtgagttttattactaacagttttattgtatttttgaggaattcctccccgactttgctcatatttacataatattgaaataaattatttttgaatttgtactgcagagctttacaggaaatttttagctccattcagcattaatcagcttacaaattaaagaactttgctagtacgactcagctgaaaaaaatgcacaaatttcttaaaaattatgaaaattttaatgcaaaatgttcttttaaaaatggaaattggtttaagaaataattaacaaacaaattcaattcgaattttcttatttcatatattaaaaaataaaaatttgctgcccaatttttttgcccaccattctcagcagaacaactgtctattcctggacaattttgaactttttttttacaaatttttcggggttctgaaatggttatggttgccggaggcctgaaaaaaaattgtgtaccaggcccccgaacctgctagagctctattagatatcatatggttcatccagaaatggattccatacattggacaaaaaattgaatggaggccggacaagaccaatacggtattagaatttaatgaattattattattattatattattgttttaattctaaaatttagatgcaatttttgaatgcaaattaagaattattaaaataataaatttaaatattttttggaaattgtcgaaaagccaaaaagagttttatcagcattatttaaaatatttattaaaaataaatatataattcttaaatttaggacgacatttatctagcaacagctgaacaaattgtacaacttttgatgaccaattatgagggaaaaactgccgaattgatgactcatcatattcaagtaaaaaatgaaattgaacttgcagaaatttgaagacaaatatggccaaaataattccaattaatttttaatttaaaaaaagaaaaaaaaaattttttttcctggtttttgggccttagtttaatttaaattcttttggaaaattttccgaagaatttgttgaattgtattaacaattttttgaataaattttgtcattttacactctaaattttaggctttttagagcctattatccattttgtttttattgcctaatttggcgctttttagagccaaaataatcccgacataatgatgtataatattttaaaactttattttcagcattggtcggaacagattgccaagctcagtactaccgtatggattacttaatttacatatttaaataattaactaaacgactgaaaatttgaataggatgacatgctaattg

SEQ ID NO: 17072 - DNA, 1396 bp, Heterodera glycines
gtgcacattattggtccataatgaaagcacaccacctctgcacattgcatcagctttccatcagtgataaaatgaatctaaaacaaattatttttaccaatttcatttttcagttttatattgtttcaaaaacaaatttgccgtatgattgaggaagaaaaaaattatgttcctttccaacaattctacaaaaggtattcaaaaatatatattcattttgtagaaaataaaaggactctcacccggtgggagttgaacccatggcacttcataccgtggaaagccataacccactgagctacgggtgtgcttttttcacagatttatccatttttgtatcaaattttttcccacactttttgaccatttaagctaataccatcttagacgaaatgcatcgactaaacaaaatgcgtttaacgaaattggatcaatgaattgaagccctttttaacatataattaaagcattcatcttatttaaaattgttactcaacattttgctattttttcatcaattcaaatcaatgaaacgataaatgcacttaatccacctcgagaatcaatctcattaattaggcatgcattttttgctctccgatccgccctgtggcaaaaggaaaagcgagagaacgcaaagaaagttcgcctcggggaggaaaagcgacagcgcactgctgaagaacacggaaacgcaccagagaagcaaagatggagtgtgtgcagagtgaagtgaaaggggaaaagcgagacagtgcggcagcagcatcagacactaagcaaaacgccttggggcacgaagaaaagcgactgatagagaaaaacaaaagcgagagatggagaataaagagggggagagagatggaaaataaaaagagagatagagagaagtagagcagagagagagagatcgagaatagagagagagagaatagagagagagagatagatggagaatagagagagagagatggagaataaagcgagagagatggagaatagagagagagacttttctgtggtgaacatttcgccacagttctgccacaggcataaaaaagagttggcggcggttacggttggcactttgccaaaccaaatgaattcctacaaatggttaattatattaattaggtctgtattttgaggcatatgtttttttgaattttcgtgtaaagaatagccggaactcgcgccgaacggcggcgccgaaacggccctctcccgtctcggcatgtgtaccagggatgggccaaattgaaaaataaaaagcgaaatgcgaaaagcgaaatttgcgaaactgaaaaatgcgaaatgaaaaaaaaagcgaaatgcgaaaagccaaaatatgcgtaaaagaaaaaaagcgaaatgcgaaaagccaaaatatgcgaaa

SEQ ID NO: 17073 - DNA, 2594 bp, Heterodera glycines
tctgagccagttactatgaaaattacttgcgtgaccatgcccagtggagaggggccgaggaatgtccacaaatttgactttggattcaaggaacaccagcggataaggtaagatttttccaattaataaaaataaaataaaaaatagaaaaaatcaaataaaaatcaaaaaaataaataaacaaagaaatttaaaataattatttctaaaaaatttaatgaagcaaaaaaaaaattttttttttttaaagaataaaatgaaaaaataataatttaatgaaacaaaaaaaaacaataaaattaaaaataaagaaagtaaaaaataaatttaaaataattatttaaaaaaaaaattaatgaaacaaacaaaacagaaaaaactaaaaaaataaagaaatttaaaataaaatgagtttaaaatatttatttttaaataatttaattaggcaaaaaaaaaataaagtaaattttaggattgtgaatactgataaattttgccttttttacgcactggcatcgtcgatgaattatttaattatggaccgttttgaatttaatcgatttatgaaaaatattgtgagacagagggatgcagctattgagcttttacgtaattgtggaattgatggaaacgaaattagttatggtgtggagcaattgccgaatgttcagaaatattgggtgggttaaatgaaaaaatgcaaaattaataaatttttcaggatgagatttaccccggaaagtaccgggttgtggcatttgagaagtcagctgatccgcggaaatcgatccgtgttttgtggaaggcccctatgggacgagagaaggtcgtaccgatatttttggagaatggtcactgggatggtctgaagaattatgtctgctttttcaaccgtgggaggaagttctgcgttgaatgtgaatgtttttacgatcaggatgtttatcatacgatggattgccgggcgagatgttattgaatgccatgtgaaaaggagagtggagtgaagattgaatgcccgaagtgtcgacgttacttttacaattgggagtgttataattatcatcagggacatcagacttgcaaatatggaggcgttgcgttatctgtgacaagacttatcgatttaacccgaagaaggaacatgaatgtggtgagacttattgccagctttgtagtgtgagccatgaccccaagcgggggtgttatattatgccgatcgaggagaaggaggaaaaagatgtctacagaattgtagttagggtaagttctacaaataaaatcaacaaaaataagtctttaactccaggatttggagactttgcaggattctatttacaagggggaccagaaggagcatgttattaattatatttcggtgagagttacgtgtacggaatgctgtgatgacaaacgaattgcaaaatttgtggggaggagaggatcaaggattggagcgaggcggagggacatgagccgaccaaggattttgtggagtggattttaactgcttttacgaattacgatacgtacatatttgcacataacgccggacgttttgacggtaatgaaaaaaaattaatctaaatttttaaatcctaaatttttaggtcattttgttttaattacctctgccttaccgggaataacccgctaccgctcattaatggattgaaaatttatgaatttaaagtgcaaaactcgaagaaacattcaaagctgatttggagagactcatgtttattgatgccggtgaagcttgagtcgctgaaggcgacatttaatttggactgtgaggacaagccctttttcccctattattacaacaagaaagaaaattatggaatacgattggaacatctgccaccgatggaggactattcgccgggatatatgaacaaggataaatttataaaattctaaaaatggtaagaaaagaaggacaaaattaacaataaataatttttcaggtacaacgaaaacaaggagacacctttttatttggatgatgaattgaaaaattattgccgaaacgacacggagattttattgctgtcaattattgagtttcgaaggatattgattaacgacattactaagggatttgacccactaccgaggagttgtacgaatgcgggggttgcgatgaatatttttaaggcaatgtttttgttgcggagcagttatcgattgtgccggagaagggatatgagcggtgtgatcgcgccagtgtgatggcaataaagtatttggagtggcggagccagcgggatggaattgagatacggcacacggggaacggacgagaggtcaaagttggaaaatataaattggatggatttattgcgaataacggagctagggacaaatgcatcgaggttatgggatgttacatacatggatgtttgaattgttatgacccggcggcggaactgattggaggaaggacggcccaggaattgaacgatgagactcaggagagattagtggagctacggaagactttggatgtcgaagaagtttgggtatgtttatttgacatttacatttataaattctactttttaggggtgtcaaattgagaaggaattgaa

SEQ ID NO: 17074 - DNA, 1665 bp, Heterodera glycines
attatatccttttcaatttaatttattgaaccgaaaatattgatcaaataccttggaattgttagatgataattataatataagtttattttatatgtttactaaaattcacaaaacttaaataaaatttttaaataattattttttgtaattatttgaaatctttttctaaattaggcattttctataataattctaattatggatggcattaattatttatattctttttaatatcggtttataaaagattttcatatgaaatcaaaaaaacatattttattaataattttatgaataacttaatggttatcagcgtcccgctcaccgataaatcaccaacacggcgcccccaagccattccatgcactgtttgcgccccctttcacatttccgttgttgtactgctccaactccttgctctcccaatttcccccattttgtccaatttcaaagcgatttttttgtgatgggctaatagggccaaattgttcacattttttactttgtggcccaattggccgaatttgtccccctcaaatgtcttccccctttgctccccaatttcgatggtttaattacccaagtttgagataaaatttggtgtgaattttcctgtctgtgctttgtgcggcccaatccgaacgtagtcccgtctcgaacgcccccgaccccccgtgtgctctccccccaacttgacgaagtcctgcaccaacgagcgcaggctattgccggactccaccacgcccacacccgcacacacccgagtccgcattatgcaataatttttttaaataacaatcaattgatttattgtcaatgctctaaaggtgtatatcaagaaaaagatttacttctagtctaacattgcattttttttaaatacaaatattacagtgtattcaaaattttcttattattttaaaaattaaaccaattacaataagaaaaaataatagatataagaaagaaaagagtatcaatctgcaagaatttaaaaggaaattggaaatattatttaaatacaaaatgcaaatattgaaaattaaataaacaattataaaatgcctgaaatccttaaaaaaatacttagagcatgattattgccttgtcaattaactgcaaacaaatgagatcaaaaacgattcttacacttatataaaaattttaaaagataacggtatttatgcaaaaggaataaattatatattaaattctacaaatttataccaattataacgaaattgatgtataaataaacaagttatataacaaattttgcaaatgcctaaatcaaaaataagaagcaatgaagaagccgattaaatactactaattctacaagtttgatattttaagaaatcaaagttttctttaatttattattcttcacaaataaagcttacaaaaaaaccattatatataatccgaagagtgtgttattttaataaaaaaaaaatatctaattaaataatcaaattggtcgatgtgatacaaatttttgaaatttttatccgaaatatagaaaaatgaattgtgataaattttttattagaaaataataataaatattattttaatagaatctgcgacctattaaaacagaaattaaaaagaaaattataaaaaactaaatataagaaaaaataaaaattccatttatcc

SEQ ID NO: 17075 - DNA, 1964 bp, Heterodera glycines
taaaattatctaatttagaaccagaaaaccatttggcgtagtttcagaagcttaaaaatttcatatgtttagtgctttatgataagttttttaagttatcttgcattcaccagttcggtattgcatttcattcactagcgaaatataatttatttgtttctaatttgaacttatcagaaatgttccttgtctttaatagaggttataataaatgataaactaatcttctgttggaaattttacaaaaaaaaaaaaatttgtttttttatgaattttggaatattcattttctataatgctcttttattaaaatatttttcgattcataagttgaaacatttttgtttttattaaaaaatattagatggaaggaaaattcaatatttgtttttcactggtttattgtttatgctgtattcttaggaaattacttatataattgtattatttttattttttattctttatttaaaaagtgcataatagtcaatatattctaattaaatttgtaatttgttatattttatgtttttatcttattttttagttttctttttcggtattgcttatttctctaacgcactgagaagcaacgaaacataaataaacagaacgaagatggtaataatcgttaagagacacaatttgtggtcaagcaaaaaggtgtttttaaaattgaaaaagtcactacaaaaattttaataaattttaaaaaatggattattctataagttttaattttcaataatactttatagtttataaaattaccaagttaatttttgtgtatccggcgccattgattgtagagctcatcgagctttacaaaaatccgctggtaccggcacgcttagcttgggttggccatcgacatggtccggggcgaggctgaggatcctccggcatatgtcccgacacataacgggctccaagtgaatggatcgagaaccggaccgtcactgagtttttttggatcgactcaccacgaaaaaatgctaacgttataaaatttattattatttaaaaattatttattaattgttgatagatttaattttaaaaatttacttttcaattatcttgtcggcattttaaagttttatgaattcttttttttctaaaacagaaaacaaaataaaatccaataaaaaaaaaaattaaaattttgatgtttattagtatttaaagataaagaaatttaataataaaatgtgtattaaattatacaaattttaaaataaatctatttaatttattaaaataattttagacaattgtaaaatatttcaagaacttgtggatgcgaattgcacgaaattggctgatacaaaaataatatttttattctattgtaaaaaaaagataaattggagaattattgagttactttaaattataaaaactaagcaaaattaatgacttttcattccttggtataagaaataaaacaataaaaatgactcatatatttcgacgacgaatatgcaaataatattaaattaaaaaatgttattaaaacaaaacaattcattattttacatatttaagttgaaaatattagctattcaattaatgtcaaggaaatgtgcagacaaatatacaaaatgataaaattaaataaaatattataatgataatttgaaataatataaaataaacctttcaggaattatatttaaattttataataatagtattatattttacatgtttataaaatggaacatatttattaaacattataattctgaataacttagtaaatagctgaatgcctaatatttagtgtttaatgcaattaaaaaccaattataatattagataaaattaaaataaaatcaactaaaaaatatcattttaatatatttttctcttggtcaaaaatatagtttacaatttattcaattaaaaaatataaagagagttataggaagtaatacagggaatttggaaattttggttta

SEQ ID NO: 17076 - DNA, 1880 bp, Heterodera glycines
aggcagtctcgtccgaaagtctcacttttaattccctttcaacaggtggaggaaattgtaaaggccgcagaaaattccaatgataattgtcgtgagtgcgacagtcaatccgccaagtgcatacacaaaagataaattcactccatatagatccgccttgactttgttttccaaagcaatttcctgagcaaagaaaagaaatttttattgttaagttttaaaaagggagcagctcattccccccccccccccccccgcatcgtttccccttgagaattttttaaaatttactaacatagaattaaaaaaaaaaataatttttttataagaaatattagaagaaattgccaataaatttctgcgaatatgcgaggggaaatggaaatgaaatacacccgtttaaaactccctacatactcgaaagtcgaaatcggcagaagagacagtagtaacacaacaaaacaggatgaaaaaaaagagcaacttaaaaggaaaaacaaacttgttcataacttttggtacattgtaaatcattgtgcacaaactttgtcagcacgcaaagtacaagttgaagcggaaaagcgatgaataggagatgaagcgggtggaaaaactgagtcgggcgcaagcgcggaaaggtgtgccaaaaacggatgcccgcgccgtaaagaaggaagcaagcggaacaatgcgcggaaatgcgagagcggacgcaccgcggacgacagtgcggcggacagtggacattgcttgatagggcttaaaatgcaaaatgtgggccactgtcataatttacactaattagctaattagagaatgagtctagcaaatcaaaaattgtgaattttacccagggaaagcagaatgccgaacaaaggttgggcaagagaattgttgttgtttttattcatattgacaaattcggattcttctttgatgccctcctgctgttgctggtggtgcccgtttgattcaaacccagcggatttgaagagttctgccaattggaatgcgtccacctcatcttcctgttgtgttgtaaaaactgttattcaaaaaacatggctaaaaatccaattgcttatttacaaatgtttgagaatttacattttcctgtttttagaagccttacgggaccgggacccagccaaaatttgccgggaatgtgatccggatataatagagatttgattctctgggtcggattcaaatcccggtgccggcaggcgctgtcggggaaattgaattcaattcagaacatttcttatgaataaggacgatcggcctcctgttataaacttgctctaaattgtgacaaaaatatgagcttaaattattgcattcagaagttcaaacgcagactgacttgtcgctgcgcgtccttcaccaacggtgccgtgccaatgccgctcttctgtcgacgcacaagtcgcgcccagaagtgccgcattagtggtgtgccgggctcagtttcaagaagggcacgatgcggcacggagtcaatgatgtagcacagcagctgttggtgaaccaactcgtccgccctggcgaatggcatgcaaatgttggagagtaacagagtggaagaaattcgatggcacacggttcgtcggacggcgaacaaagcaactgctccccgagtgtacaatcttcaaaacagtgcagattttaaggaaattatttttttttgtaaattctctcttaaaacgacccgagaattcttggcaatgccattcggggaccaatgccgcatgtgaacggttatgaataaaatcgcttcccaaaattggtaagggtggcaaaccgctgggggtaaaggtgacagacaacttagctaacggccaatggtgggtaatccctggagacatagttataacgca

SEQ ID NO: 17077 - DNA, 2627 bp, Heterodera glycines
ctctcgaatacaatgaacttggcactttttgtcgaaaggcggcctagataaagcgtacaaaaatgaaattcggattaaaaggttaattcaattggatgattgattatttatttaatgctcaaaatatttctttttatcataccgacattttaaaaatattttacgacctaaactaaaatatgattaaatgattgatcacatttgaatattattaaaagaaaattcctttaaagttgccgacaattttaaaaatttacagctcaaatcaaaatgattgattaccatatgttaaattattcatttgaattttccgacaagaatttttgcaattatttatcctgactaaaaatacaaatggtggatttttcatagattagcattccaacacgaaatggctactcataactgaaaatgtatcatcaaatcgaatatgataaaaaatcgtgactcgtccaaccactctttttagatgtacattgaaaaggttgtaaatttctttgtcatccgagcggacctggggctgaatccctttggtggccatgacacgtgcaggcagactaagggacttgggcaaatgaatcggatgatgccctcccacgcatattcgtttttgcatggtgaatgggtttggtgactccaagatgaactcaaataattgctccaaaagtggtcgaatgaaaatgtactaaaataaaaagttttaaacgaaaataaaattttcaaaaattacattgagaatgggaacggtaatcgcaacgttattcaccaacattgccttttcatttcccccatagcacagatacagtaggactccttttcggaattcatccttcgtcaatccattttcttcacgaagtgaactgaagtccaaattgcccccctcaaattccacttttctcgtcctgcttgccatgttaaatttctgcacaatttcgttcttaattttaaataagaatgataatttaaaaacaaaacaaaattacaattgtttttttagcttttatgtgtgcattttttcgttcattgcgtaaaacttcaaatttccaattaattgcgctgatcattgattttggtcctaaataacaaaaaagtgtttaactgcgattattaccatctgattaccaccatttgagttaaacagacgcataagtgggatgcacatgatctgctccaatagcagctcagttgggagtggtcttgaaattttgggtgttttaacaaaactgtccattttatcaaaaaaaattttgagtaaattgtaaaatgattccgaatttcagttggaatttcaattttgtaaatcttaagtgtgcaagcacgcagggacctaaagtcgaaaaatgggcgtggcttaccatcaataaccggaaagcttattcgattcaaacacccgaccgatttggcaaatcattttaaaaatttttcattctttttgtcacgcctcttctaatccttctctcctcacatttttttccaaataaatattttttaaatttgctgttaaccagggcggttgcttcaattacacaaagctccgtttatcctggcagcaaatgtaatttgcctttcagaacttgaggtttcgcgcttttacataactaattttccgagctgtttaggtgccctgtcgtcttgtgcttcatgggtggcagtgcgctgctcttcaggccaagattggtttaaaatgtttaccaatttaataaacgctgacaaatgatttatttatacattgttaaaagtttgcctactcaaataaatattatcgtatccatacccgttccgttcctcacttattaccgtataccaacccttcctccattatcgatttgccatcgccattatttcgccccctataaattcaatttttttttgctattttatcatttaaaccgcatttcatctctctcttctcttattagatcaaaaaaaaaaaatggaaagccgtcctccaaaacgcccattcccattcactattaatgatattctcaccaccccgccaccacccaaaacattgcagcaaggcttcctcatcaatcagctgcttggtctcaccgttcaggagggtgaaggggccgagagctcatccaacaaaaaattacccagcgaatttgttgaaaagctggagtgcagcgttgaacatgttgccaaatttaactacacgaaagtcaaatcgagcttcgtcatccgggatgtgccagccgatcccgaaagtcttctttcctcgatcttcaaacactgcattgatgaagcaaaaagcgacagccgtgagaagagcagcgaaccaacacaccttggatgcctgatcagcagtgcattattggatggcggtgatgtttttgtacccgtgcgccaaataactgccaacacaatcgacgccattctgaatctgttcaccaaagttgcgcagtcaaaacaacagaaaggtgttacgctatggggagagccgttcaccattgtcataacaacagttgatcgcagcggacttccggtgaagcggcacatcaaagggggcgccagacgtcgtttgacacacgttcagcaccaagtgcatgagaagtgcttgatcaaggtgaagcgtacaacttatttattatatcatcgactgacaatttaagatcaataaccaa

SEQ ID NO: 17078 - DNA, 2077 bp, Heterodera glycines
  misc_feature (15)..(15): n is a, c, g, or t
ggatttctataaatnagaaaaaacattcctaaaaccatatttttgaattcaacccccccccccccctcgtcagaagctaaagagctggctatgcccttgagaaaaaaaaattttttttttttttttgctaaattttctcaagggggggggctgcgaccgatcgaccagcacccctccccccacaacacttactcaccacaaatgcgcttcccatcataaagtcccatccgccaggtcgtggcaaaccgccgtgcatgcacagaaaggtgttggaaatgaccgcgcacagtggcagtttggcgaacaaacaattccatgcctgaaaattttgaaggggaaaaatttgcaatttttttgtgtccaaatttagcagtccaatggcactcacgttgtaaatttgttcggcttggtctggccgctttgcatcgacttcttctttgaacccatacctgtaggggggggagaaatgtgtcaatcgtacaaaagttttttttagaaaatcaaattttttttaatttgaaaattgcaaaaaaaaaattttttttttgaaataaattaagaaaaaaaatctccagcttaaaaaaaatttctgcttgaaaaaatgagggtaagggagaggactgaatgtaaattttgggaacatctttatttttttattttttgaccgtattttgtgatcactacgacccgtattttatgatcattactgatcagagtgcccccccccaaaaaaaaaacccgtccatgaaaactcactcaaaattagttgattctatctcgtgatttcccctgacaacaaaaattttgtcgcaaaacagcagtttgaatgagatgagcaaagaggccacttcgagactgtaaaggccgcggtccacaaagtctccgagcaccagcaaattgcacttgggtgaatgcagttggagcagacgcgactcaacgttggctttggtaaagaatctgcagggaatggacaagagttgtttttttttacattagttgccatatatatatatatatatatatatatatatataccgtatatgctctaattatagtccagtctctattaatcccgcagtctccaattatcccccagtctacgaggtgttttgaaaaataatccctctatcataatcccccagtctctaattatcctcccttttatgaggaggttgaaaaataatccaccatgggctataattagaacatatacggtatatatgtatatacatatatatgattttgtaagaaatttttaagggccggcatttcgcatttcggcaaaaaaaaaaaattaggtccaaaattccggtttcgcaaagtgccggaatgctttgatcagtttttgcacatcccactactcactacaccaaattcggacaccaattttacgatgggtgaaggggggggggcagcggttaattttttgaacggggtcaaaccacataaatcgacgacaccttttttcaatcatcgaaacattgattaacctgtgttttcactctcaaatttaattcatttttttgaagactaatgaaatatgcaaaaaaaaaatgtgctaaattttcaataaattccccattgtttcatgaaaacttttcatttttggggggaggggaattccccccttcgctcctcctgactacaggccacagattcgaaatgatgaattacaaaattggcaaaaaaaaatcacagtaaaaagccaggcaaattgccgtggatgtcgccaaaaatgtagcagggggcctccaatgacacacgtgccggctcctgaaaagtgtgacaatgtttacatatgttagcgaatgatgagcgttgtccgtccgttcagccaaagagggaacacaggacaaaatctcgtggacggtgtttttttgaaaaatttttaattcttcaaaaaatttttaaaaaatcgctgaaatttttttttctaaaacttttctcttaaaagatttctaagtttatatatatatatattttttttaatttctgcgtgttggagattttggggtgcacccgaaaaggaaattttgttgaaatgtggccaaaaaaaagggacacaaatggcaacatg

SEQ ID NO: 17079 - DNA, 237 bp, Heterodera glycines
cccccccccctgcctacgcccttagtcagaggtgaggtaaaagaaattgataacggtagaaggaatgaaaaaaggggggggggggaaagccgggggcaaagtccaacgggaagataataaataattgatgcatacatacaaaatgcaaaaagaaatttacaaatgtaattgcgcctatgtccaaaatcggttaaatatatctttaaataaatgataaattttatgaatttgatgctt

SEQ ID NO: 17080 - DNA, 1473 bp, Heterodera glycines
ttgaaaaatacacccctaaaatcaattttttgtcattttttatatattttcaaaaaaaaaaaaaatttgtttgccgaaagtaaccaatcgattcttaattttcattggagaactttcaatttataaaataatttattggaaaaaagattaattttaccttcaaacacttgaaaggtatttgatttgcgattgcgctggcgaaaatgataaaaatgagattttttggaatttttatgcaaaaatcgcctcccatcgattcgtctactcaacgattcgtctattcaacgattcgtctattatacgattcgtctactcagccaaaatgtgacgattcgtctactcggtcaaatgtcaacgattcgtctattatacgattcgtctactcgacgattcgtctactcagccaaaatgcgacgattcgtctactcctccaaaaaagttcgaaaacccggattcgaactcgaacaaactttaaagccattttccggggtttcctacttaaaaaagcagtttccatagtctgacgactttcttgtgcgttttggtgccttcagtagctgctgttgttcaattagtgttcgaatttatttcatttgcttaaaatgagaaaattgatttaaaataggttgaattaataaattatgaaaaaacgttgaaagtagcaaacataaaatatatttgatactttaagcccttggtctgtttcgggtctaaatgtatgtcatagagtcataacaagtccagcgtccaagaaaaatgtaaaaattttcatattcacattgatttttgttcataaataatttatatttgttttagtagacgaatcgtcactttttggctgagtagacgaatcgtgtaatagacgaatcgtggctttttggctgagtagacgaatcgtcactttttggctgagtagacgaatcgtcgagtagacgaatcataggcgcgcctatgggtacgccccactgtgcagagaaaagcctagtactatctcgtcgtttctctttttctttgtaatttctctctccttggcgtactatctcttcattttaattatgtaaaaaacaacatttacttcattctgtttaactttttttctacttgttaaatccacaccaaattttacatactgatagagaaaaaaattctgcataatgtaatacagccattttatgttttatacaatttttcaaaagatatatataaaacatgaaaatgcattactttttctctctttttggcgtactatttttacatctctaacacacaaaaaacatcaaattcgtaaatgctaaaaattttggttatatggataaaaaatcactttggacatttagaatcaatagagaaattaatagttttagcatttttgctgaaaacagcagtttaggacttgagttataacgtgataaaaatttgaaaatatcacaaatgttttctgggatgtcaaattgcttagcattcgcttagaaa

SEQ ID NO: 17081 - DNA, 841 bp, Heterodera glycines
tcagtgggcccaaataacccctaaaatcatatttttggaagatttttgtcgaaaaaattttttcactcagaaatcatggtcacacccctgtggtcccaaattacaaaatcacttttaattctataacttttttcaaaaaagtgataaaaagctaaaataacatttataaaatagagcaaaaaattgcggattttttgagtttattatttttataaaatactttttcagaacagagttctgaatttttttctgaaaaatcgaatttttccagaaattctggaataacttatttattttggaagatagaaattccaaatgaatctcataaaattctcctaattttttgctatttttcaaactttattccactaaatttgatcaaaaacgaagagagttatgaattttcgaattttcactggattttccggggctcaaattttgacgatttttcaaaatttgtaaccaccttccaaaaagtctgaaaccaaaaataaagtatatattcgtcttcagcaccataaattaggccataaaaatgcattttggctaatttaggagcaaaaaaatttttcatgaaatgcaaaaccatggggtcccccctatggttttgaatttcaaaatcacaattaattttataactttttttagactcgtgataatgagatgatataaagcacattatatagggcttaaaattccctacaaaaattgtctaagaagattttttgctaaaatcaactcctgccaagttatacacccaaaactgaaataagccctaatttccggaaaattttctatttcccaaaaaattttgaaaaatttttctgaaaatgccaccaat

SEQ ID NO: 17082 - DNA, 1520 bp, Heterodera glycines
  misc_feature (10)..(10): n is a, c, g, or t
  misc_feature (20)..(20): n is a, c, g, or t
ctcaaatttntgacgatttnttgaaaaaattttaaacacttaccaaaaagtctgaaaccaaaaataaagtatattttcgagttcagcaccttaaattaggccataaaaatgcattttggctaatttaggagcaaaaaaatttttcatgaaatgcaaaaccatggggtcccccctatggttttgaatttcaaaatcacaattaatttcataactttttttaaactcgtgataaaaacatgagataaagcacattagattgggcttaaaattctctacaaaaaagctcttagacgattttttgataaaatcaacccctgcatagttataagtcataaagtgaaataagcgccaaatttcggaaattttctatttccaaaaaaaatttgaaaaatttttctgaaagtgccaccaatcgatagagcgcgaaaaacggttgcttgaaagtggtcttggttttcccgagaaaaatctgcaaaaaataataaaattcaaaaacggaaaattttcgagggggcctagctcgaaaatttttgaaaattttcgaaatccgaaaacatggatggatgcagctcgtcgagctgcacaaaaaagtaattatcaccatcccgctcagatcaaaacacagcgagttattcgcaaaattcaaaaaatgccaaaattggttttcaaaattcgccgaagtgtacaggccaggcctttgatgctagggcctagctcaagaagaaaaaaatttcccaaacattccaacttagtcgcctcccagcagaagttttttgctccgggttcccagaaaaaagttttggcacaaaaactgcatgcatttttccccaaaaagccatttcagcgccgctggcgctcagttggcctccggaccggaatgccattatttttcctggatgcgcctcaaaaagttgcttaagcaatgtcaacatttcaggtccccccgattagccgttcccgagattttagttttagcaatgagttgccttgttattctaaagtatataaactagcgggtgcgtgaaccgtcggatctgggctgggaaaaagcgcttcgcgctttgggagcttcgctacctagcctgatcatgacttatagggagagaaggttccaaagaggaacaacaaatgtgagaagaggtacaacggtgattaaaagaggtacaaaagtaaatagaagaggtacaacagtgattaaaagaggtacaacagtgattaaaagtggtacaacagtgattagtaaattcattaaattaaaatgaaaatattttttaacaaatttaattaaaaaaatacatgaaattctatcaattaaaaaaataattaatttaaacttataaaatttatttatcaaaaaaaaattaaattaaatataattttttatttattaactcaacaaaatattttaaattaattaaaatcattgaaaataacgtaaaaatgcacagaaaaataatgttacaccgtccggattcgaacctgcccccccccctcaaaatgatgcctcagaatccccaatg

SEQ ID NO: 17083 - DNA, 279 bp, Heterodera glycines
tataataacgctgcggacatctacatttttgaattgaaaaaaaaattggtaattactctttctttttctccatattgaccatcatactcatactccccccaccctttctcctccttcattattttttcctttccttctccaaccctctcctccctctcttgatagtttaaactgaaggcgggaaacgacaatctgatccccatcaagctagcttctgcaggtcctgctcgagcggccgcccggggatcgatccccgatctagtaacatagatgacaccg

SEQ ID NO: 17084 - DNA, 3412 bp, Heterodera glycines
  misc_feature (36)..(36): n is a, c, g, or t
  misc_feature (40)..(40): n is a, c, g, or t
  misc_feature (49)..(49): n is a, c, g, or t
  misc_feature (3400)..(3400): n is a, c, g, or t
ttagtcgaatgtttgccggatacgtggtcagcgacnccgnaaaaccctnggaaacatgtttaatgacttaaaaaaactaaattttttttcgaaaaatgatttttatttgtttccttgcattaagctggtttgttgaaccgaaaatgcgtaactcgaaagtttaaaatttcgacttttgttcgagttcatgttcggagttcggaattgctcaaaattattgttgtattcgtgatcagctttctctaaaaccccttaaaacatgttttatggtcttaaaataaaaataaaaaattcaaaaatggagggacaaactgaacttctaccaaaatatgattttccttgtgtattaatgaatttgaatttttgctcgagttcgggtccaagtttcggaattcagcaaaacaaatgtcatattcgtgatcagcgtcacaaataaccccagaaactgactttctttgaaaatttcaggggggggtctgaaaacagaaaagtaccctttttcgaatatttttgcttggcatcccaaatattccttgtgagactcacctcaaaaatgttttcaaatgtaaacggcgcatcaggaagaggcaatggcggtgctgcggcaacaaattgttgaacatttcctgaaaatgtactaattatcttaacgatttcggtaaatttccaaatctttccccatagggcctaatttcatcgcttcattcaagaccaattatctaaccaaaaattagtagtttattcaaaatatggccaaaagattccgattttcccttcccatggcggcagctaagccaccagcctgttcagcagtccccaattccccgtttttgttaaagcgcgccgcaaattaattgaaaatcgcttgccttcttgaagagcggctgcatgtgggttaacaacactttgtgctgcggtgccagaagcggacagttggtcaaccgtgtccatttttttgtaatattttaacaaatgtctgacagaaaaaaaaaattaatttaaaagagctgaattttttgaagggggtgaacttaaaagcccagatttgcatgtgccgacagatcggtttttccatttttgaaatacgggggattttaaaggatttaatctgaacaaatatggtatcattccatagctcttgatgagctttgagcacaggacaattgaacacttcagtaccggataaaacgaaaaaaacattttgacagaaaagtgaatggtggggcgagacagagggggggggaagcattctgacaggcgattgactacgagggctgtccaaacccaaagtactgaaaggtgcttttacaccgggactcaattttttgtccttttgttagaattttggtcctggtttcggaattttgcaaaaccgagatcatgttcgtgatcagcgccataaattattctagaaataccttttatttgaaaatttcaggggggggtctcaaaacagaaaagtaccctcagtttcaccaatttttggtttcgaatattttctcccatgattttttggtcctattatatttcactgggactaaagttgccccggtgctcagatggcgtcggttcgactttgaccaaactcattaagagattttgaatgataccaaatgtagcaaaacagttattcatcattaagaaattagctttgaacctcccaaagaattaaaatggtgacaaatatcgaaaatggggaggagacgcagaaaggcgggtggacacaaatgtgaaggcaaagaaaaattcagagagaaggaagagatataacggagaaagagagaaaggaaagagagatgaaaggcagtgagaaaggaaagagatgaaatgcagtgagagatagagagaggagagaaaagaaagagatgaaatgcagtgagagatagagagagagagagagaaaagaaagaatgcagtgagagatagagagagagagagaaaagaaagatggcgagataaatagtaaagacaaacacccaaaatatttgtgtttacgcaatgacaaagcacctgttgttgttttctttggttggtctttaaaaagtgcttatgcttaggaaatgaatacccgcaggccatttaaattagagagagcaaagagagagaaagaaagatgggttagggagagaaagaatggttgaaacagaaaggaagacagagagagatagagagagccaaatagagagagagagcaaaaggactaagggagagaataaagcacataaattattataataaataactagggctgctaattttatgtaagaaaatttgcgaattatgtaaataaaatatgtataaaaaatgctaaaatatgtatgaaatatgtacaaaaatcctcaaatatgtaggaaaatatgtaaataaaatttttttaatggttattttttggaaaaaaattcttcgtaaaaagtgaaataggcacaaaatgcaataaaaatgaccaaaataggcttagaatcacatttgaatattttacaaattaatttttgatatatcattttttgaaaaaaatcgattttttagggatacattttcaaacaaaattttttaattttttacaaaaaatttctataaattctcaaaaatcctcaaaatatgtaaaaaaatgaaaaatatgtacgaaaaattgcgaaatatgtacaaaaaagtccaaaatatgtataaaaatatgtacatatttaatatgtagaaaaatccgaaatatgtaaataaataacttttgttcgcaaacacaaaaaagaaagtgtttttcctactaattaaggctatagagaatccaggaaaaaaaacatgtatttacataaaattagcagccctagccatcaaaaaccaacttattatcgataataatgaatatttcacgtctcaaaatgataatttcagtgcactagatataaaatttctgaagtggaaaacttgtttaatggctttcacaattttaacacaaattattaatattttggcccatcaattaagttaatttaatcactcaaaaatggacatgataattaattatttgtgagatcgcgtcttgtgctgttgcggttgcttctcgccgcttcctcctttgccgttttcatctcgcggctcgcctctgccccggcaattggccaccagtttctggaactcctcctccaatgtccgtcgtgcgctgtcactgtccggaatttgtaaaatgtgtgccatggcgggcacatcaaacgttacatcgagggccttaaaatattgcgaaattaggataattttcccttttgctaccattagtgcgccatggacgcccgagtcgacggcatttacaacaaacgcgccaaggccaatttcttccagccatttaatgacccgctcatttgaccagaccattagatctaatttgcaatcgccaattattaattgcatntcattgaattcc

SEQ ID NO: 17085 - DNA, 2869 bp, Heterodera glycines
gggtaaacccaactcatccatatccaattcatccatagcacgatacgagtcgtcgccgtggcatttaatgtcacgactaagaccgtacaaccaaaaaatgtccacggccaagaccggcataatcaaaaataccacggccaagaccacgtaagcagaaaatgccatgccacgacgatgactcgcaatgtatgagtttggtctatggatgagttgggggtgactcgatcatttcgtttttttgacaattacatttttcttttactttagaatcaatttgcttgataaattggcaaattcgtccaaaggtaccaacatcgtattcagtgccgcttttcaacagaacatcccgcttggtcaaatttatgttggatttgccggtggttcggcttctcctcaggcgaatgccaacgacggcgtttcgtccgttgcttcagatcagcgactacactttgagaatggcagcgagatcagtttcgatcaatttgtcaacagtgcgctcagaggagagacatcggtcaaaggtggcactgatcaggccaataatcacttggccaattgtgcagcaaatggagtaaaaagagaaatgttggtgccggacgcgacatttatggacaaacttcgggttgcgatacgaaacatcatacaagaatcgccgcccaatagcaaatggaatacattctcgagaatcaggcagaatttgtacttcgatataatttgtcaggttcatctttttcaattgtttctttgccatttggtgttcatcctttgcttttcaggtggtttcggtccatgtgccaattgctggtttgtccgtgacttatctgcgcgtttgtgatggcacaaaagccgatatgtgagtttattgcttattgtcagatcgatgaaaattaattcgaaagctcatgaaatttagggaaaaaaatttactgcattaattttttgtttttgtcccctaattccagtgaagacggacattctttttactccggcgtttcctttcgtgaaactcacgccgtgcaaagtcaattgtttcccgaagaagcgatcaccgacgagtgcaaagaatttatctacttaattggatgttggggtgggtgaacattttgcactttcattccatgtcatttctttttcagatacattttgcactacagccatgggcattgaggtgaaaactacacagtttctaggggtcgtcataaatggcctctgccggacggagggtggcggccatcgtaataatcggggaaatggtcaaagggatagaagggaggagggaaaagagaaaacgaacgcaaaataagacaccaaattctcttaacaaatttcattcaaaatttcgatttttttttcttgcggcgactatttttcgtaagcgctaatgtaaaaactgtgaggcctttttaatctaagccaagtcgaaagaaggggatggccttcttaaccaaagtggggggggggaaggataaattaaatcgcaagtgaagggaaaaaagaaacaattgaaataattaaaaagaattttttaatgttttcaggctggtgacattatcaaaattttcaacgccaaaatgaaaacgcgccaagacaacgttattcatttctcgttgcacgggcacacgccgaacagcgaaggacgatacaaaagggccatcgaatgtgtgaggaaagcgaagcggcgaattggggacgaaatggcaatgaacggagggactgaaaatgagggtgatgggacgggtgggaaaaggacgcgacagagcgaagacagttgagaataatgtgatggatataacgcaattgagccaaattggaacggaattttggacgttttgaatttgcattacccaaaaagtggcgtttttaagtgatgccttttatacattaaaatatatttgttttacatatttatgaattaaacccttcgagaataaagcgcaaacaaaattggaagaatttcctgaagagcatttcggctttttcgttgaatctgtcctggaggacttcgcctatcatgtacagaaagggcgcctccaactgttggaagtcgtcaaatttaatgccattcacttttgagcggtgcattttgccgatggacgaaaggcgttggcatgccgaggacgcgtcggcgggcgtttgctcgacggcactgataacctcgtcaaacacctgacaaatgaggggtcattcttgaaaatcaaaaattttcagtgacttaacctcctccccccccccctcattagcttatttccctatggctcactttcaaataattggaggcaattgtctcgaaggcgggctctgaacactcgggcgaatcgatgtccagcccattcagcttgtgatagcgctctttcgcttcagggcacatttttaaataccttaaaaataaggtgaataaaaaccttatttttacccctctctctctctctatcctccctctctctctcactcaattgttccttcattctcctctccctctctctctctcactcaattgttccttcattctcctctccctctctcttcctctcccctctctttcaccctttctctctaacttctctccgtctctctctcttcccctctcctctctttcaccctttctctctaacttctctccgtctctctctcttcccctctcctctctttcaccctttctctctaacttctctccgtctctctctcttcccctctcctctctttcaccctttctctctaacttctctccgtctctctctcttcccctctcctctctttcaccctttctctctaacttctctccgtctctctctcttcccctctcctctctttcaccctttctctctaacttctctctcttcccctttccctctcccctctctctccgtct

SEQ ID NO: 17086 - DNA, 1921 bp, Heterodera glycines
ttggtcctgaaattcatttttttttttaaaaagtcatgcataatcttggcgttttgttggatttttttttaaatcagaaaacatacactaagttccaagcggcacgcttggcactgcccgctgagttggattcgctgctccggcatcggcatcagcgtggacggcggcgtgaacatggcggatgcgggcggcaacgaggcacgcttcagtgacgagggcgaacggccaggcactggaaaacacaaaaagatttttaaaaaattttaaaaacttcaatcgccaatttccctatgaaaatagtgtgtcaaaaatgtattagaggctaaatgtcattttgatcaggccgatgcctacaactagttgcagatgaattatgccacggcacgatcagtaaaattgatcagctcatgggccggaagccaggtcccgaacaatttatccggctaatcagagcatcacactccggccagttcagatcagtccagagctgatcagctcaaaaatctgatccggagtaatcccggactcggccaactatccgaaaataatccggctgatcgaaacataatgcttcggccagatcagattagcccaaaattgatcagctaatcatgtccctgaatctcggactcggccaatcgtccgactgtaattgaccagagagtacaccgacgcatgcccagcaatgatcatttgttcagaggagttgatcagcgagttagctacgtatgtcccataaatcccggcctgtgccacccttaaatcccagtcggtgttcggtgggccacctttgaaaatggcatcctgctgatgctgcagttgttgttgctgttgcgtgttcatgcatgccgacgccgccgcggcgttcatctgctgctgctggtggtggtgttgttgttgctgctgttgatggcacatcatttgttgttgctgatgctggagttgtagttgttgctgttgttgcagcatcatcatgttcatgtttgggttgttggtggtcatgcccggtggcattgtgccgtagggcgatggcattcccattattgccccgggcggtagtgccgacgcagctgatggcatgccgccgccaccgccggggaacggaccgggcacaccgccctcgcacggtgacctgacaccgaccagcggactgtgcagtgacgggggcgccggaggcatgcccatgccggcagcagctgctgaaaatgcggaaaaattcaaaaatgagtatgccaaaaattggggtttggaaagcgtgccgggggatcaaagccgggaacccccaaacaaaacaaaaaatagtgagacggcgcacaattaaatttagacaccaaataaatttataaagtctaaaaaacgagtcgggcgcaaaatctcaaaatttgcgaggtcccaaaatataatgacaaatttatgaatttttgtcccataaaatttaagtgagttagccctgaaaattagcgataccccaaaaatttgaagtgttagccccccccccccacctccctcgccccatcaggggccagaatttttttacaaaaatttctcgctttttggtataatattttgatttttttgtttaatttcgcaaaatcttccgacatttaccaataaattttttgggttttcgccgaaaaatttagagaggtcttaaaagttttcgataatcgatgcaccaatcacttggtgagttgctgccgtgccccaaactacgtttcaccccccgaaaatttatttaaaaaattcgaaattgaatttttctttaagaattcctaagattttttatttgagagttcgcacccgcggccatagccgcctcgtgctgttgtcgctgttgttccagcgccgctttctcggccgcctcgcgtgccctgcgcgctttggccgactccttcttcggcttgccgtcctttgttgttgg

SEQ ID NO: 17087 - DNA, 2191 bp, Heterodera glycines
ttagtttctatgccatatttttctttcgtcgccttaacccttcttcgtctttcatttgtcttaccttactaactttttgctttgaccgtctctcttacactctcttttcccattcttttctctaaccttcggattgacatttagtttctatgccacattttctttcgtcgccttaaggctgcttcttcttcctcttcctttttttcactcgtctgaccatctttttgctttgtccgtctctcttacactcttttctcccgtccttttctctgattttaacaaaaaaaaaatcggtcggattaaaatgttgtctgtccattcgcttaaatcttgcgttctctctgtctctcactttaaacagtctctcggacagtggcagtcatcactttctttgatttgtgctgcttgggcttgggcttgggctgggcgagggcacagaaagtggggcaagtcgacgtgtcgcatcgctacgcattttctccacacaaattatacgtggccatcccatcgcatcgacccgtcccctttccatcgcattttattcgggaattttcttccttctcgtcagcacagatgacccatttaaatttgattttctttatttgatttgtcactcactgttttcaattagtattttatgaaaacaagttggactaatttgggcatattttaattatacatgttacaactcgggcttcaacctgtgcatacgggccttaatttcttcctcagatgcaacataatagcaattttttcattttgatagtaagacatttaaaaaaaggcttggatttttgcataagaatgcttcctgggttttttgtctagaaaatccaggttcgagagggctctatttttgctaatgtaaccccattttttgatttttttttaggtctcccgaattaaaatttcattgctttcgctttgaattccttttttaattgaaaaatgaaatttagatttcaaacttgatacttgttgttgttgaacatatttctatacctcacagttcgtccacattttgactttcggacaaaaacaaaagacaaaaaacggtggcaatgatctccaggagggcaattattatttgggccattgctttgttggcattagcaggtatactggctgaattggcaccatttgatggcattttaattgatgtgccaccaaattttcagcgatttcgcccaacttttccaccgctgacaaaggagttgacgctgtcgatgcggcggacgaaatcattgacgacccaaaagtggaggtgccgaagaacggcgttggcaaaggcaccgatgaccaaacagtgcagcgggaggaggaggccatcaaactggagggactatcagtggccgagttcaagcagctcagggagagtgcggagaagcatcaattccaagccgaggtccgcgcgaaaatggaccaccaaatggggctgtttggaattggaggatggggcctttttttgacaagtcgacatcgaaaatttctccgaaatgtgaccccaaaaagcctgacattcacttctttccgcgatcgagtctcatgaattgcggactttaactcgagaaaagcattgagggttgaacaaatttgtgagaaaaagtccccaaaaattttaggtcctgaaaacagtgccgattgttttttttaattagcaattttactactttggtttcccgcccccccccccctccatttgcgcttttcaatgttgttttttaattttgttttctattttttttgtcaataggtccaatatttaccaataatatggtaggatagatagagaatcactgttttatagatccatttttttcttggattaaccgcaaaatccaatttttttttttaatttttgatatagcccaaccccattccgttcaggtcaaccggatgatgaagctgatcatcaattcattgtaccggaacaaggagattttcctccgtgagctcatctccaacgcgtcggatgccctggacaaaattcggctcatttcgctgacaaattcgacagcacttgcggccaccgaagaattgtccatcaaaattaaggcaaaaaattttcaaaattttccaaaaaaatttgtttggcgtttaggcagacaaagaaaatcacattttgcacatcaccgacacgggcattgggatgacgaagcaggacatgatcaacaacttgggcacaattgca

SEQ ID NO: 17088 - DNA, 2482 bp, Heterodera glycines
  misc_feature (5)..(5): n is a, c, g, or t
  misc_feature (2317)..(2318): n is a, c, g, or t
  misc_feature (2389)..(2390): n is a, c, g, or t
  misc_feature (2398)..(2398): n is a, c, g, or t
  misc_feature (2401)..(2401): n is a, c, g, or t
ctagnctcgaaaatttttgaaaattttacatcatgtagtctccattcgatagcatttaaaatgctctacaaaaatgttctaagacaatttttcgctaaaatcaacccctgacgagttatggacccgggactcaaatgtcccgctcaggccaaaaattttttctatttccgggaaaaaatcgaaatttttccgaaaaaaataccagtcgatagagctcgaaaaactatgttttggaagtggtctccgtttctctgggaaaaatcgttaaaaaatcctaaaattcaaaaacccgaaaaccgttttttaggcctagctcgaaaaattttcaaaattttcgaaattttaaaacttggttggatagcctttcaaatactacacatttttgctcagaaacaatttttcggtcaaagcaacccctggcgagttattcgcctggtactgaagtgtacattttgagcacacttcaattagccaagcgtgcaggccagggggtggctctaataaaaaaataaaaaataccagcatgtagaggacagttgtggggagtgccctctcagcgggcactttttgattcgggttttagaaaaaaagttaggggccctaaactgcaagaaaaagtgagaaatcggtccccgggactcagtcgtccgcgctgaatttttctctatagttttcccggatgctcctcaaaaagttgtaagacccttccactactttcagggcgctcccggccttcggccgggagaaaatggttttagcaacgaaactccttgtcaatataacgtatatattaaaattaaaatatttaataatttggagaagaaaatgcaatattttttatttgatttgtataaaataatcagtcattgtgaaatttcaaattgtttcatttcagcctatttttattattttctaaattttttatatttaattttttttcaaataaattgcaatcactaatatataaaaagcctttaaaaaactcttcaattgccgcgtcagtatttttggcaattgagtttggcgggtctggcaggctaaaatgcacacagcttaagttaaagcagctgtgcagccgccaatcaatgtcggctagggcttcaagctctgctactttatgctgtgccagagtaataatgccttgcggattgtacatttggtctttgtacttgttccacaattctatggcattactcggctggccatagaccaggatgctcacaaagagccatctcatctgatctgaccagcgcgacagagctgcctccgccagagttttgtcccaaattttgtcgtcttcaagaagaccatgcattattgcagcctcagtgaatgaggtacaaagcaacccattaaccatcttaagatggtctgggtctccaggaaagtgacgcataagtgaatagagcgcgaacctttccgggtccgatgggggtacaggaacaattcggccgataggtggccttttaatttgctgccttttgtacaggacccatttgtcctttgcccatcggaaccgctctgggactttttcgaaaagaatgtccttaaactttggatcattcttccactcattttgccattgtttccaataggctgaacactgcgtttctggcagttcgccttgctggatttgttgagctttgctcaccagctggaaagccctatatacaatgggctgttggtttggcaaatgaattgccaatttgacaacatgatgcgaaagacgggcaaatggcattgaatgaacaatggcatatgcttccgttgcaccacgaaagttcatcttggcatattgagccggctcgtcaattttgattttattgccggactcttctttgcactcgacataacaatgtcctggccctttaaaagggtacttgagtgcgtatttaatatttgctttgttaccatatgcaaacagtacattatggtgtactcggtaacgtagcagaatataaggattatacggcacgacatgtgagttgtcgtatattaggccgtttacctctaattgggcaccaccatcagttggtgaaggccggaaatacatcgcgggcctgtccgggcgcaaaatcgtacattttgagtaaggggctgggaaccccttcttgcaccgcccgtaaattgggtcgctaggaccacaccaactgtcactgcatctgtgcagttgcatatgcattgtttcgcggatttcgcgatgcatttttgcaatgggcgtgtcgtcatctttatcaggcaaagatggaatgtgcgcccatatgtattcctgaatgacatatggaactgcgtccaggtctgtttgcgccacatgtgnngcatgtgggcctcctcggccttggaactccattgattcaccgaaaccaaggatttgttccgaagaactttnntgtcatanagntcttctcggaactcagcgattttgctgctccagacacgcatccacatgtcaaaacggtcagtaaatatttgaaccgttttt

SEQ ID NO: 17089 - DNA, 2511 bp, Heterodera glycines
ccggatcaggttcccaaaaatataattctaatcatgaatccgtgtcgggtgcattcccgaaaagtgtttgtaaggcttttaagttttacggaatgtttttggaaatgtcttttcccgggcctcgaaaaaaagtctgtcccgcgcatcgcaaattgaaacgaacccgcgaaactctatggaaaaagggcgattcccacagcaaattgctgctgtcattgtaattggcactccattctctcgtcctcctttcgttttctctcgcctttttaagcatcgttttcagttttttgtcaaattttttgcgcagcgattcttccaaagtgccaaaattagccttataattgcgcaatttgtgcccattttgcaattgtattttaaaaatataataattttgatttctgagttcctcgtcaaaaaataacactgaacatttgtgcagataaagcaatacttcatttattaatgttgagacattaaacgttggtttaaatacggggaattgctgacccaacaaaggctcttcagctttaaatttgaaaaaattaattaatttcctaaaaataataatttaattttaaacctacagtatgccaaacaacattatattctaccgtaattccttccttactttttgcatagactttgaataaatattcgtacacaatgtttgtgtatttgtgaaatctttcgcattttgtccgccatttttcttccccaatttcctccccttttttgtcacaatgccaattgtgtcgcatcaaatacaaaatgcctaagtaagtctcatattctttcgccaaaaaattttgcttttcttcgagagtggcttcttgggccatgacaaaatccttcaatttaccatctctttccaaatcgcagcaaaattgttcaaaataggactgacctctaacaaattctacaaataggcgctctccggtctgaaaatattcgtttcaataaatattcctttcgtcggtggaaattaccaaaaagtacgattcaaacgccagctgttcaatcatcaatgaaccgtcattattggttatcagaattgggaagtgtagtgaccctttctccgctcttttgagcatttccgccaaaaatgtgtcaaaattgtgccgaaatgcgtagttggcattttgaagtgccatttcaacaaatattccctggaacttttccttgtgatgattgttgtccaaatgtgctccataattcagcctctgctcattgtacagtttcaattcgtaatttctcacaaaaagtttgtccaatttgtgcccttttccgctggcaaagtttgggcagaagtaaaagttccaaattggtgccagactttgcaccacttccgtcaccaaacaaattgtgaaagttttgccaaaataaaactgtggcttcaccacgggaagtccggcgtacactctgaacaaatattcgtacagaatgtccaaatatttgcggaattttcggcattccctctgctcatactcctcaaaatcggtcccaattttggcacaatgccaatgctttctcatgaaaaaaataaggcccaattttttctcatagttttgctccaaaatttccttctccgactgattataatcgaatttttcatcagccaaaaaatgctcaaattttgatgatcccttcacaaatgcgagcagcacattgtcatcattaaactgtaaaattaatttaatttgaattaaattaaatccttaccaatggttttgcctcttttgctgttgaaattaatgaaatggagaaaattaatagaaaaaccaatttggaataattcatttgctaaatgtgaaaatttttcccggtcccgttatttttggacaaaccaccgggaccgggagtcccggaaaaacgggagtcccggtcccaggatcccacccgggtccattttccaagtcccggcaccggcaatttaaaaattccggaggttctagtaaatttactggattttgttgtggaggggattttatatgtgaattttaaataaacataacaaataaatgccatttatcaataaaattttattagtttttggcaaaaatgaaaataatttaaagatttttgcaaatgcaatgaaagaaattaaaaaaaaagaaaataaatgaaatgaaatgatacgtattgtacttatttttttcattaatatttctttgatgaattttaataaaacaccctgaaaaatggcaagaaaatattttttcgatcactcattttaaaaatgtcaaaaaattttcagaagagagagagcgaaaagagagaagcagacaaaaaaacagaaatagttcattatttagcgcgaattgagcattattttaaataattttgtattttattattatttttttaatttaattatgctttttcattgtccattcattggagtcaattcgtcgaatagttttacgcgtgactatggcgacccgatgatgctctgaatttgtaaaagtataaataaaatggctcaaaaaaataaaaaatggaattatgtgtaca

SEQ ID NO: 17090 - DNA, 1845 bp, Heterodera glycines
aaattctattaggaaaaatacaaaaatgcaatacctgactttaccctcggcagcaattcgtttcttcatatttcccactaaatggaaaaagcagaactgcacacgacagagtggcaacattgtacggacagcagcaaccacggcctgctcgaagcccaacgatatagtttcaggtgcaaaattcggccatttttggacaattagttgaagcatccgtgtgtaaatcatttcacattttgaagtgagaaggcagtacgcaatcggaaaaacccatttatcacgtctaaaaagacaacaacaaaaaacgtgaaaacataggcttttactttgcgagaacataaatttggctgaacaaaggcggcgccaaactgaaagtgccatctgcgtagacatttttcataataccgctccattccgaagttgaagaacgacaaatatcaaaattcttaatatggaaatttgtgaaatttaatggtttttattttttcacctttgcggtccagcctgtccctgaatttgaaaaacgccggtatatgccaacaaaaaattctcctcgtcattctctgttcgattgtacattctgtacgagggcggcaattccaatgcgtccaaactgagtggtgcagcaggtggtacatcttcgtcatgacgaacatgttttataacctaaagcaaaggaaaaaaaaaaatcaaattttggcataaaaatttgcaaacgttgaccttttttgtcgcagctttggtcggaaaagcagccaacacgggggttgctgtttctgcaatacttgcgcacgaatagtagccggcgcttcgcacgtctcaactgcacgccgcttgagctgggtcacacgtcgctgacactccacttgtgcggcgctcatgtcgcatgtgtggcttctaattatttgaggacattaccattaatatcagtgtgaaggcgccctaaatttgaaaaatagtctttattttatttttgcatacacctttgcatttgtcgttaggcccaaaaaactcgcatcgccaatacttccgaagtccatcttcactgagttggtgaagaacgtaaagtgcaccctcatgttacagcttctgcttgtttcgctttgtctttaataatcaagtaaataatctttatttttgaatttacatattatttaatatattatgaacgaatttaatttatgaattattgaaatttttgtaaaaaaattattatcactacgaaaccccgtactgacgaaatcacttctgacgaaatcacatgttaccgcataccggctatagagcagagaacggaaatttcgacttttagactcgattttaaattttcaggacagggctaaacattttttgactctattgcacttctcacgaccataaaaaaaagacacgaccataaaatttttttgcaagtttagtgaaccataactttttcaagaagcatccaaattaaacattcttacaagggaaccacccgaactgtaagtcggaaaatgcatatgtattatataccattggatagagcagggtcgacttctattgtgaatttttaatattgcgttcccataggaagaaatcaaaaaggtatgaggcctcaaaaatcgaaattttggctgtgttttcacttaaaattggtggctcagttggttaaattcgcatttttgaagatcgggttcacatccaacataaaaataaataaattttaattactatataatataattaaatagttttaaaaaatcattttttagactaaaaaagtgtacaataattgttctttagtaaaaataagcaaaaataataataaaagtaaaggttgggaattgatagaaagtgaaaaaagct

SEQ ID NO: 17091 - DNA, 1966 bp, Heterodera glycines
agtcagcatctcgaggatagattctgccgtaaaatgttcgtttgatagaagttgagcaattaaaagtaaaatttcatctgcactttcttgtgtgttaattagccacattgatgaaaaatcattgatgcttattggatgtttaattattttcactacaataaaaagaagcaattcattgtcatttagcgttaggtcggtttgttgatcatattgctgtgcattttgatgattcaaatttgtcgtcgtttctttatttgttgaccgtatgaatttatcaagttcccgtcgagcttgtgaatttgggcaatttgttttgtaatttttatgtgatggcgtttcacgaaagcttttccgctcgtttttttggggttgctgactgtcatggctttgtgcttgaagatgttcaagaatttgttgaagactaccttgaatttgggacaataaaaattgcagctggtcattagttgctgctgtagttgcgggcgggtctacgatttctttgtctttggaattactcgattcaatatttgcatgttcgagcgatgttcttatatattctagcctttgtgaatatgttggttcattatttatttgtcctcgatgtgatgattctggcaaatctatgcttgcttttttcgtgagcctccgttgtacttggaccgtttctatatttgcttctaattgcattggatctgcatatgtttcctgtatatttgcttgttgatttctcattcgtagttgttcgttttcactatttatttccatgttggatgcttctacatttggaacttctttgtcagctttttctgctcccgataatatttcgtttgacggttgcaaatttggtgatttgtcgtttattagttctgcatctaatgctttcttgttcccttgttcttcatgcttttctatatttgtttctgcatgtgtttgttcagaacttatttgttgtgaacatgatgtttcgttgtttcttggttttacatttggtgattgtatatttgtcttgttgtggtcagggtctaatgcatgcttattgactggttttgattgttttttaatttgaaaacgaacaggtgccctataatataatttgttctattgaaaatggttaaacttatacctattttcaggcaatatgagacgacgctttgatggcgattcttgccaatgctggtctggtgaataattgcttctgcaattctttcttgagtttgttaatttacgatggtctgatcgcactctaaggtccttatctttgcttgtgtttcttagatataggtcttgccttttcgagctatcgttgaattctgcgcgttctggagattgtgatcttcggcgatgttttgagcggtctgtccattcccgtccttggcgctgtttttctgcccgctctggagattgtgatcttcggcgatgttttgagcggtctgtccattcccgtccttggcgctgtttttctactgcaatatgccgatgatctttattatactcttgccgtttctcagatggtgatggaagagtgttgtttttagaatggtaatttgccgcatttgagtccgactcatttccccaacaaggtaattctttatctctaatttctggctcaatttctccttcttctaattcatcagaggccattgtcttttcatattgatcatgcacattaatctctttcgaaaatgaactttgtttttcaccataagataatgcattttcattattaatttctttattttgtcttgtcattgcttgatcatttaaccgagattgtatctctttttctgagtccacagagtcgtttttatgtcgctttggagattcaccggatgaaattgacattgatatttcatcttgaaataatgcttcttcttcattagtttcattattttctcttatcattgcctgagcattaaaccgtatctcttcttctgagtacatgattgagtcgtttttctgtcgattt

SEQ ID NO: 17092 - DNA, 1834 bp, Heterodera glycines
tttagcagacaacaggatgagcttcacggccgaaaacctttagaaatttttaatttgtaattgcaaaaataaccggtaaaatgtttgaggaaaattataattaaatttgcacccataatttccgattttttcctacatatttggtacatattttcaagttttggtacatatataatacatatttggcaaatttatttacatatttatgtacatattctggccatttttcgtacataaaaattgcagccctaataataacatatcaaaaaaaacacatatgaattatattgtatttaatttaaatattcaactatacgctgttgagaatgtgctccacttaccaagggtgcgaaaaaatgcatttgtaaaataaattgttatacatacaagaacaataaaaaaagaaacaattagaaaataaatgaataaaaataattataattaaaatgattaaactaatcataaaataaatgaaataaattgttaaataaaataataaattttcaagtataatttaataaattttataatataagtagtttaataatgaattgttaaatggcttgtttcaacttaaaaaattaagggtagagagttaagaataatattttgcttcataattttttttttgaagtttgactgcataaaattcaaaaataaaaattgaaaaatccaattgcattaattaaataaaattattttatagaattttaaaatattgcttcctgattctcaacaaaccaaaacaaacggaattcaaaaccgagttctttgttcaataatttacagcacttaccttcaaaaataaataacaaaatttcaattaatgttccttataaatatcaaaaaaaaaatttcatatattcgggcaaaattgtcaaaaaaaactattataaaaaatattaaaattatgcatatgaaatacaataaatttttaattcaaattttataataaaatatgatttaacaatttacttgcgtaatttaagaaacggcccctgaaactcgacttgttgtaagatggaatttttttaatttgttttttttaaagatattaaggctttttactgttcacccaccttttttcgttatttttaaataaaaaagaaaaacgaatgccaaaaaattcattaaactgcaaaaattgtagaaacttaaaatcttagcactaattataaattaataaaagttttattttaattatgatggtttaaaaagaatgtaattaattcttataataagggattatttttaatataaaatttaaattattacataaacaataatgaaaatttatagaaattggattataaaaacttatggtttacaataataacatcgatctcccttttgggagcatgcacacggacattgttgccgtccgttgcccgagagaaggccgtgtataattgaccatgggtaaatacttccctttcctggtaaatgccgacagtgcggattgtttggccctgacctttttgaatggtcatagcgaatgcaggcttaattgggaactgcaaacgcgcgtattttagcccaccaggcgttttgtcctcgaagatattgcgagatctttcaaggaaacacctcacttggccaccaatagcattgctattgattgattacacgaccgacaaggtgatcatcgccaagttcttcgaggacaatgcgtgtgccattgatcagcccttccctatcacttttgttgataaggatgacaacaacgcttccgacctttagttgcagacagtggtgaggcatcccagagtctgtgcgtctgttttatgctgccacttcggactcgatctcatcgatgtccaatgggcgatcgtca

SEQ ID NO: 17093 - DNA, 1077 bp, Heterodera glycines
taaaaaaaaatgacacatattacttgaaataaaatgaaaagaagctaaattatcataaaaatgcatgcacaaattgggtagaaagaaagaagtaatttccatgctaaattttgtaatagatgaatatatgatgtgaataaaataaagaaataacactcaaaaaattttaaaaatataaaaataatattgctttatgatttactctatttatatatgattgttataaagcactcgcgtatacaatcttttaaacttaattaattcagacaaatataagaattttttgggtttctgacaagcttaaaataaaagtcaaataaacttcttttttcgaacctaaatgcatgtttaaaacgcaataaatagaacttttattcgaggaataatttattcaatgcaagtctcttttctcactattaataatttatgtaaattttcaaattcttatttagaacaaaaatacaatatcatggatttagaattaaataaaaattcaatgttatttgaatttgcattttaattataattatgtacaataaaaataattgtttaagaattaaaaattttccgaaaattttaccggcaatcggttgtctacaatttcattattattagaatggttaaaatttaaaaaattctgatttgtttttaaaaagcgatgaataatctaacaaatgatcaattattattatacttatggttggggaccagtgaaaatatacatatgagtcatcgaaaaaattttggttttagaataaaaacactctttttaataaacctaaacacatataacccaaaattaaatgtcaagaataagaaaaaatctattaaagcattttaataattttcaaatttgcagtgggaattttataatattcaatatctttacaaaatgccaaaaatcgcataattaagaaaaaatttatgacaaaggcatagcaataaaaatatatttatacattcagtgcaaaatgtttcggttaaggagcaaataaaagaaaaatatatatgtatatcaaaaaagttaaaaaacaaattttatgtatattctaatccaataaatttcaataatttttt

SEQ ID NO: 17094 - DNA, 1421 bp, Heterodera glycines
aattatcaatatcgcccggcgcaggacaggatcctgcgctagcattgagcaggatcccagtccgcaatcctgcatattttgggatttgcaggattaatcctgccggatcttgtcctgtaaaaaattttgaatgccagtcctgccactggagccgcaaatttgatttttatgcaggattcagcaggcggtcagccgccgttttcgtaccgccgttttcgtacggggacgttttcgtaccgccgttttcgtacggggacgttttcgtaccgcaggggggtcgttttcgtaccgccgttttcgtacgggggacattttcgtacgagttcttgtacaagcgtcagattcaaatagaaaaacttaagaactaataaaaccaaaatttatcattttttgtttcccattcataaaattttgtagaaaattcataactttataataataacaaaatccgggacaaactaggtcgcatctcataatttcggaaaataccagcgagaaaattgttaaggttttcgggattgacattggcattgtcataattgtgatcattttgagcgacaatattgttattgatatcgttatagagttggacgagtcagagaatccgtgcgtcggcatcgcgatacttctttttctgtgcaccatcatgcaccaatttatcattatttagttttgtttaattacttgctgctggttcatttgtagttaataaaagcttaactgtcaaaacattaaaagtaattttaaaaaattaacaaattatttgaatgcaatttttttttgcatatccactcgtacgaaaacggcggtacgaaaatggcggtacgaaaacgtcctggcccggagaatccgtgcgtcggcttcgcgatactaaaaagtttcaaatttagagatgtaaaatctaaaatgtttccaaaaaggtaacaaaattaaaccaaatcagtattgagataaataattttaaaatcaaaaattgttgttaaaaaataaataaataaatttggagatgaatttttgagaaatttttgatttctcaggggtgtatttttgaaaattttcgggtcgattcttaggggtgtattttttgaaaaaaatttttaagtcgcttcttaggggtatatttttcgtttttattgcatttttattagacaaattttgggaaaaacccaaaaatagttgaaaaaaaacatggttttcgtgcatttcaggtcacggggagctcaggaaaaaataatgaaaacctataaatcgtatccctaccgttgaattgattttatttttttttgaaaaatgtgcaactaaattattaaaaaattctatttatcccccctggcacataaatggagactgggagattatttttcaacctagttcgaaaggggtatataattggagaccggcagattaatggagactggcac

SEQ ID NO: 17095 - DNA, 1895 bp, Heterodera glycines
  misc_feature (1806)..(1806): n is a, c, g, or t
aacagctttcgcctattctcaagtgttggcagttgcacgcccacgttcgattttggtatggaattggcggaaggctgcatttaaaaaatacccttttggtgaaatatttcacattcacaaagttttttggaaatgtgccgcaaaaaatgttaaaaatctgatttagtgatcccgaatgtactgaaatttatgaaaatataataatagaatacatttttatttgtttattcataaaaaataaaaaagtcatcagaagggcgagaaccacttactctgacgactatcagataaatgtcgtagagtaagtgacaaaatatatggatgatcacatgaattaaaaaaagacaaaatatgtgaaaataaataataaataaattgaggtcaaagtcaaatgaggtcgaaataccaaatcacttagaaatttgttacattctaactttcccggtcttacagattaccctagtgaacttttaagttttattttaaattgatttaaagaatttgtttttattagttctttatcgagttgattccacaattttgttaccctcccagcaaagggaatgaattttttgcccagtttgtattttgtgttaaatctgtaaaaggggatgttaaagcgtgctgatggattaaaaatagaaaatagtttcagatctgttcggccataagcaattttatgcgccatgaacagatcaaacagctttcgcctattctcaagtgttggcagttgcaggtattctaatcgattttggtatggaattggcggaaggctgcatttaaaaaatacccttttggtgaaatatttcacattcacaaagttttttggaaatgtgccgcaaaaaatgttaaaaatctgatttagtgatcccgaatgtactgaaatttatgaaaatataataatagaatacatttttatttgtttattcataaaaaataaaaaagtcatcagaagggcgagaaccacttactctgacgactatcagataaatgtcgtagagtaagtgacaaaatatatggatgatcacatgaattaaaaaaagacaaaatatgtgaaaataaataataaataaattgaggtcaaagtcaaatgaggtcgaaataccaaatcacttagaaatttgttacattctaactttcccggtcttacagattaccctagtgaacttttaagttttattttaaattgatttaaagaatttgtttttattagttctttatcgagttgattccacaattttgttaccctcccagcaaagggaatgaattttttgccagtttgtattttgtgttaaatctataaaaggggatgtcaaagcgtgttgatggattaaaaatagaaaatagtttcagatctgttcggccataagcaattttatgtgccatgaacagatcgaataagtttcgcctattctcaagtgttggcagttgcaggtattctaatcgattttggtatggaattggcggaaggctgcatttaaaaaatacccttttggtgaaatatttttgacacttttcgattttttaaatatttttttgaagagacggattccaaacctccggagcgtattccaataagggcctaatataagttttgtataacgtaatccaaatcttagacgatttggatttaattattcgaaacaaggaacgcatacgtaaatacgcattccttgttatttggttaatatgatcggaaaattgtaatttgttatcaatgtttactcctaaatccctaattgtatccacagcatttattgtattcccatcaaatttgtatgtttcttttgggttttttgaacccanaatataatacaaaagttttttgaattgaaacttttatttgccatttatgtacccattcgaataaattatgcaatgctttatgcataatt

SEQ ID NO: 17096 - DNA, 1325 bp, Heterodera glycines
tttttaagcttctcaggtcataactttttttactcttaaagaattttttagaaattttgcaggataatagaaaacacttagggctatcgaaaaataccaagattataaaatttgatccattatagacgaaattatgaataattttctgtcttaaaattttccatttgatggttttttgactaacgcccattttgatggtttttgactaatgtcccagcaccgttccttctttcatttgaaattaaaagaataaaaacataaaaaaatatattttctttacaagaatagaacaacaattaaggcaataattggcgtcgcgggtaaaaatgaacttgaaattactaatgttaaaaaatattgtatatttattaaaaattatttttttttgtcattttttcgcgatttaatcattgaaacaatctaacagctaacattaaatttttgaaatattttttaaaattttcaattaaatatcttttataagaaaaggcctactattatggtcatgagcaaaagattaacgaatcaattgacggccgcttatcggcggaacctgcagaggtaaaacgactcattttctcgagaatattacttaatacgggaaaagcgtatgattgtgttttaatgatcacttctagtttttaaagaaaatattcagaatttatcatcattcatcatttaatattattgaaaaaataaaatttcaagaaataaaaaacaaaattcatacttaaaaacggacaatgttttacatgctgagaataaatataaattatcttctacttcattatttttcgagaattgtcaacttatttattcatattttttaaagataaattaaataatatggtaatgaaacaaagaaagaaaggtataatttttgattttgactaaatttgttaaaattttaataaatttttaaaatatattaaaataaacgaaaatttaaaatatacataatttaatgaatataagaataaatattaatatgaattttgctcgatctctacctaatattgacaaaataagtctctgaacatgagttaaagttttagttattataattaaagtaaatttttatatttacgcatatagaataaatagctaagaatataaaaaattcttcaaacctaaataaaactcaattcatagttgtcaaaaaattaaatatttgggaaaaatgaatttgattaaatatcaaaatgttaaattctttcatttgcattacgaataatctattttaattaaaacagagattgttattttaattaaaaaacttatttttacaagttttgaaattacatctaataataaattattatttt

SEQ ID NO: 17097 - DNA, 1579 bp, Heterodera glycines
taaataaatgagacaataaaagtccaacaattaattgttgtgaacaaacgtatgacaaatcacacaaaattaaatatttttgaaattagaatataatccttcatacatcgtgaaaacaaatgcctttacaaatacatatcaacacaaaaaataattttaatacaaaaaagattgatttggattcgggattcggatcttgaactcttaaaaacaacattgtgaaattacttaggaaagttattgttggtggcactaatgccaggttgcgagatgagcacaatgaagcaattgtttaaacaataagcagtgaaattcagcatgaaattaaaaatattaattattggggcagcttctttcactaaaatcataaaaattgtaattatttcaatgccaaaaaggtgtcattttcctttagtattcccaggtcaaattagttttttttccaaatcaaacgccaaaatttaaattctctcctttctcagtctcttttctctgtctctctcatctctttgttctccgactcccactctgtctccctccctccctccttatctctcctttctgtctctttgctctctgactctctccaccactctctcgctgcatccttcgaaatgaacacaaaacgacgctgacccgtcggacgaccaatggcattatctcagcacatcttttgccattgccccatccaatgggcacttccctcgtcttccacattccacttcatcttcatattttcctttacatattagttttttttcctccaatttatgtttttagctcaatgtattgcagtttacagataataagactcatcttatttttttataaaaacaaattattgataaattccatatgcaattattttttatacttaatcatgaaaataaaaataaataaatatatttattaataaaaaaaattaaattgaaaaaataaaatcaaaattattcttcttcgagccggaaaacttaagaaaacagaagggtttgcgcatgagctgaagatatagaaaaaaatatttttaataagatcttccaaaagcttaaaatttatactaagaattacatgtactaagaaaatatcacttcgtcctgcgagataatttgtgcttatatttatagaaaaatatataatagcaaaagaaaacccaattcaaataaattaatttaaaatttgtaaaaaccaaaatttaacactacctttaatttgcatcggaaacaataattaataaaaaaaattttattgcaaaatttatgtaaatagattaaaaagactatacttgtatcaaaaatgttattcttacagctggtactcaagtacaaaaaaacataaatttaattaagttacagaccaatcatcttattattaataaattctcttgatttagtagccttgaataaattaccaaatgaactgtgacagaaattgcttaaattatatatgaaaaattctgaaattgtttaaattatatttgaaaaaataactgaattgttaaattatttttgaaaaaataatcacctattccaaataatgtagacgaaaatgaagcaaaacattgaaacacaaagagaaagca

SEQ ID NO: 17098 - DNA, 2626 bp, Heterodera glycines
atttaggacatcgacaaattaagaaaaaatttggttttgagtcaaagagtgttggtttatgaggaggaggaggaatagaagggtgagcacgaagtggacgaaggagaggaggacgaggaggaactgttcaaggaagacgcagatgatgacggagagggggaagaggacgacggaagggaggaagagggggaggaatcagtcgccactaacgaagacgacgaagaagaatggttgatgctgactgacgaagaggaggaggaaaatgaagatttcggagaagagtcgaacggagaagaaatgtcggaaggaaagggggaggaggaggagcgaatggcggagagattcggtggagaagagcagcgacaggacgaggaagaggaggaggtgctttacttgtgactctgcacttttatatatgtgtttcgttagagagaactaataattgttttctttttaatttataacttatctttaatttattatgttttttgtttttgttctgacatttcgtattaaaattttgatttttttattctgtccgataaatgaggttttacaattctaaatgatactatgttccccaaatgccaccgggaatattacttaaaaacctagaaatatcccctgaaaggatctgaaattttttgacaaataaatccggttagaaggttcatgtccatatttattaacaatcgaaaggaaaattaacggcctatcaaagtaaattcacataacaataattggtgaggtaaaatggcgtagaaacaagcttaacattgtgcggattaagtttattcaacatccaattcaatgtttttattgtcagtcttttgcaaattctcgtagagtcgagcacccaattcgcaggcaaccaacggacccgaattttgacgaacaaagcgcatgagcaacaacccgtccagaccgagcagctcatcctcaaactgtcggacattccatccctcttaaaaagggataataattcaaaattgaggaaaaaactgaccaatttcggtcgggacaagtttaaggaatgatttggcactgtaaagttggaacggacgcataagacgggcgatgaaaaggaaggaattgaagacagtcaggaagatcaaagcgaggtaccaaaagtaaaggaacaggaaaaccttcaacgaccaaaggaaaattgaatgattgtgaaaaattgtacaacaccttttcattgatcatattcacgctcaacacacatcgaacttcgctaaaattcataaattttaattcaaattctaagacattttagagaacctgagaagaccgccgtccgtatgtcccaaaaaatcccttccaaattcgcagtaggaaatgcggggaaagtaagtgaattcctcttgccatccgttgttacgccaaatggattcgatcagcttttgcgagggaatcaattattattttacaaatctttcaaaattactgtaatgccccatcgccaattttcataaccgacgaaatgagtgaggaaaaacaactgggcaccattgacaaagatgttcataagctttaaacaatggcaaataaagaagagactaaaatggagttcactttgaacagcaaatacatgaagcaggcacaacagcccaagccattgccacggcttttggaagtctgtggaaaagtaaaatgaaaataaaatgaaattgtacaaaataccccgaagtatgtattcggccgcctcagtcagcttttgctcgcgtttttctccagaagaaagtcgcgattcccaacaaagttcgttgacatggttaaaatcgacatctgaaaaagcagtttctggcgaacattgctcagtcgtcaccgggtattcgttgtccaagacgccagaggaaaaacggaatccgaatcagaagagcctggacgattatgacgaagggaacccactgaagaagagaacgaacataagcaattggtggcaaaaagacaacctcacctggtagtaatggacataaattttggtgctctggtcattgtccccattgaaatggtaatactttacatatgtgccagtcacataacagtactggtgaacgaattcaacccatgcctctgaaagggtgcggggagtgcagtttatggaatttacaaaaaaaaaaaaagagaacctgaaaactcattgggcaccatgcaattgatcggtttcccgatgtaatcgacggtgccggtgatgaacatgaacaatgccaacagcatgggagtgtaacggtaacagagtcggtctacgaagtcatctaattggactcgtacaggactgaaaaccaatggaaagggaagagaaaaagtatgaaaatgtaaaatgacataacgtacatgagaattttgattactgcatcaataacaggctgcattttaaaatgggtcgaacaaatatacctaaatagacagacaatcagattgtatctactaaatccactacatgtcacaagctcctcaaaatctattgtcaattgtcattttggtattaatgcagtttgggtcccatattttggtcaaatttttcaacaattttttttggttacccgaccgggtctcagacccggatacccggttttttcactacccggggcccggttttttgaaaatccaatacccg

SEQ ID NO: 17099 - DNA, 2342 bp, Heterodera glycines
  misc_feature (203)..(203): n is a, c, g, or t
ttgtgccgtccacatttttgtgccgtccccacatttccttattgtgccgtcccccatttttccccattgtgccgtccccatttctgtgccgtcccccatttgtgccgtcccacattttgtgccgtcccccattttccccccattgtgccgtccccatttctgtgccgtcccccattttgtgccgttcccccatttcccccttncggtttaattacccaagtttgaggactccaataaagtgtattttgaatcgctttcccgcctcacttgacccccagcaattccaccatccccgattgaccgccaagcgtccacccccaatcgccccagctctcgccaaatccggaccgttgccagccaacaaacacccattcagtaccgaccgctcaatctccgaccgactccccgactcgccctcttcatcccgtccccccccccatttgtccatcaccgattgcggaaaggacaggaggaggaaggaatgtcaatcgtctgagcaattttttaagaatatttttgttaatttttctttaaattttcaattacaatgggggtatcaattatgtaatttttgatttaattgtgaaagtgtgttcaatttattatttttttcagtattaaaaatgaaaaaaatagaacatttcattatctgcaaatcctcttggcgtttattagcatcgctgatggtgtaaattagagaccggacgggcccgggggcccggcgggcttttaccgggcgtcccggtcccgttttttttttttggaaaaaacgggcccgggatgcccggtaaaaacggctttttttgaacgggcggcccgctccggtcaatcaattttcgaagcccggtccggtcccgggcccggtcaatttgaccgggctaaaacgggcttaaattccgccagcgaaactgcccaaaatttgaaaatttaaataattattttggcgaaatgtctttaattcaaaaatttcaagatagaactttggatttttgaaatttttgggcaatttcaactgttaaaaagaccccaaaatccatacgaaattgaacaaaattttcataactttctttttacaaaaaaaaatttcaaatttcatgaaaaaccaaaaattttcttaataaatttcattaaaagtcaaagtttttcttcagcgtcgcctagtacaaaaagctaaatttttttctaaaatgtagctcaaaatagcaaagttttgtcattttttcgtgtaaatctgttaacaaaccaaactcaaattttcaaaaatttacccggcggcctgtcggcactgccggacccccccccccccaatgttcgtcaaaatctttttgaaaaaatgcaccttaaaattcttttgaagagtaaaaaaggtcgatttacaatggcttgacatttctaagttaaaataaaggactataaaattttttcgaatttttaatcaaaattccaaaaattttgaaaaaagcccggtcccgtacgggcgcccggtcaaaattttggaccgggcccgggacgcccggtaaaacgggctttttttgaacgggcggcccgccccggtcaattttcgaagcccggtcccgggcccggtcccggttccgggctctagtaattattcattatctaattagcagtctttatttaaatttcataattattctaaaacaattactgttgtgtgcaggtaacagttcgcaatttccgctttttttgcacacgtatagtatctgtagcataactgtgcgacgaaaaaactgtttacacgctgaaaataattaaaagataaattttgaaataaaatattaaacaaatactaatttaaaaatcaaatttctttcgtcaaaaagtgcttgtgccataacaataccttcacaactaggaatgctgtaatatttgaaagaagacaatccgccacagatgagacactttttgatttcactttttgggattttctccatttttggcattttgggtgaatggaaaaattttaataattaaattttttgaagaaaagataatgtaaaattaattatgcaaatattgtatttattcataatttctttagttgattttttccttatggattggtttttgtgtgtgtatattttatatattatctaatattggaaaattataaattataaggcgattaaaattacaaatgcattacaatagttaaattttgcgctattgatttgattttcttgtattccctaattttgttaaaacatatcccttatattaaaaaatgtccaaattttacattatatgatcaatgatggaattttcggccaattcatttctttttaatattttttatatgctttaaatttttaaaatgatgatta

SEQ ID NO: 17100 - DNA, 2475 bp, Heterodera glycines
ttgaaagtccggcgattggtccagggaagttgacttccaattcgtcattcgttgaccacaattgtgcttcatgattcgtcatttcagacttggcgaatgggcattcctggtgaatggccatttgtttgcagatccgcttgttgaccggtggaaattccttctcgatggtgacgaacttatcggccaaaagattagtgtaataacgctccgtggtgcgttttacggagcaatgccatgcaaaggtgatctgctcgggcttgatgattttttgcgaagagctcaattgccaggttgagccattgagcagtgagtgatggcgggggacggcaaaaaggtgaatttttcgtgctcttgagtttccaaatcgtgcttacgcgatctggggcgtgtcgttggctctttcgtggtctgcgttctcgccctggtgacgtactggattcgtgtccttgctctcgttgcaagggttgttcgctgagtcgtcgtcgtggtccagtgagtgccattgcagaagacgcagggtgaaggcggatccctcaaccctgcttgtactgtgcgatcccggattggcatattttaggcgcttgagttggccttagtcccctctgttgtgacctccgcggttgcggcctgttgtggttcattcgctgctgaacctcctcaatcgttgaggacatgtgaatttgtttccggaaacgtgctgtcagctgcatgctcgagtgcttttgcttgaattggtgacgtagtttaacgtccttatggaccaattgtcgttgcttgttggacgtcatttcggaccctgaccgtcggatggattgctagtttagcgtcttttcggacaatggttgcttggtggccggtgctttgctagtttaacgtcattgcggacttgtggcagccgggtgattatcgtttcggacagttgttgatggcttaggctagtttaacgtcattgcggacgattgttggtgattagcttagtttaacgtcttctcggacgagtgctgttggcatggtgtcttactgattgttgccgagctcatgtttaggcaattctgttgactgcccttatcaattactgttgttgagtccgagcttctggccaatgtagcgacgcaatgatggttggcgcctgatccacttgcggttggcgacaaggctttcatttttctgttgagttcatttgtttggcttgtttgtgcgggattcgctgcttttccttttggttgtttgctggaagaaaatgctggtcgcttggcaactgatgaactcttccttgttggtgttagccgttgcactgccataggaattggtgccgttgaatgctcatttggtgatttggcttgtctatccctgactggattttgtatgatctcaatgccggatgcgtcgctgtctgatgaaagatcaatcacgattgattttgagctgatgggagccgattctctcttccgtcttgatcgcaatgttgcaatgctggacaagagtttgttgcgttgatgccgtctcagttcgtccttttctttttgttgaatgtttttctgcctctgagccgttttactgctttgtggcgattcatcgttgttgaccattagcacgaaagagatgttggacggttgcttgagcttgattcgccctgttccactgatgatattgccgattttcgattggcaaatcgtaaatccgcttggcagttgttcaattggttgaacattcagctggtgccaaacgtccattccgaggagaatgtccggttgccgtgactcattcggcagggaaagcttcttttgttgaagttcgtcattatccaatgcgtttagttgtagtaccggcaaatcattcagcaggaacttcaaagcgttcaggttgaaaatgaacctgtcctggtcggggcataaaatgccgattgcaacgcggtcgcttatgtatcgcttcggttctcgttcaccgaagctggacaagtagcattcttccgtgctgaggacgttcatatccaattgttcagctgcactgctcgagatgaatgatcggtggcttcccgggtcaatgaagatggttcccatcatgctgagggatggccgtgacggattgaagatcgctgcctttgtcgtcattagcaacgctctggtttccttgctttggatggcattacacatttgttgttgttcgatcactgttgatcgcttgccatcgttggcatttggcttctcttcactgcaagaggtgctaggcgtgttgatgccattcttggctttgtactgatctcggcagagtgccgtgggatgccgacgtttgcagtgatagcacttagatggtcgagcgcatttgatgcgcggtggtttggcttcatgcacttgaagcacagcttcttttctctgaccatgctgatcccgttggttgagtggtgtcgacgtttttggcattcgtcatgccaatgattgctgttgcagaaaatacaggggtatgggggaccttttt

SEQ ID NO: 17101 - DNA, 2253 bp, Heterodera glycines
ttattaatattcaaaatctcagaactgtccctactcgactaccgtatcgacaacagtattcgcttatatgatgaaattaaatctttaaaaaataggcgaacatccaagcaacggagaactgatcgaagtgcaattaaattcaattaatttccaaaaaaattattcactgaattttttaaattaaaaaattcctttaaaattaaatcaataatttttcttcaatcattcatttctccctaaaaactttttttaccattttataaaataataaaaatgttttaccctgtgcttctgctatttcttgggatccagcggggttttttcgggatctcgcggtattaaactcgggatcccgaccttggcatacgtcccaatcgcttttccaaaatcttctgggttaatttaatggaataatttaaaaaaatttggagccgcattaattatcttaagctagcaaaaaacaactaacaaaaaaatacattaaaaaaaatttaattgaaaatataacaaaataaaatattttaagacattaatttttattttatttttgattacttacatccatgttttttagtttatcattttttaaatatattttttaattttatgtgcgctgtcgaaaaaattatttctcaaatgaatgccaaattttgcggttatgatttttaattttaatgaaattgggaagaaattggccaaacaaaattgttttaattttggccaaaaatttgataaactttaatatgaggtcggatttttcgaagtggcgaatttttgtggtggagttttcggaagaaaaaaatgagattttaaaaaagtgataataactattgctagggaattcaggaaaaaccaaaataaaaatttactgaggcaattttcgcacaaaaaaatgaatgaattaatttaaaaattcacaagttttttgattaaaatttgagttttatatttaatattttcaattttttgttgtttggaaaacatgttaatttgctgttatacaaaaaggttaagagaacatttagtactccaaaataaataattaaaattgaaaaaagaaatttaacgccgataccgtatcacattcagtaacactttccacggtaggcgttaatcacgtctgagacaaattcgaaggcctatgggggatgtccatgttaggctccatccaaatgttaggatgccgaacaccaaaagatcttaaaagtctgaatattttctttttcaaattgctcacttccaaattagggcagatctaaaaaatcagtacatttcatttagcaacaatgacctggcattgtgcaatcatacgatatgttgtaaaaaaatgacaaattatttgcataaaaataaatttcgacccaatgaaaataccaattcatacattatatcttttttcgaaaaatcttaaaattattaattttaatatttctctttgttggcagcagggctgggctttcaataacgaaaaccgtaatttaatggtttttttcaattatgtaatcaaaaatcgcaaaaatataacccacatccgtatttacgagggacaaaaaatgtcgcatttccgtaagccgtaattacgcccagccctgattcataggcgaataaatttttcaataaatttttacagatacattttgtgttaaaaaattttccaaaccctaaccaactaacttacacaccatcaccatcattagaaccacaaaatgaactcgcaagtcgctgttgtgccaattctggcaattgttttggtgttttgtgtgttgttgttcaacataagtgaagcgggtcgctcgagagactaccattacaaggttccgcgagctcagttcagttccgttgactagagcttaaccggaaatgatgcaaccaggaagaacacaaatgttcaagccacatcggatagttcagtatccttaaatgcttggctcccagatcaagaagcaggcgctcagcatcatcagcaacatccaaatcaggaaacttacaacaatatcatacaacaaactcagttagcaatcaaattaatggcatgccaacaaacttgttcatggaaactgaatggccaaagaatacgaaaaatggtggtcagcagtgagtgccaaaacaggtcggaaattaattgccaccattggtgaagccaatatttatagatatttgttttccgattagtttaattagtgtagtccaacaattgagtaccatttcgtgatatttttggaaaaagaaaaatgtttggtcgaatgtaagtga

SEQ ID NO: 17102 - DNA, 1528 bp, Heterodera glycines
  misc_feature (47)..(47): n is a, c, g, or t
tggccaagattgatcaatgctcgggatcagcgatgtctattccagtngggaaaatcaccagacgatggcatctcggaattcaggcagcacacaaaggcgttttatcacttcgtacccggtcagaattaaacaggaatttatgcctaaattaattaaaaataacataggcaacggcaattgctaaaagtgaccgctgctaatcattctcggcgccagtcccttcgtgaacacgcgaaacccctcgaaatggtaaagacgccgaatggtttcccaataattcgtcctgtgaacctaaaaacagaagtggacgactattcattcgttcagcagtttttacctgtatcctcacccgaagaacttccaacggatttgtaaaaagcgacgcacaaattccgcccaacgctccggaaaatgcttgcaacaccaacaaattctcgctgtccccccgaatattgacagtgttttttcccgagcttttcgcactgattttccactcgccacggagacttttaagccgagtgagaaaagtgtaataggtaaaccaaaagaccatagcagaagggatgtaaagcatcagagaggagaaaaagccacttgaaaaactcaattagagggaaaggaaaaaagaagaaagaaaaaccgaccggtaaaatccacgaatacctaaaacagtgaattgacaaggaaacctcgcgaagtgtaactcggaaaatgcataagtttatatgccattttaaatgccgatagcaacttcccagggaagggcctcgaaaattgaaattttatgattataaatcagtcagttaaaggttggtagcagggctggccgtgatcacggctcacggggtttttggggtgctgtgatctcggatcactgattttttcaaattttccgtgattttgatccgtgatagcattttatatagtgaatttttactgagacgaaaataggaaattggtgtgtgacaagtagggatgcgatttttagttaaatacctaaaatttttgcgcacttgtaacgttgagataagcataaaaaacgagtttttagcttggtttggagcttctacacccacttttataatacctatttttacctatttcggcatttttgctacctattttaaggattttcaaaaaatgcttaacaaaaatgcaataaaatcaaaaatatacccataagaatcgaccaaaataattttcaaaaatgcaccctaagaattggaaaattttctcaaaaatttatcccaaaatttattttttttttctattgacaaaatttttaatttaaaatgtcaatattatctaataaaatattaatatatttaaattttcgtttacaaagagatatgtagaaccaagattttccctctttgtttgcttttttcactaaaaatcgttaataaaaatttttatttacctattttggtacctattttgaaatttttatacctaatttgatgcctaattttgatatatttttttacctttttaagtaactattctgcggattttttttacttaaaat

SEQ ID NO: 17103 - DNA, 1092 bp, Heterodera glycines
  misc_feature (1012)..(1012): n is a, c, g, or t
  misc_feature (1040)..(1041): n is a, c, g, or t
  misc_feature (1067)..(1067): n is a, c, g, or t
gtgacaagaaattttttagaaaaaattaaataaataaattcatttctgttaaagaaggacacatatatatttagtctggtagttaagccttttgtctttcgttgtctatcccttgggttcaatgaatttttatattttgttttgataattttaattgaaatttaattataagaaatttcctaacattgaaaattatttttctttatttttaaaacgtccatagaccaataaattaaccaattatttgacatattttggacaaaatctgttaacaaattcactcaaaatttaaaaatttttcccggcggcgcctgtcggcaccaccggcggacggacccccattccagccctggttggcagtcattcagaaatgaaatgtgccttcagatctaaaaaacccaatttcgaggctttttaactcccagggaagtttcttaggcaattaaaaaaattaaaaattcacattacaaattggtcatgctctatccactgataaaaaccgtatgtattttccgagttacaattggcgaaattcccttctcaattaaaaactgaaggaattcccataaattaatgaaaaacaaatccccaagaattccaaatgtttttttctttccaattgttccctttacaaaccatcgatgtgataaaccgctcggacaattcgaagcccaaaggtcaaacggcccgactttccatccgttcgcacgaagtccaaaacggcaacatttttagcagagcccaaaaattttgcgggattattatagatcatcatatgctgactaaaacggagggaaaccgtagtgaatgggacggatttacaaaatgaaaaaggaagataacttatgatgtcggtagggacgaatattatttgagtgaaaatgctagaaaatccgcctgaataccaacaaatttggaatggcatttgattgttctcaccggccaaagcagagacaacgggcgcggattgaatattggcattaacatgaagaacatttcggaaattctcgtnaatggtggagtagatgaaactgacgccnnagtgaggcatttgtacccaaaagccntattaggggtcaaaaatgactaatt

SEQ ID NO: 17104 - DNA, 2339 bp, Heterodera glycines
tgacaggacggagatagagagaaagacgacagacaaattaccgattgattttttaatgtattgattgaccagttttgtaccaaaaatcttctcttttttctggattgatgcacaacgatgggaattgttcaaaaaatttcttgcagcttcgcacttcaaaagtttggacttaaaacgtagaattaaaaaaattatgcttcatttcgagcgataagccttaagatttttcaaaggtgaagggcactgatccggaatttttcaaaatttgccattttccagaacagactgatgcgcacacaactttttactatttggtttttttttttgtaagatgtcctttcggcctaaaaatcaatgtattttttccaaaatcggttaataaactttaataaaaatttccaggattttacccgacttcgcctatcggcactacaaagaccacaaaccccctcaatttatttaaaagacggaatgccaaaatttttgaataaatttataataaaatcaattaaaataaatcaattttcatctcaaatttcacctagaatttgcaaaaaattttcccggaggcgcctatcgacaccactggatcgacattaatcctgtagaattgagtcaaaaggtgtgacatttggtcattttttggtcaaaatcagttaattaattgataaaattttcgaaaaaaatttcagacggcgcctatctgcatagacggacccctttgttcctagtttttgaaaaaattgcgctgaaaaaaagcatttttgaaaagcaaaaaatagtcaaattttaaaatgcaggatttgcaggattaatccggccggatccggtcctgcaaaaatttttgaattccaatcctgcaacaggatccgcgaatttgaaatttccgtgctctaaactactcccatccgaatttagtgacaaaaaattttcacttacaatgtttattcgcacacacataacatatacatacatatatatatccatacacgcaaataattgaaatgacaacagttttttggggggttgattatgtgaaatgggggtttacaatacaatatgatacaacaaggggggtcgacgatccgatttctccacacgcatcgttctcagggctggctcttctgccgctgatgacgtgttgcactagttctgcggctgcgatccttccgcctgtcgcttcagccagtcgtacaccgcgcccatggagtatcggttgttgcgcttcgggtcccagatgtgctgcatgacgaactcgacgaacttcggaggcgcgtcgttcggaaattccagccggtatccgtttgtcacctgtaaaaggggggaaacgattaaaaatggaaattttttgggttttaactcactgctgccaagatcacgctcccgcgcatttctgcgaatggcgtctcgccattggtgaagacttcccagcacagcacgccgaaggcccacgtgtcgtccttctgggtgaagaagtggtcggtcagtgcatccggcgacatccatttgacgggcagttttgcgccgctctcgagttgctttgaaagtgccttggtcgccatgccgaagtccgagattttcacctgtggggaaaaatgaacaaatttagacgtttcatgacaaaaaaaaaatttctttttttcacccaccacgccgtccgtgtagaggcagttcctggcagcgacgtcgcaatggatgatgcccttggagtggatgtgggtcagtccggttcttctgtcgtgcgcaccaggaagtccccgtcgttcggcagcagctccactacgtcttggcgcggcagcttaaagttgaaaaaaaaatttaaatgtggaaagtgggggacggtgactgctcctcaccagtccgtgatagtagggcagcctccacatgtcaacgtccattgtgcttgtggccgggcacgcacgtccgcttcgtgtgtgatgaagtgttgtagacgatggacgatggacgataataataataatataatacaatatgagggcgatgaaaagaattgtgaggaaaaatgaggaaatgtctgccttttatacaacttttttccccttcatttcgaaatttttttgcttgtctatataaagggagggattggaaaatttgctctcattcattgagcccgtcaaattttaattcttctattatgcggaagatcgtctacttcaaactgttgcaaattgtgctcagtttggccttcgtgtggcaacttctttcccttcaccaattctgcggcacttttgtctctccaaaggtgttgcttttgctttgacaattcatttgaatttaatttattgttccatgcttttcaggccttcctccatgacatc

SEQ ID NO: 17105 - DNA, 1475 bp, Heterodera glycines
  misc_feature (11)..(11): n is a, c, g, or t
  misc_feature (71)..(71): n is a, c, g, or t
  misc_feature (1289)..(1289): n is a, c, g, or t
atgtactaaantatgtaaataaaacttttaaaatgtttatttgggaaaaattcttcttaaggagtgaaaanggcacaaaatgccataaaaatgtcttaagttggcttagaaccttagaatcacatttttagtattttaaaaattgatttttgatatttttatgggtacattttctaaaaaaattttttaattttcacaagaaattttgataaattttcaaaaaattcattgcctcgcctcccttttctggtcgatttattgaaagaacgtaagacaataatgcaattagcttggaaaacagtcgatgcttttgaaatgatcgaatttcattctcgtctttccgcccagcggattatccttgtcgcgcgacccctcgtccgcccaaatgttaatccgtctgcctttcttggcccaattagcacaataattaggattagtgacagtaaaatatttgtcggaaaatactagatttaataaaatttaacaaaacacagtttaaatttcggttttcgaagaatgattcgccgtataagaaaattaatgaattaaatattcaaaaattttgtacattaattaaataaccaattaattatttttttaccccttctttaatttgattttaaatgaatgcattttccactgttaattggatgaacagcggatgaccttcccagaacaataatcatcttccttcattggttggttgctgttgtccttcggaaaagtgttgacattatcataatattccagctacttaaattatttaccgtcaactttcattttaccgtaatcacttagtcacccccgccccattttaccgtaatcggtgtgtcagcgccccaatcattcagttccgggcaattagtcttccataattgcattttgtatgccctccattcatttcctcccactgctcaactcgccgtgccctgtcactgccgacaggtgctcctgccgcactctgtccctttgtattggcattgtgttggcattgtgcccttttctccctctttttctctttgccttttgtgccactgttttggcgtagtgttctgtgctgtcgtcattttcccattcattccattcgctttttgtgcttaatttcccatcatttgcctacccaaaagtgcgcagcaaatccaatgaaatgaaagagcgcatggaccaaaatttatgggggagaagaaaaatggagaaagtgagtgatgagagagaaagtgatccatgagaaggggaccaaatgcataattaaagaggaggcgaaaatgggggaaacggatgaacattgngggggggggggaagttagaaggagtaaacgggaaagttaattaacaaattaagcgggaaaagcattattagctgaacagttggaattttcatttggattgactaaatcactttggtaggctaaaattaataataaacaaatcaaaacattcgtcggcttaatgttcttttgtttttttctttttct

SEQ ID NO: 17106 - DNA, 2088 bp, Heterodera glycines
  misc_feature (2074)..(2074): n is a, c, g, or t
agggcattccctcttttctctcctctttttgctttgctttcgtcccatccctcgcttaattaccataaataaaacatttcccattgccgtttctcaccataaagtgcagaatcggaaggagaaaatcgtctcaaaggagcgaacgaacactaaccgtaatcaccatcacatataccataccaaatcagcacatggaaacggtattccgctgaagagatcgatcagaagtttaggaaaaattttctataaagttaaaaaggagatttcaagccttattttttattttaataaaaaagctatttcaaaaattttatcattaaataaccaaaaaaattcctttttaataaaaagcatttatttttaattttaaaaaatataaataaataaagcaaaagcaaaagccattcatcggatcacacaaagacaattcaccagacaacagaagcatcaatgacaaaattatctttttcaactcttttttctcctttaatctttgcgttcgttttttcccatttttcgcttggtcacctttttttgttggtgccaaaacaaagaaacgaatgtaaagttttggccataagaaaaaagaatttctattcgacacctcaaatttccccatgggattgcatttgtttgggggagggtggttttagaagacacgaaaatgaccgacaaagaaaagaagcagcacagctattaacaataagccgtaagagggcgtttgtcccttgtcccccccccccccggggcatttcaaacggacacttttccatagctcaaaaatatgaacaaattcagccaaagtttgataataagcggatagataagtacattctcaagtttatgttaagccatttttccttaggcttttcgaatcgctttttcgttttcggattgaaaacatttgctgctctgtgcccaacccattcatcatcatcatcccaatcacaaataagcaatccctcctcccccaaggcagatcaaattacataagacaaaagcaatggccgagattggttttgcggttggtcacttttgcacagtttaaacttaagcagcggcactttgccggcttaagtaaccaatggcaaaaaaaaaaaagccaaagaaacggcaagccaattctaacagcagaaacaatttgaaatttgtttaacatgtttttttacaaatgaattgctaaaatcagcaagaaaaagcctccaaaataattgttaaattaagcaaaatgacaaaaaattagtttaatttgaattttcccaaattgttccaaaagtattctcctgctgcttgtaaacaaacaaaatttgtacaaaagtttttaagctttttatgttccttaaattcttttttccgtttttttcactttttctcattgcaacattttctcagtttaatttatgcatcaaatgttcgcttttgagctgtaaaagtgaatttttgatcagtggcgatgcgatccctcttttgcctcctctctccccgccccctccgtcgcattttctgcaaaagtcaaaagaaatctgtacaaatgccaaaatattatgaataattaaaaaagcgaaaaaaccaataaattaatattaaaatttaataaaaattaaaatgctaaaaataggtaaataaataattcagtgcttcttccttttcctttgaattttgaatgaatgcacagctgttttccgaccattttcaactgacaaggaaagaatggacaaggaacataataaactttgtccgtcgtaaaagatgtcgtccatcaattagccttcttaaaaaataagtaaattgatggacattcaattcattttcatcattaatttcaaatgaatgtttttttattaatttaaaaaatcaattaaccaattgtttttaattacatcgagtgctttttcttcgtgtacctttctctctgttaattagtaaatgtaattaatggaaacagctgaatttgttctcataaattggtggtgctatatgacacaacggaagaattgctgatcggacgagcgataaggcagaagtgaatttataaaatttaaagtacataaaaatgaaatttaattaataattntattttttactaat

SEQ ID NO: 17107 - DNA, 2177 bp, Heterodera glycines
  misc_feature (20)..(20): n is a, c, g, or t
  misc_feature (66)..(66): n is a, c, g, or t
tcggtcgccgactgtttgcncactttcgttggtcgttcaatgcgccaatggcttcgtcggtgtgcncattgtcatcagctattcactatttcatcgttgcattgctccatcgccgacgatggcacttttgctcatgccatcaaagaacagtttaaacgggttgatttgcggcgttgtgccatttctttttacggagaaaatgcgtgggcattttgccgcgttcaattgtgtaaacaatgcattcgatgaagcatttattttttattatttttcatttctttggcttaagcatttttgtatatttcattatttttttgtttgataaaccctttggtacatttattttcacacaaattcaattagcgacgttatgaaacgtcaaaaattttttcttgtttaaatttttccctgaaaaacccattaatccttaattgcgtgccaactttatgtagcacaaatgacgaaattcaataaaattttaaaactttattttaaattagcaaaataatggcttctccccctgtccctgttatttctgttgatttgccctccaaacttgtccaatgttttgattgtcgtcagggcgcaattcgcgccgttcgcttcaacggtaagcggaattggttactgtaattttcgtcgccaaatgtggctcattgcgtcaccacttttctcctcatttttttgttttgttttaaagcgttaatttcctttttaattgcagttgacggtaattactgtatgacagccggcagcgataagtccgtcaagtacgaattgtgaacagtattaaatctacggtattggtggatagtatccaaaaaaacaatggactggtattttggaaacgcattggcaaggcgttgctggcttatccatatgccatggcactttttcgtacaattggtccaaatgccatgacattttttcattcaattggtccaaatgcaatggcacttttttcatccaatcggtccaaatgcaatggcacttttttcattcaatcgctatttgtccccaaaaggctgtggaacccataccgtcgtgtccatttgaagacgtacagcgggctgggccaagaagtgctggacgtggccggttcgagtgacaattcgttgattttggccggcgggcgtgacaaacagccgaccgtgttcgatgtcgagtcgggcaaaatggtgaagcggtggcaaagccacgggggcgcagtcaacgcggtcggtggacaaaagaaatggctcaaaaatctgattccctaattgggctaaatacaatacgctaatcaccaatttggcattgttttaaaattcgcaataagtttaattcggagttcggaatttaaaaaataaatttaatacgttcagcgtgcttttttgcctaaatattttagttaattaaaagggaaaaaatgttaaaaatatgcctaattttttccgcttcggagtgcctttttttgctctttggcctcattttttcgccgcgattttaaaattttagttggaggtgttaggtcgatgccggtaggcccgttcggtaaattttgtaatttttcctatttttaacatattttcaccaaatttgccatttttgggtcaaattttgggtgctgtgtcgaagtgcaaaaagtccgaatgagtggtgatcagaaggggcgggtcagttcagtaccgaataatgattttaattaattataatataactattttaatttattaattttatttgctggccctaattataatttagctttatatttaatatttcctaaacaaattacatttttgtgagagaaatacagtgccccaaaaaagtcttgactcaaacctgaaaaactatcttatagttcatttaaaaacttgaaataattcatgctcgcacaacttttggtgctgatcaaaaaagtctcttacaccaacttgatcagatcactccttcctagtgaccgggacacccaaaatacactgaaaatcggggaattttcgaaatccctagggggctggaaaattttttctagagaaaatggacaagctcactggaaagagcacagaatttgctaccgaattgcttttggaatggtggttctacgatttgtatatggaaagttaggggccaggccgttttcgtacgaacacatgtttctggactataacttttttctttgccaaccaaatccaaca

SEQ ID NO: 17108 - DNA, 999 bp, Heterodera glycines
tttaacagtttatcatgaattcgaaaataaaaaaatttgcgaactctaattagtaattacaaataaatttataaaaattttgaaagatagcgcaaagtaaagctttatttataattcatttttcttctaattgcaattacctattgtaaaattgataattgtttttccaccactaatcattttgaacgctttttcgccatattcctccctttaaactttcctctcatttggggaatgggacaaattaaaatgtgtcaagattggatggtccccctgcgccacaagagtttagtgtaggtaattgctaattggacgaaaataatgatcgcacatcggagttcatcaaattgttctaaaaatttattgacagcaacgcgcaccgttggcgagaggaaagagagagagagagaaaagggaacaaatattggggggggggagggtaattagcactaatgagaaagggaaaggacgacggacacaatgaacgatcgaccaccattttatggtttcgagcgggaggaatgattgggcgggaaaattgagtgattagaccatgggacagcgaaagtcttgtgcccccgggggttgcgcaaaaatggaagaaagaaaacaatgcgcagcgaaaagaacgaaaatggcggaaaagaggccaaattttggtttctctccgtcgccattttttcacatttgcgttgttatgaaagaatgaaattttgtttgatcggtgggccgaaacgatcaaacaaaattagtcggaaaacattccaatcgcttgctccattcacatttttgttttcttcaacaaattccgtaaccactcaaatatttttattatgtaacaattccataagaatggcatttttagggataaagcaaaaataaatttatttataaaaacatttgctataagagaaaaaatagatgttttatttcttttggcaattcattaactttttaatttttatttacaatattaaaaatattatgctctgtaacgaa

SEQ ID NO: 17109 - DNA, 2174 bp, Heterodera glycines
  misc_feature (6)..(6): n is a, c, g, or t
  misc_feature (12)..(12): n is a, c, g, or t
ctgccnccgttncggcggctccgaaacggataacagccctctttttttggtgagggcacctcgtttcgagtcggggtcgttttggcgcccacgttttggcgccaaggtcgttttggcgccgacgttttggcgccagggtcaggtttttaaattttttctatgtttgaataaatgaaaatatgtatcactaactcttttgaaatttcaaccgaaaaaatttaagagtttaaaaatattcaaaatgttttgacattttttgaagcatagcgaagagaaaaatttgaaaaaattcttgctaagtcaatttttcatgttgaccaacaaaatgttcacagcaagttgatcatatcactccttcatgttgatctacactagagatcaacattttgaaaaaaccatagttgtacctgtttcaaaaaatggcctgtacctattttttctgtactaagtacaggaaaataaatgtacaggaaaaatccaggttgccgaaaaatggcctgtgcctgtacctggatccaggaaaaatacagggctggatccaggtagatgttgatctctaatctacacccataaaacacagtcaaaatcgggaagtttgaaaaaaaattctagggggttgtgaattttttgaaaatttgaaaaacccattggaaggtaaaagtttttcactttattttgtaaaatttttgatcaaatttttaccttttttaatttttggcttcgcgccaaaacgtgggcgccaaaacgaccctggcgccaaaacgtgggcgccaaaacgacccagtcccgtggaaatttcgcatttcgcgccaaaatgcgaaacgccaaaaaatgcgaataatgcgaaaggcgaaatgcgaaaagcgaaacctcggtccatccctggtccgtatcactccgggcagtcacagcaccgaggagtccatcaatcgtcagttggccgacaaagaaagggtaaaactaattgattttatttaattattactaatagagcccgccggtcttttacctgacctgtatttttcgggcatactaccaggcccggatcgttcgacaaaacgggcttttttgcactgggttgcccgtcccgatcagttgtctaacaataacctggtccagtttctttaaaaatttagggctcgaattattaatatgtttgcaggttgcggctatacagccattttatgttttatacactttttcatgagatatatttagtaaaacgggatgaaaaaaatttgcatttctttttctctccttttggcgtactattttcatgtctctaacacatgaaaaacattaaattcgctaattgtaataattttggttgtaaggtacaaaatcactttggatatttagaatcaataaaaaaggataaaaattcgcattttggttagaaacagcagcctaggacttggagttatagcgtgataaattaatttgaaagtctcacaactttttctgagatgtcaaattgcttagcattcgcttagaaaaagattctccttttcagaatcttattttagataaaaattttgttcagtttagtcggagatgaagaaagttatggctgatcaaaataaaaaatacaaaaaggcatttaccagtgtaatttttgaattaacgcgcaaaaatttacgccaaatacgctatttggcgttttgagcaattttgtctgacaaaattgtgtataaaaggcgctgttatgatgcgttttcctcatatttcactaacgggcgtaactagagttgagcggtaatcggtaattgtaaaaaaaccggtaccggtactgaccggtaatgcaaaaaccggtaccggtactgaccggtaatgcaaaaaccggtaccggtaccggtaccaactttttccaccggtaccggtaccggtaaaaaccggtaattttccaacgtaaaaatttttggacaaaatttttattcagttttcgcgcgagtgcctgttttttagcattagaattgttcagaagtatatgtatattgagggtgaaggataaagaacactaaaattcagatgtagacctcaaaattcagattattgcaaaacaaggggtcagcagccaatttccaacccaacgacgacatcaaagtgagtggtggagcaagccaatcaattcgcattaattttgttttcatttaacgcaggtcattgctgcgaca

SEQ ID NO: 17110 - DNA, 3383 bp, Heterodera glycines
  misc_feature (5)..(6): n is a, c, g, or t
acatnnttttttgcaagacaaaaaaattcctttcgaaatttgattaactttttgtgcgagaaacaaccaaaaaagtgcctttttggcattcgtaatttatttaaagtgcctttttggcattcgtaatttatttaatcaaaattattacccttttggttgtttggtcaaagtccggagcccccgatgcttttgcatttttaagaaaaaatttagcctcttgggatcagtcatcctcattttacaataatttttgaaaatctgaccctaaaatgacataaattagtcattttttggcgaaacacgggtacaaattcctgtttttttcccccgagctttttatctatgggcctctgcatgggatactgtgggtgaggggtactgtaaactaaccgtaccacttcgccaaactgcacaaacttttaaaaaacaaattttgatttccttgttttcaatttgaatttttttttcccacaggtggggctttggcctggtcgcactgctcaccgccatcaactttgtatactacctcttcgtgctgttgctgttcccatggacgcacgagagttcggtacgccatctgttgaagcaggacaaataccgggagattgtctactcgaacaagcaccgcgagcgccggctcatccgccgctttgccgagcacgcgctgcgcaaggacggggtgcgcgaaaattttaaattaaattaaaaatcattttaaaatttgcaagtttttttaaagaaaattagaaattcaaaaatttttgttttttggcgagcggggaaacggctggcgcggagggggcgggcgaatttctctccctagtcactttttttattcttcaaccaaaattaaacattcaagcaccatcccttttgccaaagttcgactcccattgagtgctgtaaccatttttggcaatttaaaaaaatatttattttaacaaattaattaatagatttgtgctaaggttttacacttttaaatgcccctgattttcctcctctccttctttttgcagattctgctcttttggttcatcgaaggccatgcaggaccgatcgtggcgcgagagttgatgggcgaattgttcgaaacatacaagacggacatggtaatgcaaatgaataaattatttatttttttaataaatattttaataaatttatattttttaaatttaaattaccaaatgaatttaataatttttttctttattaatttaaattttaattatttcttttgataaaattaatttttttttctatctattccatttttaattaaatgcatatatttgtatttaaattcccaagtaaattaaatttaataatattttatttctttaataaatatttatttatttttattaatttaaatcaccattacttattttaattgcctatttttttgttccttttcagcatgaagaggatgacgagcagcccagtgaagtgagcgtggtcaacaagaagggcaagggctcattctcgtcgcaaagcaccggttctctggacgacgacacgtacggtggcattgcgcagcgttttggtaacggtaagagcgcaatgaattaatgtaattaataaccaatttttaaaatgattttttaattataaaaagggggtaaagctattatctatttcattgaattgtttttcaaaaagctcgagaattacggtatttgagaatttttttaccgtacactaaactcactcactcatgaaccactttatctgtttacaaattttccctgtcaccgaatatttgttacagtaactatcgtataattgtttttttaccgtacactgactcattagcctcattattttattgttactttacaacaagttttctcttgggccaattttcaacaagccatacctcaatttttggcaaatttatatacataaactgctcccctcctccccggcaggcatttctccgtccgcaccgcccaaattcctgcccgaggcgtcctccttttctcatcgcaggagcgtgaactgcttgacacggacggcaacagcacggagcagaccgggctgtactcgtcgacgcccaagcagaaattgttgcccaacgacaacaacaacgacataaacccgcaccattatcaccaacagcagcaccacaacaacattggcggacgcaacaacggacggtacccgccgcatgcaggtcggccgggcgaaaaaacgataggtggacagatacttttgaaaaaacaaatcagcaatttttgatcacttttggcactatgaccaaaaacccattgagaatttttttttatttttcgcgtggcgggaaacgaacgacctgctccgtcctgcatctctcccccacccctccgaatttttttataaatagagatttttattttataaattgcttaggggtcttttttagaaattttcaaaaatttttccaaataatttttttcctacaactttataagaaaattttgaaaaaattcacttttttaagaatttgtttttttcatttttaggttttttttattagaaaaaaaataaacttaatcctttttttaaatttcccaggggaaggtttgggaaacgtagtgaactaacaaatcaattagaattttaattttcaacaaataaacgctttttcccccaggcgatcgtcggcgtaggaacggtgctgacatcggcgctagcggcagcggcggtggtggtggcttcctgtccagcgtgttccgtcggcttggcaacgccgtgctgggccattcctcttcatcgtcctcgcatcggtcgcacccgtacgcctccgccagcttctacgggcgtacaccgatcaaacaagtctgatcagtggcggtggcggcggtgatcagcgcggcggcttccgatttccgagacagaaaatcactgatcaaatgtatctttgttatcgttgtttggtgtcttcttgttgtccgtctcattcacatggattttgatcaaatcggcagggattgattactttgattgattgtgcgcttcattatttttatcatttttatgtccggcgggccttttttttgcatctttccattctgttattttttgagtatttgtcaccaatttattacatatttgcatcgtatttattcagtttcattacagtacattttcaaattgtctcaatttttcatcgcgccttcattcatcaaacacaatgtgcccatttcttcattccattcaaaaatcatacaaacaatcaatttttgacagattttccaataaaatggtctctcgttctctatcattccctcttcttcttctaatattccaacaatttttttttacaattgttgtcatcatttggcttttttttattgtatgttttttaactgattattttttgtgttgggacggaaatc

SEQ ID NO: 17111 - DNA, 2376 bp, Heterodera glycines
cgcgaccattgagccggcggaggcgctttccatcgatttgcccagcgacgggtcggagcggcgctggtgtttgccgccttcgcccaacagtttgatctgctcgcgcgggatgcgccacgtcatgtcgtacagcatgcgctccttttcgcgcacgtacagaaaatagccgaacggaatgaccactgaaagaggcggaaataaattcgaaaagtgatcggaaggagcaaaaattggaatgatcagagagacaataaaagaagtgatcaaaagcaggaggaggagagaaggtgatcaaaaaagagataaggagaaaaggagaaaaaaaggaatgatcagagagggcaaaaaatgatcaaatatggacaaataaagagatttgaaagcaaaaatcagaaacaaaaaccgaactgatcaaagaagtgagcaggagagggagtagtggagagataattagcagaagtgaaactgataaatgagcatttaacatttattagtgacaaccaaatgaaatcagtgactggggaagaaatgttccaaatatttaaatggggacaaaaaatgttgtactgatccgctgatcagaggagtgattagcagcagaaaacaagcacagagtgatctgttgtaattggacagcaggagtacctgccaagaacagaagcgcactgcccagcacgtacatcgccgtgtagtcacagagactgtcgtcgaagccgcaacggggcatatccgtgggcatgtaaccgtccgaactgctccaataatggctgagcacttcgtgggcaaccttttcattaattgctgaattaaaaatagattaatagtaattaattacatgctcagagcagtcatgttccatcttcaaacacttcaggcggtcaccaaggcgagcggtcaattcgaccacaattttcattgtcccttaagggggggggggaaggcattgaaaaaacaaaaataattaaaaatttaaaaataaaataaaacatttaccatttttggtgtggtaagtggcgtaacttggcactcgaattgccttgttgttcatcagcacttgaccagtggcacctgaattaaaatcgcttacaattaattggttaaatgccaattaatttcactgatgggttaattattaattaattaattaatgttgaaatgtgccaccaatgaattgtctgccggtcattttgcgccaaacggtcttcccgtccagataaatcgttttgtttttggtctcctcaaacgcgtcgcgaatggccaacccgtaaaggaacagcgcgtcgtacagtgacatgtacgagagggtggcatactgtatttgggtgtgtggtacggtagggccaaccgaattttttaaaatcaaatccaagacgtacatgattactcacaacgccggtgacctgaaattgatgacgggtagaatcatttgcgcggatgattcattcatgagattttagggataaattattaaattgggggcaaattgactgagccactgataatagcagcgctatctgattatcaacctgatcaatgtccaaatgcaataaccaaatgaaagccaactatagacttcaataagagggtaattagttaactgattgactaaccagttaattagttggctaattagttaattaaatgcaattgaacaaattttcggcttctgaccatgttgaagcgccgctcaaagtcttcgatgaatttcttgtcatagccatgcgcagtgatcacaattgcgtcatcaaaagcagccttcacctcctgcttctccacgttggtcgactcccacgggtaatggtcgttcatctgagcaaaaaatgattaaagtaaattaaataattaatttgaattcggcacggacgtgggcaagccacgggatgatgtacacgtaatcggagctgaaatggagggaccattaaaaaaacctttattcattttttacttggaataattaaattttatacaatacaattattttttcagtttgagaaatttgaataaaggtgtttcaatttttttttgaattttaataaaattaaatattttttggcacacgttttcatgccggagcgataggcggcgatcataaaggcggttacgctgtgcaaatccatgcccatttcgacaatgacaactgaacatatgtgggcattttgaggtcctactcgccgattcaatttatttaattaaaattaatgggtttgcattccaatggcacaaatgccaaaactcactccgtgcccgcgtccgcaaatgtttcagtcgccccgtggcgatgatttcgtccgctgtcatgtacgggtcaaactcgacctccgtgtttatttcgattaaggtctccttcagcgaattcttcaatgaatacactgacag

SEQ ID NO: 17112 - DNA, 1575 bp, Heterodera glycines
  misc_feature (65)..(65): n is a, c, g, or t
  misc_feature (153)..(153): n is a, c, g, or t
taattggttattacgtataattagcaaattagagaattattaagttaaagaaacggttagaaacnaataaggaaataatcagaaaaaatagataaataaacttggatatttcaaaattaccttgagcgaacgatgccaacctgaggaggaatntaataataaaaataaattttaataatatttttttcgccatcattcacctgtttccagccgtacaaatgcaaaaaagtgatggtcgcccgtgccatttcggtggccgaagtgagcgcaacggagcccaaagtgtcgaacactaacaaaaaaagatcaattttaattaaaattaaataattcgaaaagtttgaccagttctgtccgagagggcgtcgtcgcccgacaaatgcgccacaattggcacattccatcgggacaccaaacggccaatgaccagcatttctgaaaaacgaaacaattagacgcctaactagaacaattagtcttcctaattggctgctgctgaccgttgttgcagccgggcccaaagtaaacgctggcattgcgcaggtaatgcaaataggcggaatgctcaacgccgctgaaacggttgcacgactccatcgtgtacacctgacaaatgaacagagcagctgattttgcttttacatttaattgattgtctatggaattcaactataggcccattaagtgctaattggccattaattgattgacctgtaggttcatcgactccggcaaaatgttgcgctctttcaaatcgctggcgcacaatttgagcaccaacggttcgtggataatgttcgggttgtttggctgcaagtgcgcaattttgatcacactttccaccgtatttttgcagataatgggcgaaaaacggaggaaaaaaagcaatggcaaaaaaggaaacaatgccaacgaaggcggaaacgaaggtatcatctaaataagagaaagaaaatggaataaatgggaaaagaaatgccaaaattcaatttgatatgagagaagaaatgccaaagttaagtgataatcagacatttaatttgaaagttggccgacgaaaggactggacataattggcacattttatagctgcgattctgccggctgatggatgcttccgtggttctgctgctgtatgtaaaccacaacgcgctcacttttctctgtacggctaatccggttgaatttggcacttcaaacggcgcagattaagtgggcgatggacggacagagatattccacttaattggtgctaaatccgcttaattcgggttaatggacgtgaggaagcgaattgccgcgcactaatggaagacggtggtggtggtggacgcggaggcaccgggcgcaattccggcacaaaaacagcgcagaaggcaagtgagaggcattattggcattggcatttcacacccccaaggcggggcagaaacggtggctaatggtaaacggtaggccatttgttgcactaatccatgccaattgtacggtgagtgatctccgatttattggactaattgacagacactcaaaaaacaaaataaataaaaataattggattgaatgaattgaaat

SEQ ID NO: 17113 - DNA, 3169 bp, Heterodera glycines
taatagctgtaagagcatagtcctaatgatggaattatcaatgaaaaaacaatgaaatcggaaaactttttaccaaaaaattcaaatatgttccgacgccgaaagcgggcatcgcaattcaaaaatatttttcctaattttattttgtgccacagctttcatccttttggcaatttcgtttggcctaccgaaaataatttcgatcgtctcaattatccttttgatgtggctgtttctgtggtttatttcgcgaatgtgatttgtgacgattttgatggacaaatgaagaaggaaaaatgattggaaaatttatagccgggattttctgggccaaaattctggaaatagggccacaaattcatttattttttcgggattgtaaccccgacctaattagaatttttttttattcctacacaaatttggatagtccctaaccaaagcaggatggttgctgatggcccaaaaattttcggaagtcggaattccgggccacacaaaaaaaaaattttttcggaagccggaattccgggccacacaaaaaaaaaaaattcgtaagtcagattaagaggcccaaaaaaattccggaagcaggaatagtcttacataattggttaacagttgaaaaatgataagccttacaaatctatgaaaagcatcataataatagatattaattttaaaattaaatttttctcgaatttttttaagtcgcatatttattgaatgcgcgtcatgactaataatgatatgatattttgaaattttcctgattttaagacttttttttgaaacctcctcttccagtattatctgattgtattgagagtattccaaaatataaaattcactctttttttcgatttttttaaaaataattttctgtcgtaatattaatttgtatgaatttaatttgtgcatccgtttttttttgtaatatttggttcatttttttaataataaattccatttttgcaacaccatttcctcttgcccaataatcattgttctaaattttaatttaaatgccaagaaacaatgggttacgctttgaccattcgtttccgattatttttagttttacgtaattaaaaatcatcaatttaaaagtgagaaaaaaaaagagagttaatcccatgtcttttattgagaaagaataaaaaagtgaaatatttttaataacatttttataatttaaaaaaatattatttaaaaacaaataactttggtctaaaattttgattaaaagaaaaaattaatttaattttagaacttttcaacaaacctatttttctcttggggccaatttactattacaaacagaaaattccaattattattttttcttatttttttttatttgtccgatttatttgacgtaaaaattccaattttattcataatttttatatcatatatatatttttgtaaaatatgtatattataatagataataataataattttaaaaatatatttaataattaaattgaataatttaaataaattaaatatcacactaaatgaaattacaattaaaaaatcatttaaagaattgatttccattttttactaattctaataataatttgctcattttgatgggttaggtggtgatgccaggtgaaaattttgagcatttgaactttaaatacgattgaatgaaattgtcaaacagattagtcttttatggcactgtcacaattaattatttaaataccgtaattgttacattatgttttatgacattttcgtacattagaccaaaaatttttcacaaaaatctcgaaaaatttcttcggtttgggaatggatacagagattcacaataactgagtacctaagtcggtgatgaatttcagtgcccaaaaattaagtatgaattgtcggggaattgaaaaggacaaagggtcataaagccatggtttgggaaaaacagtaaatttcacaactcggatggattcgattcgtaggaatttttgtaaatatttaaaaacttttaaaaattcagggaaaactatttttttacaattttttcaacatggatttgtatctgttccatgccgaccggtatcaacaattgtacaactgcagctacgatgtgaaccaagtgccgttcgaggatcgtcaacacattgcacttggcacaatgttcatcacattggctggaattatggaggtggacgagtttttgatattattatttaatatattattaaggaaatcaaatatccttgaatatattttttaaaaggcaatgctgagaaaaattctggaattgttaaaaagatttccaaggaatttgtggaaaatttttcgattgaagtttggtttaattttaaagaaatcttttttatccgggggcataatgcgaaattgatgggattaaagtagagtttaaagaaaagttctaatttaataatgctaaagttgattttcaattaattcaaggacatttgttttgttggtaaaacccagtttaaggcgtacttaaaagcaaggacaaacctttctcaaccaaaacatacaataattgttgttgctcttatttggtcttaaatatttaaaattatttgcttttttgttggctaatctataactcattaattaataaaaattaattaattaattttaatgatactctagcactaattaattaatttattaaattaattgccctaattagctgctctacattccatgcacatttgccatttggaaacaccgtgaaaatggctgctacaaaatcatgttttacattgcgatcaccgacatgatggcaatgttgatgaacggcattgccaccggctggttggccattatcggcgccgtgttctgtactcatccgaatttgacttacattttgggtgcctatgggatgtgtaagagaagcaatttttaaatttacaatttaaaataaattttttcaaatttttttaagcgttatggggagccgaatcaacagcggaggtatttttttaatgagcagggattgtatttttcatagaattcactgggatggacatgtacttggatgtcctgattgacctggaaattttgtccttatttctaaatcgaattttgaatttatttggaaaagaattcattgaaacatgaaatatttaatataaagtagaaaattagtacaaattttttagaataaggacaa

SEQ ID NO: 17114 - DNA, 1581 bp, Heterodera glycines
tttttagtcgcatttttaaacgacgtccattttgcaggcaaaaatcgaactgttgcgcagcattgaggcggacctgaaggcggagcgcaagctgcgcgaggagcgcaatgaaataaaaaagaaatcaaaggggaaatgatcttttcgggttgaatattttttttgtcaaaaattgcaaaaacaaaatacctacggtttcgctttcctgaaacaaatccattcctaaatccctactagcccaaaattcgaaaaaaaaaatttgatctgttccttaaggttatgatgacaggtcaaacaaacacggccatgaatggcttaaaaaatgaaattctttttatttgccttacggtttggccttcatttacagtatttgctttaattatccccagtctacgaggcgtttgaaaaataatcacccatggggaataattagagctaatacggtaggtatactaatttttataaattttaatcaacaaaaattgtgaaaaaaagttttgcataaaaccgcaacaataattcgtcatcattttgttgttgccccttttcccggcctcttccatttgttgtttcctgcaccggtctttgttctttttgccattccgacagctttctttttcgtccttttctgcttcggctgatcattgttttcgtccaattgtgcggcaaggaatggcggcaaattctgttgctgatcacttcgctgttggctgcacacaatgagaaattgtttaccgtatttattgaaataaagccaccgggggctgtaattcagggggggggggctataacttacctatatggttcgtaaaattaaaattttttatttaatcatcttaggttgtttagaaagtcacttaccgtaaatccgctatttgaatgcctgggcattgtattgttcaacccctcccaaaaggggcatttaattggaggggacatcctaccagagggggacatagtaatgttcaatcccaatttgtttttgaatacctaaatttagctaaacaaatttgcttatacaaatttctgacccatcaaatgaatgtggcaatttagctatcgaaattggtctaaataatgtcataatcgtgttcagcgcccctgaaaaccatatatgtgactttcgaagcaaccttagatgattataaaattttaaatttgtggcgtacgaacccatataagtaccaggaattcctttcaccgtcaaccctaagggtactaatttggtttgtatcctatattttggtcaaaattaaaaaaaaaaattttttttgttcttttttatcataattgttttaagtaacaattctgttactggtcaacatacaaatacaattgaatcgacgtggcagaagttcaaagatgagcataaagtgagatttggcagtcacagatcacttttttccacatatatttcggattttttgtggcgtaagcaatttggaggaccggatattttttataatttgtggtcacaaatcgctgaattgtacccaataaacacatacctaattcaccgtttatttgttacttaaaacaattatgataaaaaagaacaaaaaaaaatttttttttaatttt

SEQ ID NO: 17115 - DNA, 1704 bp, Heterodera glycines
  misc_feature (204)..(204): n is a, c, g, or t
gggggggggggctataactttcccttttatggtccgtaaaattaaaattttttattttatcatcttaggttgtttagaaagtcacttacccgtaaaatccgctatttgaatgcctgggcattgtattgttcaccccctccccaaaaagggccattaattggaggggacatcctaccaggagggggacatagtaatgttcaatcnccaatttgtttttgaatacctaaatttagctaaacaaatttgcttatacaaatttctgacccatcaaatgaatgtggcaatttagctatcgaaattggtctaaataatgtcataatcgtgttcagcgcccctgaaaaccatatatgtgactttcgaagcaaccttagatgattataaaattttaaatttgtggcgtacgaacccataagtagtataggggtaaaaatctgggcccccccctgggcagagagatgcgcattcactataggagagaggagagagttagagaaaaagagtaattgcaaaagcaaagaaaagcgattaaattgtaaatggacccccggccactaattttggtgcaaaaaaccccagcctaacggtattcccggatacatttcgcaccgatgcgcgcgtcacttctttttttgcgtgtcccaaaatagtgatccaagttaaagttatcaatttgtgattaatgcacctatcattatgaatcgaagcttagaaaatgatttggttaaatctcccccccctatatgtatgacccaaataaaatcacattttagaaaaatcaatcgaattatctcttctcttttgaccatggcgatttttagtgtggtaaataaagagttgcgcgaataatgattttgtgttaatatttatatttttctctattttatatcatagaattttagaaaaaatgatagaattttaccctaatctaagctaagctttatatctatttattgctgttaaaaattaaaattcgctcgggtgtgtgggtgcgatgacatcctttttttcggagatggtccccctaatcaatgacaaaggaaaagatgagaaattaaatgacaaaaaattaaatttatgaaaataattatgaaggaaaaagattaaattgcttaaatagttttttaatgagaatttgaaaaattgtttgattttttggaaaacattattctatcgaagcaaaattgttttttttggataagagaaattatgcctcagttttaattttcttcttgtccactttttgacccccaccccaaacggaaccaaaaatttcatgaaaaggaattaaaatattgatcccccctaattaaatgagagagctgggtcgagggagagagaatgagttgcaaattatcacgtgcgttagtggaaaagtcaattaaaaagtgcgcgaaagggggaataactaaactgaaaaaaatgtatttgggaaggtaaatgaaaaagaaaaacgtaaagagtttaagctctataacaattttagaaaacagaagaaaaataatcgtttttattttgttaaatttctattctttttatttgtcatttgttaaataaatttacaaggaaagcaaaagaatatatggaacataaaaaaggaaaaataaaactatgaaaaagctatagaagggaaaatatggcatacagctcaattttgtcatccattccaaattaataggtattcggtatttgtcacttcgaaaaata

SEQ ID NO: 17116 - DNA, 1516 bp, Heterodera glycines
  misc_feature (1500)..(1500): n is a, c, g, or t
ttagcaaagcaattattttatttttgcacatttaattccccgcacttttccatcagaggaaacatcgaagcgaagtgactgccgcggtcgtgaaacaccgtaaaaagcactttggcacattggcaccattggtgggaggcgaaaaacagcagaaaaagggtccatttgtagagagaaaggcgcataacgcggaaaaaaatttgcaaatcaaataaaattgagccaaaaaagaaaagtgaaaataaaaaaatttaaaatgaaaaaatcaattaaaaatgaaatttaattttataaaaaatatttaatgttctttttacaattaacaaaaaacaaaactactttgtctgattatttaaattagagagcggaccggaccgggcccggtatcggtttttaccgggcccggcaaaccggtccggcgatttttggaaaaaccggttcgaccggttttccggtttgaccggtttttgagaggcctggcccggaaaccggttgcttctgaaaacatcagaccggtccggcatttttgagaattccggtctctaatttaaatttaaaattccagtctttacgaataaaaaaattataaataaaaattaatgaatggtaaaaattgagccatttaaaaataattatgttcgctgaaaccgaataatctttagtgaaagttttagagatatttagtagttttttcttcgataagatatttaatccggcacaatctaaaaaaataaaataaaattggagaatgggaaaattaacgttggaattttaagagaaaatctcaaattttttttttatcaaatcaaagaatagagaaatattttatcaagtaatataaaaatgaagaaggacggacgaccaaaggaaaatgaaagaaaagggcaaaaacaatcgatcaaaagaaaatggagaaaagttcacttagatataaaatagatacctaattaatatttgttgaaaatattcaactaattgcctaaccgaatatttaatagaggtcggaaaacagtggcaaaaactcaatgtttgtttccatacaattaattgttcttttctgatttgcttcttcaatgtgccacttttacggcggacgaaccctttgtgatcactgatcagcggatgagtcatcggatgccaaacaacgcaatgccaaaatctgctcaatgtttcggctactctgttgtgcatcatttttttgtaaaaataatgacaaatggatgatgattagggagtccaaaaatatggacataaaatcgcgaaatatggatataaaatggcaaaaatatggacataaatttttccaaatttagggtatgatttctcaaaatttcttcaaattcgctaaacggaaagtaacactttcagaaatggctaaatcttataaaaactcgttttagaagaaaaaaagcaatttcttgagaaaatcgaccaaaaaatcgaaatttccattttttgcttatttttgatataaattaaccaatttttaataaaatttanatttatcaattttttc

SEQ ID NO: 17117 - DNA, 1479 bp, Heterodera glycines
ttttcgacaaaattttgctaaaaaatgtctttttcagaaattttttcggtccttaggagtcaaaaaggccaatttatctcatgggggccgttctaaaggggttttttggaaaaatgccaaaatatggacataaaatatggataaaaatgccaaaatatggacaaatatggaaatatggacataaatcgcgaaatatggaaaaaatggatatagaaatccatcctagaagcttcaaaccaagctaaaaagatgttttccatgcatttcaggcctcccacagtccaggaaaaaatatggattcccatataattggactccctaatgatgatcaatttatataaattaaatcatcaaatgaatgttctttttatgtccataatttctgtccgtttaaaattctctaatcctttttagaatctctgatgcaatttacatatttttaatagtgtaaatgttcttaatctttgtgtgactgttcacatatttttggtttcatttttttccattttttgtgatttttgcaaaaaaaaaaaaagaaaattaatttgacaataaaattactaattgtaagcaaattgttttttttcgtaattcgttattcgttttgcatttcttccgcaagatctgtcttttgacgaacaaataatcaatttgctcacctaattgctaaattattgcatttgtaaaaagaaaaaatcaaaacttaacaaaaaaaactccgcaattttcctcactattacaaacatcaaaacccgaaatttgaatcctaaaaactgtaagtaccaaaaatattttttcctttctatgtttataaagaaaggccaatctaacgttttaaatgcaatttttatgccattttatttgtgtcgtcaaaatgcagcagcttttgttttttctgcttttggtggcggacatttcgcacggaaaagggcaaaaagaggaaaaatccgaggcaaaatgcgacgaaaaaaataataatgaagcgataaggtggaaaataagcataactaattgtttaaatatccaaatatattttttaatctttaggcttcacaattggggcggcaatttcaaattttgcacccaaaatgtcgaatatccgcgcaccaccgccgaagtgcaacaaattgtgcggagggcacaaaagctgcgcgtttttggcagtcggcacagctacaacaaaatcgcggacagttgcggcacgcttttgtcaacgctcggaatgaattcgatcattgccatcaatggaagccgaccgaccgtaacggtgcagccggggatcacttacacggacttggcaccgacactttgtcagttgaaaatggaaaataaaagtggaatttaattgcaattaaaatcgattaaatatgtttgagattttggacagatgccaacaatttcgctttgccaactttggccgcaattgccgaaataaccgtcgccggtgccactcaaacatgtgcccacggcagcggactg

SEQ ID NO: 17118 - DNA, 902 bp, Heterodera glycines
ggcgcaattgtggaggcgcaaatgtggaggcgcaaatgtgagggcgcaaatgtagtagccgcaaatgtagtaggcgcaaatgtgtaggcgcaatggtggaggcgcaaatgtagtgggcgcaaatgtgagggcgcaaatgtagtaggcgcaaatgtgtaggcgcaaatgtggaggcgcaaatgtggaggcgcaaatgtggaggcgcaaatgtggaggcgcaaatgtagtaggcgcaaatgtgtaggcgcaaatgtggaggcgcaaatgtggaggcgcaaatgtagtgggcgcaaatgtagcaggcgcaagtgtggaggcgcaaatgtggaggcgcaaatgtggcacaaccatagattgatataaaacattaaaaatttgatttattttgtcataacaccgtcctgcttgacaaagcatcggaatttggcatggaaatggaattttaagggatttttgttcaaaccttcaaaataagtaaagcatagaactggctaatagccacattaaaaaagcattcttatcgtctctgagccttgatgttttttctgtggacgcgtaaacattgattggacgcgtgaactggaatatagccattcatctcagaggaaaaccgttcaaatgacacattcaaaagctcttgatgcgttaaaccaccaaaaatcaaggtaaaaattcgaatcaatgtgatataagaagcactggacgacaacatcgactacgaggaggaggacgacctttctgcctatctactttcttgggtgctatgtcgttatttaaaaaaccatcaatatatagcttagctcaaaagcaacctaatttttaattcttgatatcattcgatagccctacgtcttccatatccgtctacaaaatttcaaaaagtttcattaagtttcaaaaaa

SEQ ID NO: 17119 - DNA, 1148 bp, Heterodera glycines
tggagggaattcgtcccttttgggtcccagaattccatcgacacccaaaatcagtgggcctaagaaagtcgtgactcccttttttggaaaggggcataactgagccggcaattcgtactgggggccaagagcattccattccccaccatgcagtggtaaacccgaaaaagacgcgttctttacgacgcctacgcgcatgagcgtggaaaggcttcgttgaatgaactgctgctgcctgcgccaaatttagtccccgaattggctggggttttacttcgtttcagggccatggttcaccctgttctgggggacattgaaaaggcattcttggcctttggccccttaacacagtggaccgagaagtggacaaatttctctggcttaaagacccctcctagcccctgaataatgacaatttagtgttgtgatttatcgcttcaaaaggatcgcgttctgagtgaattcatcgccgtttcttcttgcctcagtcgtccaccaccatttatcagaatttgggaaccccttggggctggaacataatttttagtcgacagattactcctttgtagcgaatcggtcgaagacgccgccaaagctgttcaaactgcccgagaagtgatgagcaaggctggcatgcgtctccacgaatttgtggcagctgatccctccgttttgcatggcattccttctgacgaattgttgacgggcgaacagcaaaggtttttgggcagtttgtggaatttggccaaggaccaaataaattttgcattaccccgggccaatgatttccccccaacccgcagagaggcctttagaacaatcgcttcattgttcgaccctttgggcctgtatagtcactgcctcgttaaggccaaaattttgtcccgattgcgttcggggccaaaggtcgggcactggggtcggggcaggcagggacgagacacagaataaataaaaaatttattccgggaaatgacctcaaacttgggtaattaaacaaaaatttgaaatggtgaacgaattatcacaaattgatcacagaaaatgccatcaccggggaattatcacaaatgaaattgggcaccgggatgggacaggaaaatttcaaaaaagggggcattcgggcaatggaaaatcacagatttcga

SEQ ID NO: 17120 - DNA, 1063 bp, Heterodera glycines
ccagcatctcggttttgctctgctgcttttcgtggcaaatagcaactttttcaagcagaaaatgctggcgttccaagcagtccagtggagctgaaactttgcagaaaggggtaatgaagtgcgctggttccgaatctgaggccgcccgggtgaccaagttttgtagaaattaattaagattttttaatcaggaccacccaaattacaacacacctttattcttatgttttaaatcagtgtacaatacactcgtttcgggaaacagttgtaggtatgcgcaatggggctgctatttgtcgagagcagagcgaaagccgaattcatgttctaaaattattaatttgttgtgtctaatgatttaaattaggcagaacaacattttgctttcagaaattgtctctatgaatgcgcgtaagaaataggcaaatttccaatactgttatacaaaagaatttcaaaatttttgaaaaagccaaggtcctgatttaaatatgctaaaacaatagaaaagttcggaaaatgggtagtctaaattgccaaaaaacaaggcgcacttgaatgctcatgactatttttgacttgacactaaagataaatattttttcaaacactttctaaaaatatttgctctatagcatgtttagcaaaaaataacgtgaaaatttaaatctttaaacaacctttcaagaatttgtttctaacacgcaaattcgccttgattctatcaaatccagactatccattttccgaactcctctattgtttgagcatatttaaataaggaccatgtgttttttcaaaaattttgaaattctttggtataacagtattggaaatttgccttatttttacgtacattggtgccatcaagttcccgaaacccattcatttttcagcctaatttaaatcattagccacaacaaattaataattttagaacatgaattcggctttcgctctgctctcgacaaatagcagcccccttgcgcatacatacaactgtttcccgaaacgggtgtattgtacactgatttaaaacataagaataaaggtgcgttgtaat

SEQ ID NO: 17121 - DNA, 1261 bp, Heterodera glycines
actttgcggttgcaaaatctgctgatgttgtcctctagcagaaagggccatggacgaagaagagcgctgatcggagggaaattcgcggaaagagtggcggacgaagcgacattcgccgggctaaataatgaatgacagttgatgaaaagcttttcgccccccccggcacaatccctactcacatttaaacacaatttaaaaatcctatcctcacttctcaccatgatcagtggcatttccggtggcaagtcgtcctccgcttcgtctcgctgtctgccgtcccttcccctcccttccaatgcttccgtttcttccccgtcgtcgtcagtgcaacggcttattcccgaaaaggcgcccgaagaggtggacgaacttccggtgctaatccgatgattggcgaccaaatcagccgctgattccaatcgctgcttcgccggtgtttggtccacaaaatgcagaagggacgtgaacattgaccccgcttctgccaccatcgaaaagcttcccgcgccgtccaaatgttcttccatttctctgcccaatatttccaatctgtgccgaatgccttcccttttgtcttcttcctcgctgatcgtgcacaactcgtggactttgaggctttgctctgctgctactctcgacgtcctttcgctgccaatctcgtcaaattgatggcccaccaaaacagccgtggggtctcccattggtgagaaacggagaccgggcccaccgaaatgggagaaacattccgcggaagagccgttgctgctggtcacggtaccttggacagaagtcaaagtgggcggagcggcaagacaaagaaacagtgaaataaaaagggaatgaccgtactgtagctcaatggccgattactgtcgcaacaattcccagtagaagccgactcaatttgatcattgccatttgggagaatattttgagcactgacagaaacaccagcagagggtacactttcattaatgccatttcgttgttcgaccgaaaatgccatcgaattgcttaattcggaacaaattgcctggagcacttcttcctaaaccatccgaaattaagtgatttgtggtatctgccgaactaagcagcttcctctgcctttcctcacctgctcataatccgtccgaattgtccctttcgtcactttgtccgtataattggcatgaattatccctttcgtcactttgtccgtataattgggatgaattgtccctttcgtcactttgtcctttccgtcttttctcacttt

SEQ ID NO: 17122 - DNA, 944 bp, Heterodera glycines
cttcaaatagcactaaataattttaaaaaattatttattttttgttggatttatttcgctttttccaaatcccccccccccttcccctagtgattcattttattatattccaatgctttccataataaaaataaaaaatttaattaattttcactaattaaattttgaattttaattggtctgtttaaataacaaatgaataaatttgatgagtaaaattggagaagttttaatttttttggtctcacaaagtttctgaaatcccttaacattcggccgtaaatgttgggccgaaatgtaaacggagtctttccctcgggcaacgatttcatttcaaatggaaaaccttcggccgttttcccatcttttgaggccgtctttctttgcccaatgtccatcaattttgtccattatgtgctttttcgagggttactttcccttggcattcttttcacgtaaaagaagggtcatttaagccctttggccattgtccaaacgatggccaaaattggctctcaaaaagagaaggaaaagagggaaaacagccgacactcttttgccatttgacaaaaatttaaaaataaatagtgaattttgtggtgaatgatttgtaaagtgcgataaatcagtccgcccatgggcaaaagtcttccccaattggccactgagttttgccgatgaccaaatttgcctaattataagtgtcccccgcgccgcgccccaccggcgactcgcctcaatccttcgattagactccgcgatgatctttcccacattttccatcagtcgtgcgttttccatttccaatgtcttacaccgctttttgtatgcctccaaattggcgcccaaatcgaattcggcagacggagaattgacttggttctgattgtcgtccaccattttctgtgtttggtcgatcaaaggaggagacacacttttggagg

SEQ ID NO: 17123 - DNA, 1435 bp, Heterodera glycines
  misc_feature (18)..(18): n is a, c, g, or t
  misc_feature (29)..(29): n is a, c, g, or t
  misc_feature (43)..(44): n is a, c, g, or t
  misc_feature (78)..(78): n is a, c, g, or t
  misc_feature (82)..(82): n is a, c, g, or t
gatcatttcttaaattgntgaaatcattnttaaaatattttgnnttaattaattaattgatttatttttactttcaantttntcagaattctttatttatttttcagagaaaaacaatcgggatttgcagtcaaacttgcggttggttgtttttgatgtgatgactgatgaccatttattttaattatggttctttcagatgccaattttggctgctggggcaaggaaaacagagactgtgtgaagtgccgaaatttcacgatggaacacaatgtgtgcgcggaacaatgccatactgagagggggtaaataaaataaacaaagtcatgcggctcgggattagcgttattctagaccgaaattacgagatttgagacagggatttatttttaaaattttatttaactgttaacaaaaaatcaaaaaccaaaaataattttttaattttgcatagcaaatgtttccatatcaatgtttttatattcaaacattaattatttatattattcaaataatcactttcgattctgacggaacatttaaacctgagaatttgatcaactcaagactctcgatactcaatctatgtctcccatttacagccatttcattgtttcactgtcctccgctgacagtgcccccgttcggcattgccttcggtgccatgagcagtgccacgagtgctacgggccttccgcgcgtcaatgttcaaagtgtcaaaactttcaactttggctcaacaccgcacttccgctggcggacaatccgtacgtcgacgcgggcactgcaggggccgtgaagcaatgcgtggccaaatgtccgaacatgacgtaccccgaaggtacacacagctgaattctcgagtatttcagaacatttggcaacaccaagatcatgtccatgggttttggtctcacatcttggttttttcgttttttcttgagtccttagaaaatttgactccgcggaggggaggagtggtgataaaatgaacacaatcattttcagacgatgtttgcgtgccgtgccataaggcgtgccgcggcggttgcactgggccgagcgcacgtgttggcaccggcggatgtaatcagtgtaattacgcattggaaggggaacattttggagaggtaaaaaaaaatgtcaaaataattataaatatttattttagtacatttgtctgtttggtgatgagccagaaaaagctgtttgcggtgagaagaatgggcttgcagaaaattatttcatcacattgtccaccagttcatcttcgacaacaaaatatgtaaataaacgcggaaattaaattaatttaaatgaaataacgaattaattattctaaatataattcaattcaaattattatcaataagattcgtttaattggtttatcacacaatattttttttggttgattttccataattgaagttgt

SEQ ID NO: 17124 - DNA, 1064 bp, Heterodera glycines
agtgatcattcctcgcactgtcgtcgatggcgctgagttctctgcgttcaaattggcaacggcaccactgccaacggcacattcactgaccaaccgccaacgacacaggcacaatttgttgtcggcctttgccaacagtgccatcccttgtgcgacccacacttctcatgctctggcccagcctcaacggagtgcgaccgctgctcagtgggcggtgtgccgaacacacagaacggcacaattcaggtgaatgctgaaaattcacccgaaaatgtgaactgtaaaatatgattttttttgttttgtttgttcacatattacagtattccgctcataccgttgttgttacagtgtctgaccgagtgcccgcccgacttaccgtttccacacgacggactctgctacgagcagaacattgaagagcatcgacggcagcgcacgcgtcgttacattgcacttgcggtgttcacatttttcattgtggcattcacaattgcggtaagccacaataagagattcattatttaaaatatattaattaatgggtcatcaaagaaagccgaaaatcaaccaaaaataagtcgaaattcaatttggctgcgtaataattagagcccggaaccgtgatttcagtacttagccgagatttttgcactaactcaaaaaacttttaaagaaaaaattttgaaaaataattcaaaaatccgcaaattttttttccgtttccgatcttgcaattattttaaagcaaatatttcaatcccaaatgataataagggagataattttgagaaaattttttgctttttcattgagaatttttttgagttcgagtgaaatcccgactcagtaccgaaatcccgggagggattcgcgagtcacatatatcattatagttactgtgtcttactgtatctgcataaaataaatattaatattaaaaaaatttcagtaaatgtttttgttaagtttctcatctatcgctgtctaatgtatcagaagaaatatgtgaaagaggttcaaaggcatcttccaggcgagaatatttatcaattttatgtttt

SEQ ID NO: 17125 - DNA, 2241 bp, Heterodera glycines
  misc_feature (55)..(55): n is a, c, g, or t
  misc_feature (60)..(60): n is a, c, g, or t
  misc_feature (102)..(102): n is a, c, g, or t
aaagcaaattaatttatgtatgtcaacgataatatcttatcgaaaaaatattatntaaanaataatttaatataggaaaaaaagaccttaaaaatatttatntaaattagttttgattgcacaattattttattctaatttataatttaattattaaacaaatttttgaaaaaatttattcttccgaattctttcaacggttgaagcaatttgttctggccaattaaattaatttgattcccacggaaaaacccagtttcggcgtttctcctaatgaactgttattccattcttctgtcatgcttttccttcctgcgcttttcctcggttggccaagtgcaattacccaccgggggagggcaattaagttaaagcacattttggaagaaaccaaaaaaagttttgaggaaaagcagcagcactttaaaagtgaaaaaacaaacaattaaaatacatttatttaattatttaaaatatatttttggattaataaataaaaaaggcaaaaaaaagtagacgaaaaataaaataattatttgtccgctgtttttttgccgaatttattttcggtgctccatcaatcatctttagcataacaatgcgtctaattgtttacattcctcggccaacaaaagcataaacaaatcttttgccaagccattgaccactgttttggcattttcatcaaccaaaaattacaaatttcgccaccgccccgggacacaaaactgtgccatttgagagtattcaaatgcacaaacaatgaaaattataaaacgaaccgtcgtcaaatttgttgaaatattataagcaaatcccatttttttgttgaaattaatgatttggttaatatttgccataattaattagcctattttgtcatttcacctgtcaaaaaagggaattggtgaaacggaccacctgccaattaattaattagaaaataagtttaacaaatttgacggaatgtgaataatcaaatttgttcatttttctatcattatcaattagtaaatatataaaaataagccaattttaatttattcattgtccaattcataaaaataattggaattatttcgtcttttttataaaataaattccaacttttgatctttaaaataactttaaaaataataattccatttaattttataaatttattttctaaatgatttagggtaacaaaagtgccaattttggagtgcccgcccatttccgtcgattcattaccaaaaataaatgttcaaaattaacacttttttattttaaaatgaattttgcctggcaacggtccgtccgtcgttttttggcattttccattttattaacagacagaaacaaacatcaaatgccatcttgctaattggtgtcttattgtgtttatctgttgatgtttaatataataatatttcattttaatttaattttttttcattatccaacggaatgccaatttttttccattttttctcttaaaaatgaaacattcattattttatggcatctgtctgatttattgcttggcatttcgtattttaatttacggcaggtgtgatatttttgatactttttttctttttttcggcattttattttgactaatgaaaatattataaataaaattttttacttagggtggaacataattttgatacccaaattttttccaatttttaaaaatcataactccgttatttctgcgcctatttaaataattctttttttattttgttcttcatggtttcctcttttatatcttactatcgtttcactttttatttgattgatagatttttctgccttttttcccgaccatgccaaaattgaaaattggcccactaatttttctcgaattttttatggtcaaaaaccaaagctgatataataaaatcttagtttttctatacaatttataccagtagaatccgaatatggccttaaatgcgacctatcttttcaacctgagcttgtactgctccaactccatgcatgaagttcgagctgtacaggtttgttgcgatcccagagaccaaatctaagaccatattcgaactcaacatacccgatttaccttgtttaattaaattcagaatttccaaacccacttttaaaacattatgtaacttgggggccttgaaaatgccagttttggaaaccattttcacttctcgttctccaataattaatttttgaattaaaaatttaaattttagggttctaacaccctaactttgctct

SEQ ID NO: 17126 - DNA, 967 bp, Heterodera glycines
tttgtgtaattaaatttagaatgttcacaggcagcaaaaaaggaacaaaacaaaagtaaaaaaaagcacatgccaaatgcaataaatatactgtggaatagctatttataaaattgtaacgcattaatgaaagcgaaaacaattagtaaccgattagtaaaaaatggccaattatttgttaattactgaaattaaccaattaattaatcagaagggaaattaacgtaaattggaaccaaaatataaaataaaaaagcatttattcagatatatttcggaaagtaatttaatgatttattttaacaaatttttattggccatttaacttttgggttttggggagagaaaggactttcgtccaatttaaatatttaaattttttttctttgaaatgccacaaattggccctttttgagttggagtttaaagcgtgccgttctcttccccccccccctcccccttttgctcatattttatgtttctgtctccccccgcttttctccgcttttccttccccccattttctttcgccgcttttccccctaaatctccccggagatttacccattccgcccaaattctgtttgtattttggctttatgtagcggagtaacaacaaattcgtgatttatcccattttataattttgcccgactccaaaaatatttctcctgtttctgaattttcatcccatcgatttaaaatttatttttattttttgccgaattgacaacaaaatgccattaatcttttcgtttcaacgaagaaaggtgagcaaaaaatggcacccaaagtacccaattcagagctccattcattcatccagcacaaaaagaaaaagcgaaaataaatctgccgattgaaattaatgaaaaataaaaaataaaacattgaattgtttggcataatgccaatgaattttattaagaaaagggggattaaatgtttaaaaagtgcaaatattgat

SEQ ID NO: 17127 - DNA, 988 bp, Heterodera glycines
  misc_feature (981)..(981): n is a, c, g, or t
tttttatgcgtcccaaagaacttttatgcgtcccatgcccttttttttatgcgtcccaaagaacttttatgcgtcccatgcccttttatgcgtcccaaagaacttttatgcgtcccatggccttttatgcgtcccatggccttttttttatgcgtcccaaagaacttttatgcgtcccatggccttttatgcgtcccatggccttttttttatgcgtcccaaagaacttttatgcgtcccatggccttttttttatgcgtcccaaagaacttttatgcgtcccatggccttttttttatgcgtcccaaagaacttttatgcgtcccatggccttttttttatgcgtcccaaagaacttttatgcgtcccatggccttttatgcgtcccatggccttttttttatgcgtcccaaagaacttttatgcgtcccatggccttttttttatgcgtcccaaagaacttttatgcgtcccatggccttttatgcgtcccatggccttttttttatgcgtcccaaagaacttttatgcgtcccatggccttttttttatgcgtcccaaagaacttttatgcgtcccatggccttttatgcgtcccatggccttttttttatgcgtcccaaagaacttttatgcgtcccatggcctttttttatgcgtcccaaagaacttttatgcgtcccatggccttttttttatgccacccaaagaacttttatgcgtcccatggccttttatgcgtcccaaagaacttttatgcgtcccatggccttttttttatgcgtcccaaagaacttttatgcgtcccatggccttttttttatgcgtcccaaagaacttttatgcgtcccatggccttttttttatgcgtcccaaagaacttttatgcgtcccatggccttttttttatgcgtcccaaagaacttttatgcgtcccatggccttttatgcgtcccatggccttttttttatgcgtcccanaagaact

SEQ ID NO: 17128 - DNA, 3454 bp, Heterodera glycines
  misc_feature (91)..(91): n is a, c, g, or t
  misc_feature (100)..(100): n is a, c, g, or t
aaaaaaggtacattgggtggatcagaaagtgcatttggtgttttggttgtcacctcaaaacgccggatttgcgcgccatgcgctacgagcnaatgaaccnaatgagggtgtggctttgtgtgtgtgacgtcagatctgcgcttgagtcccgattttgtgcggccaaagacaatatgatcagctttggcaacaatatttttgtgaaaattagcggcgactacggtcaaagcttcaccaaaattactgtctcatttttccaagctgtgcggtcaaattcgccgtcaaacaattttattgttgctgtttttccggccaaagacagcagagaaaatttagagcggtatggagaggcactgtgggggaaaattgagcaaattgatgcgttggcggggaaaacagtgaaatggtagacggaaaggctaaacttttaccattttcaatttaaaggttcattggtggcgacatcagctttatttggtcattgatcggtcactgcggttcagccgttacaacttttccttccccaatttgcacgtgccgagctgatcagatgcttcatgagcaatgctgccaacacaggacaattgatcaaacagtggaactcgcggaacaataccgcgcagcattgcaaaatggcgacaaggcgactgcagcggttcgatcggcatcaatgggcatcacgaaaccgcctcttctccgttcaattaactttgatcggatcatccctgccccttttcacgtctttcaaggcattggaaatgccattgttcgagaacttgagaggcaggagggatgtgcgccgattgttcaacagttcttcagaaggatcggggcccgaagggaacaatttcgaaaaagggatttgaccggcaactcaataagaaaaattttggttcgcgctaaagaaatggccgaacttttcacaatggaatggcccaaagctatttgtaggacactcgaacacctcggcaaaattcaaaacttttcaaaagtgttttgtccgattttattgaaataaaatcataaattttaggcacaaatgttgtccccaaatgacctggacggacttgagcgatcaattgacaatttcaaagtgtttttggcagagcaggaccggatgagtgcctttctctcaaagaaacccaaggcccatcttctactcttccactttgtgccatttgcacgaaaacatcaattcattggccttctggatgagcagggtgttttaatattttcaaggtgatgaagcgcttcattcggtgtggcgaagactcgaacaatggtggaaatgtatgcctgacgcggaacaaattttgcaacaattggagcaccatttcgtcaacaattggctgctggacaccggaaggattgacgaattgaagcgggtttgttttttcaaaaggtttcccttttctgaattctcatctttagaattatgaagaaaggaagggcgaggatgacacggatgaagaagtggcggaagaaattgatgacgaatgccaaattgatgtaatttaacaaatttggattaagggatgattttcaaaaaaaaagtgaagaaacaaaatattttatcatttttgtttatttttcagaatatttatttgtcatttataagtcgttttttgcttaaaatcaccaaaaacgtccgttaacatgcatcggattcgaacctggaacccccttttggtgactagcacatataccactgagacaaaaattcaaatctttttggaactgggaggcaaaaactgaaacggtgtgtctataaataattttaatttactaataatatttattcataatatctcaaaacaaatatttaaatgtagaaaaatgaactaaatgattaagcatcaggtaaattattcttacaagaattttaatatgaaaattttatgaaatatgtaataaaaaaaatttaaaaaaatctagttaaaataaattcatatggaaaactatttaaaaaatattattaataaaaagacgaaatgttttttccaataaatataaaggcaatcaacaaaataagaggatattaatgaataaaaagggtgaaattaacactcaaaattactaattaatttgaataaaattttttaataagttttggtccaattccaactaaataatattatttaattgattttattagtttttttattttgcttatttaaaaatattaaattcgccgaccctcatttagatatttttattaaatatttccaaatatttaattttcaaatcatgcatacctatagtatgttatataatttaagctattttttaacaattttaactctttattcagtatattttaacccaatgtaaattggaaaatattcttatctaatcatatgatatggtgatatgacgaagttacaaaagtaataaagtttgtaataagtacattaattattatttaattttatttgctaaacaaagaatgatatcttagcttaaacatagatcctttactacttatgtaatttataaaaatctagcaaaaattttaaaaagttttagcttggtaggataagttttataaaaaaagaagtaatattcgttgtttctaaaaaagtaattaattaacaaatttaataaactagcggggtcagcgccttcggcgcatcccccgctaggtagtacgattgtagtgtaagattatgtttgataaaatcgactggctcggccgcttcgcggcctcgcatcctttttttgctttttctccaatcgtcggactcaactcaccagcatttcaatcaccgggactcaattctctaggagttcaatcactgggactttattctcctgcgtttcaatcactgggactaaaccctccagcatttcaatcactgggactcaaccctccagcatttcaatcactgggactcaaccctccagcattgcagtcactgggactcaacacaccagcatttcaatcaccgggactcaattctccaggacttcaatcactgggactctattctcctgcgtttcaatcacccggactcagtttttatgcattccaatcaccgggactcattctcctgcatttcaattactgggactcaaccctccagcatttcaatcactgggactcaattctcttgcatttcaatcactgggactcaaccctccagcatttcaatcactgggactcaattctcttgcattccaatcactgggacctaacctcacctggtccttcggcatcgcaatcatcgagactcaattctgcgaaattccaatcaccggaactcaattctgcgacattccaatcactgggactcaactcaccatcattccaatcgctgggaccgaacctcacctgattcttcggtatcgcaaccaccgagactcaattctcctgcattccaatcactgggactcaattctcttgcatttcaatcacagggactcaagacaccagcatttcaatcaccgggactca

SEQ ID NO: 17129 - DNA, 1437 bp, Heterodera glycines
aaattaaagtaacgggactttttagaacagaacgaaaggatttatttggttaaggataattgttggaaatcgccatagatttggaccatatgcgaaaaattcgcggtgaacgtaataaaaaaaaccaaccagcattgacttgtgcaatccgactcgttaaaataaaatgagctttaaaataattgcataaatttatggggacagtatatataatgtttttacttgtaagtttggggtcagatgcgttcagaactgacgtcacactacatagtttaatataaaaaatgttgtctgccttttttcaaatttagctggcgtaattgtaaaaaggaaaatacgaaatattaccgggatacaaaattaaagtaacgggactttttagaacagaacgaaaggatttatttggttaaggataattgttggaaatcgccatagatttggaccatatgcgaaaaattcgcggtgaacgtaataaaaaaaaccaaccagcattgacttgtgcaatccgactcgttaaaataaaatgagctttaaaataattgcataaatttatggggacagtatatataatgtctttacttgtaagtttggggtcagatgcgttcagaactgacggcacactacatagtttaatataaaaaatgttgtctgccttttttcaaatttagctggcgtaattgtaaaaagaaaaatacgaaatattaccgggatacaaaattaaagtaacgggactttttagaacagaacgaaaggatttatttggttaaggataattgttggaaatcgccatagatttggaccatatgcgaaaaattcgcggtgaacgtaataaaaaaaccaaccagcattgacttgtgcaatccgactcgttaaaataaaatgagctttaaaataattgcataaatttatggggacagtatatataatgtctttacttgtaagtttggggtcagatgcgttcagaactgacggcacactacatagtttaatataaaaaatgttgtctgccttttttcaaatttagctggcgtattgtaaaaagaaaaatacgaaatattaccgggatacaaaattaaagtaacgggactttttagaacagaacgaaaggatttatttggttaaggataattgttggaaatcgccatagatttggaccatatgcgaaaaattcgcggtgaacgtaataaaaaccaaccagcattgacttgtgcaatccgactcgttaaaataaaatgagctttaaaataattgcataaatttatggggacagtatatataatgtctttacttgtaagtttgtggtcagatgcgttcagaactgacggcacactacatagtttaatataaaaaatgttgtctgccttttttcaaatttagcgggcgtaattgaaaaagaaaagtacgaaatattaccgggatacaaaattaaagtaacgg

SEQ ID NO: 17130 - DNA, 1795 bp, Heterodera glycines
  misc_feature (1712)..(1712): n is a, c, g, or t
taaaatgcaattgggaccatccatcattagtgtacctattaataatttcagcacatattcatgagaaaaaaaagaaaaaaaagacaaattgagagacggaaaaaggcacggcgaaatgtttggcgaagcgatcgcattgattgattctctccgtcatgtgatcactgctcaaagaatgtgatctgaacaaaaagcatttgcaaacagagcgatgggataaaggaggacgcatttcaaagttaggggggggggagggaacgaatttgagaggagtgagtgagtgagtgagtgggcggattggagagggcaggaaaagaaaaaaagtaagggctgagcggggggggggggagacggcaaaacaactgctgaaaattgagaaaatgatggaaaatggggggcgggagggggtgaagggaatgaaatgaaaagatgccaggcaattaaaattaaatggcaattaaggcaaggggacaacacaataacgtagaatagcaaaaattgaaagaaaaattgagaattttcaaaaaccaataaatttcgtgggaaaacactgaccaaataattttatttctcaaaaatttagagagaacaatagaaatttcgtgaagaaaatcggcagacactcggttgatgtttttatttcaaatttgtttttgcttttaatttttaatggttttcgtaacacaaaataaaggcacaaaatgtaaacaaatgccaaaaaaaatcaaaaatctcacaaaattggacacttcttttggttattaacacatgagatagagaagaggaaaattaatagatattgaagcgaaattaatcctaatttgatcgagcaaagggtcggtggttcagctggtggaactctgatccggcagaaaatcagagacgccggttcaaagccgtcccgccccattgttttccctcaaaggctttgttcattcatagaaaatatattcacacataataaataatcacatcattttcaatgttttcttcttccctttttctcttttcattttgcaatttataaaaatgcaaaagaaataaatattcgaagaacaccgatcaatcaaagaaaaatgaatgcattgggcaataattgtcatttgctcaacaaaataaccctttcactgattaatttttgtgtgttaatacacaaatttaaatttaaatattattttaaaattattagtttgatttccctccattttttgccattcctcacaatgtttcttggcatcgatctcggcacttccgcggttaaagttctgctgatcagtgctgatcagagtgtcgttggttcggcgagtgttccgctgaaagtgtcgcgtccgtttgacggatggtccgagcagtgcccttccgattggctccgtgccacccgcgaggccattgaccaattgcggcattcgaaccctaaggcaaatagtcctttattcaaatatggtggaaagaaattttaatttacttttaatttgactttgattcaaatatggaaagaaattttaatttacttttaatctgactttgaggcgttttgtgccctccgcggcatcggtctttcaggccaaatgcacggcgccgtgctgctcgatgcggccggcgtgacgcttcgcccgtgcattttatggaacgacatgcgaagtcaccgcgaggcggacgaattgaacgcggacgcgcgcttccggtcgatcactggcaacgcggtgttcccncgggttcactgcgccaaaattggcctgggttcgccgaaacgaaccaaagatttttgcaaaaatgcaaaggtggaaaaaaggaa

SEQ ID NO: 17131 - DNA, 1458 bp, Heterodera glycines
tttccgatttgtccgatgcctccggcacttgctggttggacatggcccgtcggtgttggtccgtcgcccttttgtctgccgtcggtctatccgtctcgcaaatgcctcttctggttgagagcactttttcggctggcactttgcgcactgaactgacgaaggagtggggcctttcagaacgcgccgttgtggcgggaggggcgggggacaacgcggcggcggcgtgcggggcgggcattgtcagtcaaaggacaaaatgtcgaattaattaattattctgtttaaattaccgtttaagctccgtcccggcgatgcgctgctttccctcggcacttccggcgttttgttttgtcccgtcgattcttttcattcggacggtgccgttgacggagtgcacactttttgctttttgccgaccatgtggcatcagatgggcgtcattctgtccgcgaccgattcgttaaattggcttaccaaagcgaccggggcgtcgccagatgaattgacggcggaactcggcggcgatttgaatgctcccggcgcagtcatttttttgccatatctttccggggagcgaacgccgcataatgacgcgatcattcgcggaagtttcaccggactatcgcaccaaactgatcggaaagcactcactcaggtcaattttgaattgggtaaaggatttatgggaaaatgacacaaaaaggaaaaacggaaacggagaaaatcgaaaaattaattaattaaacaatattatttcaatttcacaattaaataataaacaaaaagataagcaaattaatttgatttcggatttctgctccagagaaatgagggcattcatttgccaattttttcagcaaatcttctttatcttttttaaataataaattttgcatttcaaatccaagtggctttaggctgttctcgaaggagtggctttcgcttttcgcgattcgcttgaggcactttgcaaaagtggcaccaaaatgccttcgcggatcatcgcgactggcggtggcgttcgctgtgcttattggatgaagctaattgccactgtccttggagtccaaatagaagtgccgacagaggaaagtggaaatttaggtaattttcggacgcatttcaagttcattagcaaatcctaattaaggtgccgcttttggtgctgcaagacttggaataattgccgctgaagggattgaccctttgagtgtttgtgagccgccaacgattggccaaagcttttccccgaatgagcagctgagagaggcatttgagcggaactatcggcgctattgcgcactttatccggcactgagagcgattgatcagtgatcagaaggggaaatgctttgattggccaatgactgaacagaaatttgatcattcgttgccattcatcactttcaatgcttccatgaattgtgctttcttgtccgtgttctgttcattgttgat

SEQ ID NO: 17132 - DNA, 961 bp, Heterodera glycines
aaatataagacgaatctttgcatctgaattacgtttcgtagtaagagagtcgtcaatgatcagaaagttggaatgaaattaataataatttcttaacaaaatacttaaaaatttccactgtggcgcctgtcggcatgcccccccccacaccatctgtcccccaaaatttttttgaaaagcgcgcaacaaaaaaagagcggaaaaaggtcgttgatttacatgtccagattagcaaaacaatctccctttgactttggattaggatgaataaactttcttacaattaattgtattttcagattgattgacaagtttcaatagatttaataattttcagggaggcgactaaggcactaatcagcgattccttatttctgcaaaagtggtgtcatttttggacaaaaaactttaatgcaatcaaactgtcaattttcccagccgcgcctaccgtcaccgcctttaagttccgcagtaatttttaaagtgcgccgcaaaaaatctgtgtaaaaaaaaattgtcgccgggaaatttaaaatgatcgaatgcaatgcaattataggtatacccctaaaaatcgaatttgtacaatataattcagggaagggagtcccgtaacctgaaatggaggagagagtggggggcaacacggtcaagtagactaaattttgttgtcgctcttcgacccatttttttcctagtgtaaaatcccgatattttagtaccacggaagaaaaaaagcattgttctgttcgaaagtgagcattttcgaagagaaaagtaatcaatggtccggcggcgcagatcattttaaaatattctatttgtcgtaagttttccactgttatggaatgagaggaagttctattgaattacctttaaggggttcacgggaaccggttttcctgctgtatggctcactgggtccatgttgaatttgaaagtggtgtactcgggcaaagca

SEQ ID NO: 17133 - DNA, 2556 bp, Heterodera glycines
  misc_feature (47)..(47): n is a, c, g, or t
  misc_feature (114)..(114): n is a, c, g, or t
  misc_feature (2442)..(2442): n is a, c, g, or t
  misc_feature (2477)..(2477): n is a, c, g, or t
  misc_feature (2529)..(2529): n is a, c, g, or t
  misc_feature (2536)..(2536): n is a, c, g, or t
aggtcctcgtccagtcttttctcgagcaaaagagtttcaatccgcanaatttgttgggttgtatatttcgtacatattttcaataccttaacgtagatttatttttttcaaatntaaaaaatggaagtgctcacaaaccgagcccatcaataacatttcgaagtgtaaaagtgtgctgaagtccctgttttcgcgccgaatgcatatgccaacgaatctgtgctgcttacttacggtgttagggtcagacattgtgacagctaacacagaacctggagaacgaatttattatttgaataaaaatgaaaattaaatttaaaaacaccaaccaacatagaattcggggatgtcaattaccatacgtctttcaaacatgtctgcttggacgagttgttcaaacaacgggtctctacgatcaagaacttcggagcgaagaaaatcaggataagcaattctaaattactaaagaataaagcgttttaatttcttccccacgggaaatcatccagagaaattgcatttatccgctcagtcgacggctgcttcacattttttgccctaacattagcaagcgtagtggccaagcgtgtagaaggaagcctttttagcaataatgaacaaactgacaaatgcattaaaattttttattgaatcttaatttgatttatttcaatgataagagataaattaagcagttgtttttcaaagtcagtaattaaaaaaatatgaattaaaaatttagtaatttctgtaactgcaaacattggaagggcggatatataagtagatttatttgggaagaaaatgaaatgcagagaaattttgaataaataattaattgtatggccttatgttttgaaatttaaaaaggctgattcgccgatttacctttccctttttctcttatctgcatttttcaatttctcatttctttccttttcttttttgtctcaaaactaatctaaggttaagaaaccaactattgcgatggctgctaatgaaaatatgcaaacagaagacaataaaaaaggaaaagtgaccaatgatgagcgtaacttggtcgtctcatttattcagtttttgcgtcacaaagtctcatcgaaccaatgcactgatgaacagattgaaggccttgaaggttttctttttgactaattgttggtggtatataaaaaacgctgcttgaattttttaatcatttcatggctttttatttattgtctataattttaatgcatagaattaatcagccaggtttctaagcaaaatctcaaatttatttcatccagtggtgaaagcatgaccggcaaattgttggaatgaataatagaacatttcgaaactggccattaaaattcaaatagcaattctatagagtacgagtcgaaaaaaatcggattcgggctcgaaaacttaaaaagcagtttttaaaatagaattgttttattctttctatcttatttttagttgctattcaatgccttgagaccgccttctttgtttctgacagaaactatgcgttccaaccgtccaaacctctcatcgaaattttcaaagcagctgaaggacttcccgatggggttgattttcagttttcccttacgtttaattgaatttttattgaaggatcaagagtttcctaagccgactcaaacggacgttgagaagtcaaacgcattgaaggaagaaggcaacgaactcgtgaagtcgaacaagttcgaagaagccatcctcaaatacaacgaagcaattaagttgaatcgcgaccctattttcttctgcaacaggtgtccattgaattcacacaatgcactattgaaatgagttttacaaatactttagagcggctgcttattgtcgtctggagcaatatgatctcgcaatccaagactgccgtacggcattggcattggacccgaaatatgcgaaggcttacgggagaatggggtaatggacattaattagtattcgttatgtttacaaccaaatccgttttagcgttgcactttcatgtcagaatcgttacgatcacgcggttgaagcgtacaaaaaggcattggaattggatcctggaaacgaaaggtatcatgaataaaatgacaaataaatttgaaaatgcaaagggtgaccactgattatttaatttaaacattaataattaaaatcgttttatcctttctacttttaagctacaaaaacaatttgtccatcgccgaagataagttgctcaagactcgcgaaacacttcgaaacaatccgcagccggtgaactaaaacccaaaaccaaaatttaaacgtcaattaaattaagaaccctttcgccaatatgttcggtggtccgggtggaatgggcggacttatgaacaacccagaaatgatgagcacaatcaccaatattatgcaggtaatttaacagtattcatattctgatggcatttattngtaattgaaggaccctagtatgcgaaatatgatgnacgcaatggttcagtctatggggcagcccggtcacaaaatcaggaccaaggncagctgngaaccttctgcaatgcttct

SEQ ID NO: 17134 - DNA, 1098 bp, Heterodera glycines
cataaaaaatgacaaaatgttatccatggtcccgtatacaatattatcgccattcggtaagctaaggattacagtatcgtcacattatttaatgcatttccaccaatgtatgcgttcagatcaaaaaagtgcagctgtattagtggaagtgatgatgtcaatccataaaaagtagaaaattatttctaaatattaaattgtttttaatatagagtgaaataaattattaaaaaattaaatttaaatatttttaaatgtttaaaatgatctcatgaaaaatctaaagaaacaattaaaaagaaattttttaagttaaattaaaaattcataacaacaaaaaattaaatgaataaaaaaatttaaaaaaaaaatttaaataaaataatcaatatttttaaaaatctttaaaaattcataataataaaaaatattaaattataatataaaataattattaaaaaatgaatatttaattcttatttttttcaaatatttttcccctctttagcacttgcattcgttttggtatgtatgtaaattattttgttaatttttctgttcattatgctcacccttttccgaccgtatcaacacgccggcaaagcaacagtactaccgtaatgatgattacattggcattataaacgaccgggggtaaagcaaaaaatatgccaaaattgtgtatcaattttttttgttgtttttgctatttttcaggtgccattccgtcattgggcgacacagtggcaaaaatttgttgacccttcaggttggggaggctggcaaagtgccaaaatttgatttgttttttacaacaattcgaaaataaatttggcgtcggttctttttttgaccatttccaatcactttttggaaccataatgaacccattaccagttttgatcactttttgaaccaaaccggtggcctatttttgatcatgaccaaatgcgatccgttttcgtaaaaattttgcccattttttgatcgtatcgtttacgatcgctttttggacaaatttcttccacctgatcgattttcgatcacttatgtcgcaacattaggtgagcatcgaatcaccgcaaagcgctcaaaatg

SEQ ID NO: 17135 - DNA, 1309 bp, Heterodera glycines
  misc_feature (107)..(107): n is a, c, g, or t
aagccgagaattgtgatgcatgaggtgaagcaaatgcgagagcattttttcaaattatttgggggacaaatccccgaaaccggcgcgggacgggattttgcgggtcncagtcagcaatcccacattttttggaaaatgcgggatagtgggattcgtgggattaatcccccgggtcccgtcccgcaaaaattttgagttccaatcccgcagcggtgcccgcaaatttgaaatttccagtctctataaatccttcaaaaaaaatttttcgcgtctttccacacctttcggggatgataactcaatttttcaaaattcaatcgaataaattttctgggctttatttgacctgcgcacagcactcattcccctctcacctaaaaatctcaaaaatagctaaattttccaattatgacgaaaaaaattcagaccttttttttgaatactttggctataattttttgtgaaagtcagcgaattttttaacttgctaataaagcacatttagatttatcggatgatagcaagtattaaaattttgttattcttgaccaaagttatgaataatatttcgtcaaaattttccatttgattgtttattgttttttgagtaacgacccaccaccgacgaagggggcagggctaagattttaatttatataatttaaatccgtcagttattgcacattctcggacttcaccatgagcaccagcgccgggaccggtccgagtacattgacatcaacattgacaacgtaaggaaaggtgaaaaaatgggggtggcgtaagggagaaaaatgcaaaaaaaaaggcataaaaatgaaattttggcattttttcataggcaaagaaaagaattttcgcgaagaaatggaacaagaaagttggggcctgccgttcgattatgagagtatcatgaactatcggtacgatcagtttgccaagaacagagagaccaaggaccaggacgagggcatggtgatcagagttcgcaaccgcgactcattttgtaaggtgctgatcaaatttgtcgggtcgggcacacacgtgctgttcgagagtctgtctcctcaggcttggaaggatctcgaactttttgaactctctgccgtcttgactcgagaaaaagcacgaatccttgggttcacttatcggctcgagaaatcccaagggttttccagtctcggttcgtgaaagatgtcgggtttttgaggggttcccagtctcaactcgagaaatctcgcgggttttcgaagggtttcggtattgaaacgcgtgataagtggatttaatggacacaaaatcaagaaag

SEQ ID NO: 17136 - DNA, 2021 bp, Heterodera glycines
ttcgccgattttttctttatcattttcgttgttatctttaaaaacttacaatatatttattaattatttaaatttaaataaatgctttttgccttcgtttcgtgtcggtggtgccacaaatgggttgttgttgttattattgttgttttggttctgttcggtggccgccgtttcccaaccggcactttcgaattggcccgaagtgccaaaatggacacttccgtcaaccatttgcccgtgccatgtgctgctttccattggctaaatgcccattaccaattcaatttctcctatttctaattttattttttttccatttttcccacttcttccgcagattctgctgcttcttctccgcttcgctccctttgcttttcctccgccgatcgctggtgtgaggactgagacagagacaactgttcggacgccgtggtcgtcggatcggagtcgaacaattcggggtatttctgaggaatttaggggaatttaaattttatagggaattggagggaaatgggcacggaaacaaaagcaatactcgcaaacgtccatattttttaagatctgtccttattttgagtctacatttaattattttttgaaaatgtgataattgcgcacataaatcatcgattaaatcctcaaattttgcttgttgatattggcatgccgaactcttcctcaattgaacttttgaattataaattaaacatttcacttgaaatagacagtgtaatttcggataattaatttgggttttcctttactaattaaaagaaaaacttaaaatatgcaaatgttcaaataagcaatggataaagaataacattctctgattttgacttttcacctcctcaaatgcgctgaattggcccacaattgcctcgccgttgcacaaattttggtccccacaaaggcaataggccacttcgaccccattaaggtcgaccacgtcgcactcctccgccaattggtacggtttgcgcgggaaagtgacgtggtgcgcactgtccgcgatgcattccttcaccacagtgaaagtgcctaaaaaagggggggggaagcaatgaaaaacattttaaacaaaatttaattgccaaaaagtgccgcaccattcgccgttttgtgtcgcgtcgtgcgacaaaatattttctcgtcctttggaaagcgtttggcgtacccatcgcagctgaacggaaaggacgttttgcactcgccgaactcgtccaagccattctcagcacaaatgtaacagttcagagctaaaaatgcttattataacctttgctcacagtaaatggaaaatattcgaataaattattttttaaataatttcaaattaccatttgcaccgagaaaagacgcggagagaaagaaaattgctgtttttgttataagaccggatgtaatcatttatttaatcttagtaaaacaaaataaatgattaaattaactattgaaatacgatttcaaatgtttattttgaaaagtcattcaaaaaacttcaatctcagcaaaatcgttttccttcggggctttggattttcggatttgctcaatctctttttttgggctttgaccgtccgcccgaaaaacgcgggcgaggcgcacttttcgtcgtgtaattgggtggatcgtcgccacaggggatgaaatgaaatgaaatcgaatggaatgaggttggaaatccatcggtcagaaatccctcgaggcattcacgcaaaatttgaaaaaaagaaagaaaaattaatctttaaaaatgtgaaaaaataatattaaaaaataggcaaatttaaaaattaagcgattattttgaaatgtaataaaaacaattacaacatgagaaatattaagtaaagaaaggagcatcggagcaattagagaaataaagcaaaaataaccataatttttgaggatggaaaagtgagtgattaagcgaatgatcggaggaggaggcggagaggggggtatttagaggtgttgttattacatatgacatcccgcaattacttgcgattgat

SEQ ID NO: 17137 - DNA, 2621 bp, Heterodera glycines
ctgcgtttgttcccctcccaccttcatttcacggttgctccacgaggaagttgccgagtatttcgctcagagtctttgtgtctaacacatggcgaagagttgtctgtgccagcagagtggtggacgacgaaatattccccatcataacagcctgagttgcgttgaacacacggtaaaagaccacctataataggggaatattttaaacgggcatttaaaaataacacaggaagccgaccgcgtcaacggtgacagtgaccgaatctttggaaagcacttgctgaggcggcacatcacaagtcacggtgcgcaagtccacgcagcgatatctgcaaattgagtggtggcgcaccgtttgtcttcaattctaatcaaacaatataaataaaacacacgcactcatcaacgcatggaaggatgaagaacaatcctgcaaaaaaaaacattagaaatgatatttgctcgttttcttggctaccaggtccttgcgctttacgacgaatacgtcccagtcgaaaaatgacctgaacttggaaaaggatttgtgtaaagtgacattgctccaaccgctcgctcgtattgctggacaatctaaaaaagaaaacggaatggcaattaccaaatggaaaaaaggcaaattgttatcttaatgcaagagaagatagtgcacggaaaggtgaagaacagcagcacatagctcatgaaaaccaggaacattgagaagcaactgaaaagggaaaaaggcgtaatttcgtcgtttttagggtttgtcgctgttttcttactcgtccgggtcgcccatatccgacactgatgactgttgacgttgcaccgatgactgttggcgttgcatcggtgacggaggattttcggaagacattaccaattagggggacttttttatatgtataaattccttttgatttattaagcgattagaatttcagcggagtaaagaaaaattaaacacaaagaaatgaaaaagaaaagactagtgaagaggagtgtttaaagaaagaagaaattcgcctttatatacgggaaaagggactgcgtttttgtttcttttgaaatttctctcattttgccatatgctccattttaaaattattctgtaggtaatgtcaagtccatcaagctgtatttttaatgtttaattgggtgcttaaagaaagattattatgcgttttagtttttgtcgtgttattttattgtcgtttcgtgtaaactgaaatagagccaaagttactacaacatttgcagaagaaaaaaattttgagtttattagtttctttcctcttatttgtattttcatgtgcttatcagatgcaaaaacgacggttgttcgtccaactaaccatagatttgacgcgtaaaaaataaactacgtaaatccaggcccaataatacataatgctaatggtccaaatttgtcgaattggggtccgggacccgaaaaaagtcaaaatgacgtctgttcatgtcagctacttcaaaaccaccagaaacaagttttttgacaacagcgtttcgtgaaatatggcaataaagcactttcggtactttaaggtagagtgccacgggaccgggaatttttgccaaaaccgggaccgggacttgccgtgacctgagaagccgggaccgggacctcgattttttttcgggaccgggaccgcaagaaaaaccgggaaccgggaccaaccgggaaattttaaaaattcaaaaaaaatttaaaaattaaaaaaaaattcaaattttaatttatatcaagtgaaaataatacaaaattatttggttttttataataaattaaattaatgaaaattttcaaacaaattttccaacaaaaaaaggttggtttttgcgattagtcaaaaatcttttttttttaaattcacattttatacaaaaaatcactaacaatttttaataataatgactagggagtccaattatatgcacatgcatatttttttcctggactgtgggaggcctgaaacgcacgaaaaacatgtttttagcttgttttgaagcttctaagatgactttccatatgcatattttgcatatttgtgcatatttcgcgatttatgtgcatatttgcatatttgtgcatattttggcatttcgtgcatattttatgtgcatattttggcgtttttccaaaaaacctctaatagatcggcccccaacagacaaattggactttttgacctcaaaaaccggaaaattttccaaaaaaataattttttgcaaaattttcacgaaaaatattgaataaataaattttctcaaaaaatggttaatttatgacaaaaataagcaaaaaaagcaaaatttcgctttttgggttgatttttcgcaaaaaatgagtaaattttgtttatcatgtttttttctcctaaaataatttttaataccacatttaggtagccatttttgaagattttactttatgtttaacaaatttgaagaaattttgagaaattacaccctcaatttggaaaattttatgtgcatatttttcagtttttatgtgcatatttcgcaatttttgatgcatattttatgcgcatattttgcgattttatgtgcatatttttggatgccctaattaatga

SEQ ID NO: 17138 - DNA, 2083 bp, Heterodera glycines
atccaacgcagaattaacgtcccccctccagacgaagctattcccgaaggattcgagtctccccataatatctggacgggtccgagtcggggggactgccccgacaacaaacacatagatttcttcaagcgtccgcatgagggactccaacaattattaagaatgtttagatttttattcgtctccgcttttcctagtgtgagcatctgagtggctaagatagcttgagacagggttcggtgagggtcgagcagcttgtgaaaaaatatgtatgaattaggttttgctaaaaaaataaaatagtgaagctttaaaaattaataaaaaattttaaattcagaattactggagttagcatcatagcagtgcttttccttgtctttttgatgccctcgcaaaatctggttcgcttctgatcagtttataaaaaaaaagttaagcctaaaatttttcgcaaatttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttataaaaatataagcctaaactttttggcctgtttaaaaaggaattaaaaattttttaaatatttattcatctccctttttgataatataagagtcagagtgccttattcaacttgtaaataaattttggtgcgtttcagagcagtttctgtaaaaatacttatgaattaattttgtaaaaaaataaataaataatgaaccctcctccttaataatttttctgcgcccaaggtactcactcggccgcttcgcggcctcgttatactgttattgatcgtatccaactgagaatctgctgaatggggtttttggctgcgctgaacccgaatttgatgccgccgtttttataggagcccaaataattttttaggaattttattgtacctgtttcgaggtaggctttaaaatgaggcttttgccaaattagctctcgagactgtagccagacggaagcagggcccagccgttcgtccagttgactttttacagaagtttggggtggtatttttaccaatcagttttttatactgttattgatcgtatccaactgagaatctgctgaatggggtttttggctgcgctgaacccgaatttgatgccgccgttgtcataggagcccaaataattttttaggaatcttattgtacctgtttcgaggtaggctttaaaatgaggcttttgccaaattagctcttgagactgtagccagacggaagcagggcccagcggttcgtccagtggactttttacagaagtttggggtggtatttttaccaatcagttttttatcctgtttcgaggtaggctttaaaatgaggcttttgccaaattagctctcgagactatagccagacggaagcagggcccagccgttcgtccagttgactttttaaagaagtttggggggtatttttaccaatcagttttttatcctgtttcgaggtaagttttaaaatgaggctttagccaaattagctctcgagactgtagccagacggaagcagggcccagccgttcgtccagttgactttttacagaagtttggggtggtatttttaccaatcagttttttatactgttattgatcgtatccaactgagaatctgctgaatggggtttttggctgcgctgaacccgaatttgatgccgccgttgtcataggagcccaaataattttttaggaattttattgtacctgtttcgaggtaggctttaaaatgaggcttttgccaaattagctctcgagactgtagccagacggaagcagggcccagccgttaggccagttgattttttatagaagtttggggtggtattttta

SEQ ID NO: 17139 - DNA, 1691 bp, Heterodera glycines
  misc_feature (64)..(64): n is a, c, g, or t
  misc_feature (90)..(90): n is a, c, g, or t
tctactgtcattcacttgcgcaacagacactatcttctaacagggtttcattattatttaaaanttggataggtgggcgccttttagaanaattttttaatagggttgaaaatccatttgctttctcttagggaattgaaaattggttttttgaaaattctttatttggtcatttatttcaggtacaatttgttctcgactcaacgctggacgtgatactttccacaaaactgaagggttgtgggctttactgaaccatttactttacacccatatgtaattcctcacactattataaaacatgcaaaatttttacaccgatttttttgaattgagataaaatgtgacaaatttttaaaaaaataggcctagcgaacccgtgccaatactgtttcctgctgtacttcgttgtgtcaaatgttttgtgaccgatttgccttacaataggtcattagcagctataactattgtatttcatgtgtctctgattataatttttatgctactgtttttgcttgactgtcgctattagagaccgaccgatcgctttatcgatcaacgcctaccaatgtttcgattttatatctttttcgagagcgatcgatcgaatcaattagtcggtctacagcagggacagtcttgtaaaggggaacctacggcttatttatttgctcttcggccgcaaaaaaaaaaaaaaattaaattttgtacaagagaagggctggcggttaaaaattttcaaaaagaccaaataaaccttttaggtatgttgttgctagggccgataaatatttattgctaaagatcaccagcttcattaaatttaagagttacaattcaaaacgaaaaaacaaattaaaaaattgtggttaattaactcgtttacagaaaaataaataaatggattttcatatgaaattttaaaatttaggaaaaaatttgcgaaaacatttaaaaatattgacaaaaaatattggattagaagttaaattttaaataaataattttttgaatttagcataaaactgcctcatacattttcatgtatcgaaacgtcaaaaaaatacaatacattaaaatattttataatttattataatatgagtgcgttaattatttccaaatttgattcatgagaaaaaagggcataaattttttctgaaaatatttttataatgtttatgaaaatttaaatttgagaagatgattttttggaaaattttccaacttttatttcggaaacccaaattccgatcaaagaagcctatcacaactgtccatttaagtgttccattattggtggtattcattttatttccatgcattaactgcttttggccgaaaaatgttaatttacaaaaaattaactttttggttctgattaaaaaaaaataataatttcatttaaaaattgaaaaacaaacaacaatttttcgtgtaaatcaaaattaagtcatttgcatttttttccaattttcaagaacaaatatttatgctcttcataattaatttgaatgcgtaattcgacaatctcatcgtaatcaaaaacaatcattttctttgttttaattgctcttttgtgtccaaatttgctgagccgaaaattaacaaagactaattaatgtaggagatgataaaaatgaccgaagtccccaaaacagcgaacgaagtggtaaatgttgaataaagga

SEQ ID NO: 17140 - DNA, 1363 bp, Heterodera glycines
  misc_feature (49)..(49): n is a, c, g, or t
agtaaaaagctggttatttcatgacaaaattaccaaacctttaacaganattgggcaaattttaaacattttctgaacaaatttattaaaggttcaaaaaaaaaaatttttttttcccagcggcgcctaacggcaccgccgaactcccatttcactatattttttgaaaatttgacccccaaaattgccaaaaatagtcattttttggcagacggctatattcgtggtttttctccctagtgctgaaatttttaaaaaacaattttttttagaccgaagtgcattagttttttaatttaacatttagattttaatatttaaataacatttaaaataactgtaaaatatttatatgtggcaaaaaaaatttaaaatttccaccggtccaaagttgcgacagtccaaaaagaagcagaaaaacaaaaaacgatatgacagaagtcagcacaaattgccaaaaggcaatttccaacggtatgttcttcatggctgtctaaaattcaaaaaatatggaattaaaaaggcttccaaattgaaaacgaaaaaaaaattggcatattttgaaaaaggtgggactggagaaactatcgttattcaaaaagcatcaaatggaaactttttgaaaaaattattcataacataacttaaaaacaaccttaattcttggtatcattcaatagccctaaatgttttctattagcctataaaatttcaaaaacatttttgttgcctttcaaaaaagttatagccagaagaacgcaaaaaaacaggttttttcaaatattttgatcatactttttataaatttaagaataaaatttttgaaattgggtagacaaacaaatagaaaaaaattagggatatcaaatgaaattaagaaggagggctcaattatcgaattatataattcatgtattaaaatgattttttccttcttgacaaaaattatgggtttacgatttttttttcaatgatcgatctggacgatattagatcaacaaccatagtgcccagagtgaagtttaagccgcgtgatcttttccattaagccgtataaaaggaattaatttgcttttaatgcctcacatcactcaccacaatatcgaatattcagacagggaaatgacttgtcacttattgccaacgacgcagtcagaaagtacgcctcgccaagcgcctctatgaaacggtctcaaaacaagtggaagccgtcatgtatccaattcagagtactgtgaaaacggaaggatataacggactaaatgggaatggaaggaacctcacagtcaccatgggcaagggttatgaaactgaaacagttcattttggaaacaatgatgactatgaagaaggaacccaaaat

SEQ ID NO: 17141 - DNA, 1806 bp, Heterodera glycines
ccccaattttattaataaaaattattgagaaaaatgcatttgggattaggaacaatggtttaataaccaattaaattccgaatacaatttgaaaactcagccatttgccggtccaaaaaattctattaatgaaataattgcagagggatttttttctaaaaaattaagctccgaactttatttatttattttcttgaaaagaatttttgattttaaaattatgtgtctcattcccattttagcacctattttgggggtttttataatcagggagcaaacaaacgttttttgctgtcttttttcaattttttgtgcctgtaatcccttaatttttatgcttttttccaattttttgtgctgattttgccttttttgtgcttttttcatgcttattttgggaaaatttggtgctttttacagtgcttaatcggtgattttttgtgctgaaagagaagaaaattctaattttttggggtttccgtgtggtatcgagtatcgaagtcaaaatcggtatcgagtatatacgtgaaataatgacaattttaaggccatttaaagtcataaattcaacagctctattgttatcagaatgctaatagagcatgttaaaagcttttaagtgaagccattttgttcaacttggcaatcaatcaacttaaaaatttgactggccagacagaattggccactccgccggcggaccagcgacagtttcgggggtcgactacccgacctattgggaatgtttttaaaaatatttaaaataatttattttttaccttatcgctgatgctaagccgctgaaagaagggaaacgttctgccaatttcgaacacaaacaacaaatccatggccaaatatggcggcatcatgcacattggcccattctgttggacaatttggtgaaacaattctgtgggtgggcttggcatttcggtcttaaatttgtcaaattttcatcatttttatggtttggaaaccgaaaagttgtcggcacattcaatcaaactcaattttcgttcaaaaatcgactcaaatgcgtcgcattgggcgaaaaagatgtccgggatcttagttttcgagtcgcgaatcctgcactttccgctcaacctccatcatatgtttcatcaaaatgaaacgcgcgaagtttttttgtaccattggctgaaagtttgaaattaatagagataactaatggggagcagcacaaatttggagacattggaatatttggcaccggcactaacactgtttttaattgtttttgtgtctaattttccgggcaatgtctaagtgggcactgtttgataaccgagtccgtcaaggcccattttggtggttcgctgctttgttcggtcgtcagtgccgacagttccgtgccaatgtccgttgcttctgatgatgctgctttctccgcttggttggcattggcattttcctgctgctgctgctgctccatttgctgtttcatccgttgtgcaaatgccaatgtttcgtggacatttgatttgttgcagttaacaccgcgaggattcattccgaccgtaaggcatttgttcagtcggcaccgcttacattttgcaaattctgaataaaataacaaaggcaaacttttatttgttagcattttttgtttgcccttatgattttaagcatggaaagacgcctaaaatatttctgattcattttttttacaattttctatttacgtatttctcccttttttaaagttccatttttaatgtctttcgtatttcctccccaaaagaaatgtttttttttaaattataattggaggtcatttga

SEQ ID NO: 17142 - DNA, 1125 bp, Heterodera glycines
aaaagtacaaaatttgctaatttttgactaaatcaactcataacttttctcagacgcaaccaaatgcagaatcttggtatcatacgataactcttgaagtgcgttattagctccgctttagtccttgccgtgtcgaccgtttgttgtaagtcgagaggaaatggctaaaacggagaaagcaaaagaggaagaagaggaggcatttttgcacgatggaatgaataattatttatttatttcaaaaataaaaatgaaaaaaaatgatcaaatttgccagcatttcttaaaaagatatcatcatatcaaaatcgtctaaatcttctcctgctggcgatggacaatctttttcttattaatgctttttcaattgctcactgttccccattcccaagtggtcactgtgccaccaatggaaccgttcgatggtggcacatctctgatggtaggacctaattttataggggaatagagttttgaattaacaaaattaaatctaaaaaataaaacattcaaaagccgaaaatttaatttcttttaattgtttttataaaaattagttcatgatttaaaaaacatttagtgtttaatggctaaaaataaactcattaaacaaacaaacaaataatttatttttacctcgaaaataatccgcgggctttcccgaatatgaatagggagcaggacgactttcggatgaagaaaatttttcaaaattatacgaacttccctgttaaaaaacacgaatttaattaagatttaatacttcgagttttaataattttttataattttatttgcctttttattgccctcatcaaaatgcgatgtgctgctccgttcgtttttgtcctccttcaacatttcgtgcatctttttgttctgctccgacaatctgtcccccaactgtttgctggcactgttgatgaagccaactttgtcattatagctcatattcattggtgcttgacgtcactcaaaaaactatcaaaataaatagtaagcaaatttgtaattttaatacaatagcaccgataaaaaaagtaaaaaaaaaaatttttttttaatttttattatttttctaaatattttaaattagcttgaaaaggttttaaaaattggcaaaaa

SEQ ID NO: 17143 - DNA, 1759 bp, Heterodera glycines
tacaatagtgattagaagaggtacaacaggtatttttagaggtacaatagtgatcagaagaggtacaacagtgattaggagaggtacaaaagtaaatagaagaggtacaacagtgatcagaagaggtacaacagtgattaaaagaggtaaacagtgattagaagaggtacaacagtgattagaagaggtacaactgtgattaaaagaggtaaacagtgattaaaagaggaagaacagtgattagaagaggtacaacagtgatgagaagaggtacaacagtgatgagaagaggtacaacagtgtgagaagaggtacaaaagtgatgagaagaggtacaacagtgatgagaagaggtataaaagtgattaaaagaggtacaatagtgattaaaagaggaagaacagtgattataagaggtacaactgtgattagaagaggtacaacggtgattaaaagaggtacacagtgatagaagaggtacaacagtgattaggagaggtacaacggtgattagaagaggtacaacaatgattagaagaggtacagcagtgattagaagaggtacaagagtgattagaagaggtactaaagtctaacttgttattagatgtacaaaaataattcataattttaaatataattttatagaattaggtttatttaaaaatttaaaaaaactaaataattaaaaatgtaaaagtttattttttaattaataaacggaataatttattttactttaatttgaaatgaattattatgcatccaaatttttaaatctaattttgcttaaaaataaatctattcatcaaaagaaaaattaaatttaattaaaataattttgttattaataataaaacaaaaaataatttctttaatttaaaaaaaataaatttaaataatttaaaacaaatcttcaaattaattaaaaacagtgaaaataacccaaaaatgcatagaaaaataatgtacaccgtccgggtccgaacctgcctcttccctcctcataagggtgcctcagaatccccaatcacacaaggattctgaggtcaaaaaatttgaaaatttctagggggcctagctcgaaaatttttcacaatttccgaaaatgaagtacagccttcgatagagcttaaaaagctctacaattttactctaaggcaatttttgcctaaaaccgacccctgacgatttatgggcccgggactcaaatgtcccgctcaggccaaaatttttttctatttccgggaaaaaatcgaaatttttccgaaaaaaataccagtcgatagagctcgaaaaactatgttttggaagtggtctccatttctctgggaaaaatcgttaaaaaatcctaaaattcaaaaaccaaaaaaacgttttttaggcctaactcgaaaatttttgaaaattttcgaaattttaaaatttggaaaaatcgagctttcaaagctctacaataagtccgctggagccccctcgctcagatcaaaccctgacgcggtattcacctgggactgaagtggacaaagttggtactgaatttctcctattttttgcagcccttcctactataggtagaggcctagaattttttttgacttttagacaacacttcaacttaggttcctaccagcggaaagtttttgattcgagatttagaaaaaaagttatgggccgtcaaacgcacgaaaaaatgagaaatcagtccctggtactcagttggcccttggaccggaaaacctatatttttcccggatgc

SEQ ID NO: 17144 - DNA, 1100 bp, Heterodera glycines
  misc_feature (1011)..(1011): n is a, c, g, or t
  misc_feature (1038)..(1038): n is a, c, g, or t
  misc_feature (1050)..(1050): n is a, c, g, or t
tcgtccgcttcgcgacctcaggacgggcgcttcgcgcccgttttttaatttttcggtggacattcggccgcttcgcggcctcaggacgggcgcttcgcgcccgtttgttttattttgtggggaacattcggccgcttcgcggcctcaggacgggcgcttcgcgcccgttttttaattttaatcgcacagagattctgaggtcttaaccatgtctaaagtaaaatatgattgattacatattcgtgatcagcggcccaaataacccctaaaatcatatttttggaagattttttgtgaaaaaaatttccactctcaaatcatggtcacacccctttggtcacggttcccaaaatcacttttatttctataactttttttaaaaaagtgataataagctaaattaaaatttataaaatagagcaaaaaattgcggattttttgagtatattatttatataaaatactttttcagaatggagttatgaatttttttctgaaaaatcgaatttttccagaaattctggaataacttttttattttggaagatagaaattctaaatatataccataaaattctcccaatttttctctatttttaaagctttattccactaaatttgaccaaaaaagaagagatttatgaattttcgaaatttcactggattttccggggcccaaattgtgacgatttttcaaaattttttaaccaccttccaaaaagtctgaaaccaaaaataaagtatatattcgtcttcagcaccataaattaggccataaaaatacattttggctaatttattagcaaaataatttttcattaaatgcaaaaccatggggtcccccctatggttttgaatttcaaaatcacaattaattttataactttttttaaactcgtgataaaaacatgagataaagcacattagattgggcttaaaattctctacaaaaaagctcttagacgattttttgataaaatcaactcctgacgagttattgcgcaagaactngaattgaggcctaccgaccaaaaattntctatttccaanaaatttttgaaaaatttttctgaaaatgacaccaatcgatagagcatgaa

SEQ ID NO: 17145 - DNA, 2458 bp, Heterodera glycines
tttgccaaatttaataagaccattgaatttgtagaagaagccaactcattgaaagagtcactgcttttgggcagacataacagagaaaggttctcactgatggaatcggacatatgaaaacagtagaaggaaaacccaaataaaatgctaaaaaacaaatttaaaatgaaaattatttttttaaaaatagacatcagatgaaagacgactattatttttaaagtcatttctgaattatagtttttacacgaccaattaacactttcatttggccatccatctattaagtgaatacatctatatattattaacaaaatttgaatacatcaataattcaggaatttattttatttttttaatgtacataatagtaattcaacaattctttggctaaaaaacctttatttatggaaaagcctatttgtttttattttttagatgcttaaaacgatcaaagataaaatctaaaaaacataaactatcacaaaaacaatcacatattaacaagtcacaaaatattaatcaattttcaattccgccaccatttcctttccttcgagacaattgcaaatgttctgttcggtagtcaaagccatcaaatccctcgtcgcatacgtagcggaaccgatgtggggcagaataactaaattaaaaacaattcattaaatatgctctttcagaagcaatcaaattggttggctaatagtaaacgttctgtgtccatgttataagcgttagtttaactgcacttcttaccacaattgtccatgcgaaatagggaatggtcagtcggaaatggctccgggtccgtgacgtcgagcccagcggcgccaatgagtccatttttaagtgcttccgtcagtgcctcaatgtccaccaaaatgcccctgaattattctggtgatgaacatttgcaaagtgtacttctcatctgaacaggaccttgaaatgttgatcaaaatcgaatcttttttcattttggaaaatgcgcctttgtcaaatattttgacattttctttggaaggcgcagcgcacacaatcacaaagtcactttgttgaagaagctcgtcaaacgagacaaattcgaacggagagtctaaaagtagtaaaaacattgtccaactaatgaaaataaccgtttgaatgatttccaatttaattaacgcaccagtcacgggcttccgattgttgtaaataatgcgtttcggtttgaatgccacgattttattggccatgcaagtgccaattttgccaagcccataaatgccgacaacggagtcaacgagtgttttgccacacactgaaaatgaataacaaatgacatcaaaggaagggaagcgtaacagaggaaataacgtaacgaaagtgagactcactgtaatacggtgaccatgtcttccatccaccgcttaaatattacgacaaataaaccaaacggatgactgactcacttttgcgcagatctcacagcctcaggaactgtaaatatttaaggaaatataaaaggaatatttatgaaaaatacttttccgcgccgtggacagcagaagtgccatgcccaactcggccgtggcatcggtcaaaacacctgctgatcaaatgacaatccatggaatggagagactaacctggcgtgtatccaatgcgaatcccactgaaatccaataataaaacgggataaaaaacgactcatttagttttcggaggctttatggatccaattcattttgactttaagcaaacgaatgaaatgtttcaaaattgtcctatttttctgtgcttttcccaccgttttttgcatgcttccaaatcaatgtgctcatatccgacactcattgtgctcacgacttttaattttggtgctcgtgccaacaattcgtcgtcgattttgtccctcaacaaacaaaaaagtgcctccgcgtcggccaattctctcaaaagcatttccctcggcatttgaccattgcccgctgaaaatgaagagcaatcaaagaacaaaagttagatgaggaaaacggacaaaattggcaaacgtcgccgaattcggccaattttttcaccgaaaccgtcgaatcggtgacaacgattttcgctttggtcgatgagttttgcgccatcgtccgccttaaaggattgtgaactgaaaacgcaaacagtgaaaggagttttcgcatgctaaaaaagtagtaaaatatttgtcacttccattttgattattaaactgacgaaaaattgataacaaaatgaaattaggtcaccaaaaagacaacaattgttaacaaaaatgggagagacccaaacttggtggcatttatacttttgttacgaacgaagcaattcaaattaaatgacatactgtaaaattcaagttatgtacagtatttgtacccttttttggtatttggcttggaatacgctatttacatgaatatttctgctcatttgaatatttaaaagt

SEQ ID NO: 17146 - DNA, 1209 bp, Heterodera glycines
aagaagagaaaagaggctgaggagaagaaggctcagaacccccaccgaggctaaagccaagaaagacgcagaagagaaggctaaaaaggatgccgaggctaaagccaagaaagacgcagaagagaaggctaaaaaggatgccgaggctaaagccaagaaagacgcagaagagaaggctaaaacggatgccgaggctaaagccaagaaagacgcagaagagaaggctaaaacggatgccgaggctaaagccaagaaagacgcagaagagaaggctaaaacggatgccgaggttaaagccaagaaagacgcagaagagaaggctaaaacggatgccgaggttaaagccaagaaagacgcagaagagaaggttaaaaaggatgcagaggctaaagccaagaaagacgcagaagagaaggctaaaacggatgccgaggttaaagccaagaaagacgcagaagagaaggctcagaaggatgccgaggctaaagccaagaaagacgcagaagagaaggctaaaacggatgcagaggttaaagccaagaaagacgcagaagagaaggctaaaaaggatgccgaggctaaagccaagaaagacgcagaagagaaggctcagaaggatgccgaggctaaagccaagaaagacgcagaagagaaggctaaaaaggataccgaggctaaagccaagaaaaaggatgccgaggctaaagccaagaaagacgcagaagagaaggctaaaacggatgccgaggctaaagccaagaaagacgcagaagagaaggctcaaaaggatgccgaggctaaagccaagaaagacgcagaagcaaagaaggaggaagaaatgaagaagcaaaaggctaaacccgaagaaaagcctgaggcacctgccgaaggcgtagcggtagtgccggaagcgaagaaggcggaagagacaaaggaaaggctgaagcaggaagagaaaccagtggaagtgccaccatctccagcagaaaagaagagaaaagaggctgaggagaagaaggctcagaaggatgccgaggctaaagccaagaaagacgcagaagagaaggctaaaaaggatgccgaggctaaagccaagaaagacgcagtagagaaggctaaaaaggatgccgaggctaaaaccaagaaagacgcagaagagaaggctaaaaaagaggccgaggctaaagccaagaaagacgcagaagcaaa

SEQ ID NO: 17147 - DNA, 2016 bp, Heterodera glycines
aaggctaaaaacggatgccggaggctaaagccaaagaagaacgcagaaggagaaagcttcaaaagggatggccgaggctaaagccaagaaaggacgcagaaggcaaaggaaaagggaggaaggaaaatgaggaagcaaaaggcttaggcccgaaagaaaagcctgaggcacctgccgaagggggtagccgtagtgcccggagcgaaagaaggcggaagagacaaaggaaaggctgaagcaggaagagaaagcagtggaagtcccaccatctccagcagaaaagaagagaaaagaggctgaggagaagaaggctcagaaggatgccgaggctaaagccaagaaagccgcagaagagaaggctaaaaaggatgccgaggttaaagccaagaaagccgcagaagagaaggctaaaaaggatgccgaggctaaagccaagaaaaaggatgccgaggctaaagccaagaaagacgcagaagagaaggctaaaacggatgccgaggctaaagccaagaaaggcgcagaagagaaggctaaaacggatgccgaggttaaagccatgaaagacgcagaagagaaggctaaaaaggatgccgaggctaaagccaagaaagacgcagaagagaaggctaaaacggatgccgaggttaaagccaagaaagacgcagaagagaaggctaaaaaggatgccgaggttaaagccaagaaagacgcagaagcaaagaaaaaggaggaagaaatgaagaagcaaaaggctaagcccgaagaaaagcctgaggcacctgccgaaggcgtagccgtagtgccggaagcgaagaaggcggaagagacaaaggaaaggctgaagcaggaagagaaaccagtggaagtaccaccatctccagcagaaaagaagagaaaagaggctgaggagaagaaggctcagaaggatgccgaggctaaagccaagaaagacgcagaagagaaggctaaaacggatgccgaggttaaagccaagaaagacgcagaagcaaagaaaaaggaggaagaaatgaagaagcaaaaggctaagcccgaagaaaagcctgaggcacctgccgaaggcgtagccgtagtgccggaagcgaagaaggcggaagagacaaaggaaaggctgaagcaggaagagaaaccagtggaagtaccaccatctccagcagaaaagaagagaaaagaggctgaggagaagaaggctcagaaggatgccgaggctaaagccaagaaagacgcagaagagaaggctaaaaaggatgccgaggctaaagccaagaaagacgcagaagagaaggctaaaaaggatgccgaggctaaagccaagaaaaaggatgccgaggctaaagccaagaaagacgcagaagagaaggctaaaacggatgccgaggctaaagccaagaaaggcgcagaagagaaggctaaaacggatgccgaggttaaagccatgaaagacgcagaagagaaggctaaaaaggatgccgaggctaaagccaagaaagacgcagaagagaaggctaaaacggatgccgaggttaaagccaagaaagacgcagaagagaaggctaaaaaggatgccgaggctaaagccaagaaagacgcagaagagaaggctaaaacggatgccgaggttaaagccaagaaagacgcagaagagaaggctaaaacggatgccgaggttaaagccaagaaagacgcagaagcaaagaaaaaggaggaagaaatgaagaagcaaaaggctaagcccgaagaaaagcctgaggcacctgccgaaggcgtggccgtagtgccggaagcgaagaaagcaggagagaaaaaggaaaagctgaagcaggaagagaaaccagtggaagtaccaccatctccagcagaaaagaagagaaaagaggctgaggagaagaaggctcagaaggatgccgaggctaaagccaggaaagacgcagaagagaaggctaaaaaggatgccccggtgggagccaagaaagacgcagaagcgaaggctaaaaagga

SEQ ID NO: 17148 - DNA, 786 bp, Heterodera glycines
accccctccattccctccaccagtcatccccctcaccgtccgcttagtctctctctgcccctctcccccgctccctctgcctctctgcctgcctttctctctctgccggtcgcccgatggaatgatttgctcgccctttttcttccccttttattcattttccttttaattccccactcactcgcttctctcacccacccgttcagactccaaattccaccacattttcttttacacttttcactctgactgctcattcctctgctctttttccctaccttcccaaatcattcctctccatcatccagcaagttcaccacattcattcctctgatcaaaattctataccgccttccaccctcctcctcctcctcctcctccttctcttctcttcatttaacgcctttggctcatttgtcacccatcaatctcgtctcgtttcctttccatccatcctttcatttccaataattttttcatccatttccgatcactgaatttttctcaatccccccacctttcttttgttcattgattgatccaattctcacaacaatttaccccgtccatcgatggctttcctgatcggtcgatctcttctcttcaatggtgtctcttcatctatgtgtgtgtgtattacccgcttgattttcaccgataagctccccgtcgcctcgcttcccccccccccccccctcccctcccttcgtcatttcattgatacaaaaaatattccccacccctttccccacctcccgtttcatcgacagatttcaacataaaaat

SEQ ID NO: 17149 - DNA, 1428 bp, Heterodera glycines
ctcccccccccccgtcgttacccatcctgatatgcacaacactttgaatttgaattccggtgttggccttttcctaccaccacaaaaagcttgcccttgattatcaaatttttttagttttctcaatcgatccactgcttcgttccactatttccttctcagcaactgatcccccactgcccctcccactcgatcacatttctattgttcacaagttgtcatcggtggggcttttaattctcctccagcaacatattctcgagtcaacgtttcatctccgtttctctccgcaattcaaattgtccagccattagcgactttttaccgaacgaacaaaagaaccctttcatcgcataagcaacagaaagtacgacgccgtcacgagaaaagacagctgagcatttcgtacagtgcacaattcgcaaaccatcgaagaacagtatcacaggagaagaagctctgagaaaagctgaaggagcaaaagccgatgcagaggctcaagaaaatgaccatagggggcatcgccacttcgaatgtgccccaaaaacaacagccacaggcagtgtcccccgacagcaatggggacaaagagagaccgcgtaagtttggggtgggggaccaatacccagcggggctttcaagccggtgattttttagtttaaggcttttgggtttttaaaaaaaaattgacccaggttaagaatttgatatgcgttttgcctaatccctaatctcgataaaacatctgtttagattcacttaaactctaattaaattaacttatgtgccaaatttgtggaaaataaaatgtgttcgaatattttaacaggaggaggcaattgtcaatacacattgatgggggaaacattctgtaatactttggctaatgggtgttggaacggaagtgggatatttgctgggattgatcattactcgtccgattcactagcgcattcttaggatatcataggaggaaaagtgggggttgaagagagagggaaagagagtgggggaggggggagagagggatggaggaggagagaagaagagagtgggagagaggggggaaggaatgtactgtaggagactaaaatagtgtgagacgtgaaattacgacgaatactgcttctgataagaaaacagagaataagaacaataatagtacacaaaaaggggccattaaactaaaagaattttccaaatttgcgaaactttttcaaaagataatttatattatattaaataaatttttcaataaatgtctgaaaaaattaaaattcatcaatatttatttgttgtcattgaatataattgatttgttagagccaatttcctaaacgattcacatgaaacagcacatggcatttatttttctcgtatacacccatatattaaagtaagataaggttaggcgccatacatattttt

SEQ ID NO: 17150 - DNA, 2233 bp, Heterodera glycines
  misc_feature (1300)..(1300): n is a, c, g, or t
cagtttcttgatcatctaaagaatggccaacatttgccatctccccgtatcacttatccaccccactcactttatacatcgcagcagctttgctgtgatatttcacttgcgcatcattcgactcgcatccgtgctgcttgaagaaagccaccttaatttgtttgtcagatgctttagcaattattcgaaaatggagcgattcaccgcatttgcatttcctccgatttgcatggcactaaattttggaaaacaaaccaaattataaaaattgttattgaaccgaagctgaatccatgacctgaaatggcaaaagagtgtgcaaacattcgagtcactgtaccaatttgtgtccaaattggtggaacggacgaaggacaaatggactccgaggttacggtggacagaagagcaatcgatgcaaatgaaaacaccgtatgtgactgaagaccacgttgggtttcgagcaccacagtcaaaacagaccttagaaagaaaaagattaaaattaaaaatgggttgagactttgttggatggattcgctcgtagtcttttaaaaatgttctcaatgtccggaggtgtgggagaaattaattcatttgccataataaaacaatattttcgaccttgcctgaatgtttaacaaattatctgtgaaataaaacaaaattataaacaaatgtttgaactggttattccacctttctttcatagacaaaatgaaaagccatcaatctaaacaaaaaaatgagaaaaaactgatccatcttagcaatttgtctgtgcgccaattcagaaagtccgaccaaaattataaattgtcaattacaacgcgcaaataaaatgaacaaattgactaaaggaaatcgctttaataatttaattttcaaaataaaatgcagacataaacgggatttctccttgtttcatgtaatgaatggtcattagatttcttcaatttccatctgctgttgtatttggtctttgttattggcggcttgttccacgtcatccaaaacattttcaattgctcgaatttgaacaaacccgccatgtgaaggctcacaacgaaaataccttaaaataataaattcaaaaccaaaacatgcaaaaagaaagtaaatttgtattgatattacctgtgtccatcaagtgaaccgtcatttttcccagttgcttcgtcataaattacgccaacccattgagtagtccccggattttcgccaaaatgagtaggaccgacaaaagcaatttgggcttttcgtggaggttgatcacggagttggacaatacagcgcttcncaggctttatggacattagaatggattatatttgtgtttatgacgtttatctaatcaaggtatttcaagcagaaagaacaaaatattttgctgggcacacattattcgagaatttttttgcaatttatgataattaaattttattcaaatcagataactaaccccaattttatttggcacttgctgctcggatcgttcgactaaaaagcgattggtccactaaaaaggctattaagtttgtttaccatcggttgttgtcgttgcagttgtcataagttgttgtttccattttcgagctgtgtctaaaataataagcatcgttttacattagcttgttgattatcatactattgtattttcacttttttaaaaagtctaaccttttctattggcgtatctctcttcgggaattacataaaatgcattggggtcattcgtggaattatcatttcttgtttcactggtatcgcaaacattcacaatgcactgatctcggactcccaactgttgaaaaaattcgagaataaaataaaaggaaattacaaacttcttctaaggtacggtcgtcgccaattaattctgaaataaatttcccttcgtgcgaacgcaattcaagcttcatatcagcagaataaattcctaccacaagctccaattttaccttaaagatcattattgtaaacaaacaaagttttccagaaaaggatttttttaccttaaattcaaccaaagccattgttgccggataacgcaccaaataaggaaattcggttttatttgttgagatggataaattaatcattatttcaataattatgtaaaggatttaaagattaacttattaaacataagtatatggtacatgataaccgaagggaaaaacccaactcgtactgtttttcgacagaaaaaacgtcacaacttttgttaaag

SEQ ID NO: 17151 - DNA, 3429 bp, Heterodera glycines
  misc_feature (1128)..(1128): n is a, c, g, or t
tgaataactcgcaaatgtaacttattgaattttgttaaaagtagtaaaactttacgaaaaactacttactttttcctcaaattttttatgtccatgatggacaatcgaaaaaaaatcatttgaacattttaagcgtgttttgaataaatttagtaaaatgaagcattttgaaccaaaattagttgttttttttcttgcctgccaaatgccaaataaggcttttgaaaattttaatcgaaccctgcttttaaataatgccaatttagggtgagtggaagcaataaaattaaattcataaatatttttcgaaaagaataggacatttagcacattattattaaaacagatgaaggcgaataatttaaaataaaggttcatttttgaactctttcagggcttcattttttagcaaaacgagtaggaaatgttttcccatttggttatctaattatatggcggggggcatttattttttgtaaaggcggccgcgccctttatctaaatttatctaaaaactaatcggaaaaacgggggaaattgctctttattcattgtaaatgccgcctccataatacataatttagttaacccaatagaaaaacatgaatctattcgttttacccaaaaccatgaatcccaaaagagttccaaatgaacttttgtttgaaattattaaaatatattcatgaattattttgtatctctcatccagcaccctaaaattggcattatttaaagtgtgtgggggggggcgatatccactgaatattgcatactgtatttgatggaatacggtttattcaataatttaaaaatgaaaaattaagttgaaaatttttttaaactaataagcgttgaaaatattttcaggttaagttattccttacacttatgaattcacaaattggtgttgtataaaaaaattggaagattcatgaaccctggcatttatttcattcaacaataaacgaaccaattaaatgataaaataaacatcatttaaaaattttaaaaaaatgaattatcaaattggggtcgtggcatgcttcaaatttccagcacattatttgccactcgtcaattcattcagcaaaagcgaaaattggtgctaaattaattaaaaattanaaacaaaatccatgaaatttattaatgtatttatcataccattaaatttttgagtttataacgttcaatcaaaagaagtcgttctaagaatggaatttccacacaattggccaaatggacgccgcaacgctccttcagccaatcaatttggaagtaatcggcaattaaaaggaaagtgagcacattttgggctaaagtgaaaaaaaaacataaaatcacagaaaattgaaaaaaattaaatttatagttttaaaattatggattaatttgaataatagtcccaaaggagactaattggtgtgctcatttttatttcgaaattgtaaaactttataataataataataatatctcattaatatatataaatatataagtgctaattgccaaaaaaaaaatatttacgatttgggaagaacggttgacccaaggacgaaattgaaatggcatcagcaaattcgctgaactgctccattgtgatgcccaatccgtccaggttgatcgcccgctgatgcttctcctgcatctccacgctgagcatttgtttgaccattggcgaaacggacataagccaatgggcagaaatggtcaactgacgatcgccgatgtgcacagtcaaatcgtcgtccggcgaacaaattggcgggcatggactgagtaaatggaggggggcggggatgtacaaaaaaggatcagtaccatagccagataatttcggagtaggggcggagggctaactaccattcccctcaaagcgtttttttttgcactttataatcacttaatttttgatttgagtttgttcacaaaaattatttaaagtgctaggatccggcggtggcaaaatagacgccgacgagtaaaatttcgccgcttttaaatttttgataagatgacctaaccaaacggtatcttttgccaaactctttctttattccctttatttttgttggagtttcccattccaccaccggcatgagcctgaggccaaacaaatacggcaatttggtttacatttaataattaactgtattacttttcgatcacttcacgttttttgagaaatctgatcacaagagaaactggcaaatttgtttcaccttcagcaccaattgttcctcctttcttcagcataaaggtctaaaattggtgcctaatttagaaaagaaattagcaacaaataaatcaattactacttttagaatggtctgtgatccctgagaccatttccacaaaataatttgcgccaacaattcggaaccgttctgcagtgaaccattgctaatatcggtgattgtcaaaaattctggcccataattattataattatttttgtaatgccgatttttcgtgaattcactaaatttagtaaaagtcttattttaaaatatgaaagctttttacattgcagaaaattgggatttgactttgagaattgaagctttattactacagcaattcgtggtaaaattgaccattttttcgtcaacaataagataattattgtaaatgtccatccatctaagccagttttatttctaaagaaaaaaattattgaaaaatttcctaataaaaatttaaatataacataaaaatgtaattaagagttgatgtagaatataaggtgcacataattatgtgaatgattaataggaattattaatgtaataaaaaaaatgcattagataaagagatgagtgactttctttgtctctttttggtgggataggtcagcgttttgccgatttgtaaaaaatgcaaatagaatttatgcatttataattaaacatatatttattaagttaattaaagttaattaaatagtcatttttaggcttagattttttgggagcagggatcggggtcggggttcggggttttttaattttccgtatttttttaaaattttatacaagcaaaaaattcaaaaaaaaagttagtcataatcatcattaaaattaattaaatgatcagtgaaattgaatttgatcacatttttttttgctttccaaaacattttttcgcgcacgcttttcccaaagacttttgaggagaatgtggggcgcagctggggaaaatttttgaaaatttgagtgcaatttgttaacaaaatttcaccaaaaactgccaaatttttacgattttttttaataaaaaacgacgcttttttttgcggcgcactttttaaaaaaactttttgggagacagggtggttcggcggtgccgataggtgtcgccgggaaaaattttgttaagtttaatgctatttgttaacagatattgtctataaaaaatgaccaa

SEQ ID NO: 17152 - DNA, 2456 bp, Heterodera glycines
ttatttcgtaatgtgcacgtgactttttttttgttccaactatttcgcaatatgcgcattatttgggtcacctgtcaataaaaatgattgatgtctttcaaaataatgaatctccagacgattttttttacatttttgaataaaatggtcaaagctgtcaagaaaaatgattgatgaccctctaataaagtagacccagacagtcacgtgactagacccctcccctttttatccatttcgtacacccggccaaatcgcaaatcattcaactaaatagttggatttcattaaactcccttccgctctaatttattttactccgctctatttttctacattttatttcaaatctactgctattttcctccgtcaatttcttttcaaattcctctgctttttaattctgcttcaatttcgcattttggtttttaaaatgtcttttaaacgagtgaactctgtcaaacccgccgtgccaatggaaaaaatgggatttccgctcaattgggtaagtttaacaaatcttaatgtataaatagctaatccttttaagaaataatttcctgatggagccctttaaacttattgaccaccaaacttcaaaatgcaaaaaagtttggttttacgaaaaacataacggaatttgtgatcaacccggatgtggagcgccccgatgaaacgctcccgcgaatcatcgagagaaactccacacaggcttgtgaaaaaagttgaaaaaagtggtgaaaaaaggtgaaaaacgcatggataaaggtgaaatttaatggtgaaaacctatggggggaggggggttattgacagccacacgtgcaagggtataaagacgccccgcttcttacccccacctaaacccatatcttggtccatccctttttcatgtaattaattataaataaaaatttgctaatattttcgttatttgtgaaaataattaaacatcttctaatcaattatttggtccctccattttcaaattccattatttttggtctcctcctctctccttctgttccctccctcctctgccgccgcccgccaattatctccgattttgatcaaaaaatttatttcaaattccacatttatttttcgtcatcaaagtattccgtggcgtagtggttatgcgcccggttcgctctctcagtgctggtgttcgagttaagccccctcgggggatggcgtgtttggggttcacgccttcgaacgtcccccatgcgcaccttcgctgagagggacgagcccagctcggacatggtggtaatgcataatgaacccagttgaggaccagtccaagacaaggggtaccactattttttctattttcatatcattattttttatttttatttaaattttcataatgttttttgcagatattatatttctttttatcatattttattttctattttcattgaatatcttattttttgttatatttggcatcactattttcatcattatcattttttacactattttttctattttcatatcattattttttatttttatttaaattttcataatgttttttgcagatattatatttctttttatcatattttattttctattttcattgaatatcttattttttgttatatttggcatcactattttcatcattatcattttttatctacgaattattttttattaaaattcctttctgcagatattatattactttttaccagattttattttctattttcattttgtataagatttttgttacatttggcatcagtattttttaatctttattattattatcttttttgttatttggaaaaaaattaaaatttcttaatctttttgttatttgtgaaaataattaaactttcatttaatcaattctttggtctcccgttttcctcattttcacactaacatttttgctttcccttaaaatatttctcaatttttattaaaaattaacaaatgaaaaaaacaaaatggaaccgtcaaaccaatcatttatcaccaccgcccgatgcggccaccgaatatcttccagcttcgactgcgagctccattcccaacgtaggtccgcagagtttttttaactcgggaattgacctaaacaaattaaataatatttaaatatatatatatatatatatatataacaaaaaatgtcattattacatgctttttcgaattcagtttgtaggtctccaatatttttttaaccagttcgtgcttttgaagcggcccagcatcatgcagaatcaattttatcatctaaatttagaaattacccctaaaaataaatggttaataaacagaaacgcacaaatatatatggtgcaggttcgagacgggcaatgattttaacaatttaaagacaaatacctgaatttacgataattttaatgaaaaagaaattaatttgcacattgtaaaaaaagtatttgtaaaaacgatatgaaaaa

SEQ ID NO: 17153 - DNA, 3453 bp, Heterodera glycines
caaattcaggttgcaaaaatttttttcgacgttcaatttcgaagatgaaggaatataattgcgataatggaggagaatgtgatattgaacaatgtaatattttaaagttaaatggtatattagataggattaaaattggaataaatgtttaatttttatataaacaagataaaacatgtaaactgtgccggctgaacaaatgcttaacggtcggaatgaatccgcagggcgttagcgcaacaaaattcagtggtcaacaaatattggcatttgtacaacaaatgaaacagcaaatggcatcattagcagcagcatcaacatcagcaaatttgacaggatttgaattgtgcgcacaaaccaacaccacaacaaaaaatgggccacaacaattgggatcactaaattcggttgtcaaatcaaagacagaaataagttaaaacgcccggttaccgtaacccgttttcaaactttttatggtaactgatcggtaacggttaataaaattttttaattatttttaagtcaagtccaactcggaatgaactgattgaacgggaaaattttctctttttttaataagccgaacttgcaaaaaaatttagatttataagatcttctgaaaaagtgcatataattgttcttaggccaaacaataaaactccgagggttttgcacaagttctggtcaagtacagttcgaaccgatttttccaagaaaaattattatattttccataattcaaaattttacttctttcttaagtgcaaactttaaataaaagaatatttccccgatgaaaagcaggctagaattgttttaaagttttcttcagtttttgagtttcggcaatagcatcttgaaaaagtaaaattgaaagaatgaaaattatttctttcgggaattttatatttcttgcaaattttataaaatgaaagtattttgttttgatttttttttaattaagcttagcttttcaggtaaacaatcattagcatttgtataataatatgagtatttaggcgctggaacaaaaagattcgatgggtttcattatgttgaaacatttgctggacattgagcagaaagtgcgccgaatacgcttctcaccgacaccgattccggaatttttttataaacaatgcgattcatttgaggcaatttttgcacggaaattaaatttgcttgatttgacgcgtaaattttcggtgagcaaattatttaaaatgggttttaattttaaaatttaagacaaaacagtcgaacgtgcctaaagcaatattttttgaaaaaatacgtcaatttgggcccttctttataaggccagaggaactggtcagagatttgttatttgtattcgaaattggcaaaagttttcctttctttgcgcggcttgacatcaatgataaggtaaaaaatatttttcaaatttattcaattttaatttcaatttaaagattgccctgtgcagtaatattgcgatgccattgtatgtgttatgcaacggtttctactcagtccaacaaaattgtgaagttttttgtaatccagctggtatgaagcccattcagaaattcaaaaattcattctatcatgaagacccaatgtatgcatttatttaataattttcttaaaaaattaaattcagtgccatgggaatgggtgacacattgttgtgcaaagccatagaaccattccgccgtttaaaactgagcaccgaagaatttgtacttattcgagcaatcatttactccaatatgggttagaagttttttataaaaaatttctacaagaaaatttatataattaatgacaaattcaattaaatttttagtttcgccagggcttagtgaccaggcacagaaattgttattatctgaagcggagaaatattcttcactgttaatgagcattttacaggtaagtaaatgaatcgagttaatttgcacatcttaatgagtttcgcgccacttagaccaataacggtgctgcgccgggtgccctacggtacgtggaactgatgggactaatcgaaggtctcttcaacatgggcgccaaataccgccaattgctcacttacatttcaaatgtgttggatccgaattttgaccgagtgatgcctcccgtgctggccaaaatatgcaccaaaaggcccgtggaatcgcacaaattgttaccgtattaaattgaaatatgctatttctaacattcgggcttaggtccgacatgctatttgtgcttatttcttcattattttgattttaaaaacaaaaaatgtgattttaaaccaaaaatttataaaattgattattttggtgcaaaatctgttaacaaatcgcataaaattttcaaaaaacaaatttttaaaattgctctttccgatggacctaatagtttttgtattttataccccagtagcactgccgtgcgcggtatacgtgctggcgttgggatttggagcttcaaatttggtaggggaattgggtgcattggatttgcacacacatactcccgacggaaaggccatttgttgtgatcagacccagtgagggagatcccctgccgctctaagacccgcacacttaatgggataagtgactttattctcgggagactaaacacatatctctaaatacaagtgaaaatttaaagtgaccgttcactcacaatcggggagaggggcgggcgatacgataaacaaaaatgaaatcagaaataaaatgaaatttgaaagtgaaactcgtgtcatctcaccaatttcgttaaaatcccccatgacaactcgcaatctcaaatgcgaaaaggattttagggcattttaaaattaatccgcacaattacctcaccccttttaatgaaccttgagaaactttaaaagattaattactgttattgataatttcctaagaaaaattcctcctattactttttatttaccgtacctgaattgccaaatctgtaattatctctctcaattcttgtttttctctgctccaatcacccatagcatggtcatcagctgattcttcccaatttcgcgtattttctgaattagatggaccaggaaaatgtaagctaccaacaaaatggatttgcactaaaaggcataactttttgctcttattatagtaagtgtaaaaaaaaaatttgattctggtcatttaattctgtgccgcaaatgtcattttgactgggcgccgtatgtgtcgaaatgtctacaccacaattatcagcgccgcaaatgtcagcgccgaaaatgtcgcatcaccgctggcggcgggacttttggtgttttcaatttgcggggaggcaattagggacatttggggtaggacattcacatactccccaaggaatggccacatgatttatcaggaccatgggtctcagcccactcttgatggacacatttgagaagataagtggttttattcagggttccacaggaaaaagaaa

SEQ ID NO: 17154 - DNA, 2343 bp, Heterodera glycines
caccgatggactccaccttgtacacgtcgtgctcgtcaatgattgcgtcgaagatggtgtacaggtcgttcatcagattgaccacctgcagcggccgcatttggttggacagtgccgcgaattggacaatgtccgagaagaacaccgacacacagtcgaactgctcgggctccacggattggccgagctttactcggtccgccacttggctaaaacagttgaatattgaaagagctccccccgctaaccgtggcatcatccgatagagcaaaatgccctacttgcgcttctcccccgccaactcgcgcgtcctttcctgcacttcctcctccaatttgttggcgtactgctccaacatttcgaacacgtggtccatcaaattgatgctctgaccggcgttcatttgccgcaaccgttgaagcacttttacaatagtcggccgttcgtttggggcttcggtccaacagtcgcggatcagatgaatctgatgagtttaaacagtaattgatttaattaccgaaaacccaaccattttctatgcacatggttcattttcattgttttagcatttagtcatttcattaattgcctttaattaccaattccgggtgcaaattatccaaagcgggccgtatcatcggtctcaatggcaccaatccgccccgcttcaccaaataggcaatttcgtccgcgttgcgtccgcgcgttgcgcctgcgacgtgccgcgtcgcggtgcctctgctccaccccatttcttccaagtcgcgcgtcgctccgccgtcttcctccgagtcgcggccctcctcccaacacggggccatgttcaccatcgtaaatagcaaataaattggcaaatttagacaatgagttaatgtccgtttgtttacttccgtgaaaatcaatgccattgtgtaaatgtccgactgttttgagccttcggccacatttatttcggcgccgtccgtcgctcttcgcaattgttcgggagacagccataaaaggtctacaaaagaattaattcattgattaattattgtaactttttcaccttttgcttgcattttttgcggacttttcagccatcgaagcccaaaatatgagattttcacttgccatcgttcgttgatcaaacaagcggaggatttcagtcgaccatggaattggagtggcgaattgtgcaggaactgaaggccctggaaggggaaaaaatgctttttacttttataattttgaaattaataattttaattttcatgagttccttagaataaaaccaattttaaactaaatgccaatttatttaattaccctcaataacaaaataaatcaatctctcacttcgcaaagctccttgacggccgattggatgaacatcacatctttgaccatggcattttcggacaaaatcacgtctctgatggacccgcgcatgcaaaagttccacacggccaacacattgggcccgtccaaactcagccccaaaaaccggttcatattctcgtggtcgaataggcgcatctgaaaattttaattaaaattttaaatcgaaaatggcattttttgtctttttcttaagaagctttatccttgctgggggatacgtaccccattaaccccttgggatgttccctgccccttggccatcctttccccgccccctccgccaattcaccgctcggcactcggccatttcagcgacagacaatggcgcggcggctgtcattgacccaaacgtgcaaacaatgcacttgtccccgttgtaagtgtacagagagaagtttttggactgggccaaactgtccatcgtcgaatgggtcagcgcggaaacgttcgtttggttggagcggagggagtggtgactccgctcggcgccatgcttaaatagggggggggataaaaattagaaaatgatttgggatgaattataaaactcacccgttgcttcactcgcttcatcatcgcaaatggaatttgccacagtaagttggttttacggttttcaacaattttcgaactgaaatttaaacatttaggctacagtaatacttcagcaacttttttcttactgtattaaatagaccatgataagcaaactgctgcctatgattagcacgaagagaacaattccgcttatgaagtaccccttttgaatagcaaataaaattgttaacgttacagaaatatatcgtactttgtacaactcaaacaccgatacggtacaaccgttgccatcgaagccgcacgggggcaccgcctggggaatgaccccaccacgggtatcccacatcacagaactggcatttcgcaacgtcacattctgacgattgagagaatatatcttaa

SEQ ID NO: 17155 - DNA, 2588 bp, Heterodera glycines
agacgaactcaacaattgaataattttaaaattgtattctctacattgatttttttctttataaaattttttttattgataattaccgaaattcggattatcattctcttttagtttcaaggtctgaatataataaacatagtttgtccaaatttatccgcgtagaaaactttctattatactaaatcttaaaataattatgaaatttttaaaatattattcgcataattatttctacaatcattactgcgggaatatgcacttgacgacaattggacccggataaacaaatccattaacaccctgccacacagtggacatcaaatggtcatcaccagccaaagccaaacataatataattcatgaatttaatataaaaactgaatttaagttttatttgatgaatataacacaggagaataataaataatacacaatgtttttgcttaagtacaagtgtcacgatttgacattgtattgaagaaatgtaaacaaaatttacagaaattaaaataaataaaaccgtgaattatttataaatttaaatacgctaatgattagtgagtggattatcctgcacaacttaaagtttttttaaatgttttacaaccgattggaccgaatggtgttcaaccatttccgccaccaaatggatccataccatttttataacaatctttgcaatttattctaaaatattatattaacgacctttaaagataaaaacttcatctattctcgcaacataaaaaaattaaaaactttagggtcgggtaggatttggcgtgggaggggggggtcgggtagtcttgtggactccataaaaaggaaggggctgtgtagacctctgcctactctttccaacggtggtgaccaagatgaacgacgacaagctaattaatgggattaccgacgatttaaatatcgccatgttctctactcgaacgaagaactactatatccatcattcatagtttgtcaattaaacaccagataccaaattaatttttgattaatttaaattttaaatataatttatataagcccatgataattttataaaaggtaaagaatacaattttaattgtaaataaataaataaataaatcacattaatagaaaaaagtttaactgttaaacgttattaaccatgcataaaattttttaacctactcaattaaaaattgaaaaccaaaattttacaacggattagaaaataagtcatgttaatgtcataatttcaaatttttaattattacgagaaaaaataaatatataaaaatttaagcttaaatgaatcattagcaaaagtaaatttttaactactcgcattcctcaaacataccttaactattgatatgacgaacacacttagtttcttacttaaatttatagagtaaaatttaaaagaaaaataaaatgtttgttagacaaaaaaatcataaaaaaagaattaaaatcaattgatatcacaaaaaatttaaataaaatgaataaaaataaataaataaaatattaagcatttgcaatgtactaaaaaatttctttgtcttgttccatgacggcgattaaacggtgctgttagatttcgacagtggtgatctcgacagtaaagcttatttttaaaaaatttgttctatatggcataagtctcgttaaattttgacaattaaaatgataagaacatggctcttatacttgtagaggggttcgagattttcgaattcttgcttaagagcctgcacatttgaattttggcactcaaacccggcgttagttagcagatttccccacacgatttgagaatcttgtctaagaaatttgttgtatttttgactcattccagcaagagatatttgtatagaaaaagtgaaagcgataaatttttagcaaaaaaatcatacaagtcttatttttattacttacttcaattataaattttgtatttgcaaagtgtatattaatattaattcaaatatacaataaatcatatagaaattaattaaaaagtactgtcaaaatcaactacgtcgaaaccaatcactgtcgaaaatacctggtacggattaaacgactttattaaaacgagtgacatgagatataacaatttatatatagcaaaaaagataaacgaatgaacatgttaatttttatatgcaatttgttaaaaaatgtaaattaaaaaagtaaaaaataaataaaaactaaaaaaacaactcaattaggttaaataataaatcattgacttagtcttgaagagagaacgaatgtaatttttataattaagaaataattttaaaagctttgaaataataaaacaaaaatagttaattaaaatgattataattggtgagttaaagtaatttaattaaattttttgtggaaaaagatcgacaaaacggtcccaaaaaatggaagaaggaaaagaacgaataaattaaaatgggcccagcgagatcatgaaggaaaaattataaagtaataatgcaataaaactttagtgtatagtttatatttatttaacaaaattcttattaaataaacaatagaggacccaaaaaatttattaaatttaataaataccattt

SEQ ID NO: 17156 - DNA, 1858 bp, Heterodera glycines
gatgatgccaaggcgcaaggccgttctgcaggcaaacttttcatttcatgtgcctttcttgtgcccgaaaatgcgttaataagaccaccgagaatgactcaattcccgcgaacaatgttttcgggactgactgacagaaattttgaaatttttttcgaaaacatttcttatttgtttttttttcgcctggcaacccatttgacggaattcgactaagcctatgtacgaattgtcacgaatgacaccacttgccgaagttggggggggggggggcggcggttctaatcacattcaaatataaaatttttctgcatttctttttaattagaaatagtaatgcatactttttattgttttcagaccggcgcactcaattttcgaccacctctcagccgttcgcgcagtgtgccacgcctttgttccattgacggggaaaggcacgggccgaggaacaagaggtacggtaaatgcctgcttataccgtaaatatgtctctctctttctcttttcccctctctctctctatccgtctcactctcttaactttcgccatctctcgctttctcactaatctatacccatgtttaagtctctcactctctctctgcttatttctctcgttcatcattttctgtaaaagtgttttctgtccatttctgagatcacgtaactcaaaatacatatgaattattacaggatgactgtgatgagactgtgaaggatgaagacgaagatctgcagctttcatcgtctgatctgtactcattgaacaccgcggttcattaccagccagtgccaaccgctaccacaacgatggcaaacgcaatggtctcccatgcctgtgtcgctgctgatcatcagaccatcaacgattatcactatttttttatttttgctcctcatttccattttttctttcttttgccattaagtatttactgagttaaatactgtacgatgcggtgtatattacgccgctgctgtaaattccaaaatatttccgtatatcatacgggtttttatttatattttttaggcaaaacatatcattgaattcaacctttctgtcatacggttataaagacactaaaaatgtttttcatagaaaaaatttataaaaaggaaattttcaaatgaaaaaacatcaatttgatcaaaattaaaaaatgccagcattaagaattgcaaggcagctccgacaaaaaactttatcaatccctctgaagtcgccttcgtgctgatactcatgccggaggagttcatcacgattaccgtcaggcacgatgaccttgcgcaacccgaagtcactcatgcctacaactttgtccacaattttgctgacatactgcacttggccttcgagtccgattcgtcccgaaaaggcaacgttcattcggacgcaacggttgatcatgagtgaaaaaaaggcggcaaatgcacccgcagacagcgaaggcccttcggtcaagccatgcggagaacgcgacacaaaaatggggtgggtgacgagaatgttctggatggccgggtgtcgctgtgcaaacaatgtccgcgcttgatcagctgcattgctgattgcttgctgtaaacatatcgattgatgataaatccaaaaataataaaatttttaattaggcttttgttcaaaaaatagccaaaaatacattttattacggctctagggaaaatccgacactggaaaatccgacaccggaaaatccgacactgaaaaatccgacacaagcggaaaatccgacaccgctggaaaatccgacactatcggaaaatcctacactgaaaaatccgacaccgactttagattttaaaaataattttcgattatttgagtaaatatctg

SEQ ID NO: 17157 - DNA, 2528 bp, Heterodera glycines
atcatttttttattattatttatttattcattcatccccccttttagtcactcctcctttttggtataaaaaatttttctaaaatttcaaagttctaaattttacaaaggtcacccattcgagtttggcaatttggttttgtctttgccattctgttaaatgcagcggcaggttcaaatgcgatcattctctatattaacaggtaattaattattcgattatttattaatatttaatttattcttatatttataaagaaataaatatttaaaaaaacaatttttagcactgaatatcgccatgaattcagaaaaatattgcgttcgctgaccaaatgtttttgtaaaaataatggtaatggataacttagttgaaaattttcaaatcctcattagcgcaataaaaattattctgtgttttggcattaaaataaacagcaaaatccctatatttcttgcaaaatatctctttatattttttaaattagtatttatgcgatatgtcaagaaattttgacaaaatgccaattttcggccgaatttttgccaaaaaccaatcaaaaaatccctctttaaaatctcaagttggggataaagcctcagaaatggttcagccttattaaatcacatttttatttaaatttgtttttagctgtccacgacatcgccgcaattcaaaatcgcgctgtcaatccgaactttatcagaccaaaccaattaaatgctttcaatccatccgaccgatttagtcgttattaattgtcctcaattgtcatttatgttgcttttttataaatatttttgtaaaaaaaacattataaaatttccccatgaaatcaattgaattgcttatgaattgaaaaaccaaaatttcattaaatttttcaactcttttgaaattaacaaacttccatgaattaactttattctcgtattggcattttaaacagaaaatatttatttttgtagtcaaaatttaaaattataatgaatttcaaatcgtttttcttaaaaatgacaaaaattattttcgaaaaataattttgatctcaaattttcacatggtaagtttttcatatttcgtgttcccgacttccgttcagtactaaatttttttttgacttttattatttaaaatacgtacaaattgccattaaattaaatcgagtgtcacggaaatccgtgagccgtgatcacggggctttaaaaaaaatccgtgacccgtgatcacggcaccccaaaatccccgtgatttccgtgatccgtgagccgtgatccgtgattataaaaaaaattttctaatgattttttatttaaatttatttaaaaaacggaatttaatcgcgggaaaaattcccaaaaaatgttttaaagaaaccaaaacatataaaccgctttttttgcggcgcggcgaccttttccaaaaaatgactaagtttacgatttttggcaattttttgaggataattagagctttttgtagaaatctccaaggaaaattttttatttttaactaatttattaagaaaatttttcaaatttttcttaaatttaaccaaaaatctatttatgtaaagaaaaaaatttcctctaatttgtaagctaacttttgatgctgaaaaaatcttttggaccaacatgctcagtccttcatgacgatctgaacaccccaaaagatactgaaattcgagaaaattttagaaaaaattcttagagggttgggaaaattttctgaaaattttgattaggcctgtcgttttaaatttaagcgacggagagaaaaaatagggtttttagcagtttatatgccaaaaatggtaatttttctgccattttggggtcaaaatttcaaaaatacggtaaaatgggggtccgtctgccggtgctgccgacaggcgccgccgggaaaaattttgaaattttgagtgaatttgttaacagattttgtccaaaatatgtccaatcattggttaatttattggtctatggacgttttaaaaaataaagaaaaaataattttcaatgttatgaaatttcttgttaattaaatttcaattaaaattatcaaaacaaaatatataaattgtcctatcccaatggggaattgaacccaagggacagacaacgaaagacagaaggtttaaccaccagactacatatatatgtttactttcaaatttgtaagcagaaaagaaattatttatttttctcaaaaatttcttcacaccactttcctattttcgtctcaataaaaattccctatataaaatgccaatcacggatcaaaatcacggaaaatttgaaaaaatccgtgacccgtgatccgagatcacggcaccccaaaaaccccgtgatttccgtgatccgtgagccgtgatccgtgatcacggccagccctgatacaaacgctaccaaaaaggtactgatctatattttcgaattagcgcgcaaagtgactttttggaagttctaaccaattttgtcgaacaccgggttagacccttatttgttagagcaaaagtcgagccc

SEQ ID NO: 17158 - DNA, 1687 bp, Heterodera glycines
cattttggaggtacggctacataaatattgaaatataagcgcttgttcttgccattcccctcgcactcgaaggacgtgttgtaaattataggtgaaatttcgatcaaaaaattccaatgcatactttcttacatttctttgacaaaagtgcttaatgctgtacgaagaaaacgaaattggctgttgaatgactttccacacccttacagtactaatcgcacattcatatcgtttgatttttagggttattacaaaaactcatcaatttatttgcctattttccttgatacggcacaatcggtccccttcggcgacggcattttattatcttttagtgtaatttactgtcggattgtccactgtcggaatgtccttactgtcgaattgtccactgtccgattgtccactgtccaattgtccactgtccgattgtccgggagccctgacccctactgaaagcagaggggacatttcggcattcctcccccaaaattcaatttttaattcaaagctgacaattttggcattttcgactcactgtgtggatgccttcgaagcgcctcgaagaaaaggttcaccgacacattgatcacttccgttttgccaattgtgccatcgatgggaattcggacgttgattttgtcaccggcccgtaacacaccattgtcagcattaatttcaacgaagttgagcacatgctcctgcccaagtgagacatttgcatgccgtatttccatgccgaccaatgaggcgttgccttcgcactcaatctgaccgacaaaataattaattaattcattactaatgatcatttttgcccaaactagggtggagctgatcagaagataaaagaaaaatgcatatgaaatgaaaagatatattcagacaaatgcttattgttacttatattaaaatatgccacaaatttccattagactaaaaataaaaataaaaattgaattttacttattaagctaaaaaaaccaaagttttcacatgaatgtgatctacggcccatggcggatatctgtgttccttgacggaatttctagatctaaattcttccggaaatggatatgggcaattcatttcgaagtcgacttcatcaattttgatgacgaaatgttccgccgtacaattaatggacaaattgaatttttggccatatttattaagcaaatgctcaacagggcgcccatttgtgatataatgatcaaaattcttgtgctcctgtaatttaatagggtttttaatcacaaagaaattgattttaacaaaatttgaaaaatgtttgatttaaaattaagaaaaattaaattataaattcgaaaaaatttcaaaacgtcgaaattgaggtaattttaattccccaaagttaattaccaggttcaagtagtattggcactggatttctgtatatgaaaaatcgaatgtcaaagcaagtatcgtatcgccaactgaaaacgaaaaaagtgcactctctttacatcagggcttccatcgaaaattttttaaaatcagaacatcgggcacaaaaaatcatattttggggtcgaaaatcagaacatttcgcgaaattgcttcaaaacagttatatttacaatttatttgatcaaaaaggcatcaaatattatatctttcgcctcccattatcggttttaacaattttggaggggaaataagcaaa

SEQ ID NO: 17159 - DNA, 2013 bp, Heterodera glycines
gctgtgttgaggattttgaatttcgaaaaaatagtaaatgcaaattaaaaaaagtttttaaaataaataaataattgtccgtattaaaatccctttaaattaaaaatcgttttttttgtcagttccgttatcgcaaaagacatttagaccaacccaaattaattagatgattgccaattaatcaaactttggttcatttacatatatatgtactaaacacaaaagggcactcacgtcttttgtcgaaatattttgcctcgtgcatcaaagcgatggtcaatttgccgatttgccttttgatgaggaattccatgcgaattacgtccccgtaattaagcactgtcattaatcgcttggtcaatggcaatccgtctttctgctgctgctgtccctcgtttgcctctgccaattgcgtatcaatgccaataaacggcttttccatcaaagtgatgccgcctttgtatttgttgatctcttccacctgtaataattaggcaaaaattatgtttaattattcctttttattacatttcattagaatattaccattttgattgagccttttatgtaaaaagaattttcccacgttctacactttctgaacagaaagaaaaaacttttgtgcaaccggtgcagttgattattaccggggacccattaattgtatttaaatatagcattaaaaattgtaatttaaatatttcctaaaaaagaatttcccagaaaactaatggaaattattgcccatcacttttcactttttggcattacccggacaaaatttgtggcccaagttggcatttctgacgtgtaattcctcttcaaaatgtcatttatttgaattgtgatcttgtcatctttgaacaaagtgatgttaatttccaatgctcctgctttgcttagatcgatcgaatcttttacgggctctgatgacttattttcctttaacggaatttaaaatttaaaaaaattgttaaatgaagaaactcttttaaaattaaaaaaagtaaatataatttgtttttaattaccactgaaaatgacgtcattgagatatgtgttggcctaacattcatttccattattgtagcgccgactaaacatttttgcgttttgattgttttaattggcaaaactttgtcgagactctcgaccctctaaaaacttactgtcctcatttttctctgggcgatcatgcaacagagagataatgaagccaaaagattttacattgttcagttgaattcggaaaataatatttttcgcgtattgcaattttctcaaagtgttgttaaatggtaaatccatgtacggtggtttctgtttaatgtaaagaaatatcttgattaattaattaattgatcattaaccttccgatgaattaattaattatttttcttacataatttgtgtccaaagtcacaaaatccatcactggcggcggatcgttcagcaacaaaaatttgccttccaacttaaacaattaattggtgaaattaacttagtatttttatttattaaatattataattttcatagacccttttgggcctcggtgagcctgtattttacatggacctgatttttacccagatccaggtccaaaatggaatcccggtcaaagtccagcttttcttaaaatttcgactgttcataatgataatcagtgctgggactctctcgtcaatgtgcttctgaccttaagtgtcgtcattttttcgagtggcaatccttgccaccactttagtggcacatattcgcggttgcagctcgacggcgtcggcaagtggtcgtttatcgcaatgccaacagcgaatttagtaaaagcaatcttgaaaacaatttcatgattggcactaattgttttgttgatgaaatcggagcatgacaagctgatgctcagggctgacttaagagacttgcttttcaaaccaatattgttccctaattatatgcacagttttctcgcgcagaacaatttttgtcacttctgattcatggcgtattgctttc

SEQ ID NO: 17160 - DNA, 3053 bp, Heterodera glycines
ttcgaatccgggttcaggggttcgaatttagggccaaactgtatgccagaatcggttttcccgaccctggaaacccctaaaaaaagtttattttcagaaaatttttttttgaaaatctgcacatagataatacataagtaccatatattgtggttgcctgtattcaatttttgcacatttattatcaggtttattacacacattgaacaatgaatacaaacattgtacatacacacaaataacgaatatgaagcagcaaattaatggatattatacatacatacatattttgatcacattaggaaggtcgctctgatcacatggaatatgtacaaaatatggggaacggacttcacacaaacaacagcaagcagtaggggggactgatcgtgaagggagaggtcgtcgtgcaccgtcgtcgttctcatcgctggctattcgtccgcttgggtcgtctccgctgtgctttgttctccggcgttagcggctggctcggcggcgtccttcttcttgtcctttttgtccttcttcccgtgcttgtccttcttggaacggcggttgctgtcgtcgctcttcccctccttcgatttgtgtttgtccttgcgcttctcctccttcttgtccgccgcagctgcgccgtcgcctttcttgtccttcttctttgccttctcctccgcgtcgccgccggtcgtggcttcttccttcttgggcgcttctttgtcgtcttcgctcttcggtttctccatgtacgtcttcgcgaagcactgaaaatttgaaaaaaatttgtttgagatgtaaaatttggagcgaaaaacaaaaaaaaaacttaccattcccgccccgaaggctgcaacgccgacgagaaagtgagaagtcattgtgttgttgttgggcgcactgaagtcgttcgttcgttgattgggtgtcgtgtcagcagcaaatgtgcaaatggacaaaaattcgcccattttatatgcattttctgttgcactttttttcagtgggaaatttgaatataaaaaggcgtgaaattgagagaaatttcattctcttcacattcttaattctattctctgcactattacatctaatttctgctgctcaccgactccatcgacaacgacacgcgatggaagaactcgtggcgctctcccctggaatccgcgtcggccgttggacgatcacaaagaagctgggcgccggagcattcggagccgtctacctgtgcgtgaacgaccaaggagagcaggccgcgctgaagacggagccggtcaacacgccacatccgctgctcgtcatggaggtaggcgggggaggaggggcgaaaggcaattcaatttaaaattttttttcaccacccaggctcacgtgatgaccaagctggacacccttcgagacggagacgggaagcacttctgccgctgcttggacctcgggcgcgatgagcaacaggaccaacaatcgggacaaatgaagaagttcaactacatcgtcatgtcactcgtcggtcgtggcctggacggagtcgtcaaggatgccggtggccgcctcagccttggaagcgcagtcggcgtctcgatccagatgctcgccgctctcagaggactccacaccgtcggctacctccaccgcgacatcaagccgggcaactcgaccatcggacgtccggaatcaaacgagatccgcctgctctacctgatcgacttcggaatggcgcgcaaatacaccagggacgacgtgagtttgagtgaagcgctttgaaaaaaacaaaaataatttgttccctttccccccttttcaggggagccaacaccgcccgcgcgttgccaccaacttccgcggaagcccccgttacgctgcgatcagcgctcatctcggacgcgaatacagccgcaaggacgacatcgaatcgtggttctactgcatgatcgagctcttcaaaggcgcacttccgtgggccagcgtggggggcatgaaagaggtgagcaaatgggagagggagggataatcagaattctgatttcatcgttttagatcggcgaggcaaaggtcaaacgccagaagaaacaaccggaagccgttcgacgccaggcaatcgccgacttgctctccggatgcccgaacgagttcggccaggtcctcaaatacatcgtgagttcgttcgttcgttttttccaaaattaataaactaacaaattaaattttgcaggacgacatgaagtacaccgacaagcccgactacgactggatcatcgcgacattgcgcagcagcctcagcaacgccggcgtccaggaattcccctacgactgggagacgggcaagcgcaacgcggcaccgggcgctggaggcggcggaggaggagggggaggagacagctacttcaactgatgagccgtgcagcagcagcagcagaagaatcgccaagaagcgtcaccgtgcagaattgatcatatgaccactattactgtattgtatgtattattttgtgtccatgctgccatccccgatatacacatgtattgtattgttgacatatgtattgattgaaattgttgttgcataactgtgtttgtacatatgacttttggcgaaataaaggacattttgtatgtttcgtcaagttcattttctcgaaaatatagcataggtgtattgatctcaactataggagaataagaccatttaaaaagtgaatgaggaggaaaaacggagcaaatcgaaatgggcaataaaaatgccaatgtgattgcacaaattagggatttcgatcgaaatttctaaatgagcgaaaatttttctgtcttggaaaaaaaggccgggaaaaaaacgcggcacttgcgagattctggcggcgcactcccaatggcattggaacagttgtgggcggacgaaatccttccaaaaagcgtcaatttttcgtcagttaaatattttaaaataaaaaaattgaaataattcacagatttcaatggcattatgggaattgcaacgaggcgtcggcattgggccgatttacaaatatgtgaaggaattcgatggcgacgcaatcatc

SEQ ID NO: 17161 - DNA, 1480 bp, Heterodera glycines
aaaagaaatcttaaaaatttaacatatttctcaatctcgcattgcaaacggaagaaaaatgtcggagaacacaacggaagcggagaggagacaaatggaaaatgaactgtgtgtctttttctagggatgtacgggtccgagaattggtgcaaaaaccgggtccagatattgccagagggtccagaaaagccgagtttgggtccgagcccaagtttttcaaccgggtccgagtacttaattaaaaaaaattaaatatttcgcgaaatattttgtacataattaacaattattaaaataaaaatttatttttttttgaaattgatagcaaataaaaatctgaataccaattttataattttatagaagataacgtggctatcattttttttttgcttttcatatcttttttcagtctttttaggaaacggcagtgatccggcggtgccgacaggcgccgctggcaagatttttttaaattttggaaagatttattaattgctttttatcaaaaaatgaccattgatggatatttggatcaaatttaagaaaataaggtagtttggttacagcagaaccataaaggcagctctttccatacttaagacaaagtggaagttttacaaaagtcgtaaaaaaaagtaaataaaatccaccggtatgagagtgttttccctttccctcaaccttgatcatcaatttgacgctcacacccattcgtactaatatttttctgggcccggttagacccggacttaggcccgggttttcttgaaaaaaccggttatccggctctggaccgtgtaaccctagttttttaaatgaaattttaaaattaatttgccatttttcagtttcatttgtgccgattgttggctttcagtcttccatttgctgccgccttctcaacttggccttggcattgcactgctcagccaccgatttgactgtttggtggacgaacacttcaaaacgcgcaaatggatgttgggagttattgcgattggaaataaaattggagaaaatggcaaaaaggaaatgaaacttcagcaatgtgcaaatttttgggaatggagaacagtgccaattccgcaaaatccgttgccgaacaaattcatcggatttcgacacattctgattacgtaaaattggccgatttaaatgatttacgataaattactaccattttcagatacattgattccaatgtgattgcttttcttcagcgttttcgttctttttttgcttctcatcagacaaatttgtcaattacaacaaaaagtggcgacagccattttttggaaaatgttgtaaaaaacatttggccaatgatcaatgacaaaattggtgccattggtttttcgtctcccgacgaattttgccgttttcaacaattggtgccgtccattctcagcgacaattgttgttgttgttgtcaatctcttcgggcaatgattttttacactggcgatttgccaaattt

SEQ ID NO: 17162 - DNA, 2436 bp, Heterodera glycines
  misc_feature (15)..(15): n is a, c, g, or t
  misc_feature (26)..(26): n is a, c, g, or t
  misc_feature (69)..(70): n is a, c, g, or t
  misc_feature (75)..(75): n is a, c, g, or t
  misc_feature (104)..(104): n is a, c, g, or t
tagttttttaaatgnaattttaaaanttatttgccatttttcagtttcatttgtgccgattgtggcttnncgtcnttccatttgctgccgccttctcacttggnccttggcattgcactgctcagccacgattttgactgtttggtggacgaccacttcaaaacgcgcaaatggatgtggggagttattgcgattggaaacaaaattggagaaaatggcaaaaaggaaatgaaacttacaaattttcctgaatggagaagaatgccaattccgcaaaatccgttgcccaacaaattcatcggatttcgacacatccggattaggtaaaattgaccgattaaatgatttgcgttaaaattctaccatttagatacattgattctaatgtgattgtttttctccaacgttttcgttctttttttgcttctcatcagacaaatttgtcaattaaaacaaatagtggcgtcagccattttttggaaaatgttgtaaaaaacatttggccaatgatcaaagacaaaatttgtgccattagtttttcgtctcccgacgaattttgccgttttcaacaattggtgccgtccattctcagcgacaattgttgttgttgtcaatctcttcgagcaatgtttttttacactggtgatttgccaaatttttgcattttgccaatttttggcgatttgccaaatttacccgctaatggctgtgccaatatgtcgactgaccaatcggttatcaaatggctattctcgcctcgcgcagacggtgctccgaaggtgctccgatacagtctccaaatgaataataaatttccgagaaaaattgacgcatttaaaagggtgactaatttaatatttactgttttgaaatttccctaattaaggcatttgccaatgccttttctcgtgccaatttcatcgtttacattcgctttcgcttttctttttggagtgttcgggttggtattccgacctttgaattgttcaacaattcaactggggagcgattgacactgaaacagatttatgataagtatgttattaatcttacatatcaatcaattgggttgatgggaccgcattaggccaaaaacccaaaaaataaaatttaaatttcaaaattttaaatttcatttgtaattttttcttctaaattgttttttttaatataattcacccatcctttcgtgatttttaacgtaacttttttcagtcattttgtcttattttgaagaaaaaaaaatgcgaactctggtttaaaagagtttgagaagacttaatcatttgttcatatataatgttctcttttttacattttttaaaaatggaaagtccattttatggaaaattttaattattttattgaatttttgctaaaattttgagagaaaaatatctttaaaaaacatttttgtttactaatccgctccctagtgataagcgtagctttttgctgattcgttgtccaatttcgcgagatgagcacaaatgggccaagtgggaaagggaagcgattgaatggatattcgatgatcagtggagccatattaatttgtcagaaagtgatgaagatgatggatatgatctcatcagtacatggttggtactaattattagggatgatatttttatgtttttacctatttttcccctaactcccagtgacctgataagcacgaaaaatatgttttttcagttgttgttaagctacttttgaagtttttaaagcccatttcttggtttttactttttagaatctaacctaaaaatttcgtccctactaatcactacttacatatctatccaatcactttcgtttttttcattagtttggtggacacaacgccaggcccaagtggtcagcagaagtgaattgccgttgctttgtctttatttggatgggcccaatctgagaaaatttcaatccgatttgaaatacttaccctttttcagcctattatctactttatgctttcctttatttgttaaacataataataataaatttaatattcttttaaaaaaaaagtgtttttgggggccaattctatcaaatattggcaaaaaaaattttccagcgacgagcgcctcagaacggccggatccaaatttgaatatgttttaagtttattgttagcaagaatcaagggcgtagccagacccttggcttcggagggggctgaagtcaaaaattcgatttttaggggtgtatttttcgattttttgaaatcacgatttatggggtggggtgtatcttacaaaatttttcgccaaaaattactattttttgccattttggtctccatttttcaaaaatatggtaaaatgggggtccggcggtgccgataggcgctgccgggaaaattttgcgtattttaatgcaattttgataagaaaattgcataaaatttcaaaaaaatttactgaaaatttt

SEQ ID NO: 17163 - DNA, 1235 bp, Heterodera glycines
tttctcttaaacccaccctgattccatgcgtatccccctgagccggattctgaagaatagggctgaaaaaagtcgaaatttttgaattcgtctgtcatccataactcaatttaaatttaagctatagtaatgctttatagctcattcgaaccgccagagtcttctgaagtgccctttctccaagccgaagaccctatccgcaacacccggcccgctacagacccttttttgacacatggtcgaaaaatttgccaaaaattttctgaagaaagttttttttatttcgacctttaaaaaaatacttttcaccattcgataggaagaaatccttaaaaaacagctgtgctcttttgttcgaacccgatccgtgcacttactgattttcatctggcaaccctgcttttataggttttcttaggcgctgagaacgataaacagcttaaaattgggcacagaaaagcatttaaaccggtttttgaaccggttcaaaactcgaaattgagggaaaaagggtgttcctgaccttttaaaagggtcaaacacagacacatttggtatcattcgaaagctcttgatgagttctaaaaatcaggcaatgaagtcgaaccgaagccatatgagcactgggacaactgagtcttagttaaaatggacatttcagtacaaagaaataacaaatatgatttttcttcttttaatacatatgtacatgaaatcattttttggacttgaatactgaatattgcgctaaaaaccgccgtacactcgactacggcggccagtaggtggggcgagactacgggctacggaagaagtccgcgcgtgatccgcaggcggttgactgattggcggttttcctcaccagcactttcgtccaattccaaagcgcatttaacccttttctttacacactttttgcaacaaaattccgagaaaagttggcaaaattagtgaaaaggaagcaaaaacaacggaaggacaatttgagggacaaaaatgaccaaaaggcggagggaagagaagagaaaggggaaaagatggaacaaaatgggcacaaagccagcgcaaagtcgagtatatcatcattgggaggaggagtatgaaggaagaggaggaagaagagacgaacagatgaggaagaggaggaaaaagagagaaccaagaggaagaggaggagagataatggagaggaggggacaggaggagcatgagagaaccatgaggaagaggaggaa

SEQ ID NO: 17164 - DNA, 816 bp, Heterodera glycines
  misc_feature (266)..(266): n is a, c, g, or t
ctgaaatgtccattttaactgagactcagttgtcccagtgctcatatggcttcgtatcgacttcattgcaagatttttaggcttaactcatcaagagctttcgaatgataccaaatttgtctgggtttgacccttttaaaaggtcaggaaccccctttttccctcaatttcgagttttgatccggttcaaaaaccggtttaatgcttttctgctcccaattttaagctgttctatcgttctcagcgcctaagaaaaccctcttaanagggtttttatgcgattttgtgttggtaccgtattcggcaattttacccattttttgtatggggcctaaaactgttcaacttctacatcgtaaaaattaaggaaataatgattgcattgctagcgttaattctaagttcaattgcatttaggacaatgttgaggtatttgtcgaaatctttgtcttcgactcgtagtgccctcgttgatatttcttcagtgcatttttctttttatcatctatttttttatgaattcaaaaattttcaggttggaaagccttcttacccttccaaaacgtctagccctaccggaagtttgcttctcagcgaaggcgagcattccactgcgtctgggtctcttgttaacgtccgaatgccgaacataaaaggtgaagctgtgtcaaaatccgattaattaaacttcgaattaaagtcttttctgggtcttcacatagcgatttggcacaacgaatttgcgacagacttcagcttgaagttgcaaaagccgctttaaagagattcagcaataaggtgggcttagagaccgaa

SEQ ID NO: 17165 - DNA, 2492 bp, Heterodera glycines
aagcatacatttatttaaaatttcgaagtattaaaagtttttattggaaaattacaatgggaaagcctgtaaaaatgattattgtttcagtgaattctctcgtccactcgtcgaatgatttctttttttgttgataatttctttgtacgtttatcgataagctccgaattacctccttccctctaattagtgtcctacaaaatcgattaactaattgctttttgttggtttgttgctataattcactaattattttcatcggcgtgtaaaaatggcacggagtgaagcgaacggtcaccggcaaaaaagggaaagtccgccgacttacgacgattggcttggcacaattcggcaggagggcggccaattggcatggctttggcggaagagttgcggcgaagtgcacaatttggggaggacgaagcagcaaatggacgaagccgttctgtcctcaaagagaattcgggtgaaatcggaaaaaagcgacttttttgaacgtttcgccaatgtttttcaaattttatttgttaggacgcaattcgaactttggccgcccggggggaaacggtcgacgccgccgtccgagccgaagcacagcaaattctgtcgacgatggcactcgactttcgctttcattccgccgcacaaccaattggctacagtttggccaccgtttttgaagtcatttcattcattgagtcgatgattgtgttctcactttttgactgttcagcgcattttctcccacatttgggtcaattcggcacggatgtgccaaatccgacaaatctcagctgaccgatcagtgcccatcgtttggttgcccacgcatcgaagtagcacaagaagcttttgtcaaactacctctctcccgctttctctttctctctctgctactctctccccacacacacacactctctctctctctctctctctctctctccactctttcttctacttcctttctctctctcctcttctctctcccccactctctctctctctctctcctactttctctctctaacccctttctatatctctccttctctctccccctttctccgcccccactttctccctcaacctcctctccctgttccattaggctatctcgactttttgcttctctctcttctctcctaccattaccgtatccaactcccggccatttgtgccgccgatgacttccgcgcctcgcgccttctcggcgaggctttgcgccgttgcggcgcctttttcatccgtcgctctttcagagaagtgtttacttacttccatggctttgttttgctctcaaatgctttctctcccttttatgatttgctctatcgctctgttttttctgaatatgtccaacaaattctctcccacggcgaccgacccatcgaattttttatcgaagtttcgaatttgtttttggtctcctctaagccaattcctttgtcagggccaacgcagtcggacggccaaaagtgttttcccgcgcgttggactgctccaacttgtcgtggaaccgttcatcagagcgcaagtgtacgacacggtagcgacgaggcaattaagctcattaaggtccacttaagattttggtgcccgttaccatcgattacgaccgaattttggaggaaaaactctttgcctgggaattggtgggcttctcaaagccccgggaaaccacaatgggtcagtgcaaacggagtgaacggctgctttattcctccgatttcctttaggccttttgcgtgcgcattcgattttaagtgacaattttggcgatattcgcgtcacagttggcgagccgatttcccttcgcaaatattttttcgataaatttggccatggcttcgacttccgattggaaatggtgggccaaatgattgcaattggagattaaatcactcactaatttttatgtgcagaacaaatcagattcggacgagagagttcgcgaaatggtgcacaatttggccttggaaattgtccatttgcaaaatgccaatggcactttgattctttggccttttgttgcattggcaattcttcaaactctcaacgaattccccttaaattctcagccaatttcgcctttttccttcactttgcgctcactcagaaccaaatcggaaatatttctgcgtttatttgaaaaatgttatacgaatcgaatttggagaagggcggaagagattgaggaggaaattcggtagggaaaaaataaatttcaaatgctttccttttccatttgctttttaatttgtcgactctttgtccccatttgtttccgttttaggcattttgtccatctccatcaatcccgtttgtctctttcttcgtccggcgattctgtccgatttgattgacttttctccggacactcttccgccgtttttgctcgattccgtccttttagccaatcattccaataatttagtccacggggatggcgccgttttggtggggtttaaacttttttgttggcccatgac

SEQ ID NO: 17166 - DNA, 2068 bp, Heterodera glycines
ggtcgacaaagaaaaaagttatagcccaacaatttggtctggcgccgaaacatcggcgccaaaacgaccatttccctttgtaaaaagcaaaaagaaaactcaattaggccgtatagcaaatgaaaagaagcaggaaagccattaaacaggtgtgctttaagttggagcagactaatttaaatataatacaaaatttggcactgtgtaaaatcgaatggcagagaaattcaaattatgtggccaaatgccgtaactttcgcgcatttatatggccggaaacgcgccgccaactcaactcacataatgttgtgtgaacgaacattggcgcaatgtgaaaatgggagaaaagaattgttttatcgtggtaacttttcagtttggccaatttctgacaaacaaaaaacgtgagaaatcgtatcgtactggaaattttaatttaatataaaaattgtagtttgccatagagcccggcgcgggattttgcgggctcccagtccgcaagcccacatttttttttggaaaatgctggatttgggatttgagggattaatcctgggggatgccgtaaaattttgagttacaatcccgcagcgggatccgcaaatttggaatttccgagctctagtttgcaatgcgataaattttggcaaaaatttcaaaaaatcgtaaatttaaattattaaacaatcgttgggatttggatgccaaaggcgtccttgaaaaccgatttcatccattctgtgagggttaacaaggttgttaaaaacagaattttcgtcggactttgatccaaaaagttaatttttttggcactttacctatataaaaaaagcgtcgccttagaggtgaggaattttcatattattctttaaaagaattttggcaggtattaacagaaaaatggaaatctccaaaacattgttttaaaagtaaaaaattttaaaattttaaattttttccctggaaaaagccccaaaataacaataaaaaaatttggtaatcatgggtaaataattgtcataaatttaagtgccctcagtttttggcacagactaaatgccaatggcaaaagtaaaattttgacagcagcgctcaattggtaacggaccttgcttccgctccaataggcctacaacaatttccccacttttccgcgtctccgaattgtgccattgtttaacaatcgcctaattaccgtgtcgttagtaattagtcagtctattataataaagtgcccgcggcaaaaccaaaaacaagaaatttttcgaaagaaaataaattcagcaaaaaatgaattaaatttcagcgaaagtactgcaaaaaaatgactctaattaacggaaaatggcctaattacatttaaactgccgttggaccaaaaaatataattaactttccaaagacaaaaatttatcgattataaatgtttgaagtgaaaagcctttattattaaattaacaataccaaaagccttacacataattaatcagattgcctcaggcgcccacaaatgaataaaatttaattggcatggccacaattcacaattattcaattaaatggctgcttagccgaaggaaaagcgcgaaaatgaatgaatgattgaattgaattgcattgggccaaaaaagaaaaatatttgaaccgtcccggacaaatttaggagcaataacaaatgtcgtaaatgaatgatttgattgaattgcctcgggcaagaaatttttttttaattatttgaactgtatgcgggacaataagcatggtcatcatcatcatcagtctataattacgacttgtaaaaaaaaaaatttcaaccaccagcagagcacattaggagcggtgtctaatttttgttcctcttttcatgccattgtttttgtgccgtgctgtcgtctctcccggcatgaggtagaaggggagggggcagggcttaacccaattttttctttttttggggttaggtgccattccggcaagaaagccaaagaaagccggcataaaaagcaggccaggctttacctctccaaacgtgcccggcgattttgagggggcttaacatgctaatcat

SEQ ID NO: 17167 - DNA, 2573 bp, Heterodera glycines
agtctcaaaaagacgctacaaaaatgttcaaaaaaatattattgggcccaaattgcactcagatatttttcgctggatcaaacaatgtcttgtctgccagctccggcataatcccatccccatgttccgagctgaaatgaaatcggtcccttccaacactctctttgccaaaattggtttagatttagctggccccctccccatcacagaaatgggaaatcgttacatcctaaattttgtttgttggttctccaaatatgtcatctcagtccctgtccctgacaccaaatctctcactactgcaaaggctctccttcgacatgtttacttaaaattcggtggttgcactgaattaataagtgacaatgccaccacattcacctcagacttctttaaatctttttgttcccttctctatattaataaatcattctccaccccttactggtcccagggcaatggtgcaacagaaaggacatttagaacttttcataatattctgtctaaatatatcaatcccaaagagcccaatttcgatgaatttctagatgcagctaccttctgttacaatacttccattcatgaatcaactggcgaaagccccttctttctcgtgtttggcagagaccctatctttagtattgatcaaattcttgatccctccgtccatctaccactccctcacaatgacttagctgagttcaaaaccctccttgtcctttccctaagaaaagcctggaattctgcagctgactcaattaaagaggctcagaataaatcaaaagtgcaatatgataagaaatttaggaatcctaacatttccattggggaccgtgttctgttacggaattatactggaaaaccgggcacttcccaaaaatttcacaatccatggaagggcgttttcagagttattaacatagaagaactccatgtcaccatcgtcagttgttcctccccacaatccaacccatttaaagtccatattaatcaactgaagaaactttttgagatttccggtcctcccagcacctcccccgtcctctcttctgctgaaaaagctgctttagaagcagcagaagccaccgagataccaaacacgataggcttcaatcatacccctgatatttcaccaaaaaccctccctcctgatacccaaaaatccaatgtaccccaaattttacctacttctattgacaaagaacaagcggttttccctcagcgggatctcttgcataaaagtaaatacaatctccgctctcgcccaaggtctaacagttttaaacaataacaaatgcacttttctccttacccattttcatactcacaattaatttttaacttctcacaccacttttttacaacatttttccccttttttggtttcattccttcacaccgccttgcacccaaaatttttatgattaattcgcgtttccctcccttccccaacagaatgatccccttcctgtccaacatccccgaacacaaatacctctcccaacttctaccccgcccccttcttctaccctccctcctcctgtcacttcctttcgtcagagcaatgttaccaatccacaaaagcaacattcttccaaagatacgacatagacaccgaaatcctgaaaaccacctccccagtcgtagcaaaacgactcggggctcgtgcccaaaatgaagctgaccccgcagcagtaaaagtgtggcacagcacgaagcagtcaaagatggaagagattctcttccacaagttcgaccagaaccccgccctggcagagtgcctcatttcaactggggagaaatttttggttgaagcgagtcacgctgaccgattctggggcgctggtgccaccattgacgacattcgtcaatggaactttactgggcgaaacaccatgggccaactgctaatggaacttcgtgaaaaattaaaaggttttaggattcctcattccccagcgtcccttctcaaataaacatcataagtctcacacctttattccccccccccccatcttcctctttcccttccaaaagtatcgacccctcctttgcactccaagttctccttaaatgctttgttttgtttgtgttactaacaatgctttaccatacttccacattgctgtgttgttttctaatctcgttttgtcctctcctcgaatatctcttcactgccacattaagtatgccgaaacgacaatcgaaaccctggattccaaagacgaaatgccccagactccttccgacaacgcctcttgaagaatcgctccaagctctgacaactaatgctgattcgaccatcactccggcagcatctcctactgaacctgctgactcttttgatcctctctcacattctgttgtcccttcatctcctctatcctctatggagactctgttggcccttatctcggtctcttctccttctgaaaatcagaatttgtccaacaatagtccggctccttccccaccacgaactgaaaatcaacccatgtcttcttcctcggacccggatataatctttttggaagaaatctcaccccccaaaatccaagaaaatgctccccttg

SEQ ID NO: 17168 - DNA, 602 bp, Heterodera glycines
cctttcttcttttcaaaaaatttctctttttcattccctcttttttaccgtttttcttctttctttccaattaattcagactgaatcattttcatcgagccatcaaatggcgcattttttgtatcgaaaaagccatttaaaaaagaaagttggattaaaaaatcaaacgcctttcaatttatttaataaacgaaaagaatatttataaaaggggaggggggggggggggaatgtgccgcgatcattgtcatgccaataatgccaataaccgttaattcatgggttccttcctcaatttgaccacccatcccaaattggacccccaatttgcccccgacttttcacctctctgcgcccgtaaattagagtggtacctgtggagtatcgtgcgatcgacatggcctatgtttatgcgagggaagttatttgaatctcctgtactgatcgtatctatatccgcagtaggtctctgaggagaacaggctctagtagatagattaatgaaggtaagggcagcaggaaaattatattcgaaaattcgggaaaagaattggctctaaaggtcgggaaagacgggctgttgagtgaaataggcggttttt

SEQ ID NO: 17169 - DNA, 2937 bp, Heterodera glycines
atctgtcgccggccgatcattcggattatcgaaacaattctttcaaaacgtttccattgtttcctttgaaaaagacaattttgaagcaattgtacttaaaaatgctttacaattatccaaattttaacaaagttaaaataaatgagttttcattgtttttcgtctgccaatttgagttggcactaattacgcccttcgggggaaatgagcggtgacgtaataattgaattatacggacaatcattggcacatttaagcagaaagcgtagaagacaaatcgcgtgagaaaaaagcattaaaattcgaaaatgacagacaaaagcaaatttgaaagtgaaattcgactaaatttgcatttttaaatgaattttccattaattccataatcccttcttttggaattttaattccaatttcttcgcttttttacccattgatttgtccattttaaattaattttaaacttttacttttccttctttcaaatttctcaaaatgtttccaaaattcttctttgggaattatttttctttcacccgttccgatgacaaaaattaattatgtttttttaggcaaaacggccaaaattggcaaattcatgggatggacgaacacaaaattcgcaaaatgcctcacattactccccccccccccgcccgtgccatcccatcagttggcatttggccctttcaaatgacgcttcaaaaacatattttgacctttgttttgcatttggcatttgcaatgttcattctttatccattcaaatacgaattcgaggggaataattaattaatttccattgcacaaaaagaattaattaatgaattaaaataattaattaattaataaaaataatgaattagtttaatttgtctccgcctcagcacgaccgaccgatcccaacaccgaagtgatgtaaagggagagaggggtaccatcttttttttttgattttacggttcgccggtgccatgctggctacaggcaaattcgggttttgctcggatttttaaaagggctctcaatttcggattgcgcgcaatcaaaatccgattgcgttctgcccttgtgtcctggtgccatacactcaccccccgcctccggcaattttcttccctaattttagaaccttccgagcgttttttttgtcggaactttttttcactctgagcttcttgtgccttcattcatcttcgaattttctttatccaaatgacgtccgccgatggatgccttcggtcggtccttccaaaagtgccaacgcattcctttggctttttggccaatagcatcggatttattttattttttgctttgttttgcacattttggtcatttgacggtgggaattggagatgaattcgttaaatgggttggggacattctgtgattattaaggaaaagaaagcaaaatgggccaattccattcattctcctcccatcactttgctcttcaactttcgtccttcttttcttcctttcctcctcttccacatttctgttcctccgttttcctaatttggttttggcattttttctgttcggctcgttccgccctcttcctcctctccgccccctccctatttattacccctcattttcctgtacacctctcatttttgtctttagtccaattcgccctgattggtggcccttttggcataattttgtgccataattccacaattggctgatcacttctccgatcttcctccttctcatcatttctcccttttcccgccggtcaatccacttttttaatttgccttatcaattaccatattcaggcacttatcctgataattattaattaactatcattagccccaattcgtcccttctctctgccgatgctttcgccttcgtttgcgctgtttctccgtacgctttttcttctccttgcgatgattttcctctccgtcgccttcgaattcgatctccgcgacgatggccaatccgtccgctttggtccttcctcttccggtggcaccagcggcgcatccgttgcctcccaactgttcgtgaactcggaggacaacgcgggtttcattggcggaattccgggcggatccgcgcggcgcagactcatccaaccgccgccgctgaaaagggatggaacggcgctgccgtggggggcggaagaggcgtgggcacggatcagcagaagcggggggagaaggttctgattgaagagcggagagagaaaggaagagtgatcggacgaaaagggactgatcagaagaggaaaagccaccaaagaaaggaatcatctgatcggtggcacccaatgatctttggtccaatgggcaattcgacgtgataattctcatttcggaaaatcaaatataaaattaaattgagtgaattttgtttatgtttctttttttattcatttagaaattattgcattcaattctgtcgtttgatttccataagaaatgagagaaattcgatgcgaacgatggaaaaaacaaaaaaacagctgaaaacgccgtcttagagcagcagatttacatttgccgctaattccaaatttggcaattctatcttttgttttttctcgcttttatctttcatttgtttgttcccccgcgggcatcaaatttttcttgtggacgcgtcatcacctagtcgtgggctgatgacaaaaaaaaaagaaaatttggccaaataaacgaaggattggccaaaagtacaaatggccgagggaaaaggggcggagaaacaatggcacaatttgcctcactaacaaataaagtatttttctcacgggaaagaacgaaagacgaattcaaatacaaacaacgaattaaagaagatgagataattcaaaacacaattttggaaataaataaaaagaaaaccatttgataaaaaagcgacaaataaattgggaatgatctccgaaagttgggaccctgccaggccatgcca

SEQ ID NO: 17170 - DNA, 1541 bp, Heterodera glycines
  misc_feature (45)..(47): n is a, c, g, or t
  misc_feature (50)..(50): n is a, c, g, or t
  misc_feature (56)..(56): n is a, c, g, or t
  misc_feature (91)..(91): n is a, c, g, or t
tttgaaatatgataaaaaaattaattaatttatcctatttttgtnnnacnttattnaaggaaaaaattcaacgtgacgccaaatcgacttntggccgaatctttgtcagtgagtgtaaaaacgaaaaaagtggcctcttggaaggcattgctgaaaaaataataattttaaatcaaaaattttcaacaaattaaatgctataattttacttaccgctttttcaactgccgaaatgcggaaccgttaaatgacacgcacccttcgggttggcaaaaatatgtgacatcacggggcaactcgaaatcacgatggttttcgctgggataccttggaaaataattaattaattaatatcattcgttcaaagattattagataatgaagttattggtatctagcatgtgaaacccaggaaaattttgttcgtgttcgttaaagaaaaaaaaaaattaagaatgaaaaaatatatttgcattaaaaaattatgttcaaaaatgataaactttttcgaaaagaaaaattaattaaatcatatatttttaattaaatttttcaaaatattgatactatgacatcgcttagttggaaatcattcaaaatttcgttaaactttgtttcgtgcaccccgaaaaaatatcttcctggggcactcaatgattgttgacacactcttttggccaagtccattcattttccgtggccatcagaccttctcagcaattcgggatgactaacagtgccaccggggattgccattggacccgctcccccgccggctgtcacattgacataaccgccggctgacggcgggtgccgtcgtcgtcgaacggtggcattaggacgacggccgacaattacaatgtctgaaaattaaaaaattttttttaatttcatttttttctacggatttacaatcaattaagcgggggcaaagcgattgttctgccgaaattcgaccgggctggaataaacgagacttggcatcgtgcattttcaaatttatttttttttatgtaaaagccgacattcgatttttttatctaaaattaaaattggtatttaagtttggtcctttttgggttaaaattttcatattttttcactttttgttgtcaaaagtgcttcaaagcaacaaaaaaatgcaattggatcaagcaagaattggcacacaagatcagttttttcatatgcatttctgattgtaagaaattaatttccggggcgcagatgtccgattttcgcttgggacgaaaattcccgaggcgtaaaatgcctggggcgccaatgtctgtaatcccaataaacacaaaataaagtttttaagttactttagcaagaaaaagaaatgaaaatttttgaccaaaaaggggacctaaaataaattaatactctaaaatttcaatttgaaatacaaatatagtgaaatgaaattttaaacagaattagaaatgaatttttcgtttaattaatgaccaatggcttccagcatctgccagcactaattaaatttggcaacggacaacggaatgagcggggggggg

SEQ ID NO: 17171 - DNA, 1249 bp, Heterodera glycines
aatcgaacattagcggggggtggggatacttttttcgctaatttatgttcctatgtgaaaatgcgaaaaataaataaataaatgaaatttttttttaaataattaataaaaattattccgcccattaaaatgaatgtgcacatacatttttatttatgtacatatgtaaatggattggatttgttcagcgggccagcagaaattcgttcgtgcatgtgacagacgaattttatattatttacatgcatttttatccggcccaaaagtttcataatttttggccataaagcagctaatgttgagataacaaaagtttatcataaaaaaatcgctttaccctttaattattaacaaaaattgaaggttgaattctacagttgctaagttaccctggaagcttaattaattttcatgggaatgtacaatcatattttttcgttaaagctgcaattaataaatagttataaaaaattgaaaaaaaaattgtaaaaaaggaacctgtgaaattctaaaaatataaatttaaattaaaaacgcaatacattttttgggtaccaaaatgaaaaaattcctattacaatagataaacataaacaaaatataaaaaccgctgacaaatgaatgcttcttcacgttcccaatttacgaaatcaatccattttagggaatgggtgagagaggagcagtggaagcaggcgacatgtcgagagtgagtgaggatgagaaaaagcggaatgagttagagatgtgatggaataagaaaagagtgatgggagggtggtaaagaggaagaagaagtgaatgagatgaaaaagaagggaaacagagacgggtaatgaggaagaaaaacgaacgaaaagcgaggggggggggaaaggaaagcgagagggagggggagaaagaagaagcgaacgagaagcaaagaaaaagaaaagtgggagaggaagaagcgaactatggaaaaaccaaaaaagggaaggaaaagaaggaaagaaaaaaggaaagtggggaggaaaaaaggaaagaaataagaaaatcaaaaagaacggaagaaagaaagggaaagcataaaaacagccaatgcttgcacagcaaactatgtgtgctgcatctgtgtacatatgtatgtatgcttctatgtgcttcaacattcttcccatatttgggttgatgaagcttggccagaaagacaaagaagagagagagtgagagtaagagaccgagagagagagagagagcgagagagaga

SEQ ID NO: 17172 - DNA, 2896 bp, Heterodera glycines
ctctcaattttattaccgatttatgcgtcattacagtactgtttattattttattttgtctcctaataaatttggtttccgatttattgcaattatagtaatttgtgtctcaaataatttttgatttgattacataacttggatgatttggtatttcttccactccttcctcctttgtatgaacagtaatattaaacaaaaagttatctagttatattatctaatatgctaatccaataaaagcggcaaattcatttggtgcataaggccgtcggccaaatgaccttgttttccgattctcctcccattcaccacccaataaatatgcataaaaagcacctatcgtcttactccattcatttccgtttgccaaaatagtaaataatttggggttaatatttagaaatgaaaattaatcgccgcttcaccagtaagccgagtcgtgcggaaacgacaccccttttccaaattaaaatgaaaaataagaccaacaaaaagttggcgacctcaaaaataatgaaggcaaaagaaaaacaacaacaaatgcaacacaaccagccaaaaattgatgatctcctcaagggcttggcccgactccagctcgaccaatcacagcaatcggccggagttttgatggccgtgccaagcccgcaaactacaatgtcaattgtggggccacattcgactcagtcgtgtttgatggagctgtctcggtcgacagcggctcttctacccgccaacattgcggggggtagaggtcccgttgactttggtatgaaattgtttaagttatattaaaaagatttttcaaattcgttataatttatttataattatcaaaatttatttttgtgtcttttcaaaatgttttttccagcctcggcctttgccgaggagcaagtacggagcaaaaaaagcgcgttgctcgattgcattgcgctggcggaggagtccgcaaaacttctgagcacagaagggcgaattcggtgtctcctggatcttggagaagagttggaactggatttcaacgaatacttagtgggtttttaaagaaggaaaaatgatcgggggaaaatcggaaacgatccaaatgaacagttcacagttagttaaacactttgataaaaataacttttaagcttcatttattttctcattgagacttttctaaactttattaatttatttgagcttagaaatgattttaaaaatgaaaatttaaaaccaaaaataattaaatttaatattttaaattcatcatatcaaaatttgcactctgtgcgccttggcctaacactctttctcattgccttcgagagtgactgaaataatagtaagtaaaaaacgataaatttataatggcattttcactcaccctccaattcctgatcgataatttctttgtttgccccgtcctcgtcattatctcggatcgccatcggactccccaattcgagcaccacgtgctcctgtaaaggacaaaaatatttataaacaaataatttaaaaattttgactcatagaacaaaaaaaaatgtaatttggaaagaaaacaattaagtttaaattacgtttttttgaaaacattttcacctttccacgacgataactgcgcaagatcggctctgagcattgaggacgacgacgtgggcggcgaacgcaaaacatggccgcgagaacagcacacttaaattttttgattgataattttgggattagagttattgtaaactttaaaaataataatgaggatgaaaagcagaagcagaaacgggaaaacatcaaatcccccgtttccggtgctcatcggaggcgaaaggaggtgggcagtgacatttgagagcgagcgggggtgaatacactcaattggcttcgtgtatggcgatggtcttgcacatacagtaatcccgggacaaccggaacaattttggacaataatccattcgagacgggtggggaagatagggacagagacagacattactttcgagtttcggtaaagtttcaccggaatttaaattaggaattaataaaacataagttattatttatttattataactatttttattattaaatgcggaatatttgccgatttgttggagatttggccattgtgaatgtcattggcgctgcgtcttgtattcattatgtgtccgcccaccctctccaaatctcttttgtgaacaacaaaatcaaaatttatgtgatccgatccatagataaattctttattgtgttgtgaatgcaaaagaaaataataatattttaaataatttatcattttttattagtttgtattaaaatcggttagtcaaagtcttcctttcttataaattaatgtttgaaatgaaaagaaattatcaaaataattgattgattgattaatgattgagaattttgaattagccattcagcgtcccgggccaaccgtactccataggcacaggagtccggctaaccatcctcaaaggataggccgcggtgaataagccattataaattgataaaaaataaagaattaatgaccatcagcgtccctggccaaccggaccccataggcacaggagtccggctaaccatcctcaaaggataggccgcggtgaataagccattgaaaagtgataaaaaataaagaattaatgaccatcagcgtccctggccaaccggaccccataggcacaggagtccggctaaccatcctcaaaggataggccgcggtgaataagccattgaaaagtgaagattttagaattgatcgagaattgagaatgaataataataataataataattttaatattcatttaaatgacaagttacgaggcaaagaacgccccatcgtccgctgtcgacagaggcggattaatttgcttttggaaaattataaaaaaaa

SEQ ID NO: 17173 - DNA, 3721 bp, Heterodera glycines
  misc_feature (2365)..(2365): n is a, c, g, or t
actagggctgggaattttatttaaataaataattttttcctggattctccatgctctgaatagtaggaaaaacactttcttttttgtgtttgcgaacaaagttggacttttatttaaatatttttacatattcgggctttttatacatattttacatatttcgtgattttatacatatctggtacatattttgtactttttttctgacatattttcatatttttttttacatattttgaggattttttatggaaatatatggaaaatccttaaaaaaaaatccaaactttcggcaaatttttcgtacatattttcattttttttgaatattttgagaagttttgaaaatttatagaaatttcttctgaaaaaacaacaaatacttatttgaaaatgtactgctaaaaatatcaaaaattaatttttaaaatacaaaaagatgattataagcctaattaggttacattttgtgcctatcttaccctctacaaaaaaatttttccaaaaaaataacaatttaaaacattttatttacatatttggtacatattttgggtttttcttacatatttcgggatttttttttacatatttatgtacatattttgacatccctagttggaacatttcgaaaatggaaaaaggaattgatgccaaaataccataaaagtaagagagtggtgtcgccaaacgagacacattaaaattccgttcaaattttaattaattttgccgatcaatttccttcgttcgctccctcagttaattgtgtgactcattgtttttgctcttcatttcgctatgagtcatcatttttgtgggaatattttccgtttgcttgtgcacatttttcacgtacctgtccccgtccccattgatttgtgagggtataaaagcccggcccatttccattttcttcacttatcaattttctatcaagtctgcaaggacagttttctgtccaactaagccaaagggtgtatttaaattgtaattgtgaatatttgaataaagattaagaaaaagtgtcttagtcttatcattcattgtctgtaaaagggaaattcaggagccctttaatacagaccgtaagcagtgaccccagtagtatgtcaatagttggtaaacgaaacaaatatttattaagaagtaaattgggaagcggcggaaatattggggtgtaaaataagtctttgcatagctgtgaattgatttgtttatggattttttaaaaatcggtcaaacaaattattattaatttggattctttccgagactcagccaaattaaaaaccaattatgtatattttttaagggctatttgttatttatctcatggcccattcagattttcttaaaaaaattcccacggtcatcataaattgttgatcagcaaactccaaaaagtgtttggatggcataactttttcaataagagaccgattcccaaaatttcatgctattgttatgatcagacctaaactttacatacaccgaatttttgaaaatttttgaaacaataggttagaaattctgaaaaagcaccctttatcaaaaatctctcttgggccaattcagaaaacaatgtccaataaaaaatgaaaaaaattactttttttcgacaaaattttgcaaaaagccaaaattttttaccgtctcggtaattaacaaactgtacttgatctccaattttaaacacaacccgatttgctccgtgtttcctgtgataatgaactttggatttgattgcgttgcttctcttgattgttccttgcatgacaaattgtggaaatatgcccctgtctaccacagttgtggcggtggcgctttgccgatttgaatgttttgcaacattttcatgaactgtgcctgctgatcagccaaaatggctttaagttgctccggggtgatagccatgatcgattggaaagatttgagtgatagtgaatagatagtgaaatttggccgtcaatgataattttgatttgaattttaattgacagtaaaattcggtgtttgttgagtgatattaagtgtcctttggcgagtggaaattgcgaatttgaactgcacgcagcggtcgctttgacttgcgtgttcccaaatccgtctttcctttaatgggtgttcacagaagcctacttatcagcttgtgaagccaataaagtcttttccttactgttgacgaaagcggtctacttatcgacttatcggtcagtaagaatgtgttacgggcaaaggtggacacaaatgaattgaataaaattgaatttggaattaaactgccaagtgaattgtattttaaaaataaaagcctatgctgactgcgccaatttgttgtgtcgtttatcaacaacaacaaatnataatcaataacaaataataagtcagaggagaagagagagataaatatgtgtggggtgaaagaaaatgagaaatgagaatgaatgaagtccgaagcgaggaaggagagaagacatcagtatttatgggcgatgatggtggtgacgtgccaataaacataatgccaagaaaatatgaaatggcaataatacaataaaaccttcactaaaacaaaaaaatttcaaataacaatgctatatttttgagcccctttcttcaatatgcgcagaaaaatgtgcaaaactctttcctctgcggagtaatatttcattaatttaccaaagataaagttttttgtaattccataaaattatttttcaacgttttactaaacagaaacggaaatttaaaaaatctaatttttttaaatccattatttcatttttctcgatgaaataattttttataattttataatatatgaatttataaaaattattttacaaaaatgtaaatgaaatatttgttaatcaattgcataacaattaaaaacaacgataaattgcaattaatttgataatttatactttatgaaaaatatttttccaaaattctataatattaatataatatatatttaatattataagctgaaaattcaaatttattattttgttattactaaaaaaatgctgcaaattaacttgatgattgttttcttctcatttttattcgtactaattgatggaactgatgaagaattatttgatgatttgtgtgaaaaccttcagccatcgacctcagaaaacttcaaaaaaacaaaactcgaagaaatgaatgccataaagaaagaaattgttgataacaatgaaaataccgaaaaacaaaatgccaatcaaattgaaatggaagacataaagccaaaagaattgcaaaaaattaaaaaggaaaaaatattggaagaacaaaatataaaagtgacgaaaattgaattggacaaattgagcgaagaatcctttgaaaatgagtttgatgaacaagctgatcagaatgtttcgtctgctgatgctgaaggctacaatgatatggtaatataacagataaaataacatcattcctggaataaatttttttttataaattcgctaaattctcagatttttttgtttagaatacagaagaaataaatgaaatggaaattttgaacaaatataatttgttgaaaaaggaattgcgaaaagaaaatgtttataaaacgttgacaaaaactcaatttgaaaatgaaattgcaaaaaagttgggcacaaatcgaagcaaaatttataaattaaagaaaaaattgggacaaaaaagagtgaaaacggaggaaagtgaagaa

SEQ ID NO: 17174 - DNA, 2448 bp, Heterodera glycines
  misc_feature (26)..(26): n is a, c, g, or t
  misc_feature (34)..(34): n is a, c, g, or t
  misc_feature (1585)..(1585): n is a, c, g, or t
gtctcggtacattgtccgcacttacngtccttcnaatgcattaatcactatttctctgtcgttaggatgattcagttgctcacgcagtgaaccgacacttgtagcgagcaaatgagcacaaaaagaactgacaagcatcacttcaatgagaaatgaatgtgtaaaatggttaatcaggcttatttatagtcgcttttaagtgtgaacgaaacaaagttaagctatggattttctttaaacactatgcaaacaatggtgacccaattaaattaattgttcctaaaaatctatatgacctacataaacccgtatttaagcgcggtttgtttaataagtttcattcattctcattaattaatatgaatagcagcactattgaagagcaaacaaatgtaggacatcagctgcatcagcagactatgaacttaaactgtgactgtaaacatccaattaccaataaaagatttgccgggtctattcctactggggcttttcattccatccaagacgaaccaacagagcagccaccaccaccagttaaaagaccagaacatttgtggaaattgaccaaagcaaattcgttctgctcttccgtctatgcaacttgtgtcaaaaccgtctctacaacagtgaagacaaaacagtgcgtaacggggaatttgttgatgtgaagttttcgctgtcccaggtcgtggcatgaaaaagtttgtcggaaaaagggaggggacaaactggggggatggaagggaaggaggagattcgagactcgctcaaaagagcggcgacgcagattggcgatggagaaggcgagagaaagggtgtgccgctcgttcgattttgggggggtttctcgccgtctgtgtccacatttcccgtgtttcccgacccctacccaaaggcacctctttcaacaacaatttatttgaagcaaaaaaaggggggggaggcggttaggattagaaaattgacgcagagcaaggcaacggttggaaaaaaaggagtgattatatgtgtggaagtgagccgcccgggggagacagaaacacttaaaaagaccaacagaacggggagggagcacagtattatgagatgggccgtgattatgcaaaagagaagaaaaaagggtgcgagcagcagatgccaacgaaagttggccaatgaatacaaagagaaaggaaaaaggggacaaagggacgaaatcggagagagaaggcgaagagaaatcggtgcagattttgaatggacggaggatggcgggtgaattagcacaaaggggggaaagaattggcaaactagaagagggggaaacggttggggtgaaggacagagaagaatgggggggaacgttaggaaaaagaaaaaacattcaaaattaggaggaaaaggtgagacacaaaaatcagaataaaatcgtttctcatcgctccctcgtcgcgactttcgcgacattttccccaggcagcgtctatcggcatcgccagcccctaaaagtcctttattttcttaaaaatttgctcaaaatcgcaaaagttggccttttttgtggacaaatctgttaacaaatcgcattaaaaattacaaattnttccccggcggcgcctatcggcaccgccggccccttattccccaaatttttttggaaaaagcgccgcaaaaacattcaacttcgatttttcatgctagaatttcacaaaatgcttatttctaataataaattgaaaacacatataacatttgcacattttaaatgtgttttgaaaaaatttgtaaaaatgaggctttttgacccaaaatgaggcttttgaaaattttaatctggaagccttgtttatgatgcgtattctgttaagatttttttctgcttttctttgatggtccgtccattcattttggccaaaactttaaaatgattccaaatatatataaatttgcatcgattaacgaatttaagaatttcaacagaatgccaaaattccaaaagaaaaaagatacaacacgaagaaggcctcaagcaagtgtttcaaatgaaaaagaaaaaatttccggcaaataaaattattattttttcattatgaaaaattttaaaaaaaatgaacaaatttcggtgatgaattagttttagatcacgaaacatttaaaataaattttttaatgaaaatgggcaattttaaaaagttctttctttttccttaaaatgttaaaaattaaaaacatttaaatttagcccaagcaattttgttatacttcagcttatcaaaatgaaacacttggggcttgacaacagaactgtagcacgaaatgcaaaagtcatattgccgtaatcgtaatatcgtaaccatacagcaaattatgacgacgatttacattacatgcgcagaaacaaaaaaacagtgcacagatcagccccacagctaataggaatgccccataagataaccataacatgaa

SEQ ID NO: 17175 - DNA, 813 bp, Heterodera glycines
tactagggttgctccccgacccctcggggggcaaaatgtcgggggtcggggcggggagcagctcaattgtcgggggtcggggaccccgatcggggaatgaccaaattttattttaacccaaaaaaccaatttttctttttaaattctcgtaaatcttcctttttgtcagtttaataatctgatttcgttagaagctggcctttaaaccagggcttatacattgttcttatttataagaatttctaattttggggtagcgactaaaattgttctgatttcttaaatatatttataattttaaaattttattgcataatgtcactattttatcaagaaattttaaagtctgacgcaaatttttttttgatcttttggtcccaaaagtttgaaaaatgttgcaaaatgttcattttgattaattgggattttcaaaaataattaattataattatttaccttttaataaagtttcataaatttcaacaattttgcttgaattgttaaatagttttttaaacatccgcttattgttgtcattgagcatttgatcttttgctatggctttgtccatttggcttttgtcaaatgttttcttctcaatttttgtcgtttgaaatattttggtcattttttcaaaatttttattttcaaatgatttacagaattcattttgcaatttttggagactcttgtccattttcaattcaaattttccattgcacaaaatgccaatcgcatttttctgcacccattcagtggccaatttggcaccaaagtttccctcttttactttgttaagcaaactgtttgcat

SEQ ID NO: 17176 - DNA, 1454 bp, Heterodera glycines
tttgaagctgtgtttgccgtccttaacaacacacaaaaatgaaagaccttattaaatataatagaaaaaataaattaaataaatatccaaaattagttttataattagagcttgacctggatctgaatccagcttggatttttcttggatccaggtccagcccatttttcggcaaaatggatttctcctggatttgggttttggtccaagaaatccaggtccaggctaggcctggttaatattttattatttgttatttcatgtgacttactatgttttattaaaatatcaaaaagaattaggtaataaatttaaaaacacattattattataaattaaaatttttagatgttcttaagcaattaattgattttttcgaacatttgtttgcctttaaaacaaatttcaaaaaacccaggactatctcttgacaagcctgggtttttgtcccggaaatccatgttcaacatggaatccaggtcaaggctttttttcaaaatgccgagctctagttatatttccgttcgatccagggcttaccccaaattgttgtaataattgttgctgcttccgccattactgctgacaatgaattttattttactctataatttaattttctttattttttacccataattattgtaattgctttgctccaaaggtctaaaataattttatttattttcaattttatttaccattttcttacctttggttgtaattcaggcttctgctgtatgcattattattgtaataattttgcgatgtttgttgctgctgttggtatccgttgttgtaatttgctagggcaaaaaattgcaattattattgttttttaattgcaattattattttatttttttttactattttggctgtttcctcctccgctggtgatctgtcgatctattaattttattattcaaaaatgttttaattttcttttaatttttccgacttttaatcgccgccgggtatgccacccgcggttccccgtaagtccgtccatcgatggcatttgcatccgaaaaggcgggcccaggcggtgcgtcgtacgcgcgccggaagtccgagaagtcgtcgttgtgcaccgccgcctgcagattgctggtctgcaaaatgagcaaattaatataattaatcttgaaataagttgtagagaaaaaaaggcgtgtcaagtttaattcggcaccttttatatgtcatttgatcgtttgttttatctcctttggtctgatcacttttgatcgtttccgttcccctttttcaccaattaatcactccactcactcagaccaatttagccccctttgatcagcttattattattatacccttttctcactaagttaaccatttttgcaactttattcaactctgatcacttctcctgagcactttcgttgatcactaagctcctctttcatctaaactctgaactctcttttctc

SEQ ID NO: 17177 - DNA, 991 bp, Heterodera glycines
atcattctatttgatccctttgcccccctttcatctttcttatttctctcttttctcccaaattgtctctcatatttttttctctctgctcactcactttgatcacatttgtccctgctttggtttggcttcggtaatttttctcctccgttccttcttctgtccccattagtcgctttatcatttctttgtccactccggcttccactttcaattttaaattagttggcttttccttttcctcccctcccttacattttccgccactttttggcctcggtaggcacggcattcgcctgacagagacttcgtagaaaactctgaaattgtttttttattattatttttcgattttgcttctcgttttcaccctttggcgtccacgtgtctctgcacatttgcgatgtaatcgaaggcgaattggcgttcgccctccatcacttcaccaccgtacacaatttgaccggcttttacaatggcaacgccacggtcttggcaagaaaaagaaagggattattagcatgggaaagaaaacggacaatggcaaatgaaataaaggacaaatggcaaaaaaaggacaaatggcactgtgatgaatgaatcacctgccgaatgccttaaagcggagtaggaacagcaacggagttggaagctgaaaaagaaaataaaaagatgacagaacggacggacggacaaaagggaaattggcagacaaatgagcaaataaaaaaggaaagtcagaaaatggaactttcgatttttttctatttaatgttatttctatttctttagccattgtcatgcttaaaccctgttaattggtggtattactatggcttaggagatctgttccacatttggaaatacgttgtaatttgtgaaggaaattgagagttctgcctacataaaaacatatattttccaaaacccaaaaaactcttaagaaaagttgtaaatttgccactttaattaaaattgaaggaatttttcg

SEQ ID NO: 17178 - DNA, 2330 bp, Heterodera glycines
  misc_feature (52)..(52): n is a, c, g, or t
  misc_feature (61)..(61): n is a, c, g, or t
catcatttcacatcactttccactgttcacagtcgtaaaatcggcctccgcntaatttgcncaagtccatccgttgcatcgcgcgcatgtgctcatcgcgcaccaactaaaggggggttggccaactgtttgagaatttaataaaagccaaattaacggcaccaaaatcttgccaatattttatttctttttttttattccgaatcttgaattcaaaattttcgtgctgtgcatttcctaaaatctattctataatttggcacccttttcaaagcaatgcttaccttcaactgctgatgttgttgggattttggcggaatgtcgtcgtaatcgtagtgctcatcagcctcatcaaggtggtcgctgttgttgcacacgctggccaccaagccgttcagcagtttcctgagctgctgacatgacatcacacgccgtggacggccattttttgtgagaaacaaatcatccgtttgttccacaattactgctccaacatgtggggcgcgttgcatgaggaaacaaagtgacaactgcttaacttttaaggagggcttttcatgatactcttgtaatgtaccaaagggaaaatggtctctttggattccgccctccgaaaattttgtggtacagcaggaacaaggaaatagaattgacccagagattctggaacgaagccttatatcgagaatcaagaacaaagcttaacccaagatttgaacgaaatttgacccattatacgaatcttatcgagcatttttagtagagttgagcggggccgggaattttgggcaaaaccgggaccgggactagccgggacctgagaagccgggaccgggacctcgattttttgaagagcattcgaatttgattaggagtaatccctaatcaatgataagattttgactaatttaaaatccgtaacccataatatgccaatcatcactcaccgatgtgccaattttgtaaaatgatgctatgcttttcagcagcaaatagcgctggtgttgctttaggtaggaaggtttttgttctttgtatgcaaaaatgctgtgggcctttaaaagttaacaattaatggattttctttttctgaaatagagaaaatattaaatcaattaaaaatttaacttaaaaaaatttgtctgattttatcgcacacagaaaagcattcttaagcttttagagagcttttctaggaccatctagcaccatatcacaaacccgagaaacagacactcacaatctaaacgcaaattgtcgatattttaagtatttaggttatacttagaaaaaatttaaggtgcttttgtgcccttggtgcaaattttgtgccgcaaagtaaattataaaattttaaatcggcttaacaatttaattttaaaaatttgtttgatattttgttagaaaattatctgattctctgatgcattttccactgaaccttccgatcacaacgcttaggggtttttaaatttattttttccaaatttgaccacctgcaggaaaatccctgcggatttacagtaatcaagcagatcgtcacgctgtaagaatgggtgcatttcgcattggacaacggccggcacacaatgtatgccattcttgactaagtattcgacatggtctgagtcgaaatttgccacgcctattgaccgaatagtgccaatgtctgttgaagagaaaagggatttgtatgtatttatttatcccggtggcgcctataggcaccgccggacccctcccatcccctgaaatttttaagaaagccgcaaaaaatagcacgaaaagtgaaaagattgtccattactgatggattgtccttcactgacggattttccggaccccgaaatgttgggtccccaaattactggtatccaatgttataaatccccaaatgtcgcgccattgaccccccactgacccatgtaatgttctaacacactgtacacttcttcacggtcacttctgttatttgagcaagtgtttgacacatttttagaaacatccttcgcatagtgtaccatgcacaagtcaatgtagctgaaaaattgttgaaaatgatttaaatatttatttactaaataaatgcattttataccaaaatgtttaattaaaaagaggaaaaatttgaaaaacaaaaaagttataattttagagaatttaaaattcctaaataacaaaatataaataataaaaaagccacccatcaaattggtcgatgcactccttcacgctaaaatgtgcgtaatcggaaactgaatggaattggtcgccgtcaatttcttttttaatcggtctaaagcagggggttggaatttgcagttattttt

SEQ ID NO: 17179 - DNA, 2718 bp, Heterodera glycines
tccccctttttctgacttcgtaattttccgtcggtgtcacgcgaatgtcgaaatctgtgaatgaaaaggcaaatgcgctttctaatgacttatgaggtggttcaccatacaagcagtgtatttggaggggatcacgttcatttgctgctccgccctaaattttggtcaaatttacgctggtcacgtcgcccaattgcaaatccgaatattcctttcacgatattcgttgaaactgttcagaatggagccctgaattaaactgtttgattaagccgatcatttaaaattggaaagaatgcgaaaaagaacaaatttgatggttttgaaattggttttactcatgctttttcggcttatcctataaaattaaaatttaattaatatataattttcaaattcgcttttttactgcgtgtaaaaataaatgattggtctttatttaccagttttggaccaggggccttatgctcgtctcgcggtttagtaaaccacggttaacgcattaaccacggtttcgttaaccgtggttaacgaccgaccttaaccggtatgctcgtctttaaccatggttaagtaaaccatggttaactcaaccgtggttaagagaatttatcttgaaattgaaaaataattaatattaaaaaaatataattaaattattataataattattttttgtttatattatcaatattagcatagattttattaaaaaaccccgaaaaactattaaatcaagaattggttttctaaaaatttttggccataacttttttaaacacagcaattttttttttaattttgcaaattaatagaggactcttggggctatagaatgataccaagaatgtttaatttggatgcttcaagaaaaagtttgctgcattaaaattgtcaaattatttttttatggccgtgtgaactgcaatggagccaacatttcttggtaatagtgcattacaaacaattacgttgttatgcaacatgctacaaacagcagcaattgagtcggggtcgttttggcgcccacgttttggcgccgacgttttggcgccaaggtcgttttgggccgacgttttggcgcccacgttttggcgccagggtcaggtttttaaattttgtctatgtttgaataaatgaaaatatgtattcgtcagttttctgagtcgctaatcacgaatattgtattcatcttgacaattgcgaagcccggactcgatttaaatgaaatacaatttttgaacatattagatcaggccttctatctgttttgttttatcaaatgttttaatatggtgggtccaaatctgagaaaatgatttaccagattcaaaaccgtagttgtacctgtttcaaaaaatggcctgtacctaaattttgtcaccttttttaaaaagccattttagcggtttgggcgtgtgcaaattttttgatgaaataacactaatccgtcaataatttatatcatagacaaaaataaaagtcagattctttttctgcatgtaaaattaccctagaaaaaatttatttatttattttactatttaaattattaaataaatttacgttaaccacaactcgagttgtggttaagattccttaagaaagattaaaccacggttagatgagcataccggttggaaataaaccacggttaacgcaagttaaccgtggttaagaagggagtaaaccacggttaactcaaccgtggtttatccttaaccacggttaaaaagggaaggacgagcataccggttaaggatttttaaccacggttaacgccgttaaccgtggtttagctctaaaccgcgagacgagcataaggccccaggagttcaggtcgcttatcacgaatttgacatccatttcagctaattccgaaccccggacattggtgcctttcacaatcagttttttataggcaatctcgagaatcctttagacttgtttttagactttttggaaatgttttttttcattggccaaaatggtaaattcttgtgtaattcccctcctccgtgtccttcgcttaattttgtttccattttatccttttcaatatattttgttgcacaaaagttcccattaatcatagcgaccgtcatcattcgctttgctcaaattagtgattaatgggcatgcaaattgtgattaatcttggtctttgcccttccttgccggaaagcgggtaaaattgaagtgaaaacgcaagttaacctatggtcgaggccatcctttggcgaagaatgcccgtccattgcctcaatcagcggaaggtcgcgtaacacatggaaaagcgacggacggagggactgcggtgggtcgcttcccggtccgcccccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttgcataaaaattatttaaatga

SEQ ID NO: 17180 - DNA, 2069 bp, Heterodera glycines
cgggattcgaaatatgtggaaattgatgtcatattcgtgatcagtgcccccgagtacttcaccgtattgtataaaacccctttttaatctctctttttttaatgggaccaataaaatacaggattagcgatggtcgtctcctgccggtgattaattccatattcaatgtatgttggaagggacagtcccaggggggagaggaggtcccccatccacactcgaaattttaagtgaaaaagaaatgtgtgccggaaatcctcggttttcctattgatgacactctccaaaataaattttgctaaatatccaaaaaatttaaaaatgtagcataaactgcattttattaaatgaggacagatagagacatgttacattaattgggtggggaaagaaattgggacagataaataagtgaacggaagtgaaaatccgggcataatagggttggctgagtgccatggaaagtccgtagctacggaaattcatttccaaaattcgttattttggcactcaaacaaaaagaaacgctgtggttttgtataataacggcagccttagccaagattcaggaccatgatttttaccgggattttgaaaatccgaatccaaaaatccagtaaaaaagggcatttttttcttccaaaatttgatctgtttccaagtccagggggctctctatctttcaaaatttgggctttctatatgaatttagttagttataatacacaatttcttgttggttgacacagtccgtcagttgctgttgttgtccaacagttcgtcaagatgtttgtccaattcgtctcccatctgtccgtcctcatcattcgcattgtcagtaccgtactccttgccatcgtccaccaccatttcaaactcgtgcaaatcgtttaacagttccttctccagcttttcctcctcatcattttccggtgtcgcatcagcagttgctaaatttaccatatttattgaattacaggcccctggtggctttgtgtgtgtttttcaaccttttcacctcgaaaaagggagtggactttatttcagagcgaaaattaaaaaaaaaattttcaaacctagaaaaaatttttttgcaaacttttctaggtattttaacaaaatattatgactaaatcttttcgtttttaaaaaaattctgaagctttttgcgggggggggggggctcgatttcaatagcagttttaaatagggttacgaccctgatgtcggggttggaagcgtcggagtcgggtttaaccccgaaaaatggccaaaaaagtcggggttgcaaccctagttttaaaattagaaatcgaaacaaaacgccacgcactttgttgtagtttttgtggctgctgctgctgcttgtgctccgtttccacacattttttgcttttatcctcctccttcgctgaaccctgtcgttgttcagacgtcgttttttcggccacaaatttgcggaccaacgaaattcggtaggcgtagttgcgccaaaatttgtcctccggaactctgaaatgaaaacagggaatggttatgggttaagaggatgaggaagagccaacaacaaattcaagatgtataacccaaaaaaaaaaaatgccggaatttttgttttttactcacaattttggcacaagttcaaatctgagcactgccagccgagggtccagtcggaagagggcatccgcgtactgtttgaccagcgcaatgtccgagtcgagtgcgaatgtgagcggtggctcgtccgtcaaatttctgggattctaaaaatgaataatcgaatttttttccgttttccctttcccgggaaacatttaaccgcgttagtatttattagaaaataaatttttgcaaaataataataataataatttaccgaagaaattgcgatgatgtgctgttgagcctcaacatccgccagcagtccgtcaagtccaatttcgtcaacacatttgccctccttgcgcaactcttccataaacttttgccgttccttttcaatgttgccgataatggtctaaaacggagaaaaaatttgaatacgaattcatagctgtgcaaggggg

SEQ ID NO: 17181 - DNA, 2417 bp, Heterodera glycines
  misc_feature (34)..(34): n is a, c, g, or t
ttctttctctcagttcaattcctctctttttctntcgtaactcatcactccctcttttctttctctctacttatttctctctctgcctttcattctctctctctctctcttactatatccccccctccatcttctcttctctctccatctctatttctttctttctctcagttcaattcctctctttttctttcgtaactcatcactcactctctttttctctctacttatttctctctctgcctttcattctctctctctctctcttactatccccatctccatttttcttctattctttcttctcttcctctcttcacctttctctctctatctcatttcttcttttctctccctcctcttttaattgactctctctctttatctccatactttctttctctctctcggtacctcttctctttcctcattctttctctctcacattgatgtaaacaactgaaaaataattctctcttttttgttttgtttacctgtcactgtcatgagaagttattgcaaaattttctttttttctttttctaacgctcttttttgatttttctttcttttttattaatgaacaaatcgccacaaatcaaagctttttacgccaatttaactcaaccaaaaaagtgggcggagcttcggctcgcttattatatagtcgtctcccttgaatatgggccgaaaaccttcggactcattcaccagaatctggtgctaattcatcaaatcaaaatttcataattcaatgaggtcatatttgtttacctccgtcgatgtagttgtcaagacttggaaaataagtgggcgccgcacttgaataacgggccgctttccaaacgcgaattttctgcgggtcggtggaatcatcggaaaaacgtgagcggtaagtgcgaaatctgaccaattcggttggcaattgcttaattttcgtcgcagtaacaaataacctgcaatttttgacaaatttattcaaagaaatagcccatttatcattcagtgaaagtgaccatacattaaaagagagggggaggcagccatgtaaatcgacgacctttttttgaatataaattcaaaaatgatcaaattaaaaaaaaattttgtccgatggtgccggtaaacttccaccggaaaattttttttattaagaattctgaacgaaccatattaaaataagatttgtgaaatctttcagaaattcccctctttccccttcgctggggaacccctccccggccaaccccgccccctaaaatgtatgatagtgacgataatttaactgaaataataaaaaatttatttctcaaaaccaacttcatcttttctccacaccacagattggacatccttttgttggacccaaattgctctttgaggaactcttccaaattttcgggcgcgtagcagccaagaagcatttttggaccgcaaaaaacggcgtccttcagacgaaagtaaagtcgcaggcaattgagcaatgacgagccatccgcaagtgctaaggctacaatctacaattaacatgaattttaatgagcaaaataaagaaacaattaaaaagaattagtggaatttttttgtacacgaaaaagggagggagtgaggttaaaggcgaagaaaaaaagtatttcacgaaaaaatatccctggcagcggcttaagaagtaccaaatttaaaattttctctcagcaacacttttgcttttaagtcataaaataaaaaacgatatttttgaaagaaaaaatttcaaaaaagaaatttgaaaaattttaaagttttttttctggaaatttgtgatgaatgaataattttttcagttttcatcaaaacccaagaaaaattcaaaattttcttttcttgaatttttgaaaaatcttatgaatatgataaaacatttggtttttctcaccgctcctgtgcttgttccgcccacaagattgaagtgtttctgcacaaaatttggcgcattctccggtaggccatctggatagaggcgtttctcgatctcgagaagcatctgaaacaatgaaagagctaaattacatcaaaaaacacagttaaaaatttattaacaccattaaaaattcaaaaaatttttagactatttttggtgaaaatctgttatcaaataacacccaaaatgtcataaaaattttcctgccggagcctatcggcaccgccgacccccccccctgttcctgaattttatttttgcaaaaagcgcgcctaaaacggtttgaaaagtaaaaaaaaggtcatcgcggcggcagaccccccttcgcaaaaattttttttccgacaaaccccctttaacgtatgagccggggtaaaaaaagttgcgacacagaagccaagctgtggtcacagcaagggagggtgtcggaggtggcggaagcgttagtaattaaaaa

SEQ ID NO: 17182 - DNA, 3067 bp, Heterodera glycines
atatggatataaaatcgcgaaatatggccataaaatatggaccaaaaatcgcaaaatatggacataaaatggcaaaaatcgcgaaatatggacataaatggcaaaaatgtcaaaatatggacataaatttttcaaaattgaatgtaaaatttcttcaaatttattggttgaaattgcatatgagatacatttccaaattttttgactcggtaaggcgctttgacaaagacggctttcgttttgcaattagtcggtcaacattcggaaattggtctcgaattttttcggcaattacgtgcaatcattttaaaagaaaaaaaacataaaagctaaaatttattaatttttttagcgcaaaatcaacaacaaaagcgaaattttcgcttttttgcttatttttgacataatttattaatttttaagaaaatttaaatttattcaatattctcgagaaattttggcgaaaaaatgattttttgaaaaatttttcgggttttgggctcaaaaaggctaatttagctgctgggggccattctaatagaggtttttttgaaaaatgccaaaatatggacataaaatatggacaaaatgccaaaatatggaaaaatatggaaatatggacataaatcgcgaaatatggaaaaatatggaaaatatggatatagaaatccttcctagaagcttcaaccaagctaaaaacatgttttccgtgcgtttcaggcctccaataatccaggaaaaaaatatggatttccatataattacacgccctaatcataatgaaccataaaaccgtgttttcttaattttaatgcttattaggctatcaggggttgaaaaaattcaactttgagtccgattttggacataggcgtaaatgtcggggccgcaaaagtcggggctccataataccgccccgtggcgaaaaccatttttttttcttttaatgccatttttgctgagagcttttttttaacttttaggcggagggggatcttggcgcggtaaaaatctgaatttatcattttgtaacagattttcatgtaaaaattgaccaattttgtggatttttgaaaaagagagaggggttcggcaatgtatggcgctaaaatttttattggggaagggcatgaaatatgaacatgaaaacgcaaaatttccaacaaaaattgcttgctattccaacccctcggcacggcatacactcacacctcccacattgtcgtagatgcacagcggtgcgagcattgtcgtggacgatttgccatcgttggcggttgcgccgcgcgtggcacggaaaaaatcgagcaaaatgcgaacttttgacggggcgtttggtcgccacactttttgccgcgaccgccaaccgatggaccaatcgctgctccaacgcgtcggtgcccaaatagagggcggacagcacaacgcgacgctttgcggactcaacgcgttgctgaaaaagcgggagaaaatgggggagggattggcatttttaaaagaatgcaaaatcgaaaaatgaatgggtttgtccttaaaaaacataaaaagtcgcccagaaaaaaacaaacatcataccattctgggaaaccttttttaaatttaagtacttggaattttaaaaaaaaaatctggatataaagcgcttttggtaaaggttaatttataaaaaatgcattaatcaggaagaaatcggaggcgggtcagtaaattgagaacaaaataaattaaattataattctcatttttgcttttagtcttatcgaggcacttccgacccaagtgatcagtgtgaatgtaactggccagatttcggtacttttcacaaaaatgtaaaatgaaaaaaatgtgattttgaaggcgagttcgcgggtgtcaatgtgcgactcgaacatgcttatggcctgcgcatcgaaggccgattcgcgcggatgaccagggtaaaagtatccgctcactttagcaatagatttttatgaaaaattcaagaagttcagcgattttttttcaatttttgaaaggactaccctgtcgcgtgtatgtacctcccccaccaaaaaacacccctaacccgccgatattttgagaggaaaaggatctttgtcagaaaaaatgtacaattaatcgtgcataacgaattcagagtatatttagaaaatttataaaaagcaaaatatttcaaatttctgtttttcatgaatttttcaagcaataattttcgatgaacaatcttattactctttaaaagtttagataattttttgacctgttatttaaaagtctgttgtctgaaagtttttcttctcagcggtcttcatgactgccttccatcttgtgtgcgattacgccgaagctgaacttggaccggcggaacaaaaattcatgcgaacttaccgctttcgcatttcgataccaccaaaagatgaaaagaagtggggtactagcctcgcttctgccgcctacatcggcatggttgtgttgttgacaggccgagcagtgcgcgccaattggtgtgtcaccggcgcactggatagcgatggagaagtaaatgaagtcgctgggatcccgcaaaaagtggcggcggcaaattttaaacttaagacatacataagaattgaacgggaaatccaagttggatatgttgtgcatgcgataatttaaaaacaaaaatagatgaaatcataaagctaatgtattgttattttagaataaacttgctttcaatttctgaaattttttgttttaaaagtattgcgaaaataattttttaaggaaaatctaggaatggtatttaaacataaaattattagaaatcaataatatttaattttttatctaattattatatttaatcgaatataaacttactttattgtaaaagattatttttgagaaaatttataacaaaatgataatgaacaattaattttttgtttttcaaataatattgtatatcattttaaatatgataatatttgtccgctttaagaccggaaactaatcaatataaatttagaaaataaataaaataaattttaataaaattaagtataaccgaaaacttttgctt

SEQ ID NO: 17183 - DNA, 2017 bp, Heterodera glycines
tcaaacgcttttttcgtaatgtttgcatttgttaatagttttttataataattttttttaattttttgaaatctccttatccccccccccatgtgagcttagattagcaggtcacgcaaaaacatttaccaatctccaaaggaaatttggtttttccgtctttagctcagaatctcatcctctttactaattttttagtgattgtccattcaacgaaaactcatataattctacgaattttatggttaataggcaaacaatggagaaattcaatccgataaaagcaaaaaacatttataaatgggaaataaatgggtttttggtcaaattttatgccatggaaatgtaaatttgtccgacattcttttggtaacaaatgagggttatataccataaaaatttgctccctttcttcttctcttttcaatcgttcctctcataattctgccattttcggcttccgttttgtttgctcaatttgtcctaccgtactctcttgctaatgagtcatcagtgtcgccattactgtcttctgtcccttctgcttcccaattgatcggactttctgtcgtagtggtcacaaatgtctcttccgcatccggaactgagtcaattgttggagggattatttgctgcggtaattacagcaaatgagacgatgaaaaagggtaaaaaacaaaaattgaacaaatttataggctgaactttcaaaatttttcagtccaaattccattggaaagccctggaaagcccccgccgaggggagaaggaaaacgagccaaaagcaattttaattgaactaattgacatttataatgagctgaaattggatgattataaggcaatagaaagttgccgaaaatgtgacaaaaaaggaaaagaaaatgggaaaaatgaaagagaaaatcatgaccataaaaaacggcgctttctccgatttgtcgcgcgatcattggaaattgaatgggactcaaatgcattttgtgctgatggacaaaatgacaacgacgatgctggtaattaagtggatttttctgcacccgaaattttttacgatttttatgacccaaaattcaaaaaaacgaaatttaagtgctttatggtattcccacgtaacactaaaagtaagcaatccacatttgccacattatttatccacattttaaatagagaccggacaggagcgggatcccgcgggattaaattttggatttcgaactcgggaaccgtcccgatcgcttttttaaaatcctggattcatcgggatctggatccggtcgggatcacttcgatcccagttgtacgttatcacattttggatgatgcaattggtagtcgtcgtcgttgtcgtcagaggcgtcgcaaacgaatgaataattcgccggcgccgatgccaacaaattccaagcataattcgaatgatcgatttgctgatcggtttattctgatctggcttgcggtgacgctcgttgttatggttttgctcaagtgtcgctgtcgttgttctcgtccacccgtaatccaaagccaaccacgtgcaaatattgtggcattaatgccaccccaaaatgtggttagaatgccaccgcaaaatgtggttagaatgccaaaaaatgctgacaccaaagtgataatatcaacaccttatgatggcacggaaaatatcgaatgccaaatttaattttgatcggacttggaattgcaaacccaaacaatgaagatttggaatcttcaaaggatattatgtggtaaagtctctggaagagaaggcacagatggagaaggaaaaattgagcaagtacaaagttcaaaaatgaataataattacaataatatgatatttaatgtgattgaaaggattttagccaatgtctggcacaaaagtgcgaattcaattcaaaagtttgaacaattcgctcatctgctcacacccatgcacaccaccgtacgtcgagatcgaataccgtaccgacaaaatggcgcaaggcaaaaaaatgaactaattaattaattatta

SEQ ID NO: 17184 - DNA, 2533 bp, Heterodera glycines
atgattttagaaaaatatttaaaattcaattaaatcatgatatgagttaaacaggtggcataaaggagattttgcgcaatatcgttgcctttatgccacctgtctgactcatcgtgatcagcgaccttggaaaccccaaattacgaattttggaatttttttgaggggggggggcagcataacccggaagtacctaaattgaaatgataaatgtataaaagcaatgctttccataaattcactcaatttaagcagtacgctgtgaccgaccagcgcaaggaggaccagaaaactgttgactcgcaggttatggaagtgatccgcaaacatcccgagaagaaattcttgttcggctaccttggctcacgctttcatctcgccaagggaatgcatccccataaaatggtcttctgattccttttacgacgaccgtatacgaaattgttgcttgctttttcgaagaacagctcgtgaatgcacttattatttttcattggattgataaaatttgttgtagcaactctagttctgtgcatggacggtaaaaaacgaaaaaaattgccaaaaaataattggcgtaaaacaaaacgccaacacactcaaattgaaaaacaaattatattttcatctgatcaaatgttttaaaatcgtaaaaactcattagaaaacatagttttttacagcaaaactaaacatttattgtaatgtgagggcaaattatttattaaatataaaaaattgaaaaatgtatgaaaaataacaacaaaaagtataataaacttataaaaaaaactacaaaagactgatcagagttcatttgaatcaaaaatggcgtttcgaatggcagattctctagcacagaacatcaaaatatcgtggagatctttggtgtttgctttgcgcgcgagatcgtcattgaacaacgcgtgaaatttctccacaggctgctcactgagaaggccccaaaatccatggttttcagcaaattcaggggcatggtggaccaaatgatgaaattttgaagtcgaacagtgccgacgaaagtgctccaacatgtgaacacggaattgatcagcagtggcgcggaaatcagcgatttgatcagcagaaagcaaatcggcgacggcaaatgattggagttttgccaagagttcaagagccatcaaaatattgtcgcggcgtggtgattgtggcaaaaactcggtaacatgcataggcccgccaccgcgtaaaatgttcctaaaaattctcgatatttaacaaaaaagcaattttcgaactgaccgcacatggtacccgctgtattcctggtaccacgcatttttgtaagcccccaatgcccgcaaccgcatctccagctgttcctcgtactcagttccatggcgtgtgcaaaggtgtctcaattctttgaaaatcccgaaaaaaactccttgacaagcgacgatgtgcagcgacggtggaattgtcattgaaggctcaatgttgaaaaatgggctgtaaaacattcaaaattttgaaaaaattcaaaataaatacaaactcaaattgcattcctgcacattgtttgctcatttgtgtcacatttaccccattttgaacgccttcttgaaattgagcagcctgttgcctcatgcgctcaagtgttcgttgacggcctggctcggatggtaaattttttgcttcacagcaaaaacaaggattggcactggctgctccacggtgcccaaagatttttgagatgaacatcaggtcgccggtgaggaaaaattgggtcgaaaggccatcaatttcacatatgtcggccaattgtcttgccacgtccgcaaaggcaacgcgaatgcctgcacttgtttctgcacctataaaatgcacatgtaaatgttaacaattggcttgctcagaaattacccctgtagcacccaagcaaagtaaaatttgaagctgccccaggggttgccacatttccaattaggaagcccagtttcatgaaattgccaccaaaatcaccagcgagacacaatttgagcgcattgccaggaagaacacgcaaggctgatcgatcggctcaagcggcggacaatggcaccggcaagtaaacgcttggaccttggcgaatgttggtctacagaaacatgcataaaagtgaaattagcaaaattattttctcttactgagtacgcttgtgagttggcatatgtcagctctttgcgcgcttcctttcttttcggcgaatcgctttttgggcctccctctgggcgtcctattttccttgtcgtcgtcatcgttgggccttttctccggttcacggactagtgaaggtgttcgctgcagctcagccaattgttgccgcagctgtgcaacacgacgttgtagctgaaattggcctcgcaaagtgcactgttcccaagagcatggatgttccagtcgggttggggtgagacttccattgtttgtatcgcgcattggactcccgcttctggctgtgcgggccagggcggcggttggtgatcgtcaatggcccaattcggcgaca

SEQ ID NO: 17185 - DNA, 898 bp, Heterodera glycines
aaataaaattcaaaaaatccaaatccgtaaaataaaattcaaaaaatccaaatccgtaaaataaaattcaaaaaatccaaatccgtaaaataaaattcaaaaatccaaatccgtaaaataaaattcaaaaaatccaaattcgtaaaataaaattcaaaaaatccaaatccgtaaaataaaattcaaaaaatccaaatccgtaaaataaaattcaaaaatccaaatccgtaaaataaaattcaaaaaatccaaatccgtaaaataaaattcaaaaaatccaaattcgtaaaataaaattcaaaaaatccaaatccgtaaaataaaattcaaaaaatccaaatccgtaaaataaaattcaaaaaatccaaattcgtaaaataaaattcaaaaaatccaaatccgtaaaataaaattcaaaaaatccaaatccgtaaaataaaattcaaaaatccaaatccgtaaatcaccttatatggtttttcaccggtgtggatgcgcatatgattgaccaaagtgttcgaatgcgcaaatgttttcccacattcagcacactgagattttggaaacaaaataaacaaattttagggatctcaacaaatccacaattcacttggtacggcttttcgcccgtgtgaatgcgttgatggcgatttagacaatccattcgagaaaattttttgccgcaaaattcgcactgtttttaaaaatattaaaaataaattcagaaaaatatttttaattatttaatttattattattatttttaccaaaaaaagcttctcgcccgtgtgtttgcgcaagtgtctctttaagtgtgtttgttggctggccataactttttggacaatgtgcgcacgagaagaggttcctataccgtttttgtgtcccaacgaatgat

SEQ ID NO: 17186 - DNA, 1770 bp, Heterodera glycines
  misc_feature (12)..(12): n is a, c, g, or t
aaatccaaatcncgtaaaataaaattcaaaaatccaaatccttaaaataaaattcaaaaaatccaaatccgtaaaataaaattcaaaaatccaaatccgtaaaataaaattcaaaaatccaaatccgtaaaataaaattcaaaaatccaaatccgtaaaataaaattcaaaaatccaaatccgtaaaataaaattcaaaaatccaaatccttaaaataaaattcaaaaatccaaatccgtaaaataaaattcaaaaatccaaatccgtaaaataaaattcaaaaaatccaaatccgtaaaataaaattcaaaaatccaaatccgtaaaataaaattcaaaaatccaaatccgtaaaataaaattcaaaaatccaaatccgtaaaataaaattcaaaaatccaaatccgtaaaataaaattcaaaaatccaaatccgtaaaataaaattcaaaaatccaaatccgtaaagcttttcgcccgtgtaaatgcgttgatggcgatttagacaatccattcgagaaaattttttgccgcaaaattcgcactgtttttaaaaatattaaaaataaattcagaaaaatatttttaattatttaatttattattattatttttaccaaaaaaagcttctcgcccgtgtgtttgcgcaagtgtctctttaagtgtgtttgttgaatggccataactttttggacaatgtgcgcacgagaagcgttttgcctttaccgttttttgttgtgccaacgaatgatgctggaaaaaatggggcacattaattagcgcattggcatttttcattgtccagctttttcgactgtttttttatctttacttaccaaaatgccctttttccgcccaatttgttctccgtctcccgcctttcttttcctccatctgattcctcttccttctcctcctcactgtcaaattcctcctcctcctcttccgtcgtccgcttctcctcctcctctccctcttcttcttcctcctcttcatccgttgccccttccaattcctccaaaaatgcttccattccatccttctctttttcttcttcctcaatccctacaccaacaaattcctctcgttcatctcccactttttcctcttcttcttcctccttttcctcttcttgctcctcctcttccctatcatttttccccaaaattgcctcctccttccgttctcctttctctcctcctcctccttttccattttctttcttttcctcttcttcagtccgcttttcctcttccttatccatggtgttgttgttgttttgtccaaatttctgcttcaaaaattggtcgacaattgctttgatcagcaaaagcgtaaggcaaacggcggcgatcagaaggaatgccaaaagcaaaaaatggacaattctttgatcagttgcgatgagaagtgactgaaatttgaaaaatttggggagtgaaaatcgaaattctaccaatttcataaaatattattttattcactcacctcatgttgagtcattttttcgtcaatcgctgcgctgagaagcgactgaaaatttggaatattaaaaaaaaggaaattttatttttacattgatccctatttttgaattttgtcaaatattttcctgttgttgctccaatttggccacatttttcgtaagttcagtcaccgcgtcgataattgactaaaatttttaccattcattgcactgaaaagtcgagccgacggaggtaaccaatctgaaggcacatcatcattccttgtgactgggagctcaagttc

SEQ ID NO: 17187 - DNA, 3268 bp, Heterodera glycines
  misc_feature (3241)..(3241): n is a, c, g, or t
tgttagacaatccgacacaagaagatggcgaaaccgaggagcaggacgatgcttattcggacgacgatgatctgagttggaaagtgcgaaaaagtgctgccaaatgcatcgaagcattggtgagcttcttagctttggagttgccattgatattccttttagattacatttcgaaccgagaaactgagcgaaagttacggtaaatgacattaaaaataaaaaacctttccgtcgctgcccttcccttttagaccatttcggtccgctgctcatttcacgcttcagagaacgtgaggacaatgtcaaatatgacatttttgccgcctattcggctctgctgagactgaccaaacagatgaaccctgaactcgcttctttccaagcgcaggtccacgaaactcacgtttaaaataatctggggaatttagaatgcacaagggggaaacgaacttcttgttgaatcatttccgccttcgcgttttgagcaaattcgtaaagacgaatttagcaaggagcaaaaagcagtctttgcgaagctacaaaaacaagataagcatcacaaaaagcacatttgagaatgaatgacggttttatcaaaatcattgtaattatatttaactaaatgattcaatgttctgaaaataccttctcccatttcacttccgtcgctaatgcgcgcgcttcaaaaacatttgacgatcaaaaacatgagaacacgcattagtgccttcactgttctctcgcaccttgtcaggtatttactgattgatcaatgaactacatgataatgattgcttgtttcagaactttcccaggaattatgaacgattacttgggcaccattactataaacatcacaaaaactttgactgatagtgcggcggacggaactatgaaaattgaaattttgcgtttcatttcgctgttgttgaacacccacgaacctgaggtagaaagccattcggtggtttgcataaattgatagatgggtcttacaattagtttcgctaaataccctccccttctttttagtgtttcattttcttcaataatttctaggcaattacttaaggtcccaggactactctgctttcgtttattttggggttgtctcattcgcaatattttgtgcttagtattgcaaattttctttagcggctcgttccttttgtcgagacggtgcttcctcatttggctgctgcggtcggtgaccatttctacaaaattgctagcgaagcacttttgactactcaatcgcttttgcgagttttacgcgcccaaaagacggacttttcgaaggcattgcccgttatgtattcagctgttgtctcaaagctaaaaattgctgacattgaccaggtaattttgagttattaaatggaaaatttggatttacgttaaggaggttaaagagaaaaacattgctactgtcggactgctggttgctctgttttctgctgaacttggaaagaaaattgtactaattttggtgttttatgcctttttttctctcgttttcagaccgacgaatgtttgcctcttcttttggaaagactgcgcaacgaaatgactcgacaaggtgcgcatttttgggtgaccgttgtctaaatgtgcccaaattttagtggccctccgtgccatcaatcacattgtgcaaagtccaaccaaattggaccttcagccgatgctgcccgaacttttgtctctttgtgccgattttttgcgtaaaaaccagcgatctttgcgagttagcacattttcttgaaacttacattgatttctcattgtgtttagctgaacactttgactctgttggagtctttggtgtgccgtttttcccacaacggactgcagggaccgaatttgatcaaagtggtcaaggaggttcccgctctgatttgtgaacaggatttacaaattgcattaattgcggtcactttcattacaagtaaggcttttttggtgtgatctttttctctctctctgtttttaactcgtccgtactgattttcagatgtcgttaactcttaccctgaccaaattttggccgactcattgaacaacatgttccagtaataacccatgcttgtattacaatttcacttaatttcccttttcaggtcactaatcactttggttcacagttcactgctgcagggcacgacacttaacgtgagacatgccaaacaaagaacctttcccactttttaattttccgtttaggcgactcttttactgttgtcttctttgataaaatcacctctcccgaacaaaccatcgtttaaggtattctttgctttttggcatttaactatttttccattaaagcaaattttggagcggatctctgagccggtttacaacactggcacttctcaatttctccaccgtcaaacgtacagttccattgccaaggcggtacggagctaataattttctgttaaattttatttatttcctaagactgcgacagtggcacaatcgaatgccgaacaaactgattcgcgcactttggtcctttccttgcgcgacgcctttcggaatgctgggccagtaaatgactcgggtccttgcttttctttaaattagcaaatatgcacttaataaaatatcccaaaatttagttcgtctcttttctgttttggcacttggtgaattaggcagactttgtcgctccgtttttgagtcacttcaacgcgaaataaagtcgtaatttaattttgttattattcagaacttaatttagtattgaatcactgataatcgaagcatttgaatcgcaattggaagaaataaaatcggccgcaagttacgctttgggtcagtgttatggactttgtccttttgaataatcgtttttaagggagtctggccaccggaaatctgcaaaaatatttgccatttttattgaaagaaatttcaagagaggaggggaggcgacaatttttgttccttcatgcgttgaaagaggtcgttattcgaaaataacgctttgaattgcattttttaggtgattaacagcgaatgcggagaatgtggcactgtcggagacgctgacgaaatattcaaaaagggcgttgaacaaatttgggagcttttgatgaaatactgcgactcggctgaggagagcatcagaaatgtcgtcgccgagtgcatcggtcggcttatcatggtcaacccgcaaaattacgtcgaagaacctttttggtttagtcaattgtactgctcgatcgtagcgtanatgccttttcagcgacattctgccgat

SEQ ID NO: 17188 - DNA, 1064 bp, Heterodera glycines
agtcgatactatgggtggttcaaggtattgcaacaaatactgtgcttttgtatgtgtttattagtttgagaaaaggggaggggagagtaattagcctatagaatcggggtttatataattttagtcccttctattcagtttggagcgtgacccgtacatacacaccggaaatcgactcattccaaagccttttgtgcctccaccgccgccaggcaaaaaatggaactgtccgagaagggaggagtcatagtgagtgtctaacatgcgggaaacttccgcatcaattattcattcgacattccttgaatttagtgttccatcggagcgaaggttgaaatggcgatgtcctaaacgcgaacctgcgacgtaagtcactcgtcacattaattgaatttaaacgtggacaaaatattcgatctatttcaggcctccgccacgtcgctaacagaacggaaggatatgaatgagggaagaaagattgtgtttctcaatttgacaacaactttgtttaccattttctaattaattttcgtaatacatccaccaatttacaattattttttcacatcttttgacttgtatttcaatttctcactttacattaaataaaatgaatacaacaaatagtaaaaataacaaaaaaattaacgcgtttgattgttaattcattttcaacgtttcctctgccattcgcattgccccttccagtgattttgtccctccaatgaatccgtttgcgtgtacaaaaatggccccttcgatgcccgattctttctccaattgatcatcgcggtgtcccctccacggaatcgaaattctgcaatgtaccaaaacattcggatacataatacatggggcagggtcggggtcgttttcgcgtgggccgttttcgcgtggggcgagtttttgaactataacttttttctttgtcaactaaatccaataatcttggtatcattctatagccctaagagttctctattagcgcacaaaatttggaaaaatttcgttaaggttcaaaaaagttatggtcaaaagagttcgacaaaccaaattttccaact

SEQ ID NO: 17189 - DNA, 1619 bp, Heterodera glycines
cggtcggggtcgttttcgcgccgccgttttcgcgccgtcgttttcgcgccgtcgttttcgcgccgccgttttcgcgccgccgttttcgcgccgtcgttttcgcgccgccgttttcgcgccgtcgttttcgcgccgtcgttttcgcgccgccgttttcgcgccgccgttttcgcgccgtcgttttcgcgccgtcgttttcgcgccgccgttttcgcgccgccgttttcgcgccgtcgttttcgcgccgtcgttttcgcgccgccgttttcgcgctgccgttttcgcgccgtcgttttcgcgccgccgttttcgcgccgtcgttttcgcgccgccgttttcgcgccgccgttttcgcgccgccgttttcgcgccgccgttttcgcgccgtcgttttcgcgccgtcgttttcgcgccgccgttttcgcgccgtcgttttcgcgccgtcgttttcgcgccgccgttttcgcgctgccgttttcgcgccgtcgttttcgcgccgtcgttttcgcgccgccgttttcgcgccgccgttttcgcgccgtcgttttcgcgccgtcgttttcgcgccgtcgttttcgcgctgacgttttcgcgccaggttcgttttcgcgcgggggtcgttttcgcgcggttgcatatatgtaaaataaatatgtgtattcgtgttttttttttactaaataatgcctaatcttatgtaggcccaaacaagcctagcttaggcctaagcctaggtctaaagcttatgcctagcctatgtacgaaataaaataaaacgatttttcgaatttcgaccacggggggaggcacgttgtttttgagtagataattttcactcagaatttttcaaaaaatagttttttttagaaaatttatgccgttgataaccaatctctaatcagatttccattaggacatcgctatgacctcagaatccctgcgtatctgagattctgaagccggctggggtgaggtcaggttcggatccacccgcggagtaaaaaattatttggttttttaggtatttttaaacttaatagactattagtaaattttctaagtattttttaaagtatattcgcaattctagtgctaaaaaagcgcgggcgcgaaaacgacccccgcgcgaaaacgacggtgcgaaaacgacttggcccgcaaattttttactatgattttatgaaatttttttaacttataactttgtcaataatagaccgaataaaaccattttatgcttattttgaatggaaaattctgtaaaataggtattgtaaattttattgaaattttcgcccagttgaattttttttttttgcacaggggagtttcttcgaatttttgggcgctacttaaaaagaggtccattttgaattttttttgcacttttttttggtcaaaatttttttttgtttaaaaagtcatgaaaccaagtacccgagggttttaaaggtcgctgatcacgaatatgacaattatttgggtctattaagcaaatttggcgctaggtataaaatgatagattttgaattttatcaaaaacaaaaggggggacccttttgttttgtaaaatttttttttggataaaaatcgcgaatatacttttaattcgccataat

SEQ ID NO: 17190 - DNA, 1240 bp, Heterodera glycines
cccccctccccccccccgaaaaatgtttctagatacgcccctgggtttatacatgtgcttattttagcaccggccctgccgggaccgggacatttcttttcaataattccgggacctggaaaaccagtaattcccggactggtcccgctcaactctattcaaaatcgaaaactggtcacaaacttttgcagtttcgagggctcgattttttctcaaaaaaattagtataaaagatagagaaaaatggcaatgactgccattttttctacaaaaatattggctaataattcaggggaatgccatgccatacaaaatgtttcattcttgcttttgagcccctttatattgcttctaaaatgacaattgctctttcattttgtttgtgcattgtttaattttaaccgaattaaatttttttttcacacacaaaaaacgaaaacaattccatttaaattgacattttaatgattttttcctcttatttttgtaaatatgtaaatgcttaattaacatgattttaatcagttttactaagcaattttaaatccatcgaaaactatcttaataatttgccccgacaaaatgtcagacaatccaaaagaagcggaggaaaaaatggcaaaagcaatgtaaaattaatgccaatttcacaattttaaatttcatttttttcagcttcatctccgccgattgttggctttgtgtcttcgatttgctgcccccttctcaacttggcctcggaattgcactgatcagccaccggtttgacttttacgtcgatgaacacttcaagactcgcaaatggacgctgaaacctattcaaattcgacgcaaaaatggagaaaatggcaccaaggaaatgaaaattgtcaattctcgttggaaaccattgccaattccgcaaattcaattgccacgcaaagtcatcggattcaaacgcatcgatatctcgtaaaactggcaatttacaaaaatctaaacaacacttcccttacttttcagtttcatcgacaaaaatgccatcgcttttctccgccgttttcgccaacttttcgcctcctctccaattcatttgaccatcaatgtgtactacaatgctcgcactttggagtttcttttgcccaacatttggccattgttcgggaaaaacattcatggcatggatttgtccgccacatttttccgccatttgcgtaaattcgccccgtcaattctcaacgattgtccatcgcttcgcttt

SEQ ID NO: 17191 - DNA, 1073 bp, Heterodera glycines
ttgagccctttgatctgatcaatgaattgactcgggaacaattgacgttgaaaggaactgacaatagccatcgttttctgcttgtccgttgtccaattgcgcgagacgaaagcaaatgggcgaaatgggaggaggaagcgattggctggcgactttgtgaacaatggaacagaattaacattcaaatttatgatgaggaacaaatcggagatgggtaagcgaatgcttttttcaacaattcatatttattgcgtttctatttttaggcttctcgacgcaaatcccggcccaagtgatcagcagcagaagtgaatgaatgattgtgctaagaattgatcgatcaatttggattatggagatatgaaaaatgaattttgatgctatttgacatgctcataaaaatgttatttttctgtttgaatgatcctcataaatagggagtgtaattatatggaccaaaaatcgcaaaatatggacataaaatggcaaaaatcgcgaaatatggacataaatggcaaaaatgtcaaaatatggacataaatttttcaaaattgagtgcaaaatttcttcaaatttattggttgaaattgcatatgagatacatttccaaattttttgactcggtaaggcgctttgacaaagacggctttcgttttgcaattagtcggtcaacattcggaaattggtctcgaattttttcggcaattacgtgcaatcattttaaaagaaaaaaaaacataaaagctaaaatttattaatttttttagcgcaaaatcaacaacaaaagcgaaattttcgcttttttgcttatttttgacataatttattaatttttaagaaaatttattcaatattctcgagaaattttggcgaagaaatgattttttgaaaaatttttcgggttttgggctcaaaaaagctaatttagctgctgggggccgttctaatagaggtttttttgaaaaatgccaaaatatggacataaaatatggaccaaaatgccaaaatatggaaaatatggatatagaaatccttcctagaagcttcaaaccaagctaaaaacattttttcgt

SEQ ID NO: 17192 - DNA, 2201 bp, Heterodera glycines
tacaggagggtggaagaaagggcttgtccttcaaggtggttgcgaacatgaatggaaacacggtggtgtacaacgacagggacgtgccgatagggacgggttctgtgcggaaagtgggcggacgatcatatgaggtaaaaacggtaattcagcatttttgatcactcctaccaacaggcggtgatcagcaagaatctattcatcactcggctgaaggatgcccggaggggcccatgctgcagagagttgacgggcgaagaatgcaccgaacccattaaggtatttgatcagcactgatcagtctgatcaattatcagtccgatcactttgcagttggccaacccgcagttcagtcacccgagccaaagggacgacaatggcacgacgaggctgacctggtccgacctttgctttatccctccctccctttggcttaagcttcgagtgattcaggcccgactgtttcgacatgtccatcgatgtcactttgccaccaagtgaatgaataaaatatgtttaattggtccaacatttttgtgaattccttctcccaaccccccccccccccaccttttaagtgccttgggacctctgtttttcaatccctttcaaaaaaaggggagggggggtgtttccctaggaattacagtacttttttacggttcgaaattgaacaagtcatttctcagcgtacagaagttgtagagacatgcgattttttgcattttgtagccaatcatgttctctttctgtccgccatgttcatcttccaaaattcctcatcagagggaccagtaaatttgaaatttattggctctactctataccctcattttcgagttttattttgatttttcttttctattaatttaatttgtcacattaaatgaaaaatagacaaaaataatttgaattaaaaattaaaatctatgaatgagtcgcaggaatgaacatatggaaatggaaattaaaaatatttaacaaaaataacgtgtcagttctgaaaacatattatgacgaaagggcatgaaaaaaagaaaataatatttaaaaatcagttaattgggaggaacaaaaatataaataaaacattaaaaaattaaattgtttaaagcgaaattattaaaaattttagcaaaaactcatttagattttcttttttaaaaaataatcttccttcattacaacaacataaaattaaagctaatttcgaaaattagaatacctgcaactgccgacacttgagaataggcgaaagctatttgatctgttcatggcgcataaaatagtttatggccgaacagatctgaaactattttcaatttttaatccatcgacacgctttaacatccccttttacagatttaacacaaaatataaaataggcaaaaaattcattccctttgccgggagggtaacaaaattatggaatcaacttgataaagaactaataaaaacaaattctttaaatcaatttaaaacaaaacttaaaaattcattagggtaataaccggaaaagcaaaaaaaaaaaaacagattaattttttaagtgatttgacatttgtgttatcgatctcaattgactttgacctcattttattcatctattttgattttattttttgatcatccatataattatatcacttactctacgacatactatctgaacagtcgtcagagtaagtggttttttgcccttctgatgactttttttattcacgaataaataaaataaaataattagctaatttgttcattaattaattaattaattcgttaattaattccttaattggcttgtgccgttgcgctgtctctaaacgggaatgcttctcgaggcaatcgtttgccgttgcgcccccctttccgcccctccgttcgctccgtttccgcttctcctcatcccattgcccccatttgcgccattgaacgaattcagaacgatggtttgcccacctcttaagaaacaaatttgtaaaaaaatggaaaaatcacgcgatgtagacagattgacgggtgaaaatgggcgattatcatcggttggaagagcgaaaggggcggagaacggcgaaagtaaaaaagttaaaaaaagtggcgaaaaacggctggcgaaggcggtggaccaattttgattaattgacgagatagttttgcgaagacggcacgtgagcaaattaattctctcttcaattaaataa

SEQ ID NO: 17193 - DNA, 2290 bp, Heterodera glycines
agaggtacaaccagtgattaaaataggtataacagtgatcagaagaggtacaaccgtgattaaaataggtataacagtgatcagaagaggtacaacggtgattagaagaggtacaaagtcattagaagaggtacaatggtgattaaaagtgctacaacagtgatcagaagaggtacaacagtgattagaagaggtacaacagagattagaagaggtacaacagtgattagaagaggtacaaagtcattagaagaggtacaatggtgattaaaagtgctacaacagtgatcagaagaggtacaacagagattagaagaggtacaacagtgattagaagaggtacaacagtgactaaaagaggtaaacagtgatcagaagaggtacaaccgtgattaaaataggtataacagtgatcagaagaggtacaacggtgattagaagaggtacaaagtcattagaagaggtacaactgtgattagtaaattcattaaattaaaatgaaaatattttttaacaaatttaattaaaaaatacatgaaattctatcaattaaaaaataattaatttaaacttataaaatgtattcatcaaaaaaaaaattaatttaaatataattttttatttattaactcaacaaaatattttaaattaattaaaaacagtcaaaataacccaaaaatgcacagaaaaataatgttacaccgtccggattcgaactttgcaccaccccccccccccaaaaaatgatgcctcagaatccccaatcacacagggattctgaggtcttgactatgtctaaagtaaaatctgatcacgtattcgtgatcagcggcccaaataacccctaaagacatgtttttggaagatttttgttgaaaaaaatttttcactcaaaaatcctggtcacccccctttggtcccgattcccaaaatcacttttatttctataacttttttcaaaaaagtgataaaaagctaaaataaaatttataaaatagagcaaaaaattgcggatttttgtattattttacttttccaaaataacttttcagaagcgagttatgaatttttttctgaaaaatcgaaaatttccagaaattctggaataactttttttcttttgaacattataaaaccaaataaatcccataaaattctcctgatttttctctatttttaaagctttatttgctcaaaattggtcaacccttaggctagatatgaattttccaatattagcccaaatttccaagggccaaaaaattgccaaaaaataaagaatttttaaaaaattctaaaatttccgaaacttaaaataaacatcatattcgtattcagcaccccaaaataccccagaaaaaaatttttcaccccctttttcgaccccaaaaaaatttttgaaaatttctagggggcctagctcgaaaatttttgaaaattttacatcatgtagtacaccattcgatagcatttaaaatgctctacaattttactctaaggcaatttttggctaaaaccgatccctgacgagttataggcccgggactcaaatgtcccgctcaggccaaaaattttttctatttccgggaaaaaatcgaaattttttcaaaaaaattaccaatcgatagagctcgaaaaactatgttttggaagtggtcttcgtttctctgggaaaaatcgttaaaaaatcctaaaattcaaaaactcgaaaaccgttttttaggcctagctcgaaaaattttgaaaattttcgaaattttaaaaactggaaaaatccagctcattgaactctacaataagtctgctggcaccccctcgctcagttcaaaccctggcgagttattcgcctgggactgaagtggacaaagttggtactgaaaaagttcacgaacctacagcctttcctattgcagatagaggcttggaattttttttgttttttagaaaacacttcaacttagccccctcacagcagacattttttgattcgggttttagaaaaaaagttaggggccttcaaacgcaagaaaaagtgagaaatcggtccccgggactcagtcgtccgcgctgaatttttctctatagttttcccggattctcctcaaaaagttgtaagacccttccaccactttcagggcgctcccggccttcggccgggagattttgttttttgaaacgaaactccttgtcaatataacgtatatactagcgggtgcgtgaaccgtcggctatttagctgggaaaaagcgcttcgcgctttgggagcttcgctacctaggctgtgaagcga

SEQ ID NO: 17194 - DNA, 2637 bp, Heterodera glycines
gagagatgtttttttctctgcactctctatttattgtttcatgtctcgttttttgaaacggtgtgggtacctttacacacatcgattcaaaaaacaaagacgtatgtcaataaaaaagagggtgtgaagataaatacacctcagttgggtatttttttgtgatttttggataaaaaataaaaagatttatgccggggacgggctcgaacctccattccttttcctttactatacctatcttacaaaatccatcacgcagttatcttttttagtttgggggctgaaattaaataagtatgtatatgacggattataaaaccgaaaaaagtgattccagcttaattaaacaggataatcttatttatttttaatctctcatttgttctcgaatgactcacaccattctgctgattcagtcgagttccaaagtcgactcgcggacatggcaagactttatgattttgttaagctgctcaaattcactaatccttttgaggagtgattacgaaactctgaccgattttatggaggcggtatgcaaaatttacgaggaacatctgaagaagctgaaccccgacgtcccctgcatacagtgagcgaatcgtgacataaataaccgtaggaaaatggcattacttttggccaatttccaatcccaaacccgagcaaagtcgagaattcaaattttaaaattatgttcgaaccctgagttcagattcatgatcatctatttttacactagaaagtacaaaaagaaaaattttaaaatttattttccttgggacaccaattctccagtattaccttattttcatttcactaattgtttttttaggtacgacatatccgcactgttcaagttcatcgaccgattggctgatttgagctgcatggtgttggacaaaagtgtatatgtgccaaaggtaacaaaacaatgccaaattctgattatatactgcttttgtaacggaattttgaccaatattcagggcgaggatttcatcaaagagcagattttcattttgctccgtggccaagcggcgtcgaacgcggcgaagaagtgcccggctgaaggatcgctctgatttttgatcgcattccttttatttgtaattaactttcatacaaataaaagtacaattctttaccaaacgtccataaaaaatagtaaaactacgagccaatggatagaagtaggattgctccccgagccccagacatttttagcctatttcccgacccgactcacgacatgtcgccaccggacggtccccggcataactaaacatcaagccaaaataaacgtttttctttatataggtttaaagtatggaccaaaaactgccaaaatataaatgttagattctgaaattccaaaaatgtgtatatattcaatatttgttaaacaaattaaagaaatacactaaaactaccaaaaaatagatttaaattgataaaaaagcaatttttattgtttaccgatgtataagctcattatttgttaaggaaattgttgaattttctagaaatgtccgaaatatcagaacatgaccaaattcgccgtaggctcgaaatggtttgaatgaatgaaaatccatataactatccaaacgaacaaagtgaacttgttactgtaaaccaactattaacaaatagcttgtcacacttgggcaaaggcacagccgaactcgccattgtcgttaagagtgaaccaacgatgctatcaactgatgcttttgaaaactaaaaagacgacaataaaatttgacttagaattaacaacaaaactaataaactaaacaaatttgttcggcactttgatcgggtgccaaaaattgctgacctttaaataaaccttgctatcatagccattattttttgccgcgcttccttcgaggagttgtccagccattctggcccacgttttgcaaaagctaaaggcaaatgttggcacaagagcaattattgacactgaaaacaaagcaaagaattagcaatagtcatttgcatttttggcaaatcgggcctcgtcagtacggaatttgccaaaaatgccctatagaaacgaaattcctaagtgtatttcggccctttccgcagatacactgtaaaaatgttaaaaataaagaagccaaatgcgcagtaataaatgtccgtcaatccatccatatggaacgataaagcaggcagaacgaacaaaaccttataaatgtctattaaaatggtttgaaataatgaaaattcactaaactaccataatcaaagagtgaattcattgatgcaaactgattattgtaaaaaataaaccgcttgaaccccacagataaatttaaagcaataaaaatgtgagtgaaaaagaaaaatgagaaggcttaaataagcaacagaaaaatatatagtctaaaaaaattttaactgattaaattaaaatagtatataagaaaagatttgctgttcatttaatgtgtttaaagctattttccatctcatttcactaatctattaccatccttttaatttacaatgaacattgcgaactgtcaccacccaaatcattttaaaagctttttttttatcgtgtcgagcatggtcgatttgcttttatgaattgtcggcctttttttctgctgacccggc

SEQ ID NO: 17195 - DNA, 2861 bp, Heterodera glycines
  misc_feature (130)..(130): n is a, c, g, or t
gggattgaccggattatatagattgaccggattttgagaggctggattcggatcggggtcctttctcaaaataccagtccggtccggtccgacagatttgtaaatgtcggtctctaataaaaaaaatttntagtagtttttctacagtgaaaatttaattgtaattaaccgtcgaacccgggcttgggataaagcgctgcgcgctttttgagcttcgctacctagattagcattggtttgaagcacaccacgagtgtaagagagtacaacaatcgttaaaagaggttatttaattttgattatttactttctttagtaaacatttgaaaagattaaaaggatttcatgcattaattttaaattagtcaaaaaataatttattcaaaagtttataaacaattactaaaaaattataaactgcaaagttttgtgtttaattaataaaaaaaaaattttttaattttaaattaatttttttgcgtccatttttaaatcttaatttgcttaaaaaatatgttgtaggaatttggttgatggcggaggtgtaaaaggtaagcctgtggtgggaattgaaccaacgaccacagctttccgtgctgtgctacacaaggcgccctttacaaccttcaattgcccttttgcatcagagcaatgagaaatactctgcctaccaggcactttgagagcccgcactacaatataaaataatttttatatattttttatttcagtatttcaccgaaaaagttatttgtttcatataaaagatagaccatattttgtatggatttccatttttttttatgaacatttatttcgctttttggcaatcatttagaactcgggtttctcaaaattaacttactttgagctcaaaaaggttcatgatttacaattaattattcatttgttcactgattaagaggtaggatttttagttcaagaatcttaattcaagcaaatttttgcaaaaaatttgtgaatgcaataaaactatgtaattatggaaatttagctatatcatcgttcttgaaatacatttctgatgccgatttgttttgattgttatgccttgaagacctaaaatttttaaattattattctaacttaatctttatataaatccttgtaatcaagaatagatttaaaaattaatgtaaacaataaattatacacttttaaatttaccctttaaatcaatttgcaaatgtttttcaaataataaattcagaaaaaagagaaaaaattaaaaaaaaaatcacttaataagaaatttatccattaacctcaccataggcaaagccccacgtttgcaccgctttttcatttttctatctttttgaaatggcttatggcttttcttgaaaccctctccaaagcctttctcaatttcccaagaattttgtaaatttttgataaatattttttaaaaaatgttgaaatctccacaaaaaaatctaaaatttgatcaaaaaattggcaatttttgtcattttttgtacaaaatctgttaataaaatgcatacattttttgaattttccctggcggcgtctattggcaccgccggccgccctcagaaaaatttaaaatttaaaaaacaataaacaattaaagaaaattgttgaattccaaagatttggtccaaatttttaaaaacacaggaaataatattgttttgaatttttaaatcaaataaaatgtgaacattttgggatttttatttgcatacatttagaaataatatggggcttttctacattgtttaaaatagatatttacatatttttctactagtttgcctcactgtaagtttatttttagttatatttttttaggtttaaacccacatttaaacataatttggtctttttgtggtattttatgcccggtttcacgcttttatttgaattttcttgtccaagaaagcatcaaaatgttttttattattattcttatattaaagagatgttttaattaatttgttttaaaaattgaatttattaaaaaaaatataattttatattctttcactaatcaaatatgtctacaaatctgatcagttttggttaatttagttttatttaaattaattaccgttcctaattctgcttattagtaattccaacgcatatttgatggtgaaggagcagaagctgcgctaacttcaattggcaaatcggcacgcacttccctgatgatgtttttgcttgacgttgggaaatcactgtgtgcttcttcgcgaaggagttctgctgtctctctcacctatatctgccattcagctttaaacaagaaatttgagaaccatttttgctccaaataatggagcgtgattatgttccccagttacgcgcccctctttatattggttgccaaaagcatcaacttgccaaccagtgcgtacacatctcttcctggacagtacggtggctttcttggacaacgccaatattcactgtaatcagccaactttgaaacggccttgatttttgtacatatttttaaaattttattttataatttccaacctcaaatacatattcataaccgccatttgttaacaaaatttttccccgtgtcgattttgtttggtcaaaacaagtaatgccatagaaaataaggagaaattgatgcttttgcctacaaaacgaattcaaaaaagtgaccaagaagatacaaaatcccatttttttatctcgagaatttcgataaaacacacacacataccactgaccaacaaattggagaaactgataaaacgaagtaatcaaaaatacgactaagcaaatttgtttgttcccgtcattgacccattgctgacccccccccccttattttttgttgtttatctttaataaaa

SEQ ID NO: 17196 - DNA, 1803 bp, Heterodera glycines
tctactttagttcgtagtagtagtaagaaacgagggacgagaaaatcacgtaataaggtttttattttatcgctatttttatttttgccattttctaggccccttttttcaaaaaatccgagttttccctaaaatttctttgctatctcctcacattgatcatttgtgctttcgttttaaacagtgtccccattttccagttgaatagcgtcgtcggtgtcatcctctctttctcaacgcttcaccaggagccaatggtcgactttttcgtctaccatttcaagcagcgcaaattctcgcacatggtgaaaatcctccgtacaaagttagctttgaacacttttctccgactatttgttgtctcataagtattgagtcctaaccaacaagtgtttaattttttaaaagtccaaaaacaaagaccaaaaatttgtggtgcattccgattcagaaaaacaagttgaatccgtttaactgtaagctaattctagctcaattagtaaaggttacaaaaagttatggacaaaaataaacaatcaaagatttgataaaatcattgatttttgaattgtttagagaatctgacgaattcttaaaaaaaatacatgaatcatactatagaactcgttttgagattgtgctcaggaattatggggtacaacctaacatattgcatttttactcttttcgactttatttgtttaattgtaagaagttttcggtttttgcccatggcattggttgttcaaaatttagtaaaatccattcctcacagattccccgatacgtgtcagcccggcgtttggtttcgtctgatattccccgaagactttgacgtggtcggacacttccgggcattggctcctcctgatggcgaagaatttcctgtccttattcccaggaaggtggtggactgccaacgtcggttgaccacacgcatacgggacgagcaagtgatggttcgtttcactaattctgaccattttcattattccaaagtgacaatttttacaaattggctacaaattttaaaaataaatttatttgtatatgtaaactctaaacatttttattagattccgtaagaaaatcgtgtttctgtaccctttggaaaatttaactgtgaagccaggttcgcactaccccccccctcctcctcctccacccgtttgttcccccacccccagaaaattctcaaatttcgaattttagaagatcttataatgaattactaacaaaaccttttaattttcaaatttttcttaaaattttcttatgaaaaatttaaataaaaagttttttttaattttcgaagtgggggcggaaacgaactgcttccgtgaagtccaggtcttaattagattaaaaaaatttgaggttgcgacccggcgacttcgattttttttattgttctatcctaattcttaaatgccctctaatattgcattggtttttctttagtttttcgtcactgcaacatacagaagcaattgtcccgccgacgactccttcctgtacaaatgcaggctcggcatgctgaagttgacccgtgcccagctgaacgacggggtgccggatcaagaacaacccccggttggggagcagcaatcgacacaaaattcggacatatcggtagacgaattgcctcagcgattgaaaatttggattgtgccatccggagcgggcgatgtcagtgccgttggatacttcctggtcaagcgcattgacgcacggatatgggtgagctttttttaatttatacctaaaaagcgtcacttcccaaccaagttttggtacattcgt

SEQ ID NO: 17197 - DNA, 1783 bp, Heterodera glycines
cctgtaaggtttccaacgagccagaatccgattcggatagcagcagtgtgaacggagatgccacaaacaacggcaacaacaacaaagtgccattgtcgcattctttcgcggcatggttttacgaaatggtcaccgccttccacgaagccaatcgcctgtctgatgagcgacgaacatccatccagcaatttgttgacgaactgcaacagggctttcgcaccgagaccggcgttgactcgttgcaaattgaactgttcggctccgttctgtccggattcggctccaacgactgtgacattgacctttgcctgatcaacaccggcatcaccaagcaggaaaaagtgcagccgaacgggatcatctctcaagaggtttggattgaaaacaatgatatgagaggggcagaaacgggaagagctcgtttccccatcggctcattttcagtcccccccgttcttttgggaaattatttgaaaaatcttagtaattcgctataaaattttccaaaaaaaattttcttggaatttccaacgatgagggaaggggaacgtagtgcacccggtacaaacaatgaattgttgaaaattttgttgtaatattatgattaacgacagagacattttcataatattttaaaacaaaccatcatctaattttttattcagaagcgtcgagaatggttaaacaaacttgtacaatatttgcgtaaaagtgagctttacacggtgatctctgttgcggatgcgaggacgccaattgtgaagtttgaataccacggagaggaaggcttccatggagagtaagggaagacgtgggctttttttgtacatttacatacactggaaaaaaaaattttgccgaaaaccaaaaaaatttggattgctctttttagagatttttttaatggttacgggtctggaaattattaattttatgattattattattttatgcattccctttattctcaagcataagtgttgagaatgggctggcgttgcacaacacggagctgctccgactgtacacccgttttgatgaccgcgtgtcaccgctgggatttgctgtcaaacgttgggccaaactctacgggattaatgatgcatcggtctgttgggccattaggctgttataaatcaaatttgaggcaagtacggcccagtgggaaggggtaagtggattacgtacctccctccccaatgaagtaaaaaaatttcatgaaaaatgtaatcatttggctgacagaaatttttccgctggaaaaaccttgggaaattttctcagaagaaaatttcaagaaaatcatttctgaaaatttttttaatgaactactactaattgtaagtataagtttttccaaaaaaccactggatttttcttaaaatttcttattaaaataccgaagattttaaaaattattgttaattttttttcagggagcgtgaacgacctgctccgttagattatacccttggagcctcaaaaatccaaattccgggatcatccctaacaattgaaaaaaatgttatctgtgattatttacttgtcggtgtgtttaggccggctcaatctcttcatatgcctacattgtgatgcttatccattttctgcagcgtgtcgacccaccggtgctgccctttctgcaaaatgtatgtttcttccctatttttcgtccatttttcctcacgaaattttaggaccacaaaggacagatggtcgagggatggaatgtgtcgtttaggcgtcagctccctgaacaggttggccctggtgggagcagctc

SEQ ID NO: 17198 - DNA, 2287 bp, Heterodera glycines
ggggggttccattcgaggggggggggggcgtataatcgaagaaatacggtatttagctatttttcttcacattttgtttgatgagaaatgcacgaaaaatacaattttagctcggaaattcataggtattatcgtcacaattgtcacatggagccacaggtgctaggtcgaaggacaaaaagtgcaaaatttgttaaaattttgactaaataaactcataacttttctcatgcgcaaccatattgcaaaatcttggtaatacgatagcactcgaaatgcgttattagcttgctaaatttcagaaaatttattatgtgatctagccaaaaaactggaaaaattgtcataacttttgaaagacttaaaaattttttttttaaatttagcaagctaatatgcaattcaagagctatcgtatgatgccaagattgtgcactttggttgagtctaagaaaagttatgagtggattttgtcaaaaatttggcaaattttgcactttttgtctttcggcccattagattatttttgttcacaattttaatttaatttttatatttttccataaattagaatcgttaatttttaggcaaaaaatccgaaatttaaaaaaaagaaatcttaaaaatttaacatatttctcaatctcgcattgcaaacggaagaaaaatgtctgagaacacagcggaagcggagaggagacaaatgcaaaatgaaatgtgtgtgtcttttttagggttgcacgggtacgagaatttgtgcaaaaaccgggtccagatattgccagagggtccagaaaagccgagtttgggtccgagcccaagtttttcaaccgggtccgagtacttaatttaaaaactaaatattccacgaaatagtttgtacataattaacaattattaaaataaaattttattttttttggaattgatagcaaatcaaaatcagaataccaattttataattttatagaagataacgtggctatcattttttttttgcttttcatatcttttttcagtctttttaggaaacgggagtgatccggcggtgccgacaggcgccgctggcaagatttttttaaattttggaaagatttattaattgctttttatcaaaaaatgaccattgatggatatttggatcaaatttaagaaaataaggtagtttggttacagcagaaccataaaggcagctctttccatacttaagacaaagtggaagttttacaaaagtcgtaaaaaaaagtaaataaaatccaccggtataagagtgttttccctttccctcaaccttgatcatcaatttgacgctcacacccattcgtactaatatttttctgggcccggttagacccggacttaggcccgggttttcttgaaaaaaccggttatccggctctggaccgtgtaactctagttttttaaatgaaattttaaaattaatttgccatttttcagtttcatttgtgccgattgttggctttcagtcttccatttgctgccgccttctcaacttggccttggcattgcactgctcagccaccgatttgactgtttggtggacgagcacttcaaaacgcgcaaatggatgatgggaaatattgaaattctatataaaattggagaaaatggccaaaaggaaatgaaacttcatcaaagtgcaaatttttgggaatggagaaaagtgccaattccgcaaaatccgttgccgaacaaattcatcggatttcgacacattctgattacgtaaaattggccgattaaaatgatttatgataaattactaccattttcagatacattgattccaatgtgattgcttttcttcagcgttttcgttctttttttgcttctcatcagacaaatttgtcaattacaacaaaaagtggcgacagccattttttggaaattgttgtaaaaaacatttggccaatgatcaaagacaaaatttgtgccattggttttttgtctcccgacgaattttgccgttttcaacaattggtgccgtccattctcagcgacaattgttgttgttgttgtccatctcttcgagcaatgtttttttacactggcgttttgccaaatttacccgctaatgactgtgccaatatgtcggctgaccaatcggttgtcaaatggctgttctcgcctcgcgcagacggtgctccaaaggtgctacgatacagtctccaaatgaataataaatttccgagaaaaattgacgcatttaaaagggtgattatttaatatggatggctttaaaattgccactaattattactaaatt

SEQ ID NO: 17199 - DNA, 2995 bp, Heterodera glycines
tatgccttttttgcatttttcgaaattttcgtgccttaaatgccttttttggcattttgccgttttggcgcctttttggaattttttccgaaaaatccattaaaaatgcaataaaatcgggaaaatacacctctaagaaatgacccgaaacaatttcagaaaatacatcccctaagaattgaaaaaatctctgaaaaattaatcaccaaaaattgatttttttttttctttataaaaattttaggtttaaaaattttctttattcttattcgggattttctgcctttttccaaaaacttttttggtgcctattaaatgcgtttttcgcgatttttggtgcctttcgtcggtctctagtcaccacaccagcaaagcagtacagcgtgctgccgggacccgtagtaaaagaacggtcggggtcgttttcgtacgagtcgtaaaagaaataagggatgttgtcgagggctttaatattgttgttgcacagcacacggcaaagacaacagcccaaagcatacagcaaaaaaacaaaacagtgtcgaagacaattttcgtttaattccaattaaaataaggcgaacacaaatcaatagggaaaaatgacgactgcatcaactaattcgatgttgaaaggggcggcaagggtgaattcagcagcggatcggttcagcttgaagtcgcgttgcaggctctgacctgtaaaaacaacggacaaaacggagatatgcccttttttctggccttaaaattccatcagtggcagcttcttgcgcacatttgcgatcagcaattagaaaattccttttgccgattttcaacaaattttcaagattgtctgctgcgacatccgcgaattcctccccggccttcggcgaaaaaattgccctcaatttgacatcggttttgcgtccttgcacttcatcggtgctactcattgagcctttacttttccaaactcgtccgcactttgacttttgcttcgacactgcaccggtgaacaaaaccaacgcagcaacaatttaatttaaaaacaatttggaatttcggtcgggttttcctcgctctttcctccttttacattgcatgacgacgacgaatttccctttggtttaataacagtttccatcttcgttcgtggtgccgctagttgttccttcgagtgcttctcaccttctgaattttttcgaaaatcggcgccttttttcataaaatttagatgttgtggcggttttaatgcacagttagattgcttccgcgtaaaggacaacctacaatggcgagaaatgtgtcccgttttgttgcagttgtagcacacaattcggtttgtctttggcataatgaacttttgcggcgcagtcattttcggctgaaaatttggctagtgctcttttccagtttcagccgatttcgttgctttttgtactctgatcgcactgcaagagcgacgaaactgtcgaagctcatgcctggtcgacgagccaattccaatcccaccgaaatttccgggttttccaaagcatgaattaggtgtttgattccaaaatcgttgacaaaatttggcggcaaacctgggtaagcacattcaacaatgcagtagagccgttccgcgaattcatcgacagactcattcggtcgtcgcttcacaccggcccttcattgaatgcctgcatttctgtgcgtcccactcgctaaaatttcttctattccgcggcaaatttcgttgaaatttttcgggcgatgttttttggcgacgtcaaatgctcgctctgcttttccactcattacaatgtcgaagaaaattttcgtttaattccaattaaaataaggcgaacacaaatcaatagggaaaaatgacgactgcatcaactaactactaattatcacacaaaatcacaattaaaaataacacaaaataaaacaacaaaacgccaaacatattttaagtcactatattagcacatacgggccgttttagtctgataaggggaggtgaccaagtgtccgtgggatttccgaatgaaacttggtaggtgggtagagcatccatgggttcttaaaaaaaattctgccaaatgagcacgagtgtcgagttatcatattttatgtccatattttggcatttttccaaaaacctctattagaacggcccccaacaactaaattggcctttttgaccccaaagatttatgtccatatttttgccttttatatccatatttcgcgattttttgtcctaattttatgtccatatttcacgattttatttatatcaatatatttcttttccctagttatgacgtgctaacatgatagcactaagtgtcctctataagcctgcaaaatttcaaaaaagctggttttcttaacatttttgaccataactttttttgaaacatcaagaaattttgcgaaattttgcaagcttaaagaggacttttaggactatcgaatgataccaagattgttccatagcatcattagccgggcgtgtgctctcggaaaatgcatcagtggaaaatgcaaagaaccggttcttttactgtgagggtagcattataattattttttaaataaaaaatttattttaatttttatattcattgattaaataaagggattaaattctaacaacaaaaaaagtacaaatttttgacaatcccataactatgcgaaaaccgaaaaattttaattaaaatttatcaaatggatataaattttcaaaagtaattatttttgtaatttattttggaatttttaataaattcgaaagtatggttaccctgttccaacccagagtaagaatcttaccgcagctgagggaaaggttacccttaccttgttctttttctacggaactggatggaccagggtaattagacttattgaatggaatcaagattgttttatttggttgaatacgaaaaaagttagaacagtctaaatttttcggcgcccaaatgtctagcgccatgatcccgacccaggttacctgggt

SEQ ID NO: 17200 - DNA, 2489 bp, Heterodera glycines
ttaagttttacgcgttttgctccttaaaatccttaataaaaagttttaaataacttttttcatgcctttttcgggattttcgtgccttttcatgctttttttcaattttttgcgccattaagtgcctttttcgcgatttttggcgcgccgttttttacattctctaataacaacaatgagcaaaaacaattgtttcgatgtccccaagaaacagttgtcattggaagagacaactgatcaatcagttcagtcaattttggccgcaatcgattcgcagaagcgccttttttaccctttaaaactgagggccaacatttcggatgcaaaaaaaacctaaaaatgcgctatccaatcttccaaatctttctgattatgtcttttatttgtcgctttaaatcggcggtaatcttccgatcggacacaatgaatcagacggattatggcccaatggttcttgctcataatggcacatctccgagtgatcaggataaaattcgagatgaagagactgatcactggctaacattaacgcaaactgatcaaacaacaactgatcagaattcaacattgagcatcgattggatgagcaacacaataatgaaagccgatcatgacgcaactttgagcttgggagaagaccatggacagactttggaagccaaaaacgatgatgaacccaatttggaaaatggtcattatggcacaactccgaccgattacgagccaaatgaggagaaaaatgcagtggataatgctgatcataatgatatggcagtggacggcgcgcatgatttatcctcagcagaagattatgacgggaatgattcaattagcgctaaaaatcagcaggagaatgtcgaggtattaaatggagcaaaagccaaattaaacgagaaattaatttaaattatatttgtcaaggaggcactcgatgacagcaaaaatgccgtcgatgaaaaacaacaaaaggtggaatcagacaagcatttggatgagtacacgtgggagcaaaccttgacaaaaaagtgcccgctgaattgcagtgaaaacaatttgcagtgttggcgcttatcagggtaaaaaaaaattattaaaaatctcgggtcagagactagcagtggttaattaggcgaaattttctcattatacaattaatcttggaaattcaaaaaagaaaataaaattttgaaaaatctcaaaatttcccataagagaaagggctcccgacagtgaaaatgaaaaaaagttttggtccacttttgttttgtacacagatatcggctcccattcatttgtcttccacccaattttgacccgaacaccgccgcaacaaaaaatgccactgatgccgacaaaaattggtggcacaatgcgttgcgctgggccaccgcgttgctgtggcatgccagcaatgccgaactggccacgctcgcactgctcggcatcaacacggcgctcgtgctgtgcacgtgcgcatgtgtatgcgtgcgccggagatgtttacggaaagattattattgatgattttaatggaaaaatcaatcctttttttgttaaaatattttattttacatattccgttaatattctgttgtcttgtccactcaaatatgaattttctccaattatgatgttaatttgaaaacccttcttagctgggggagaagaatgatttaaaaaagaaaatttaaacatttttttataaaataaaataaaaattactaatgaaaattgagaattgaaaattaaaaattaaaaagtggcatatataaacaaaataaaataatgagacagctgaacaagataaaaagtgaatttaaatctgttaaaaataaaacaaatctctgagctacaaaagggggaagacaaaatgtgcaaatgaatgaattaatttatgaatgaatgaacccgctgcaaaaacggttctgaaaagggaaggcagtgagtgactttgttcgcttttgatcataaaggcattttgaatggaaccaaacccaactaaaaattggtcggctattagctgatcaacggtgaaaagaatgaaaaatgaaaacgtaaaaacatttcttttaatttaattatttctttaaaaattgtaaagattttcaaatttggcaaaaaacagataaaatcggccaatcacgcgactaccgtaacactgcccgcccataattagtgaaaaaggcacaaaatcacaacacattcatcggcgcagaaatgccatcgttagctgctgactgagtgtttaatctgtggtggatggcatcgcggctgtgggcattcgtcgtcgactgctgatcataggcggaattatcgtagcccagtggtgccggcactgtcgtgccatggccatcggtggccgccgcatatacccacggagcagtgacagtcagctgatcatcgttgcgtgccaaccacggcactcgcttgtacaactgatcgcactggcaacgtttgacaatacccattgatggagacactgggggaaa

SEQ ID NO: 17201 - DNA, 2315 bp, Heterodera glycines
tttaatgtttcagggattttataaatatttgctatatgacttggcttatatatttcgattgtgaggattttttactggaatttttggaaatgtccaaaaaaaattcaaaatttcgcaattttttgtacattattttttatattatatatttgagattttttgaaaattattcaataaattttttagttttcaaatgcgtcccaaatatcgattcctttttaaaaaatggctatcaaaaatcaatatttaaaaagcaccaaaaacgttattttagaaaatttagggttttttatggcattttttttgcttctttacgcttttctaataattttgactaaatatcaccattttttgaaaatatgttgatattttttgtaaaattattgcattttctgattttttaatttgtataaaatcgatttttctaaaaattttaaacaaaagcaaattatgaattcatcttcatcaactgctagtttcgatgattttgatcgaaatgaaaacggtaatattttattcttgtaaattatttcgcaaaaattgataaattcattaaagaagaaaaagatgatgtgattattttgaatgacgatggacaaaatgagcaaaatgatcattccgtcgctgacaaacagttgaaaggtaagaaattaatggaaaagttgtaactcattaaactataacacaacttcttttttcaattaacatatgtttaagcttcgatcagtcaaagcaaaaaaatgcaaaatgatcagaaggagaagaagccaaatttggaaaaaggcggtgaattggagaaggagcagaaaaagcaggaagagaagaaaaacggtaagaaaggaatagcattacaactaattagcaatattaattaatcggtattgatgcgattaattcccacggcatcgaattaattaatcactttggtatagctgatgttttatagttagctacctaattggttttcttcattcagaactgtcaaatgccattccgcctggttttcagatgaattccgctgaggtgggaaaataatttaaaaaataaagaatatttaaaaatcaaattaagaaattttcaattccgcaacaaaattattggaattcttgtgcagatcgtcttgaaataacttgtggtggtttgactgtacatcattcaggaaatggaaattgtaaccttcattttaattaagaattaataatgtcttatttatatttttataatattttcataagggtggctttcggcgttcgcaaaatgtgccattccgagcaataatttcggcattgtttattttgagattaaatttgttcacttgaaaaagtaagtggatttttttattataattaaaattttactattttattaatttcaaatattaatttgctttacgtttttagaagtgccgcaattggatttgccaccaaagcgatgccatttgatggacgagtcggactttatggcaacagttacggatacgaaagcaatggcacactttgggttaacggtgcttaccaaactgggcatgcaaccttcaaattttttgatgtcgtcgggtgcggaattattttggaaaatcgacagttattttttaccaaaaatggacgttgtttgggttggtaaatttaaattttaatttatgaattttcattttcagatcacactgatttgttcgcttcttcttcggttgttccgttgtttccgtgcctttctttgcatgacaatggcgacaaaattttgacaaattttgggcctaatttcgagttcgatttgaacacacttttctgctgaaggaagcaacaatatcagaattgataaccaaattatttggtattttttaccacaaatatttctaaaattgtttattccatttttggaatattatttcaaattatttcattttgtatgatttctcttttgtgaggcagaagaaaatatgtcttggtccctttattcccataattttgtggatttttttgccaaaatattatgggacagacgaaatgattatgcgccgcaggtagaaatattaaaatttaaatcggttatccatttctgacaaatcttcatcagattttctcggctgctcctaatctagtatttttatatattttttaaaatgtgatgagtatttattcgagtttacgaaaaattattatagttcattttttacaaaaccgaggtctacaaacctagaaaaataatatgaattctacaaaaagctattgctagtatgtactttgtactttttgtttttctcgggtcctacccgggctttaataataaatgaataaatccttaaataccaagtcaac

SEQ ID NO: 17202 - DNA, 991 bp, Heterodera glycines
atccatatgatcacttcataatatcatttatagggattacatttatagtttttcactatttttttcctgagctccgcgtggcctgaaatgcacgaaaaacatgtttttttcggctgttgttaagctacttttcgagttattagcaactattttctagttttttatttttagcaactaaaaaactataaaatttttgaaaaaaactattttcaactattttggcgttttgcccaaaatttgttaataaaaatgcaataaaaacgaaaaatgcacccctaagaatcgacgcaaacattttttcaaagaatacacccctaatatcgaccctaaaattttcaaaaatatacctatgaaaaaagaaaaatttctcaaaaattcatctccaaatttatttatttaattttttgacgagaatttttgattttaaaaattatttatattcttaatgatttggcaaaatatttttgctttttgaagaaaatttttgattttacaccccctaaattcggaagtttttagcaactattttgggggttttttagaaactaaaaattaattattttggcagtttttagcaactataaatgtaatccctaatcatttatcgtctaaaatgaatttgaattcagtttcttgaaactgagttttcactccacggaattggcgttaagaatggcgagatgcatcacataaatttcccgactttggcatggaaagcgatgacgctgaagctcacgctgtggacaatgatcagaatgaagttaatgatgtggttgatgccgatggcatgggcaataaaaatgggcaagatcgccaacaggaagatgaccatggcggtggtggaccaatagaagtgtcgatatcagggatggcattccgagccccaaaactttcggaatcggaattcgagggtcaaaattttttcggaatcgggattccaccccaaaaatgtcgacatcagaataccgtgccatcctggtcgatactattt

SEQ ID NO: 17203 - DNA, 1510 bp, Heterodera glycines
aatattgggttgatgaaaaagttctgaccctctgaaaaaacaaattatgcaaaaaatgatattaattctaaagagattgaaaaagggaggcaggcaattgggatgaatcagcggacagttggccatcttcatgaccaaattcgtcgtcctccattttctgcaaaattccgcggcggtgtactccttctccatgacaacgcacgcccacatgttgcgttctcaacgcaacagaaaattgagcaacttcgatgggcggttcttcctcatccaccatacagcccagacatcagcccgtgtgactactatctgtttcgatctatggagcacttcttgagagggaaagaatttgctgatcaaaacgaggtcgaaaatgcattggatgaattttttggatcgaaaaatgatcagttttataaaaaggggattgaaatgttgcctgaacgatgggggaggatcattgatcaaaatggtgagtacatcattgattgaacatttgttttttgtgaaataaaaaattgtttaatgttgaagtgcttaaagggtcagaactttttcatcaacccaatattttgttttgataattttaattgaaatttaaaaaagaaaattttcttacattaatttttttcgttattttttaaaacaacattaaacccataaattaacaaatgattggacattttttggacaaaatctgctaacaaatcgaattaaaaatagaaaatttttcccgatggtgcctattggcaccacctgttctgccccctgtactcgaaaagtttttgaaaaacacgccgcaaaaaaaagcgttacctatatggttggtttggtttctttaaaatacttttgtttatttttccagcgattaaattccgttttttgttaaatttaaataaaaaatcggtaatagtttagatggtatgacaccttttttgaaaaatttttcaaaattttcaagtcttaaaaacatgtttctaggggtttataggtacgccacaccgtgaacacatccgacgcgtgtgcagaagccccaattgctcaagccaagcaaaaggcaatcgcttcaaaattggctacatgacatttcgccaactgacatttcgccaactcagccaaaaacattcatttcgccaactcagccaaaatcagacattttgccaactgacatctcaccaactttacatctcgccaacttttcgccaactagtcgaaaattgaattttaactatataatgatattaaatttattataaaagtgcttcaagcaaagaaatcttcataaaatatataaaatatcaataaaaaaacaataatatgaaaatgtttaaaatcaattttcatcggcctcagtttcttcaccactcttctgaatttccacggacgtgaaagtcccctccgcaaagccttgcatcaccagcccgagcaggtgccaggcgtttgtcaatccttcctccgattcaaagtcgggctcggcaaggatccgcaccacatttttgtttctttgatgacg

SEQ ID NO: 17204 - DNA, 2910 bp, Heterodera glycines
  misc_feature (65)..(65): n is a, c, g, or t
  misc_feature (2819)..(2819): n is a, c, g, or t
aatgatcattcatccaaaaaaaaacatggatcaatcaaaaataggaacggctcatttctccaccncctgatcactaatctactctctgatcattaaaaatgaaaaatgacggcacgaatttgtccaaaatcaagggtagtttaaaagttgtgatcagaacgtgtataggtgtttgatcataaatcacattggctttatgcttctgacctcaacagtttgtatactgatcaaaatgctatccattcaaacattgatcagtgatcaaaatttcatttattatctatgatcagtactgattattgaataggctttaaattgatccgtaacaatattacacagaatgtgctggtggattatcatcttttgccgacaaatttgtgtggtccgagagactcaacaacattgcattgcagcatcgtgaattgatttatatcagttaattcaattctaattaaaaataaccatttttaaatgaatcaattcccttcataattaataaagcgctaattggcctgcctcctaattaaaataggattaaaaattccatttttaaatgaattaattaccatatgaacataattaaagcgctaattggcgtttaaaacccaattaaaaattccatttttaaatgaattaattacgcatgtacataattaaagcactaattggtgtccttgcgctgctctgtttgtccttgtgcggctacattgcgtgctgttccgtcgcagcgcgctgctgtacccatcggcgaaaggtttttacactggaatccaatggtaaaaaagagaaaaattgaaattcaaaattttcaaatctgatcgactccgtgcccgctttgtttatcgtggagcatttttttgtagcctgatcagtgccataatcaccaaatccaaactatttgggattcggcatttttttcttgatcatgggttaagcaccgactcgatgtagggaattgcgaatgccatctgaataaaaaatactcatctttttgattttttaagatatgtttttcggttttttatgaaaaaggggaggggcggggggtcaacgaaatttttgcgaaagaatccgtccggccatgtaaatcggcacgtcctttttttttgttttgtttttttagttattgcctaagaaactgaggattatcattggattggacaaacagagttcaaggcgctgtttttgttgggccatacaaatgtttttggcaaaagatgccccacgctaaatctagtttttcctagcccattttaaaaccctaacaggcttctggactagttaaccgaggacaactcagctgatatgggtcaagatggacaactcagccgtacaataattttttttttaaataaagcctaagcctaggcctagcctaaagcttaggccgagcctaagctattgtacaagttgcctttatacgagtttgtgtacaagttatcatgacacccgaaagacaactgttaaattttaaaaaatttaacattatctaaacttaaatttaaaaacttttagtttaattaatttgtttaaattattatttatttttttttcaatttttataatttttttaaattctcgtaaagctgagttgtcccatcagcagttgagttatctccagctgactgatcctgacacgccctgataaatttttgaaattttaaatccttaccccacccacttttccctctgtgtgcacagaaaaggcaatggaaacggcgcaaaatgaaatgggcacatgttggtggcggtacagcatcaacaacaacaacaacattggtgacaacgacggacggcgacgaccaaccgttgtttcagttggaggaaatggggggcgacaccaatgaaatggtggtggtcaccagcagcagcagcagcaccaacgaaagtgatgatggtggtggtagggatgaagaagaagaagcagtatttgggaggcatggaggaagacgaagcggaagaaaaatgaggacaaatcaacaacaaaaattggatgatgatgatgatgatgacggattatgattgattgatttagtcatgtctaattcatccaaacccaactcatccacgggagagcattcgtttcaccctcccccgaaaaaattttaagaaaatttcaaaccttgaaatttttcaaaaaaaaaaaatcataaagaattatttcataagaaaatttcaagaaaaaatttttgaaaatttttcagcgattttttcaaaattttacgatgaactactagtttttttaaaaaaatttctagatttaaattttttttgggagaaaacgacgggggaaaataagtgcacccctcatccacacagctcgatgcggtgtcctggaatttcttgaattgcggaatccgtgccgcggcatttattgtggtgcatggatgagttgggtctaccccatatggtcggataatcattttcatttaagagccctaataatttctattatccagcaacaattacgaaaaattgtttttttttgaaatttgcaggataatagaaattgggttaatgaatgttggttgatatatgtagtaggtcagtgtgttcagtgttcaactcacccacttcctttcgaggaggaaaatttcataaaattcaaaaaatattaaaattaacaaattttctaaaaaaatctttaaattttcattttttctgttttgttgaagaaaagcatattatttgtcattcattaaatgtgatattaaaaatttttgctgttttattgaaacatttttattgttatttttgttgtatcaatttcattcatcaaattcacacattttgtaatgttttgctatccaattgtttanatctattcttatgttgaaaaaaaacagctgagaaccctgaaaaataaattaaggcatatttttagtgaaatataatcccatagtaaaaatg

SEQ ID NO: 17205 - DNA, 1557 bp, Heterodera glycines
caactcatccacgggagagcattcgtttcaccctcccccgaaaaaattttaagaaaatttcaaaccttgaaatttttcaaaaaaaaaaatcataaagaattatttcataagaaaatttcaagaagtttttaaaaaaaatttccaaaaaatcgctgaaaaattttcaaaaatttaaaaaaaaaatttctagatttaaattttttttgggagaaaacgatgggggaaaataagtgcacccctcatccacacagcacgatgcggtgtcctggaatttcttgaattgcggaatccgtgccgcggcatttattgtggtgcatggatgagttgggtctaccccatatggtcggataatcattttcattcgagagccctaataatttctattatccagcaacaattacgaaaaatagttttttttttgaaatttgaaggataatagaaattgggttaatgaatgttgatatatttgtgttcggtgttcaactcactcacttcctttcgaggaggaaaatttcataaaattcaaaaaatattaaaattacaaattttctaaaaaaatctttaaattttcattttttctgttttgttgaagaaaagcatattatttgtcattcattaaatgtgatattaaaaatttttgctgttttattgaaacatttttattgttatttttgttgtatcaatttcattcatcaaattcacacattttataatgttttgctatccaattgtttaaatctattcttatgttgaaaaaaaacagctgagaaccctgaaaaataaattaaggcatatttttagtgaaatataatcccatagtaaaaatggaagaacattgagaaattttaattgaaaaaatgtttagtcaagaacgaatggcctattcggatatacggatttattgtgtggtgtttgttgtctatttgatttggctcttttttgcaaatcccatggaattaagcgatggcacatcatcattggcttcggcttcggcttcattgatgtggataatctttttaagcatttttgctttatgtcttctacatttatttcattgtggttgtttgtcgctatacattttccaacactgaaccgattttgccactgatttaacaacagaagcgaattttttgaaaaacaaaaaatatgcgagattttgtgcattttatgctgactggaaaaatgttgttgtcaatttgaataaacaccttattcatcaaatttgtttgagtttaagttattgttatcatcatcagcatcagatgcttcttttaatagcttgatttaatgatttcaaagctatttgattttcatgtttaaggtgtctcgaatcaaagagagtcggaatcttaagcctatcccaaaaattttgaaaattttatttgaactttaagcttattttcaaaataatacctactaaaaattcaaacttctcaattgtcttggatcaattttttcttttataggtgttcttttcaattttattagaaacctaaaattaaatataattttgtatttttgtaataaaaatatatgttaaaaaattgcctaataaaa

SEQ ID NO: 17206 - DNA, 1963 bp, Heterodera glycines
tttgcatgaatggcacggcggcataatgcataaaacattgttgctctactattgcttttcatgaattggcaccagatgaggtgaagcagcagcggctggcagcaatttcccccctcccacccccgggggcgggggttcatgtcatgagactttttcatatatggatgccgttctgctggatttcgtgccaaatttagaaatggcaaaggcccccccccctcccctccccaaaactgctggagagacaacggcgtggcgcggcggcctcggcactcaaatctctgtaattttggtacacttccccgccctccccccacagcgaaacgggccagttgcgtctgaccagttgcgtctgagccaagtttagaccactataacttttttctttgttgaccaaatccaacaatgttggtatcattcgaaagctcttaacaagctctatcggctatccaaaaatcacaaagacataccgacatataaaaaagttataaattaaaatatgcaaaaattctgactttttggtagtgttcatgttgcaactttttataagttgttcaatcgcttagcaatatcttatcaaaggcttctaaacatgtagagctttcgaatgatgccaaatttataaaatttgacaaacaaagaaaaaagttatggtgctttatgcttggctcagacgcaactggcagacgcaactgacccctaccgcccggcggtgtgacccacgcgtttgggcgctgccgtttgggcgcaggcatgtttttccactatagcttttttctttggcatccaaatccaacaatcttggtatcattcgaaagctcttaacatactctattagccttaccaaaagcgaaaagattttcaagcctggaaaaaattttattaagaaaaaacttaaaaaattcgacttttcgcaattttcatatataacttttttgataattgtctaatcgcgaatcaatagcttagaaaaagcttctagaaatgttaagctttcgaatgatatcaacaatgttggatttgggtgacaaagaaaaaagttatagcgtaaaaacatgctgtggccgaaccgtggaggccgaactgagcgagtccgtcccccggcagagcgggccaacttttttcccatacatatttaagaagttgccaaacttataaaatttagtcaactgttaaataagtacggtttgttgttccgacatttgctgaccaagaattaagcccaagcagcagcgagagtatagagaaatgtattggcaaattgcatcagataaatcatttattttatttttagttgatatctgggcccaaccaaaatcaccatgtggtatttctattccctcgacaatttccggagatcctgactctgatttttttttatcaaaagttgaggctgaacttgcttgctttaaggcaggctaaaggttggaaatgaacgtagacttattttcctggtggaatgaaaacaccgaccgtcttcccgaattgtcaaaacttgcaagaatggcccacagcattcctgctacatctgtcagttctgaaagactgttctcaaaagctggacttatttttgcgaactcacttcgaaataggtccaaaatcaataaatgtattaattaattttataatttaaggctttccggcaatactgtacgccaaattttgattgtgaaggccaatttggacgcacttttactggcatcaacaaatgaatttgaatcaggtgatgaaagtgaagaaaaagacattttttgagttttgataactttatttaatagcatttaaaaagaaaaattggttttttcgttaaaaaattttactgatctctacccgaccggggttcccgaccccgacaattgagctcccaccgacccgacccccgacatgtcgcccccccccccccccgaggtccccggcccccgacattttgccaccccgagggctcggggcttaaccctagttt

SEQ ID NO: 17207 - DNA, 2506 bp, Heterodera glycines
aagtgcacttccggaggaaatcgcgaagagaatcgttaatttagtgccattggagcggaaaagtaaataaataatggaacttattcattctgatgggcaatttaataataataaataatttttatttttcaactccgccgaatgcctcgcgggcatttggttaagaaatgacaaatttacgccaataaaaattcgtttttgtaccaaccgccgaacggcgacgaccaaaaattgaattaccaacgaacgcccaaaggcgagttttcttttttttttttttttgctcggccaaaaggaaaaagcgatcgaattacaatttgagccaaattttgagcgacgaatgacgtcaaaaagggagcgaaaatggcccaaaaaatacaataggtgctaaaaatttcaacaattctcagaaatttgacagggaaaaaaaaatttggtcggggatttttgtccccgacatttttctgtcccccgaaggtcgcgggggaacggaccttaattaaaaatccaattccctttttccattcccgaaattcattttgatatttaatccttaaacccccgcggcgtttgtttgttttatgtgcacagactttgcgctcgaaatgtttaccgccgccggcgccgcttcgcttcgcttcgcggcgggggcgaatcaaagggaaggcgccgcccgaggcaaataggcgtcaaaaaacagactaattaagtgctcgaagccgttaatcggattgccctttaattgggacgcgcaacgaatgagtgaccttttaagcgtaatcccatcacagaatgccaatgtttgttttttaattacttcctaatcggatttgcatgagaagaaaaagaaaggcacttttataatattttaaatttgaaaaacggaaaatgccgataaaaatggaattgatcaaaacgcagaacaatggaaaataagatgatcaaacacaagaatggaaaactgaacaaaataatgaagaaacaaattaaaattgactatccgactgatcactagcggaatgattaagccaaaacgaagtgccgatgaatcaaataaacggagcgactgatttgtaagtaactctgcttttggcgtcgttttatctctttataatatttaaatggagcaggaaaaaacttcaggtcgaaacagtccaaaaaattaccaaaataaaataaaaactgatttttctgactatcatttccatatacttttgtatctttttgaaattttgcagaataatattaaatagagctaccgaacaaaacaatattaacaacatttggcacagttcgtcccattttcccgcattttttggctgtaattacgaaaaaatgaaccagaaaatgatcaagccatacgtaataaactgctgtaatgagtgagtgctgtgcacccaacgacggcaaacatcgccaaattccgacctcattagctcattcatttcgacggtcccccgccgccccaattgccccgcaaattgcttcaaactgaaaaagtgggccatacatcgcactttattagccgccgtggcccggccggggggattttggattgtttgtttgtgtttgacgggagaattttgagtgggagggcgaaaaaaggggaagggcgaaggggagaacttcaaaagcaccgggggacaactgctggccaaattgtgggccaaattagccaaatcatcgcatcagtctcgtgacgccgtacggcgggggaggacggagttccgtccgccattcggcagaacttttggaggcggcgctggtgggggcgggaggaggacagatgagctggaatggaacacggagcggaattggaatttgattgggagtaattaactaattaattaattaactaactaattatgacaaaccgcgtggaattaattggggagaggagattaattgatgatacggtacaataattaccgaaactagacaaaggcttcgagaaattcgaatctctgaactggggattcttcgagaaaagcgacaaaaataacttttttaattggggaaatttgctaggggagatacctttcctgtcatttgttgatctcgattttcgagttttaattgttggtctcgggttttgcttctccgatgaaatcatttctcgcaaccaaacggaaaataaaatatacggagaacaaacaaaaaaagggaaatgccaatgggaacaaaaaataattaagaaacaaaaagaaagcgaataaaatgccatcccttggggggggggggaatgaatggcagtaaaaaaataaaaataattgccatttatttcgaataaattacatgtttttttgaattttaattgaaattttcagaatgaaaaaaatgtctccgtgggaattggacaaagaaacgaattgatttgagagagcggagacattcgtttgaatatttgcacaaaaaagagatggggtaaagtaaaagggcatttgcgggaaattgggacgaaactcaaaggaaaaaaggggaaaaaaggaaggagagggaaagggga

SEQ ID NO: 17208 - DNA, 1723 bp, Heterodera glycines
aaaaaagaaaagaattttatgacaaaaatttaaatttagatttattttttgtggaaagagtgagttttcaattaaacagcaactcaatctcgggtgacgagaagccattcaattttgaggagcttgatccttggggagggcaatgcaaaacggggcaaaggcaatcaccaattaatattcgtaaagaatgggtaaatttaattaataactctaattacataattagtgagtaagaacatatttcatttttacttttgttagcgttccagttcttattttcgagtgttgggcagaattttacaatttatcaatattctaaaatttgctaagccagcacttttaacctaaagatccaaaaaggctgtcgacattgtcgacatcaaatttttatgaaaatttttggttttggtaatgaattttttaactaattctagaaaaattcttgatatttcattgtttttaactattttttagtttactgaaaacaaaactccgccaattcgattcgtaaattatgaaaaacaaaacaatgtgacattgcacaaccatgggcattcaggtgaaacagaatgaatacaaaggtttcatcgaaaattccataaaataagcattttttaaaacgagattatattgagcgtttttggtaaaaatttttaaaaatttaatccaaaaaatagaccttttttaaagagtttttaaaaacaaactcaaaagatttggcacgacagtgccgacaagtgccgctttttgtagttttcataaaaaattaaagaaataagcacgccaagaaagaaaaagcacaaatgtgcggcctctgatctctgattaaataatttttttatatttatttgctaataaaaactaaatttgccaagtggaagtaagcggctttgacacttggcccgagcgacctttcatcaccgacggtggcctgggaagcaaatatttgttgatcgaattccattttcactggtcccaaaagaagaacggaagtgaacatacggtagacggacagcactttgacgcggaggtactgtagacgaaaacaaaagcgagagtgaaagcgagacgacagtgagagaggccaagattacaaacatagagagagagagagagagagagaaagttgagagaaagagaggggggggaggaggcgcgagaaagagagagagagagggaggaagataaagagagcgagagagagagagagagtgagaaagagagagagagagagagggaagataaagagagagagaaagttgagagaaagagaggggggtggaggcgcgagaaagagagagagagagggaggaagataaagagagcgagagagagagtgagaaagagagagagagagagggaagagaaagagagagagagggggggaggaagagaaagggagggagaaagaggaaaatttgaaaggcactttctaatgattcaaaattcagtcttaattaaatttgactttccggcaaagctctgtagagaatgctacacaatcgttaaagtgttttgtttttatacaattcatatttgctattttagcttcatcttgtccatgtcaaaaaagggcttacacctgaagaagcaattctaacttcggatggcttcgctgtggtgggaattttttacaaaactgcattaagcggaagcccactgttgtcacttcaaaaccaattaagccaagtgacggaaaaaggtgggataaatgggaaaaaaa

SEQ ID NO: 17209 - DNA, 2628 bp, Heterodera glycines
  misc_feature (2582)..(2582): n is a, c, g, or t
ctccccataatctggtttgagtaccccaaacggacacttgattaaatcgatttttttgttttcggggcagtccccccgaaccgatgcgcccagatttatggggagaccgaatccttcgggaatagcttccctatagtctgtactttaattctgcgttggatttttgctccccataattgtgtgagtaccccaaacggacacttgaaaaaatcgatttttttatttcataaatattttttcagaaattgctctgaaacgcaccaaattttatttacatgttagtttaggcactctgatgctttttctatcgaaaagggagatgaataaaatttttaaaaatttttaattcctttttaaacaggccaaaaagtttaggcttaacttttttttcagaaactgatcagaagcgccccaaactttgcagggatactgaaaggaaaagaattaacctggtttatcacattagcttgtcatcagtttttataaaaaattttcaaaattctgagtctcctattattttatttttttttcaaaattttgaagggcgggggggggggcgctgttccatttatcaaaaaagagcgttgtatgtttaaaaattttcaaaaaaataaaaattttatttataacatggctcaaaattaatcagtttttttagataacgatatcccttaattgttctctacatattagctctatgaaattttaaatcttgccaaagaagagagctaagcgatgtcacttagtccattccatcaccaccacaacaaccactacaacaatacaaacagcagtagcaaacaacctcatcatcaaccttcttctactgttgctgctgctactgctttgcaaccgcatcacccattttctcaacatcaccaccagcatcattttcatgacgacgaggaaccgatatggacttgcgcggacacctttgactcatccctccaccgaagtccaccgcctccgcttggctatcagccgccggccgttcgtggcgaaacgccacaaggtgagtgagaaaatgccactggagatgccaagtgccttccttgggcggagtgtgggagataatgtgggctaaatggacatgggataacactaccgtatcccaatcatacattggtggtatgaatcgaaagttttaagtctcagaaagttataaattgaataaattgtgtccttaagaaaaatacgctgacaaatgaatgagagaaaggaggtgaatcactcactatttttctaatatgtatcagtgatgccgcgggttgagaaaaatttcgggtttcgggtcgggcactcgaaaaatttcgagttcgggtttcgggttgagaaaaacttcgggtttcgggttcgggttggcatcactgatatgtatagaacaaaaattttggatatagaccagaatttagtgccatattgtttctatagacttcaaatctgtcaaatgatacccaaaattctatttagatgcatagaaatatcggtttttttgtgggaaccgcccacttcggcgccggccttttcggcgccgttgctaacaacttttttcttgatcaaccaaattaaaaatttttgttatcattcgatagctcttcagattctctattagcctgtaaaatttcaaaaaatttcgtcagtttacaaaaaagttatggccaaaaaacctcaaaaattaactttttcttggctttttcggcgccgcgtggcataacttttttatttttgaatcattcatttctatttttacatgtaaatatagagcacacatagagctttcaaatgatgccagattggctaaagctaactgacaaataaaaaagttatagcatttcaaaatttgcggcgccgaaatggtccgcgccgaagtgaccccgaccctttttttgtttgtttggagttttccgtcctctcaaatagcactgatttgtgttgtaccaccatatccactgcatacagtacgtacgcacttggctccctctttttttacaatgcccagtctaatctctcccccctccaaaaaaatgtgcagcatttccgaccacagtggtgcatgccagtgccaagtcgaccacacctcgcgacatttacagggtgggcatttacgggtggcgaaagcgttgcctgtacgccttcatcttgttgcttacacttgtcgttttcatcaatttggcgttcaccttctggatcatggccgtactcgacttttctctagtaaacatttaaattcctgtgccctgtcctgttcattttgcataaaccttcataattgttaggacgtgcatttgtatgagttttcggattaaaattttagcttggtttgaaacgatgctttttattaccgtattcttccataatatttaacattctgtcccaaattgccaaattttgtccatatttcgacattttaacaagaaaatttgaaaaatacagcctaaaaataaaaattttcattttgtttcctctctgaaaaaaattcattacattaagattattctaaaattttgaatatgtatacaattttataaaaatttttgtctatatagtggggattttatcaaatatttcggcgtttttttccnatagatggaaattttttctcccatataaatcgcgtcctaaataact

SEQ ID NO: 17210 - DNA, 3559 bp, Heterodera glycines
  misc_feature (1617)..(1617): n is a, c, g, or t
aaggcaaattggggaggggcagagaagcgaaaaggggtcatcgacagcaaatccagaacaccttcctggactggctgaattcctttgaaaagacgccaattgtacgaatttcgggcctcgtcgaaatgaatgaatggctaaatagcgaatgccacggggacggactaaacagtcgtagggccgagcagcagcaaatggttggcgaactgttggagttaaattgaaaggtctctcaaaggcactgctcgtcgtccacgaccaggtcagtccagtggaacgaacggcacaaaaggaagcccaaaatgccaatgggcaggggacgctgtgccctttcatgcgcttttcctcagttcgtttgccccgaatttcgcttggccactttcgcgcgttctcttttcgcctccgcccgtcagtcgcattcgccgccgctccgcacaaatttcacagttttggaggcgcttcgtccgcttgccgagggtgaggagttgtcgctgtccgcgcgactccccggcctttcgcgcgcgtgccgaatgctcattttgctcagggcgaatttgttcacggaattgccacagggaatttccggctcgaaagtaatgagactttcccgtttcgatcctctgaaatccgataaactctcaacagatgcaccaaatcatcgaactttggctgagacttcccttggcaaccgaacgatgccccggggagaattcggcactgaatttggccccaattttgggaccattgggcgcagcaaatttggaatttcttcgagaggagcgaattctcaaggcaattgagaaaaagcgcgaatatttagcagtcggaataattgggggagtggcggtaagaaaaaggaagcaattagcgaagggatgaaccaattaaggtgatggcacttgcaatgtcaatcttttggggattgaatggcaacgatttcgtaacgaaaccgtaaagaaattttgagaactgtcatttttatcaaatcaaatgcttttttatgaattagattcatggaaatggccttatttgtcttgtcttttgagaaaaaatttgcagaaaagaatttatgaaactttattaaaatccattcaaaatgttaatagtttaatgaaaatcctgaatgatattgattaaaggaatcgtacagaacaaatacaaaacgattgtttcaccccaagctaaaatgtaatcttttttcagaattaaaaggctaattgattattttactatattgtaccaataaatgattagtaagatgaaagacattggatcaaaaatcacatgtaattttagactgaaaaatcacaaatttcaacaattctctttaagtttctctgccaattttgacatttgtttggtgggctgcaggcgaaggtccgccaaagcctccatcaaaaacactgaaaaattattttgaaattcctcgtttttgtgcattctagcaaataaaataaaaaaacaaacaaatgtcagcattgaattgacgcctcagtttcaacgacaaattaacaacatttcccacttgagtacaaaagacattttggacgagtttagcgaccttaaaaagagtttaatgaagaagacatggtgaagcggcaaatgccaatttactcncggcactcacttccgtcaaaagccacaaatccgcttcatcatctgcataaaattatttgtaataatttgacttacaattaggtaatgttttctatataagagtaggtcaaaagaaaataaataattttaaaattcaataggaaaacttcttaaaatttgacgaatttgttaacaaatcgtcaaaaaaacccagttcttattttaggttaattaaagaaatgaatttccaaaattggttatatttcgtttattggagaaagcgcaaggttggaattggaattattaatgaaatatattggcccaccactgcttcacacttaccattgaaagatgaatttatttcagaagcagcggaagcgatcgatcgaacgaagtttcggtcgtttccgtaggcgccgattgtgctcatttgggacaaaagaccgtggccaacgccggtcgcgtaattgtgaggggcaacgctaaagctaggaagggaacggctgagttcgtccgcggccattccctccggcgtttccgtctcattttcagattgtttctgaaaagcaatgaaaactaaatcggccgaaccgaacttttgatttagattcgtgtttttgaaaatctaaatccaaattttttttttaatttgggaagcgtttcactccaattcactcggaggggagaatgattagtgcatcaccaccaaccaatttgcgtatttcgtcttccattgtcaaagtgattgtgttggcgatcgactcaatctttcgtccgacgacccgcaaattgagcgtttccaagagagaggaattcgaaatgagccgggcagactctgctgcaatttttcgattgttaggcaagaaaaaggaacttgggatgagtaagaccgaccgttttccgggctttctctgctcaaatcagctgcagtttcgcggatgtactcgttgaggtcgtcgattatgttcaacagatagcccatcacacaaatggaggacactttgtcttccgtgttctcctgaatgcttttcctcatccggatgtccgctccctccggctttatgttcaaaatgtcatggttctgcaggagagagttcagctctctaattccatgctaaaataaataatcatcaaatccgaattcatttgactgtcgcggccttttggaacctcaaaggaaggcacaatttgagaagagaattctgcgccaaatgtaagcgaagaatcattcacaatttcccgcattttcgactgaatttcctcgaggaatggcatcagccaattgtgccgatggcgcgaccccttttcaggcttaatggaaaagccacatgaataaatggagtggcataaaagtgagcactgcatttctcccaaatcattgtctcaaatgaaagtcgtctggaaaactcgactcgtttttctagtaaagcacttataataaaataaaacagaaaattctcaatcaatttatcatttttgagggggggggggggaaacaaattactcccggcgggagataaaagagtaccgcggtaattttgttgatggaacagaggagcacagaagtggcgtatttgccatagtcgccactaagcagagaaaagactttctttttgatttgctcggtgactccaatcatatgctcatccccctccttctgaacaaattcagaaaaatccgcaagaatctaaaataaaacttaaggcttcataatttgagcgtgtctgctaattttaagatttcgtcaaacggaccagcgcaacgattttgaacatcttcacgctcgtagccaaaataatgaggcggtatccgaaaatatgaagacttttttttctcttacaattaaggcgaacatatttttctagtgagaaaaataagaatttgtagcccttttcgccaaaaattgccaagtcttttgccattgagggtcaaatatcaaattaaaaacaaaacaagaaaaatg

SEQ ID NO: 17211 - DNA, 1209 bp, Heterodera glycines
ccattccttcgggggaccgtgccgggtgccgcgggcttgcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaatttttaaaaaaatttttctccatctccctttttgatagaaaaagcatcagagtgcctaaactaacatgtaaataaaatttggtgcgctttagagcactttctgaaaaaatatttatgaaataaaaaaatcgatttattcaagtgtccgtttggggtactcaaacaattatggggagcaaaaatccaacgcagaattaaagtacagactatagggaagctaatcccgaaggattcggtctccccataaatctgggcgcatcggttcggggggactgccccgaaaacaaaaaaatcgatttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccacataaatctgggcgcatcggttcggggggactgccccgaaaacaaaaaaatcgattttttcaagtgtccgtttggggtactcaaacatttatggggagcaaaactccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaa

SEQ ID NO: 17212 - DNA, 820 bp, Heterodera glycines
cgtggcattgtttttctctgaaaatctttcattgtttcttttttcgatttttaggactccattttttatttattttccatgataaattctgattttttatgaggcatgtgtcacaaaattggactaacaaaatgatgatgttcaagaaaaaaggtgagattgagatagtgatcgagaaaaaaactgagacctctcgagagagagactcgatacagcgactgtcgagaatcaccacatcacactctttttgagatagccgtctgtatgctggcatgaattcgaaaattaaaagtgatcagtttacataatttgttaattatgtcatgccaaccttttgtttgcacataaaggtggaattcagaataaaatatgaaaatcttaaaacagttatattaatattccatcgctccatttcggatttaagaaatatttttatcttaattaaaaaataataataaaatatttaactaaaaagcaaccgccaaccgaaagccggaagagaaaacggacagagcgcaaatgaaataggaaatgatggaattgttgaatcaatcatttattatgtgtatgtatatgtgtatatattcatatgaataaacaaagttttctgatgcaatatttgccaaattttacgcatatataaaaattatgaattatataaagcgatattaaatgttaaaaaaaacataattttttacactaataacggataaagaaatgaagatgtcaaatgccatgctaatgtcctgcttctgctttttgaatatttcaatgcttctttttgtcccaattaatgggacacctgcggacgagtcaactg

SEQ ID NO: 17213 - DNA, 2330 bp, Heterodera glycines
caaatcccagctttgtcggacatttagtcatttattatacaaaatttataatgggcattattatatattttagttgacccacgcactgaaaatgccatcgtttttgatgaagaaaatatcaatgtattggttgaggatgccattgattgggctcacaacattttattagtgatgcgacccccgggcatggaaggaaggtttataaaataattaaaaatttaattttaatcaattaaatttgaatttttttaaattttaaatgtggtaaacgattttgacagaagcgacatggtccaaaatgtgccattctcactctttcctacaccgttcccccgcgcaatgttcaatgaagccattgacgttgccaaagtgcgttcatttatttaaataatcttttagaatttttattgtacttatataatgattaatataaatattactttatttttaagtatttttttaaaattaatgccaaatgttgtctcaaaatgaatacaattttctgttaacattataaattcaaagctttaaaataataaaattctaatttttcattttaacagcataaattcatagttttcaattaaaaaaattttactttaattttttattttaattaattaattttacttaaatgatttattaattattttctcaggcaatgagtttgctgtactttcgtgtttcacgtgacatcgactttctgaagatggtttacaaggatgtgattgatagtgatttgtccattcgaaactatttgaaaatctgtgaagatgtgcacaatgaaggcatcaagcagccgatttccatttatcttcaacgatcggtaaaaatgattaaaattaataattaaattcaaatttttaaaacatttaaattcgctttttaggattatatggtccatgtcagcgaaagtgatgatggtgagaaaaaatatgagcttaaacaggtaaaaaaaaaacccaatgtattaaaaaagctttaaaacgttaaaacatattagtttattatctaaaaatttactaaggtttttaaaaacgaaaaaattttttgaaaatttttgatttttaatgatattaaactactaattaatatctataaagtgagggaattgcatcaatttatttgggacctttttgcacttacttcccaatttgatttgctaatgttgagtgagcggattggatttattaaacccaatttttgccaattttggaaagtcaattacatttcataatcctttggatgttatacatacaaatcaaaaataaacttctttttaataaaaataacatttctttttaaatatagattccataaaagtggcatttttctgaatttatttattttcgtattttttaattttttttattagattgaagtgaatggcggctctattggtggtgcaaatggcatcccgccacgcatcaccaaaatccatgaacgaatgttggaaaaagcgggcttcccaaatttcccagaggatgtgctgccgagaagcaccaaggcagagagtgcatcagcgcaaatgcttttaactgcttggtatgagtgtgttcactgctaatgaaaaaaaactcatctccaaatagctatgggagaaagattggccaattagtggtggtctaattaggacataatttcattaatatgccagttagtggtggtttaattagcacaaaaattaattatgccaattaatggtagtttatgacgacaaaaggtcattaggacaattagtggtctttaattaggacaaaaattaattaaagccaattaatgatagttttcttagtggaacaattaattaaaatgctcgtcaaggaattagttaggcttagaaatttatgatttagactattaaattcacaaaataacgccaatttaatcaaattaccgtcagattaacaaatttattggaatgttttttcataaaataaaaaatattttttacttttaaactgaaaatttttcatctggcactgcctaaattattttaatttctttcattttaaaaattacaggaaaaagtttaaaaatccaaaagcaattattgtttcactcgttgtaaaagaaaaaagtaaatggcacttctgcaagcgttttgacgagtatgaaattgaccgaattactaacaagaaagtgaaagtctattacttgtcaatggaagaagctgttaaaatgtaaggaaaaaatatttttataaattaattttttattcaaaaaagatttataaaaattaatatatttttttctatttgaaaattagatataaacaatagtggaaatattttactgtattcagggctaccgggggggggggggggggg

SEQ ID NO: 17214 - DNA, 4252 bp, Heterodera glycines
tttagattttttgttgaatttatttgatgatttattttctttcattttatttttttgttggtaaacttttggtgacatacatattttcaaataaattatttatacaaacatttaagaataaattaaattgttataataattcgctgcttattagaaaaaattaaataaaatatttttaatttttttttctcattcatttggttgtattattttatcaaaattttatttttaaacttttgattaggtagcttattttgctaataaatttttgttttcaaatatttcaaaaattaaaaataaattgatttgtaataattcaaaattaaataattcaaaaattgccatcacggctcagatgcggattagtgccatccatgaagcaattcgggacgacattagatgacgctgaaacagctggtggacgactgggacacggccacgggacgagaccaacacggacggacaccgctgcacatcgccgtggggaagggcgagcggaaccagagggggcgggaggttcaaacccagaaatttttttattaaaaatttcttcgaaaaaatattccaacataaaatttgtaaaaatcgctaaaaaattgtataaaaaattttttcggaaaagttttaatctctgtctcgggcttaaagaagtattggagcagatgagaatatccggctcggaaaactcattatacacggacaccaacaacaatttgaaaacgtaaataatttataattaattacatttttaataattagatgaaaatttttaggtattaaagtgcaaaatatgcttcgaaatgccaaacaaattttaaaaaattaggaaaaaaataggtaccaaaaatcctgaaatagatacgatttttgcaacccaattttttaaacggtaagattagaaatccgagcatttggtattttgtcgactcattaaaacattgctcataatttttttttttagaattttcataggtagtgcgcttaaaagtctcaatattgcgatagtttgtttactgttaagagaaaaatatactcttttgagtacattaaatggtgccgaattcaaacggcaaaatccgccgtggccatcgtgtgaaacccaagagaaagcgcaacagacagtgaaagatcattttgaggaaatggcagaatggatgctcagcgatctgctcaaatcatttcactcgagaaaaagattaataaaatatttgaaatggtcattaaaattgtgaaacaataaaattaatttttaaaaattcaaaaatcaattatttttcagcgaaattgcagcaaaaaataaccaatacgaaactgaaaaggcgtggaaaaagctggtcaatctgttcggatttgcacgtgctctacttctttgtagaacatttcggcaggaatttggcattttgtgtaagcgaaattagtggttcatttaaaattattcgtcaattatttactagggatgtcaattttatgtaaatacatttttttcctggcttctccatgctttgaatagtaggaaaaacattcttttttgtgttttcgaacaaaaattgggtcttttatttacatatttcggggttttattcatattttacttacattaaagacttattgttagaaaaattaagcaaagacaatggcgagacgaaaagtgaaaaattcaagggccgatcttggcctactgatgctgtacgcagtcaaaggagaaggaaaacaagagctattcggatgtgcatgatgattttttaataatataatcactcccgttagcccttgggaaaggcaattttatgaatatattttttattcacaattggggcgcaaatgtgcggggcgcaaatgtgcggggcgcaaatgtaggggcgcaaatgtaggggcgcaaatgtaggggcgcaaatgtaggggcgcaaatgtgcggggcgcaaatgtaggggcgcaaatgtaggggcgcaaatgtgcggggcgcaaatgtaggggcgcaaatgtagcagctccaattcatttactcctaggctcataatcaaatttttgaagacaaacgatcaattacggcttgaaaataacacagcaaaatacgttttttccaaaagaaaaatagccatttcgtgcttttgaactggacataaaatttgaattttggaaatgtatacttgaattatcacgtttatcgatatccggtgattagccattatacatacatacatatatatatacatatacccaaataatgatcacacaacggttttacaatgacaattgatcacagacaatagagcacattaggcacatatgggggaacaatatgggatcatttaaaatcatttctgatcactgtcgatgaacatcattgaagcgggttgtagagcatcttgttcttgtgctgtccggtggttgttcaggccttctgcgacgcggctcctccagctgccgacttctgcgatgcagtgcccaatgccgacgctcctccaaccggtgccgacttcagggtggttcctccggcggccgacttctgcgatgcggtgcccagtgccgatgttcctccagctggtgccgctgcggtcttctgcgatgcggtgcccagtgccgatgttcctccagccggtgctgctgccgacttctgcgatgcggtgcccagtgccgatgttcctccagccggtgccgctgcggtcttctgcgatgcggtgcccagtgccgatgttcctccagccggtgccgtcttctgcgatgcggtgcccagtgtcgatgttcctccagccggtgccgtcttctgcgatgcggtgcccagtgtcgatgttcctccagccggtgccgtcttctgcgatgcggtgcccagtgtcgatgttcctccagccggtgccgtcttctgcgatgcggtgcacaaagtcgtccccgtgccgggcgccgcgtacgtcgaaggaactgctaaaaatgggaatgaaagtattagagtgaaccaaaaacgcttccccgcccgcccgtccctctcctctcaccggccgatgcggtccccgctggagccaatgatttcttggaggcttcggctggctgctgtcccaccgcggaagttccaccagctgctgaagttccaccaggtgctgcgctctgtcctgtcggtttggcgctggcctccgccccttccggtcccgccggcatttgcggctcttccgtgttctgaaaatgaaaaagggaaattattttaaaaaatcagtcacgacagaagcatcgctaccttctgtccaccgccgcagcattgagtgatgatgaccaggcagacggcggcgacgacgagcatcagctggacggggagcaatgcgaagagcaccatggcgttgcgttgttgatgacagcagatgaagcagcagatgaaagtgtcgtgaatatatgaaatgagagtgatggaatggacgaatgggcggaaagcgaccctttatatagccaaaaaataaacttcttttccaataaaatgtttaactttaacatataacccaatcaacggggctatataaggaaggcatttccaactgtttatcgcagattaaaaatgtgcttttttaaaaattaagattgggaaccggccactttggcgctcaatttcacattatttgtgtttctccggggaatttctcgcaactagcgaatgaacccgtgattttttgttttattgtccaaattaccttatgaacccgtgaatttctgttaatttttacgttttttattgttaaaattattgttgaatttatttttaaaatgtgtattttacatttttatgctgaaatttaaaaagttgtttttactgtgatttttcatttttaacataaaaatttttgaaaatctgcccacagataacacacaagtatgtaccattttctttttcgattttcgacaattgaccaaaacaattaaaaagacatgtaaaccaacttgagaagcattccgatccgaaaaattatagagcttaacattcccatatttttccgtaaaaatgtccatttattgcctttgaattgaattcggcataaatgttttgaaaatttgcacttaatttttagttccttttatcgacatccgctgatcagccaaacacatacatacaatatacatacatatacacaaataatgatcacacaacggttttacaaatgatatacgtgatcacagacaatagagcaattaggcataggtatgtgggggaacaatacggggtcttttaaacatcatgacggatcactgtcgataaatatcattgaagcgggtt

SEQ ID NO: 17215 - DNA, 2364 bp, Heterodera glycines
cttccgttatcacccataggtaacaacggttccggtttttatataagacatcgcttccgttatcacccatgtaacaacggttctggtttttaaataaaacatcgcttccgttatcaaccataggtaacaacggttccagtttttaaataaaacatcgcttccgttatcacccataggtaacaacggttccggtttttatataagacatcgcttccgttatcacccctgtaacaacggttccggtttttaaaaaaacatcggttcctttatcacacagaggtaacaacggttccggtttttaaataaaacatcggttccgttatcacccagaggtaacaacggtcggtttcgttatcaaccataggtaacaacggttccggtttttaaataaaacatcggttccgttatcacccagaggtaacaacggtcggtttcgttatcaaccataggtaacaacggttccggtttttaaataaaacatcggttccgttatcacccagaggtaacaacggtcggtttcgttatcaaccataggtaacaacggttccggtttttaaataaaacatcggttccgttatcacccagaggtaacaacggtcggtttcgttatcaaccataggtaaccattggttccgttatcaaccataggtaaaaacggttccggtttttaaataaaacatcgcttccgttatcacccatgtaacaacggttccggtttttaaataagacatcggttccgttatcaaccataggtaacaacggttccagtttttaaataaaacatcggttccgttatcacccataggtaacaacagttccggtttttaaataaaacatcgcttccgttatcacccatgtaacaacggttccggtttttaaataaaacatcgcttccgttatcacccatgtaacaacggttccagtttttaaataaaacatcggttcctttatcacacagaggtaacaacggttccggtttttatataagacatcggttcctttatcacccatgtaacaacggttccggtttttaaataaaacatcgcttccgttatcacccataggtaacaacggttccggtttttatataagacatcgcttccgttatcacccatgtaacaacggttctggtttttaaataaaacatcgcttccgttatcaaccataggtaacaacggttccagtttttaaataaaacatcgcttccgttatcacccataggtaacaacggttccggtttttatataagacatcgcttccgttatcacccctgtaacaacggttccggtttttaaaaaaacatcggttcctttatcacacagaggtaacaacggttccggtttttaaataaaacatcgttccgttatcacccagaggtaacaacggtcggttccgttatcaaccataggtaacaacggttccggtttttaaaaaaacatcgcttccgttatcacccagaggtaacaacggtcggttccgttatcaaccataggtaacaacggttccggtttttaaaaaaacatcgcttccgttatcacccagaggtaacaacggtcggtttcgttatcaaccataggtaacaacggttccagtttttaaataaaacatcgcttccgttatcacccataggtaacaacggttccggtttttatataagacatcgcttccgttatcacccatgtaacaacggttccggtttttaaataaaacatcgcttccgttatcaaccataggtaacaacggttccggtttttaaaaaaacatcgcttccgttatcacccaccagaggtaacaacggtcggttttgttatcaaccataggtaacaacggttccggtttttaaataaaacatcggttccgttatcacccagaggtaacaacggttccggtttttaaataagacatcggttccgttatcaacgataggtaacaacggttgcggtttttaaataaaacatcgcttccgttatcacccatgtaacaacggttccagtttttaaataaaacatcggttcctttatcacacagaggtaacaacggttccggtttttatataagaatcggtcctttatcacacagaggtaacaacggttccggtttttaaataaaacatcgttccgttatcacccagaggtaacaacggtcggttcctttatcaaccataggtaacaacggttccggtttttaaaaaaacatcgcttccgttatcacccagaggtaacaacggtcggttccgttatcaaccataggtaacaacggttccggtttttaaaaaaacatcgcttccgttatcacccagaggtaacaacggtcggtttcgttaaaagccataggtaacaacggttccagttttaaataaaacat

SEQ ID NO: 17216 - DNA, 305 bp, Heterodera glycines
  misc_feature (9)..(9): n is a, c, g, or t
atcggttanttggtcattgtcaaaaacataggcgactttggacgaagcgacggaaccgtggggagtcaaagtggagagagtggaggtgaaggacgtccgattgccggttcagctgcagagggcaatggccgcagaagcggaagccgccagggaagcgcgagcaaaagtgggacaattggggaaaggggggaggggagggagggggaatgggaggggaagaggaagggggtcgagtttaaggaatgggacctggatggcaaaggtccggggaattgtaatttatgggcctggaagccgctcggaaa

SEQ ID NO: 17217 - DNA, 2170 bp, Heterodera glycines
ttaacttcatttccgtcttttcagcttcgctatttgccttttctcattcgatttcgtaagtttttcaatgaaaccaatgattttctttctttttttaattcagtgccgagaagaattcgaccattattttcccatttccgatcgatttgctcagttctctgctgcccgcccagcaatggcaacggtctgcgcccgcccctccggcgcccgtcgtcgccaatcccccgcagcaattcgcccattcgtcaaagttggctttgatgggggggggggcaatgccaatgccaacattgtgttctgtgtcagtgtttcttccggctccttttccggccctttcgccagttcgaccgttgttgacacgcaaatgaaaagtcagaaggcgcggcaactttaaaggacgaatcggcaaaagaaaccacacaattttattcattcattctgcttgttttcattttaataaattaaaattgcctgagagactgaatttccgagaaaatcattagcaaatggaccattgagaagcacctcattctttttttttatttgactaattaattgccaatatttccgtttcttcccttagcattcgtttcgttctcctcctctcctccgccccttctcaaatttcacccttcgaagaattaattttatgtctttaaatggtctcttaatgaatattccatcccattaatcccccccccccctcttttcccctcccttttccctttcatttgccccataagtctctgttttacttaaaatggttaaaagtgccttttcccctcccctcaattctgtgcccgcttcttcttctgatggtcatttctctgccgtttctttgacccctcaaaagccttctccttctgttgcctcagattcagtcactgcccgcaaagtttggcatttgattcggggaaatgctaaaaagcatttgttaagagagaaacacttaatgatatcagcaatggtttttagaaaagcatttaatccaaggacagaaaatgaaaattaagaatttgctaaaagcaatgaaagattttgctcaataaaaatttatcaattgaaaaacacatggaggtatttgagtttagagaaacaataaattatttttcaaaaaactgaaaatatttttagaaaaccaaaggtagtgaaagtgtcgttttaaatggcattttccacatttcactgggatctgcttttgtgccaagtttacatcaaattgtatttcctctccgtctctgatcgtttttatcttccttttccccacctttttcagtacatcggttcggcccttctcctgtccaacgtggtgtacggctccgtcctttacgctttgcatggtccgttctcccttttggtccaccaattcgtgcctttcttcgccgcttacgctttttctcttctcttggcacttttctccgtccgctttcatcttcccctgcttctcctccctcttctgatcactaccgttcgttttgctcttccgtccgttcgagtgcttttccctcccctcgttcaggtgcctttcgttgtggtgcctttgctgatcgcttcgctgtttctctcccaccatttttgcctgctaattcccccgctgttcgcccccctgcccaattcgtcgtcccccggggcggatttccctcccttccgttcgccgccgaattccgccgctctctccgccccatccgtcgattgttttcactccgcccgatttgttcccaattcggcagtcgtcactttctttttggcaattattttcgtggaaaagtcggccgaatttcttttctttctcaatttaaaacgcctttttttgcaaatttcaaaacagcaaaaaattgaaaaggaaattttaacggaaagaaaattggaaaaaacagacgcagcagaagagaaagcggacaaaaaagagcacggggaaaaacagaaggggaagaagcggaagagcatcttcagacaaaaaagcattgtggaagacagagaggaagagggaaggtcggaagaggaggaggaagaggaggaagtaattgggaaaaagggaacacaggatgatagagagagacagagggagagagagagagagacaaagagagagaccaagagagagagcggaagatgggaagtggcggaagaagaggaggtaattgagagaaaaggaaagacagggtgcgag

SEQ ID NO: 17218 - DNA, 3403 bp, Heterodera glycines
ggcttttctgcttttgctgttccgccaaatttttcctttgggtcggcgaccgtaagcagaaaaaaggggaattgtccacgggatacggtagtgccatttcgactcaaatcgcacggcaaaaagtggagacggatctgatcacggatttggatggagaggaggccgcctgagagagcagaggggcacaaatgattacttatcaaaatgacccaatgttaattaactgatcaaatagcccaatgttaattccccccccccccccccgccccgcgttttccccggctttaccttctccgaaaagtgtttttcccggtccttcaaagcgaactttgaccgcataacacgcgcccggtctcaaaggaaacgcgtgcgcaaaatgcacaatttgagtgggaaaagtgtcggtttgtcctgtgacgcgttccaccgaatgccattcgttttgttggcccgagggaatgtcgttgatggattgggtttttactaacttaaaatattggcacaaattagtcaaagccaagtttaccgacctccaactcaaagtgttccggccccgtcgccgcacttcccgagaaaatgccaacgcctgccaatgcgattccgggcccatcgacgcggaaagcgactgcgtcccaagcggacgcgtgccggttcccgcccacttcccattgtgcgtgggccgaaatgtgccgaaagcgggaaggactttgaaagagcggcgcagcttcgccaatcgtttttggctgggggagagctcggctgatcagacgatgggcgagtgaagtaatcagtcgctgtgccacggaaggcaaccgaagggaaatgccgtcgaagaggggcggcgtcggatgccgcgctccccccgacgaagtgatcggcccgcgcatcgtccgctcattttcgtctgcgcttatcgcgtcgtatcctccgtcgtctctgtccatcagttcattttttgaatcattttcattttccgtttcattagtcatttcgccaaatgcaatttcacatataaatttcaaaatgctcagcggcgaactttcgtcgtccgattgcccagcggcaaaattcgcattttcttcaaatcgccaaattctctccaccgcttcattcattcgtttccgtcttttgtcgccattttcattttcattggacgaaattcgaatgattgacaaaaggtccttaaaggaattaaaaggtcagttcaccagtaattagccaattagtcctttaattattcttttctcacattatccagccgactcattgaacacaaaacagcgaaaagccaccaatcgttggcttttcctttggcttttgctccgttttcgttgttccgtctgagctgttcgacgagacgcattcggaccaatgccgaatttggcgcaaattctctggccaaaattgtgcatgtcaaagcggcctccgccgttacaaaagcggaaatgcgatcctttgagattatttatggattaaacaatgttttgagaaagtcgcacttgtccatgactttttcggcacaaaatgcctttgagcaaccgatggaattcgaccatttcctccgcgttttttcccgccgatggaatgcacaaaaaatgacggatcaatcggattgacagcaccgcgacgaatgccgccctctcctggcgccacaaggcgtcgcaattgatcagttcgtccgtttcctcggcccccgcgcggaaagcgccgtccaaagcccattcaacgattagcaacagctgatggatgccggacatacagaatttacggaagagcggacaaagcgactcggccaaccgatggtcattgttatcggtcgcgaggtgaactctctctccgtaaaagggagcgtcgcccatattttttggacggtgccctcgggcagcgacatttccgtcgccttcgacttgtttttgacagcgttcgtcgccgtccgtcgcaatgggaaggaagtacagctcgggaatctgtcccacctcgacgttggttccgttgttagacagttcgctggtgcggaaacggaattccgcgcagcatgcctcggaagagtcctccgcaccgccgcatatttcaacgcgcaccgtctcccgtcctcccgtcccgcagtccgaactcggaccccttgacaaattgggggaattaacggtggactgatcggtgatcagtcccaaaatggacgcccttctcactggatttgcacccatatcaagtgccacacgtcctttatgatcgcaattggtcgctccaattggagcgtcgccgtttcccttgtgccgcattcgtaaagcacttcgtccgtctcggccagcagttccacgcactgctgctgtgcctcagtgccgacttcgtctttgtcaatggctctgtacagtttcagccgcgcggtgtattcgccgcgtccgccgaacagtccgacgccgcaaaaagtgatttcgcaactgagaaagagccgaatttgaatttcaaaagaaactgaatgcatggatttggttggcactttgtcataaattggatagcctccacacaatgggccgaatatccccaactgccgccgaagttttggaagcgacggaccacgcgacagttccgaacggtgttcgcacttcgcgtcactccgtccgaattttcatcggcgttttccgagcccaatccatcaaattgcacttcatcttcggcacattgttcacttccattcggcatttggtgaattgcaaggcaaagggaataaacgatggaaaggagaaaaagggccatttgggcatccgaaaaacggactaaaagcgaagacgaattagcatgtcaaactgatcaaattttcattggtttgccttggctaatttcggtcgatccttgctggtcaaattcgcattcgtcctccattaacgatggcaccattagctcagtacttctgagaatcatttgacgatgtttggcgaggaaaagccgattctgatcaaaatggacgcctttctcagaagcgtcggataaggcaaaaacacgcatttggacggggtcataggcccagagaaggctcaaatggcgaggatcgaaacaaaaactaaaagaggaagcatttcgaaggatcggtcagttggatgcctttgcttcacctgcacatggccaactccaattcggcactttctctgtgttgcgtttgccaatttcggtgcctaaatctgcccatttccgtccttccgatgcccgtggcgatttctccacagttgcttcgacgaaccataaaatagcctcgagtgccgtttttctgctgctgttgtgccctcccagcggatggcaaaagcatcaaaagatcgcccgaggcggtgattcgcccgtcggccaattccgcgcgagaaataagctgacgctgcacttggaccaccgtgcggtcgccctgcgcactgac

SEQ ID NO: 17219 - DNA, 1688 bp, Heterodera glycines
attcttatgtttagaatttgttatgctggtcagtccatatttttggagaacgttttaaagaacagtgaaaaataacggattttatttgattacagttttcaatattcatagtttactaattatataatatgtataacacaaacataaatttttgaattcataactctatactcaaccatatttttataatggcacttttacgaaacgcccatagtggcactttttacgaaacgcccatagtggcactttttacgaaacgcccatagtggcactttttacgaaacgcccatagtggcactttttacgaaacgcccatagtggcactttttacgaaacgacctagcaccgggggagggaggatagagcgactgctgatttaattggctcagttttacattggatgaattatgtcacattataaaattatcaattaattattattacctgcacacctgttgggcaatctaaacaaggaaaatgattagccacttgtttttaaatttcaattcctcttacaataaaatagtattaaaaaacaattaaagacaaattaattaattacctgatgggcctaacccaattaataataataagttaattaattacctgttggacctaacccaattaataataataagttaattaattaattaattacctgttggcccaacccccaatgacaagcgtccaacagaacagtcaaaggggtgaagaggaaatggatgagtctaaagaagatggatgacaacttatcagttaatcctatccaaattaaaaattttgttttatgcggtaattttttttaattagagaataattaaggaaatgaatcccactctgggctggacggctcgtgaatgtgatttttgagttttgcctgacaaaaaaaaaagaaaaattctttttaaaaatgcaagaaaatagggcggcaccaaaaggttgaagcagagtttgaatttttgaaaaatgtccacaaattcgtcctgggtcggcatttgtgagcgcaaatgcaaaatgccattctgagccgcttttgctgcttctttagctaaaagaaaaaattgaaatataatttagaaaactatggaaaatttaaaaaataaaaaaaaatccgcaaaaaatttaaacaaataaaattggccacagcaataaaactataattataaaatgcacccttcttgctcttccgctgtttgccgtcatttttttgcatttcgagttccctctgtgccaatgccaccgactgaaccctggccacaaagcgttcaatgtcatcaaaacaacggttcaatgtattctggatataaaaatttaaaaaatttattaaataaaaaattaaaatagggccccataccacgtccatttcgaagtactcaacattgtttgatggtgaatcgtgtgagaaatggccacggggcatttcattcaaaggatttggataaacggaggctggaatggacaaaaaaaaggaagcagaacttgacaattgttttaaattttccaagaaacattttaaaaagtgaaatgatttgaaaaatctatttttttagattttttactaaaaaaaaaactttaaaaaataattaaacggaaatttttttaatattttaattccctatctcggttcccgaatctcggaattacaactctcgagcagccatagaatgtagccgaaaataaatcaaata

SEQ ID NO: 17220 - DNA, 2241 bp, Heterodera glycines
  misc_feature (21)..(21): n is a, c, g, or t
attaaatttatataatttgcnaatagcgtcggttattttactcacagttatacaaatcttcggcaacttcgcctcccaggcacattgatacactaattaagcaaaaatgaaatcattaaataaatttcatttttttaaataattttaaatcgtatatagggaagcaaaatcaaattggtgataaatttctcaaatttcttcaaattctcaaaatataagctaaacttttctaaagggctaaatatgtattaaaaacattttattagaaaatgaaaaaaaatgtatctaaaatatagatatgaattttgaagaaaatcaagtagaaaatccgatataaatttttattagagtgagccgttctaataaaggactttttttgaaaaaaattcctaatatgcacactaaacctaattttacgaattgggaaatttatgccagattggttatttgtcaattttagacaatcggtttctttggtttttaatttttccatttaaatttaatacatacaaagagtgccgtgccagtatagaatgttcattaattaaaataataaccgaaaatgccacctggaaaatgtgaagttcggtgggcacagtgccaccatcggaaacaacatgttccagcacaataaatactgtaaatcaggatcagtgattaatgatcaaattgtctaatttgttgaatttgatagtgtgtacaaagcatgttattgaacgtgtcacgcgggtcggacgatgtgtgcgcggttgggtcggacaccaaatccatggggaattcctccaccaaatttccgttcaactcggacaccgaaattcggttggggaaaagcgagaaaatcattggcacggggctggaaattttgttgaaattttaatatgcgggaaaaattaggatttttgttgatgccgttaattaattactgtgcgattgaatggttttaggaaattagatatacaaatcccgctgatcagtagaaaatgaaagcattgtactcaagaaaaatcagttaaaaatttatatatccttgaaaaagattcagttttgaaaagaggactaaaatgtccttgaaaagggcatagtctcggtgcatttattatccttgaaaagggcacaatcccggtgcccttcccaagtgaagtccaattgtccttgaaaagagatttttagtcccagctctgtccttcccaattgaatgcctccgtaaccaaaatcataaattatatataaattaatttaaaaataaaaaacccaccaaatggcactgttctgctccatttgcttaagtttacgcacaccgtccgcaggcgaaagcactgagaaatgacttccaacctgacaatatgttcacaacaataacgaataaattttttgaaatccaatggcaaattcatattttggctatcaaaaattaaatttaattgctaacaaattggttaacattaaaaaattaaaatgtaattgaaaaaattggttaattatgaattaaattaatcgatagaaatggataattaaaaatgaaatctaatagaaaaagttggataataataaaaaataaatttgattaataaaattaggtaatactaaaaaaaaattaaatttaaatgataaaaagttgggtaataataaaacttgaatttaattgataaaaatgggtaatactaaaaaaattaaatttaattggtgtataaaaagcaccgcaaatgatgccaaatgttcaacattatatgagggtgccgaatgatggttgtggtggtggtggtgattttgatgcatggcattcggtggtgcactgtagtcaaaatcgccagttgcagcagttgatgtgtgccgacggccaaagccgccgtttgacgaagggccagaaaaattgttgttggaagaagactaattggaaatgaattttaaaatacttattaaaaatttaaaattacggattaatattttagcaattctctgactattaaccactttttgatataaaaatgaatcaaattttacaatgaaaattagtgagttttttgagaaaacaaaactcaggattacaggttacggtttttaaagctttccctaattaacgggttattaattcgtaaatacggttacggatttttttaaagccctcagtaactacggtagcgatcaacaagaaaaacaaaaacatctttaagaatgggtgcatgtttagtaaaattactataaattttttttaagtcctaaatggcttctgatcctacctac

SEQ ID NO: 17221 - DNA, 2480 bp, Heterodera glycines
ttatatgtatcaatcacaaaaaatgcttatgcaatcaaatgcttccaagttcaattcaaaacaaaatttgtcatttgtttctctgcacatttttatccactccgattttggaaattcacctgactaaattccgtgcaaaatcatttaacactcaatcacctgatcattctcgcgcccctcctcccaaattcgcttcaaaacatcgccatttcgtccccactgtcatcgtttatcattcattcgtcgcatttatcagcggagtgcacccactccttctcccccccccccccctccttttgaccaccaaaggcttcgtctgttcgagccaattgatggccaatgttttcattgcctttccttccattttatctcattactccttccttcgtctttacaattagccgtgttccttctttcgtccttctaattacctgtgccatcaacagataatataacacagcgtcccatccttccgtcgtttccttcccctcgtctcttccattcccctcgtctcttcgcttcctttcgtctcttcccttcccctcgtctcttcccttcctttcgtctcttcccttcccctcgtctttcttccattcccttcgttttttccattttctcttcccttcccctcgtctcttcccttccttttgtcgtttttcattcattttctcttccattctctttttcatctgtctgtgtgtttacatttttcttctgtgatggatttaaagagaaaagaatgaaattaataagtaggtatatatacaacgaaggaaagtcacgttggaaatgacggagggaaatagggggagagagaggggggaaataaaaggaaaggactaaggacgaaaggggtgcgaagagccactgatgaatgaaatttatttattgctcactgtatttagcataattaccttttcagtaaaaataacggagcaatgagtcacgagaaaaaaaagtccaaaataaggccgtaaataagggcgaaaataaggttaaaaaagttccaaatttaggggtgtaattttttaaattgctcttttttatatgaaataatttcagactaaggcaaacaatctatttttgaaaaatttagtgtcgattcataggggtatatttttctgaaaattttttggttgattcttaggggtatatttttcgaaatttttttgagtcgattcttaggggtgtatttttcgtttttattgcattttttaaataaattttggacaaaacgccaaaataagggcaaaaacttattttaagggcgaacaactaaaagttgtaatttacataaattaaaccaacaatttattcctctaccacttcattaagttctatttaaaccatcaaatgctcgaaaaccaaagttcaaaattaataatgatgggggggggggggggaaaggtcaatatatatgtacgtaatataggtaataattattatgaaattttaaattttaactcattaaatttagaggaaaatgtggcgtgtgtttgcttaaaattgttgttgtgtaagagaagagcgagagatagagagagagggcgaaaggggagagagagagagagggaggggaaagaaaggaaagaggagggtaagggggagagagagggaaaaagaggagagagggggggggagacttgaatatgttaatgtaaagaattactgaatgtacggctaaaacctttccttttttaatggcgagtgcgtcatcatatgaagcaacgtgtgaaccgtgggccaaatgggaagcaatttaattcatgtttttttttggaaaaaaagaaatgtattttggtaactgtttgtttttttgcctttctttttattcttggccaaatatttctaaatttaccaaaaacacgacgagattagtacaaggcctttctttgcaaacggaatggagccaagcaaataccaaataatacacgcaaaactaacacaaactaaaacattgaaatttagccatgccccaatatttaaaaaaataaaatagttaatcgaaataaaagcatcacaagacacagcgacaatgtcctcaaatgcgaacgaaccgattcatagtggtcattttatgacctcaaatccacactcggaaatcccaccagatgacgaggacgaagatgttgaggtttgaattcatcttcggattattcgagtaaacgccaaacccctaaaaaccaaaggaaataatattatttcaatcgtaaccaatttgaagtttcacttcacgattccacttgccattcattttaaggtcgatgttgtcgatgtggacgacgccaattcattgtcagccgcgcaaactgccgacaaaagcacggccaaaggttcgctactaaaagacgaggacagaccggtgaccttctacaaattcggctctcaaaaaacgcaatcgatcgtcatcgaccaatcactgaacaacctgcctcaataaagacgggtggcctacatgaaaatgacaacgccaataatgg

SEQ ID NO: 17222 - DNA, 1139 bp, Heterodera glycines
tttttgctcaatggaggaaattgccaattttgcacaggaaaaaagtcgtttttgttatcattttatttttcaatttaaatagtttagctcaaatttcgtctcaatgcgacattaactccgaatttaacgaattccttacttttgagagagcaccaatcaattctgacccgtttgaatggtggaagaagcatggaccaaaacttccaatgttatcaaaattggcgatgaagtatttgtcagcccctgcaacaagcgtgccgagcgaacagactttcaaagtggcgagggatgtttatgattatcgacgttcgagattaaagccgaaaaccgcagaaatgttgatatttttgaacaaggccatcccaatgttggactacaaatactgatttaattttgttggatgataaaaagttcataaaattttccataaaattttggtttagaacaaagaaaagaaattacgcaatttttttatatttataaatgcatttttaaaatttgaaaaaagcccggtcccgtacgggcgcccggtcaaaattttggaccgggcccgggacgcccggtaaaacgggctttttttgaacgggcggcccgccccggtcaattttcgaagcccggtcccgggcccggtcccggtaatttcaaaattccggtctctaataaatatagcaaattttcgattttattttttggccaaaagggcattttacatggcaataacgtaaagttatgttaagcaatcaaaaaaataattaataaaaataataaatttatttttccgaaaaactttttaaatttgtaaatttttatttattagtagggctgggaataaaaatcgccaatcacgaaaaagtcataaaaaacatcaaaaatctcgaaaaaaatgtaaaaaagtcgtgaaaaattaggaaaatgtaaaaaagaataccattattgaaacaattatagaatagcattttacaaaaacgattaatttcggttacaattttccaaatttgtcatattaaaacgcattgtaaaatgggacatggaattgggcaagacttcaacaaagtaacctttttgtcgaaagaatcggactgaaccgtcgtctctggactgggatacagcgctgcgcgctttttgagcttcgctatctc

SEQ ID NO: 17223 - DNA, 1766 bp, Heterodera glycines
  misc_feature (22)..(22): n is a, c, g, or t
  misc_feature (45)..(45): n is a, c, g, or t
cgttttagtcagggtgtcgttntagtctggttagctgttttcacncacaaattaattactttttataaatttcttttgtttgtcaatcatatacataaacataactttaaaatgtctgtttagctacaaatcaaatggaaaactccaatcaggaaataaagacaaagcgaaacaagcagaagctggaacatgagggtgcactttatgttcttcaccaactcagtgacgatggacttcggaagtactggcgatgcgagtttttcgggcctaacgacaaatgcaaaggtgtatgcaaaaataaaataaagactatttttcaaatttagggcgccttcacactgatattcatggtaatgtcctcaaaagttcatggacaattacaccggaaggccgtggttcaatggtggtttgacagtgccacggttcgcaccggaagaatggagtgtgcatcaacggacgttggatggaggagacagaaccaacaattacgcagaagcattccatagaaaacttcaacaggcatttgattgtacccatccaagtgtcttccacttcatcaacacaattcgatgtgagcaaaagtcaattgatgcattttgttctccctcttcaacttaccgtgtccttccaccgtacactgctgctgtttgccctctaccgtatactcctccccaccgatgtcaccgatgacaaaaaagcgcaaaacatttccctccgcagaacagccataattttgcgaatttgaaacatttgtgcatttaaagccaagttgattttcggggtcggcaacagaagaatggaattgaatagaaaatgccaaagcaatcgaaatgagaaacattttctaaaggtaaaaacaaaattattattttaaattatgatcaaatttaaatgcaaaatgaaaatttctgagtgaattaattgagcagtgatagccttttatgcagaattttctacttaatgatatgaagaaatcctactcattgacgtaatgctgagctgatcattgattggaaaatattatttaagcattatttccataaaataaagatgaattattactatttctgtgaattattactatttctattgctagaaataaatgcagaaaaaataaaatatagtgaatttcgatttttttaataaaagggcattttcatggcaatgatgtaaagcaaatgttaatagcaggtgggaataaaattattttttaaaaatgataaatatagcaaattttcgattttattttttggccaaaaagggcattttacatggcaataatgtaaaggtaatgttaagcaatcaaaaaaaaataataaaaataataaatttatttttccgaaaaactttttaaatttgtaaatttttatttattagtagggctgggaatttaagtcataaaaaatcgccaatcacgaaaaagtcataaaaaacatcaaaaatctcgaaaaaaatgtaaaaaagtcgtgaaaaattaggaaaatgtaaaaaagaataccattattgaaacaattatagaatagcattttacaaaaacgattaaattcgattacaattttccaaatttgtcatattaaaacgcattgtaaaatgggacatggaattgggcaagacttcaacaaagtaacctttttgtcgaaagaatcggactgaaccgtcgtctctggactgggatacggcgctgcgcgctttttgagcttcgctatctcggtaagctattgggttgtgaaagaggtacaacccacgggtggaagtttaaattaatt

SEQ ID NO: 17224 - DNA, 3688 bp, Heterodera glycines
aaaaaacggcggacggaaaaaagggaaacaatgaaagggggaggaatttaccagaaaagagaacatttgtcaattgtaagcaaagtgcaaaagaacggagaaaagagagagggagagagaaaacagtacagggaataatgatacagtatatatttattacacattcaaacgcttgcggccaaaacaaaagtcagacgatcggttttgccagtggcaaataatcggccaatgccttacgaagtgaaaagtcggggccaaaagcgaacagagaattctcatatttgtgaagaagttcggtggcagaagggctggaattcatttattaactactcctaattaactaaactaattgcccctcccttttgtattattttgttttgcgttttcttcactcaccgcctctgttccaacacttcgcccaataattcgtgcaattcctttgaaaatgtccgccgcccgaagcactccgtcccctcacagtgtgtcgagtccaacaaaacgggcgccgatccgctgagcttttcgtacaaaatgcgaaggggttccatttcttggaagggcacgacgccattggccaattctcaaattcaaaaacatgacacacaatcattctaatgattttgcgaaggattaccgcaaaggcatatcccaacgctgtaaatgtcggaatcggcaccgtatccgttgaggtccttacagtaagcaatcaacgaaagaaagaatcgccaatgtttccccacaatttcactgtgcccacctgcattagcacttccggggccaaccaagcgaccatttcactcaaatccgacgtgaattcgtgcactctgtcctccacaccgatcctttgaatcaattggaaaaataaaaaatattacgacggatttattaccatttgggacagtcggaaattcgggtggcatggcgagtgagcgcacttaaagcaaaaaaaggggggataaagaagggattggcattggttggactcacagacgaatttgaccatccgagtcgagccaaatgttctcggcacaaacgctccttcagagagaagagcaaacgcataaaaggaaacaaagcgaagggaagggaataatgacctgtgaatgaccccgcgcgagtggaggtgttcgagtgcgtttagcgtcgccctgagaatgacacgaagcgccgactcgggcaaaccctcggaataaaatgcactgagcaaatgggcacaatggccaagatcggcacggaaggagcagcggaggaaggtgcgttcggcatggacaaaggggtcgcagaaaaggagcagagactcgtgggacatggacaaatgggcgacgattttggcccgtttcttcaatttttcagttccgagcgttccatggaatttgcgtccacctttgctacgacggtggatgcgctggcggggcccaactcagccaaaagtacgcgacgccccgttgcagcggaaacgccccaaaggaaagtgccgagccgcgcttaaaacgacagagactccaagacggaatgaacaaatgccgcattagggcactttacccgggttcttcggaacagagacagtgccagacgctgaagagttgcccatcgttacggcatcagtgtatggcatttatggggccacagaaaaaagaggggaaaaatcgcaattggccaaatgtaacaaaggaagccttaacggttaattatcattttattttctcgaaaatcaattttataaaattaaatgatacacaaacaaaataaaaaaatctatgaaattcgtaagcaaaaaaattgaacgccaaatcagccataacaaatttacgaacaaaatcaaaatgtctctcagagacgagcattggaattgtaaaaatggcacccaaagaaagggcaacacacaattttattaactcattcagtgaaaatgttcataaatctctcaattcaaagaatctccatatttgaagaatttgtaatggtgcaaatttttggtttttctttgtgcgccgattctttggaaataacacaaaaaaggaaaatgaaagattagcttcgtaaaccggtagaaaggagcgcaattttggctgaatgggctacaaaataaaagtaaatgaaatcaaaattcatctagaaaatactataaaaatatgcaaaaatggaaattttgcagaaaaagagacagtgaagtcacaaggaggaaagaagacaatatgaaccagtggaagacaatgacagctaatttagccattcttttaatgagtaatcacttatcaatggattcattccccgccccccgcaatttgtcacgagacggggacgtccttcagcttggcatccgtcaccaattcctgcataaggggcaatgccgagactgtatgggcgaggagttgagccggagcattggcggcgttggacggtcgaatgattgtgcaaagattgggctttgccgagtcacacgcgacggtgtaagtgacattggaaggcgatctgagcaaagggaagtcaaaagcaaaaggaatttggaagggcacaaagggatcggaatgttcagttgtccgacgggcaacggcggcagctccaaattccatccgacggagccgaaactgtgctccgactcgtcatggccatgcagcacagaagtggccacggtgaaggagacatggctgaaaaaggagagaatttggaggaggtgagaagaaaagtggaagaaaagcaatgggaccaaagggggggggaaggaaataaaggaaagaacacacactctaaagaagtccatccaaactgagtttattcgatacgaataacgcagatgggagtccaaaaataaacggataatacaaagcataacagaaaagttaatagagtaaaaagaaaataataatggaaaaattgggggggggacaatttgatacaaatggaggaaaatgaaaagaatggataatttgagaaaagcgaaaataaatgaataatttgataaaaatgaaaagatgaataaatagagaaaagcaaaaatgaataaatagagaaaagcaattgtggagatgaaaaagtcagtgggaaagacatttctgctcgaggctttgacttcattgaataacattctcacggttttctaaaattgttcaagtaaagaccatgaacaacaaatacaatatgaacaaacgattgtgagactgagaacccttacgaacgaaggcttaccattccgaatcgtcctcttcagcggtcgttctggaagagtgacgacactttttgtcactgacaattgaaccatcattcgaatgaaacgtaaatttgtgaccaaccaaaggctaccaccggacacaccttttgctgtgctcctcctctgattcaaaggacgtttcggactgtttttggggagatttgccttcagatgaagccgtggcgttggcggtgttaaaggcgttgatattgtagaagccggccccactcataaagccaccggattccattggagaagtcctaaaagggaattgtgcaaataagtcacacccaagataaacagtaaccaatttgtaaattgggagatcagaagcggtggagaaccaaacggcggtgtcgagccgtaaagaaagaccggctgaggttggactgggattggaaaggctgcggaggtggccaccaaacgagtgttggtcggactgaattggtagttgggcggggaggtggagaagggcgagtc

SEQ ID NO: 17225 - DNA, 874 bp, Heterodera glycines
tattttaatgcgtgtaaaaaagcttggctgatgggcccaccctctttcttaatagccgcaattacctgctggtctcaaatgtcggtgctagggcgaagtgacaaaagtatcaatgattgaaatatttaaattttaaaaaattatattagttgtttctgaaaaatattactaaggaattaaatgtcaatttttattgtcataaaaatacaaggttgtttaaattcacgaaaatagttcaaacttcaattcattcataaaacccttcatttgattagtagggctgccaaaaatatgcaaatgcatatttttttcctggcttctccgtgctctaaatagtaggaaaaacactttttttttgtgtttgcgtataaaagtcgggacttttatttgcatattttgggtttttatgcatattttggcttgttttacattttcatgcatattttgccattttttgtgcatattctcagatttttttgcatattttgccatttttcgtcaaatatttttcgatttgaatatatcttagaaaaaaatttgattatgcttaaaattaataaaaattttgaatggatgcgcgagtgggtcaacagtgaattccatgcgaaaaattgaaaaattttgatttgaaattgcaaaaacaaccgataaatttatgaataaaaaatttttttttattactaatttgcacccctaatttttaagtttttttgttcatatttggtgcatattttggccacttttcgtgcatatttttggcagccctattgattagatagcccaagacttctctgttattctgtcaaatttcaaaaaatttattgagtttaaaaaaagttagtgtcaaaattttgttacaattttgtaaaatttt

SEQ ID NO: 17226 - DNA, 1768 bp, Heterodera glycines
atttggggttgactgtctccgggcggtccctcctcgtccgttccgcgcctccgtttgccgcgttactcgtcggactcggactcgccccgtagccactttcatccgttacggcacttttaaataaattaaatatttaattcgaaaatgcctttaaaatataaagtgattttgtgtaccaaatctatcttaatttagttgttcgaaaaactcttttatgtttttctttgaaattgcaaaagattaagaaaattataaaaataaattctaaaaattaaaaattctctttttttaatttttgccggaagggcgacgatttgccggtaaaccggttcgaggcgggggggggcgggtttggaattatattccctacaatttcgttttggcatttttgttttaaattaaaacaggtttatttttaatgatataaaattaggaccaaaggtttttaaacgaaaaaaaataaaaacttaaaaaattacctattttacatatttcttaattaatttttgataaaaaatgctctcaggttcgggtcactaatgaaggcccatttccaaaatgcaccccgttgtccgattgttcggagtgaccaaaagcgtcggctgcccatagattcgcctggtcgacttgtaaatgtactgaaaagggactgtcttcaaaaagcatgaatggaattaattgagccaggtccctcccttgttaattaattgattgtgagcgtaaaagtggcacttttcgtgccaaacagagtgaaatgataataacggcacggcttactgacgggattgtcttcggctgaccagtaaagagtctgctcctcaattggccgaatggcaatttgctaaagggtgccgaaattagaagaaattagtaatcattaggctgccaacatgtaaagcggggctttggtaggcactgcccaacaaagtgccgtccccgccgttgcccatccaatggcattcgtcagccactgagggactcgaatagctcaggtaactgatgccggcggtgccatctctgccgacgacggaataaatttggcgctgctgctgctctcgccagtgattaagcaaatgcaaagagctataattaggcaaaataatatgcaattataactcaataggtttttatttaaaatgttaaatcgcttagctaaaataaatttataaaatttagcattttaaattttcaatacctaatcaaatctgaaaattttaaaattttggtgatgattcgaaaaaataatggtgaaagttgcgcaaaatcaccgaaaatgattaagcaaatgcaatgagctataattaagcaaaataatatgcaattataactcaatagatttacagaaaataatgaacttcttaaaattgccaaaattgcttagctaaaataaaattattataaatttagcattttataattttcgatacctaattaagtcttgaagatttgcaacatttttggtaatgattcgagaaaattatgatgaaagttacgtaaaatcaccgaaaaatgacgacagtcccaaaaatcacttggagggcacacgcgagggcggaggcggaggcgaaacaaatgcccaaagtgatcagagtgcgttgggcgatgttcagcccaatggccagccgagaattgagcagaacttgctaatcataatgaatcagagaaggaaaattgaactgattaatagggttggcaattttatgtaagaaaatttgcaaaaaatgaacataaatatataaataaatttaaaatgggttttttttttttt

SEQ ID NO: 17227 - DNA, 1565 bp, Heterodera glycines
  misc_feature (1218)..(1218): n is a, c, g, or t
attaattttcaacgttattttcaattaataaatggaggctttaaaattaatttaataaatttataattcatacaattttcatcactgttgaacctcttctgatcactattgtacctcttttaattcacttttgtacgtcttttaatcacttttgtacatcttttaatcactgttgaacctcttctgatcactattgtacctcttttaattcacttttgtacgtcttttaatcacttttgtacatcttttaatcactgttgtacctcttttaatcacttttgtacctcttttaatcactgttgtacctcttttaatcacttttgtacctcttttaatcactgttgtacctcttctaatttaaaaacgggcgcgaagcgcccgtctgagctcaaaaaaataaaaaacgggcgcgaagcgcccgtccaagcacaacaaaatttgaaaaacgggcgcgaagcgcccgtctaaggccgagaaacggcctaaaaatcccagataatcttttaaaaattccaaatctcttcacaacgcaatagcatatctaggtagcgaagctcccaaagcgcgaagcgctttttcccagcaaaaaagccgacggttcacgcacccgctagttatatatacgttagaatgataaggcaactcatctcaaaaactaattccggccggccgaaggccggccgtggtctgaaagtagtggaagggtcttacaactttttgaggagaattcgggaaaactataggtttttttctccgagggccaactgagtcccgtcggctaatttctcacttttgcttgcgtttgaaggcccataactttttttctaaaactctaatcaaaaagtttccgctggtaggaacccaagttgaagtgttttctaaaagtcaaaaaaaattccaggcctctacctacagtaggaagggctgcagaaattggcaacttttcagtaccaactttgtccacttcagtcccaggcgaataactcgccagggtttgaactgagcgagggggtgccagcagacttattgtagagttcaatgagctggatttttccaaattttaaaatttcgaaaattttcaaaatttttcgagctaggcctaaaaatcggttttcgggtttttgaattttaggattttttaacgaattttcccagaaaaacggagaccactttcaagcaaccgtttttcgagctctatcgattggtgatatttttganaaaatttcgattttttcccgcaaatagaaaaaatttttggcctgagcgggacatttgagtcctgcgctcataactcgtcagggattggttttagcgaaaaattgtcttagacatttttgtagaactttttagctctatcgaatggtgtactataagtctggaaaatttcaaaaatttcgagctaggccccctaaaaattttcaaaaatttttttggggccgaaaaaggggggggaaaatttttttctgggggatttttggggggctgaatccaaaatgatggttaattttaagttccggaaatttgggaatattttaaaaatttctttattttttgggaaatttttt

SEQ ID NO: 17228 - DNA, 1757 bp, Heterodera glycines
ttttctggggattttggggtgctgaatacgaatatgatgtttattttaagtttcggaaattttggaatattttaaaaattctttattttttggcaattttttggccctctggaatttgggcgaatattggaaaattcataactcggtgatggtttcatcgatttaactataataaagctttaaaaatagagaaaaataaggagaattttatgggatttatttgagttttttatcacaaaaaagaaaaaagttattccagaatttctggaaattttcgatttttcagaaaaaaatttgtagctgccttctgaaaagctattcgggaaaagtaaaatactacaaaaatccgcaatttttttctctataatataaattttattttacatttttatcacatttttaaaaaaagatacaaaaataaaagtgattttgggattcgggaccaaaggggggtgacaggatttttgagtggaaaatttttttttcacaaaattcttccaaaaatatgtctttaggggttatttgggccgctgatcacgaatacgtgatcagattttacttttgacatagtcaagacctcagaatccctgtgtgattggggattctgaggcatcattttgaggggggggggggcaggttcggatccggacggtgtacattaatttactatgcattttttgcttacttttacattttttaattaatttgaagattcgttttaatttatttaaatttatttttttttaaattaaaaaaattattttttgtttttattaataacaaaataattttaattaaatttaatttttcttttgatgaatagatttatttttaagcaaaattagatttaaaaatttggttgcataataattcatttcaaaacaaagtaaaataaattattccgtttattaattaaaaataaacttttacattttttattatttagttttttttaaatttttaaataaacctaattctataaaattatatttaaaattatgaaattatttttgtacatctcataaaaagttagacttttgtacctcttttaatcactgttgtacctcttctatttcctgttgtacctcttctaatcgctgttgtaccacttctaatcactgttgaacctcttctaatcactcttctaaacgctgttgtacctcttctatttcctgttgtacctcttctaatcgctgttgtaccacttctaatcactgttgaacctcttctaatcactcttctaaacgctgttgtacctcttctaatcgctcttgtacctcttctcatcactgttgtacctcttctaatcgctcttgtacctctctaatcactgttgtacctcttctaatcaattttgaccgcttctatttactgttgtacctcttctaatcgctcttgtacctctctaatcactgttgtatctcttctaatcactgttgtacctcttctcatcactgttgtacctcttctaatcacttttgaccgcttctaatcacttttgaccgcttctatttactgttgtacctcttttaatcactgttgtacctcttctcatcactgttgtacctattctaatcacttttgaccgcttctatttactgttgtacctcttttaatcactgttgaacctcttctaatcgctgttgtacctctctaatcactgttgtacctcttctcatcactgttgtatctcttctaatcactcttctaatcgctgttgtacctcaaaatttaaaaaacgggcgcgaagcgcccgt

SEQ ID NO: 17229 - DNA, 2819 bp, Heterodera glycines
tagtcagcgtagatttcctacgctaggtttttcaaaatgatccgggaagcgatttctcactcccttttatagactttgagctcgagtatgataactacattagcctagtgtaggaaaggctagtgtaggaatcctacgctatgtcattagtcagcgtaggattcctaccgctaggtttttcaaaaatgatccgggaagcgattttccactcccttttatagactttgaaggtttattttttttatataatcaacacaagtagaaacagtacaaatgcagaatctacactctacactatagaacactctacactatagcacctgtaaaagtgactgcggatgtgcaatttcgctgcgcttatatagactttttgagagtagtgtaaagtgtagtgtagtgagtctctacactatagaacacacctacactctacactatagaacactctacactatagcacttgtaaaagtgactgcggatgtgcaatttcgctgcgcttatatagacttttggagagtagtgtagagtgtagtgtagtgagtctctacactatagaacacacctacactctacactatagaacactctacactatagcatctgtaacatagctgcaatggaataatagccaaataatatgcagggaaataatgcatagctgaatggaataatagccaaataataggcagggaaataatgcatagctgaatggaataatagccaaataataggcagggaaatattgcatagctgcaatggaataatagccacatattaggcagggaaataatgcatagctgcatggaataatagccacatattaggcagggaaataatgcatagctgcatggaataatagccacatattaggcagggaaataatgcatagctgcatggaataatagccaaataataggcaagtaattaatatgggatgatcaaatgcgttgtacgtagatggataataccagatttagtagcataaaacccaacatatgaccatataaacatatgcataggttttatgccacaaaaaatgtttttttccatggaggtatttcactccagattcgcagcacacttgagcggcaccagcacctgaagtttaaagtttagggagatttgaaaagtaaagaataaataaatatataattaataatattttccataaaaccccatattaactttaaacatattttgtgcgtgtcttaaaggttagtaatttaaatttaacgccaccctgcccacttgaggaatagtgcactttagaatggtgtcttaaaacagaaaactaaccaacaaaagaaacaaagcgccaacaaaattaccaaaaaaagtaaacaactaaattttaaaatattgaatgatggtggttttaaattatgtcggtttaaacttataaaattttattaaaagcaagtcttagcatttctaatcataaataaaattctgtggcaaaggcaaactcggcaattatcgcaaaccattcttttatatattttttgaatattagaaaaaaatgtatttgtttaatttttacagtaagcagtacacctcaggtggtcccaggcacatttggacaccagcatgtttttggactataactaattttctttgtccacctaatacaaaatgttgctatttgagagctttcagatattagccagaaaattcaaaaaagccattaattgttaacaaaatagtgaccaaaaacctgaaaatcttttttttgtgttcttctggtcataactcttttgcaacacaaataaaaattaataattttgcaggcctaatagaccacatttacatgtaccgaatgataccaacaatgtcggattaggatgataaaaaaagttataaccaaaaaacggctggggtccaaatgtgccggaacccaactgagcaactcagataatcacaccacaaagtcttatttgaagaagaaaggctataaaatactctgcaagttaattttcgcacataatttttgtgaaaataaataaacattagagcaataaaaattaaactgattttgcgttttttggtaactcgaaggcgccgtgtttaaaaaaattcttagaatccaaaattaaccaaactggaccccaaaaaacccttagaggatccctcactccaaaagagaagcgttctcttttaactgtgcctgattgccgtattaataagcgcacaagtcagcagttagagcacccgtgtattcactgccagactggtagtgtgaatatccaattttcagggaatcatcggtgatcaaatcctcatcccttcaaactggtgggtggactatctgtgcgacccaattgcacagattagtctgagggtatccaggacgcctgactcaattagcgcctggatattcccacggaaacccccctaaagtgtcaaaaaaactcaaaataaattgtgcaaaaattgttagatgtgatacgtgatcgttagtaaatttcttaactcaatactcaatgttaggtgcaaaaaactaaattttatgaactctcagttaaaagcagacttgtagacaacgaagaaatgccgaatgtagatggtgatggcgagcagatgggcaagattcaacttataaaaatggaaaatagcaaaaaaaatttgctcaccagtcaataggctctgcaaacctatgtcatcccggatgttgctcttcaagcagaatttgaaagatgctctatcaaatagcatcaatttcagaattttaggaccattttggctttgacgaatttttcaatcccgagaatttaaaacggtttttggcccgcccaaaatggtcctaaaattctgaaattgat

SEQ ID NO: 17230 - DNA, 2529 bp, Heterodera glycines
  misc_feature (169)..(169): n is a, c, g, or t
ttttcaagtatttattgtaactaagacacacaccatcctggaaatttcaaggacttttgtttttaaagggcaagatttaaatatatatattttttttttgtttgataaatcaaaatccgaaaaggactcccgaaaagttacaaattttgcccaaaattacggaaaaatntagggaacggtttccgcgccacactgatatacatgacaaacgattagccgtcgctccgcgcttcattcgctctttaaataattacgatcgccgtaactcgcgcgtttcattcgctccattggcttgctgtcgctcagcacttcactcgctctttaataattacgatcgccgcaattcagcgcccttcactcgctcccgtgctgtcgatccgcgctgcactcgctctttaaaattttggactccttcactccgcgcgtttgactcgctccttcagctcgctgcccatggcgcttcactcgctctttaaattttggactccttcactccgcgcgcttcactcgctcattcagctcgctgcccatggcgcttcactcgcacttccttcactccgagcgcttcactcgctccatctcgctgcccacggcgcttcactcgctcactcttatcacgccgcttcgttcgctctaactttggttgtgtattattattttagtaattctaaatttatttattaattatataattattttttttccattttcttaaatgaataaaggttctgactgatctagaaataattactaccaaacaataaaatttaattgttttttccctctactcacttttcttatttggccaaaatgagtagattcctctgtttctctggcattttgctaattacgcacaaacattcactatttttcttttcctttcaatctttttcattcaaattacgtgcttccactatttctcaatttctttttatctctggcaaattgccaattacacaaacattcactattttcttttcatttctatctttttcatccaatttgcatgcctcaactatttcacagtttctttatatctctggcagttgcaatttgcatgcgctgtatttcttaattatttttctttcccatttaattcccatactattttctcaatttattattgctttctaactcaatatctctctttttcctttatatctttatactgctaaatcttttactatctcattttccattttttcttttcccattttttgctctctctttatattccactgtgtttccgtgtaaaaaaatttacatcacaaataatttacaattatgaatgctcagcttcctttcgcgtcactgtaaatgtgggtacaatttagtcattgaatttttgataaattttaatggattaaaaattatagaattatttcaccattagattttattcattcattattaattttaatagaaaataatatttgtttaattattttataagtttaaaatttatctcttgaaatttattaactataatttagattttgataaattctttaattttttttcaaaatttcactgtgctagctaattaacatagaaaattaattattttttttcgtaaaattttttaggtatccttaatctgtttaaaaatggtcaaaatttccaatttttcccacggcggcgcctatcggcactgcctcgcctcaaaaaaacgattttacacctaaaaaattttttctgctcatttttcggctatattttcgaaaagaaaaaatatttaattgttttttattttcattttttggcaaggaaattttcttaattaaatttaaaaacgattttacttttacctactttaataaatatataaatatttttcttttcccaattttcaaaaaaaaaatttctcaaccccctcctcccccattctaaccagtgcataaaaatttcgtttttaatgccaaaatacaaaatacgaaacacgatacgaaaggccaaaaaaaacgaaaacacgaaaacacgaaacgataaacatccctgctacatacaatttttgatatatatttttttaaattttctgttgtttaaaaatgaacaaatattttattgtcctgataatttttttaaaatttttcttaatttatttatccatctgtcatactattaattgaaaacgacaaatgcttttatgaaacattaatttgattctgatcttttaatttcctttaaatgtgttcaaactttcgaatattatatataatatgtatatatatttgttcgaaggccatttttcaatattttaaaaaatttgttacaaagttaatttaaattttattaaaaaattctctctcgctctctctatctctctatctatctctctctctctctctctctctctctctctctctctctatctttctctctctcccccccctctctctctcgctttctctctatctttctctctctctccccctctctctctctccccctctctctcgcgctctctctctctcgcgctctctctctcttgcgctctctctctctcgctctctctctctctctatcttt

SEQ ID NO: 17231 - DNA, 2488 bp, Heterodera glycines
aaattaattaattaaaaaaaaatattatgcattaggtaataaaattttttaaataaaatgacatattaaagaaatgttgtttttgtataaaaaaataggattttattttcattttaaaaaactaattgttttatctattcatttatttttttacctgactccattaatttaaaatatttttacaaatttatttttttaaaattatttttgcccccccccctaatcaccggacaatgaccgtgccattcttgcaattttcaccgtttcctcctcctccctctccaaaatgccatcgccctcttccatcaattctgtggccattttttgcgctaattggccaaatgtctcggcatttccgttcagcagttgtgccatcgaaatgctttccatctgcgcaactgaagcgaaaacgatgtcaaattggtggccggagcgggaaatgagacggatcaaagggaccgaagtgttggcaatggcacggacagagccaaagtcggcaagctgaagaacgggcaggatgaagcaaagatgaagcatgcttttaagcgaggagaacccctcgggattattaaactattatttttcaaaaaaaactaagggaaatttttcataagaaaatttcaagaaatttttttaatttctattttttggaaaaaaatttttgaaaaatcttagtagttctctgaaaaatcgttatgaattaaaaaatttttttttggattttcttatgaaaaattccctgtgaatttttttgtaaatcttttttaaattttttaaaaatttttcgtggggagggggcggaaatggtgggggaaacgacggagggaagcggaaaatctgaaccgtattttacggccttttgattcaggcacgatttggcaacagatgtaagtctcgatttgcaatacagtgaaggtgaagcttgtctttaggcgagcgaaaatgagcaaaacaaacgaaaatcccctcacccaacaaaagcaaaatgatcaattgccggaaatatattacctgaccaagcatgtaaaacaatgagtcatcttcacacttttgcccttccttttcttcgccgctgctcaaacagtgcaaagtgccaaaaaaggcgtccaaatgaatgtgcgccggcacaatgcaaacggtgtcaatgtccgagtccgccgtttggacgcccatcagagaggagccgcccaacagcagggcaccggtgccatttgactacaaaaacagttcactgtttattcagcattttaaattaaaatttaattggcattttaatgggggaagggcgagtagttggtgggaatttctggcattttaaaaccgaattaagccacgaaggaatgggttttggaaatctcacccatttggcgacagtgtctctgattttttccaattcttcttcaatttgtttttgcttatgcatttcaatgccatcaaagccatttgcccgcagaatcttgatgagctaataaaataacaaaaattaatttaatcattaattattaagattttttttcgtcaccaaatttgtgtaaatgtccgtttgagtgttatatttgatttgctgcatattttgtacgtaatttctgtccaaaatttgttctgaattttgtttgttatattcatcaaataaacgttcatctaaaattaattaatttaataattattttatttacaatgtgccaacaaatattaaaaaaggccacaaaaattgtaaatttatttaaaaaattatttatttttatttatttatttaattaattaaagaaaataaccgaacactgacccaactcagtctggtcgcgcaacttcttccatttggccaaatatttgaggaactgtgcccgagtgttactgtactttttgccaccgtctctgccacctcttcgtcccaacagtaccgtaatgacgccaaattgcacctcgtccgtcaaattgtgccacgctgcgcgtgccgtttcgtcatccccactgatcagtcgggcaaagttgttcctgtgcaattgatcacgaattgcgatcagttgcggctcgctttcgatttgatcactttgcccattcattttttggtcagttgctggcacagtcgttttctgatcatttgcatcggttactgtatcatttcgttgctcaccaactgtattctgctgttgataatttaacgtaattagaggcagtggtgttttctttttccgatgacttttccttaacttctgatcactttgtttatgcattttttcatcacttttcccattttctttccggtcacttagatcagttactgtatgattttgctgattatcaattaaattttcatgatagatccgattaattggcattttgccatcatttgtaattaccatattatttacttttcgatcactttttatcttatttgtctgatcatttttcaatgcgattccgatcagcagaatttcctttaacattgtgcagaattccgccctaaactttcgcatttttattattt

SEQ ID NO: 17232 - DNA, 574 bp, Heterodera glycines
cgcttcagacgttggactgttggccgtagacgaggctcatttcatttcccaatggggccacgagttcaggccgggctatcgccaaattgccgatattcgcaatgttttgaccggtgttcctgtcattgctttaactgctacagccaccgacccggtgagaaatgacatcgtccaaaatttgcgactgagaaacccaaaagtgactttgtccgcatttgacaggcaattttcgaattctttttttttgtgttttattagagaattataggaagaatttgttcattgaagtgcaaaaacgaactcaatcgctgaggtggcgtttatcatcattaatttctaatatgaggtcgaattcgaactttagtttcgaaaaatgcgtacagaatgacttggaacgtcttctcgaggatgacccgaaaaccgggccgaattttggtggtccaacaattatttattgccaaactcgggaactcgtcaaccaactgacccagcaactcagaagtgagcggcggatatttactgtacttttttgcaacgactcattggcatttgtctccattgcaatttaaggcgt

SEQ ID NO: 17233 - DNA, 1444 bp, Heterodera glycines
ccttcctcaaaaagtttttggaaacaaccgcgccgcaataaatggtttgaattagcaacaaaaaaaaggtcatcgccgggagaaaaatatggaccttcgtataaaaaattggtcccgagacacacccccccccctgtcccaagcgtccgtcgtatggcccttgggccaagacaccccttgcacatgtatggaaagggacatacaaaaaccgggcccacaattttccattccttttaaaaaccaagcttttcagcatttggaactgattccatctgaatatttgctgtcccttctcagtaataaaacaacggcagagactcgggaaatttgtaacaaagcagcggttgtgcaaatcttctcagaaaagtatttacaacaaattaaagaaatagcaaacgaagttcttttttaagtttacccatttgaattgcaatttaaactctttttcaaattttaatgatttcttttcaattttttcaggaaactaaacgaaataaaggggcggacttacaaagacggcactttctatccctctctgatctccgaatcggtctcatcaaacattgaaacatatgaaaaggtgcttttgctttttacatgtcttttccattccatgcaactgattggtttttttcagcttcccgaattgcgaaaggaacttgaagacctccgttatgagttgtccttgcaaatggactgtgctgccaattccgtcttcagtaacaccgtcgtggaggaattgctgagggttcgtccaacaaagtcagcaaaagattttaaatgctcccctgtcgtgatttaactcattttttccgttttcagtgaacggagtcttgccaaagttgagggccttcccgaacagcgtcggcatcagttctctgctcagattttggctttgatttccgctttctgtacctccaataatttgtcgtccaatcagtgcggctcctccatcggtggtgaagtgccgttggaattggatggcacaatccgtgagcagttgactccgtccgagcgcaattcgtacttagcccatctgttgggacggttttcgctggccgtgttggccattcggttcaaattgaccgcctcaacaattgcaaatcatttgaattctgccgtccgcaaaggccttcccgtccatttggatgtgctcggcatcagttcagatttaatcgaaacagtgtaccaaaaagtgcaggagaacagacggggtatgtcaattaattcgaatgttgtctataataatatatgcaaacggggggaggaattcaaacaaaaactttcatcaaagttttaaaaacgcaaatttttgtatatttaaaatatcaagatatctctacataaccttatgctaaagcatttttcctgcacaatttcatgtgcattctgacaatatgaacagtttgaaaagcaacttaaattctaaatcattctattgatg

SEQ ID NO: 17234 - DNA, 3368 bp, Heterodera glycines
atttttgttcatgaatttggccaattttttcggcaaatattcaccatttggacttttcccgtcgtgatcatttggacaatttgcgtcttcgcacttcgccgacaattctcactgatctcaaccaattgaattcaatcaatttatatggtcggttgcccgctgcgattggtgatggttttgattggccaaattcaacaatttctgctggccaagcattgtccaaatggttgcactctccgagaaaagatggccaacccaagcgattgcgttgttggcaagggaactttgaatggatcaacaatttcaaggaggtgtggccataatctcgaaaaatcactgatttttgttttcaaattgtttagcattttcttcgtgccaatgccatttcttccgtcagttaccaaattcatttttctgttcatgtgccatcaatggaaatggtgccatttgaattggtgaacgaatgcacaaaggaaaagctgacattggccaaagcaaatgaaaatgaattggacaaaagttggataatgaaacgctgcaaaattggagagacagcggcggtcaattgggaagacggaaattgggacaacaattgcaacaatgtgttcttttggctttttagtggcactaattgcatcgggtgagcaatttaaaaacatttgatttttatccgaatttgaattttgcgcttaatttaggcctttgtctccgccaccaccagcgagaagacgaagaagcgggacaaagcatcacaaagggcgaaaccaacgcattgaaacgtggcgaaagaagtgccaatttgaggccgagttgaggacggtcaaaactggggaaaatgtccatccaaacgtcgttgcaaatccaactgaaatggaaaaacagtttagttaaataaatgatgaatagggatcggatttttagtgataaaaaatcccaaaataattaactaaatagtgagaaaaaaattccaaaatagtggcaaaaatagtggcgaaaaagttccaaatttaggggtgcaattttttaaataggctgttttttaatttgaaaataatttaaaattaaggaaaaagattttattcactgattgcagttacaaaatattttcttagaaaatattgaacaagaaaaaaaaatttgggggaagaatttttgtgaaatttttccaattcttagggatgtatttttgaaaatttttaggtcgattcttaggggtgtatttttgaaaaatttttaggtcgattcttggggtgtatttttcgtttttattgcattttttgggaaattttccaaaaaatgccaaaatagtggcaaaaataatgacgaaacgccaaaatagtggcaaaaaattattttagtggctaacttccgaaatagtttttttttagtggcgaagctccaaaatagtgattcctagtgatgaatagtggcactaaaaatgaaaaattttcgaaaaagaatgtgtttttcgtgcatttttcgtcgagttaaagccgcagaaaaaatagttaaaaaactaagaatccgatccctagtcataatcatcagtgatcaaatgccttttttgatgaataatgtctaaattggtaaataaatcggacgtataaaaatggcaaaaatcttgcttcgatttttccttttcctctctttctcttccgtctctcctccttccccaatgctattttcatcctttccctctctctatccgtccaattgattatttgattgattgatttgtgggtggggggataaggtaaaacgcccggcaaatggtcataattttgcaaaatattctctttggtggtcctcctctcctctgttgcgttccattccaattcactgtgccattccctttttcttctcgccgtttcttcggtcggtgctatgatgttggtcaaaaaaccatcaattgtagcaatttttttcaatatctttacttaaaatcaaccaaattttaattcttatatcattcaatagctctagttgttttctattagcatgcaaaatttcaaaaagggtgtgcgtacgtttcgcctactggacatctcgcctactgacacttcgcctactggacatttcgcctactaagccaaaatcggacgttccgcctactcacctaaaatctgacattttgcctactaagccaaatacggacgttccgcctactcacctaaaatctgacattttgcctactggacatttcgcctattgaatatctcgcctactaacctaaaatacctagctctctcgacagcaaatttcaccaaatatatattctaatttgacatataattcgctatatttataatgctaatgaaatttagccaaaaaaagcaaataaatttttcaaagaacacagaaagtgtgcatctccattagcttcttaatcactctctttgttttccatggatgtgaagcctttggcttagtagacgaaatgtccagtaggcgaagtgtcagtaggcgagatgtctagtaggcgaaatgtcagattttggcttagtaggcgaaatgtcatcgtgccttcaaaaaggtttcgttaagtttcaagaaagttatgaccaaaaatgttgtaaaaaacttggttttttgagcttctcaagttataacttttttgaaacttaacggaactttttgaaactttataggctaatagaaaacagttgggcctattgaatgatatcaatattttaaaatttggtttcattttgggtgaagttatgaataattttctgtcaaaaattttccattttttggaaaacattcgttaaatgtgattttggtgcttcttcatcaaatacaatccgtaaaaaaataggaaaaccctaaaaaccaggttttatccaacgcaattaattaattattctgctatttgtttgacctcattcggaactcggccaaattgtgctaattaccaaaaaatgaaccgacggtaaaagaatttcaaaagtcaaaaattcttatttgccctaatttactttcattatttcagttggatttgcaacgacgtttggatggacattttgcccagttttgaccatgcccaactcggcctcaaattggcacttctttcgccacgtttcgatgcgttggtggacaaacatttcgatggcaaaagcgaattgacaatttggagatcaatcgaaattcgtcgcaaggacaaaggaccagaaacgaaactatctgtgcggatggatgacaaatttgtggaatttccattgccggaccgtccgttgcccagcaaaatccgttttaagaatcttcggattgggtaaatcaaaatcagagagctatgacaataaaagctttccttccatttttaggtacactgatcactccgtcatcgcttttcttcgttcaaatcatca

SEQ ID NO: 17235 - DNA, 995 bp, Heterodera glycines
ctaaataaaccaaaaattcaccaaagtgtcatgcccttcttatcttccgcccgcggcacaagtttgaactcatttccagcagacaaggcatattccaaagccaagttgtattgctcgcgacagtaatgaattttggaacaaaggagagaagctttgtgtctgccagcgaatccatcgacagtcgcaagactttgcaccgtgccaatgtgccgtgccatttcaaaccatgttgcggtgatcacacgccaatcatccaaattctctgtgataaatcgcttctcttcctcagaagttgtttgaatgccaagtttggccagaaaaggctcggcagtagcatattttccagcgttgattttctgcttaaaagacagcatcagttggtcggccattttaactagtttattttttctttctaaaattaatgaattaaaaaatggttaattaagaagtatatttattttctaatagtattcttattccaccttaaaagtttacttttcggaatttttaaggaaattggtcattttaatgttttccgaaatcttcctggcgcactgcatgattcttttttggtcaaaatctgtttagattttcataagccattattagtatttgttttttcaaattatttgatttttaaaacaaatttgaagaatccagaccaggcccggatccaggccataacaaagcttgcttttaacttgaattttcctcattaacaggggctttaaaaatgatgattttgatttatcaatttaaaatttaaatttataaaataaattttaacgccaaaataatagaaaaattcaaaaaatttactgatgtatgtaagtattataaacgagcgcttgggggggcgccgctttcgcaggcaccaaccgctctgttttattctgaaaagaaattattttgataaatctaacgatttaatttattttctttccaatatcatttctcttctcctttatctcctctctctctctcgctacttctct

SEQ ID NO: 17236 - DNA, 1662 bp, Heterodera glycines
aaaagttgctttcaacccttccgcaaatttggtccattcccaaatcgcccgaatgctcaacagtgccatcgtcgactcggaactgatcaaagaaaagtcgaagcgagcagttgtgaaacccctgcgggaacacctcaatgaggacgttgtcaaacaaattgctgaagcatgtggtctgctggggcgaaattgacctcgacaatgttcacagacatccgcggacggcacgtgaggaaaatgcaaaaccgagaattgttaaaattcccttttcctcccaaaaatcccgcaattttttcctttataaattccgctccacacttctcaaaatgcctgtgattcctcataatttgaccgctagacgtgatatgaccataaatgaactacaaatattgtatgacctccgaaaaaaggcttttgaggcaaaccaggccgctggcgtgtataaatacatcgtcattgacctggaactcaaaaccttgtccaacccaaaaccactcaggactagggtttcgtaggggtgcgcgagcaaaccgcaaaaaattataaatgaaataaaaggtttgcttttcaatgctcgctcactctctaacaagatcccagacttaggtaaattaaaaatcctaatcatttacgagacctggttaaataccagaaattcgatttcatcagatttatctataggtggcaaatatatacccattttagcaaatcgggtaagtaaaagaggtggagggtgtgctatactaataagtactgatattcctatgcttgaaattttttctgggacaaaatttcaatgtgaaattattcacattaaactttgtttagcaaaagtgattcacatttttgccttgtataagccacctcaatgttttacaccaaactttaaaaaattattagattatattatggaatttaattataataatattcttatctgtggtgatctgaatttaccgggaattgattggattaattaccgaatagagaacaataatcattcgaaattatttattgattttatcgcacaaaaacaattggttcaacatgtaaaacaaataacacgtggtaacaacattttagatttagtgctttcaaatcctaagcaattagtttgtgacacgaatgttacagaaagtttttcaacatcagagcaccacatgatagaatttaaaattaatgggagcttttcgatcatcaaaaaagacaaaattatattagagagtttaaaccaaaaaattttctaaaacttagaagtatgcttcagcaaaaacgcattgatctacatttaccgaaattatttaaagttgacgacaaatacaattttctcgttggcgaactttataattcctttgatcaattatttcctaaaaaaatattaaagttataaaaagcaattacccacaaaaaataaaaagattatactccgaaaaattaaaatacacaggcttattagagaatgccctgatcacagacaatataaataaaatacaaaattttaagtaggaatctgaaaagggaattaaaaatattaatgataagaaagaaagccaacttgttaataaaggcaatttggctatttttaaatacatcggcaacaaatttaattctgacagagaaataagattgcttttcgatgaccaaggcagaatttacactgag

SEQ ID NO: 17237 - DNA, 3434 bp, Heterodera glycines
tattgaattttttttgttttcacttcggagggggcgggatattcacactctcgccatggctaagggcctgccaaaccccctccttccccggcacctttgtccatctcgtcatagtcaaccccatatttcgccgtgtccgtcgtctctcggttctccttgtcctctccgcgaaccgcttaatcaaattatacagtatttcgtttgccttttccctatgccgtcctatccttcgtcactttcaaatgccgtgccgtggaagaactcgtcgtcgtcgtcctgcacttcgtcatccctcacattcaccacactgtcatttcccgcaccgttccgactgcacaaagaacgctccattggaaaactgaggaaaaaaccgaataataatgggaaaataaagtgattaaattcaaagataaataatgatgcaaaaccaaggggaaaaacaaagcaaagaattgggaaatttatttaaaaacagaaaaattaattgtgaagtgtaacagttcagaggagagatgcgcctgcttgggagatcgatttcaacagtttttgcagcttttctttgtccaatgcctgaaaatgatttgatttattgaaatattattagattgttattattatatggattctcgccttatacaaacagtaaagcgggtccatgataagcgtcgctgtgtccaaaacgctcattggcatgtccgaccgatggtaaatgtcaatgagtttttggagtagactggccaagtaatctttgcgaatcctaataaagtcctccgcccgctccacaatctcttcgtcggccaaatcttcgtctcggaggggaattgtgacaagccatccgtcggacattttcaaaataacttccagaatttcaatggcacgctgaatgtttgaaaagaatcagaagggcaattgcattgcaaatatttcattttatggtccctctcttaccgtacctttttgtacagttcgaccagtcggtagtacttctgcagacagtcccttgccttttgtacgctcagttcgtactccgttctccgtcggatgtccatccgtgcccatctttcgtcactcaatttggtcggcagttcgggtgctctgttcccctccacgtgattttgccattcggtgtaacgactgatcgcttccttaagaaaggtccaatatttatttggcaaatgcatgccaattccattcaactgacaaaataaagttggtaacagtcgaattcgcgttgcgcgtcttttaatttggtgggaatttctttgtccggaaattccgtttggaatgttctcaaagcaatttcgggcagcttttcgggtgccaattgcatcaattgaagtgcttccgacattaaaccgtacactaaataaaagcaaatcgtaaaattaacaaaatcaataatctaataaaattgaaatgacgaaacactcacaattcaaattatttctgttaagaaaaactcacaaaagaatttacgcaacagaaaatttgcttcaataatggcatcccaaacagtttcagtttcgcaaaatgccaaccatttccatgccaaaattagctcttccgccgcttttctaagcgcctctctcgcgacgtttggcccaaaattgtgtttgtctttgaagcgtctgtaaacatcgcggcacaaattgggcacatcgaaaccaattttcatcgcattttccaacacttccttttgttccgagacaaatgtgagttctgagtttaattgggttaattaagaaataacaaattcaatgaacaacaactcataaggaagtcaagcatcttttcagttgacttttccggtgacaaatggtacaaataaaacggcacgatggtaatgagtcgcatttgctgcagtaacttgctgtactgttcgatgagcgcgtcgaaaattggcaaatcagtgaaacatttgccactgagtctgagcagaattacaagatgaacaaagaaacggagttcatccgcagcaatttggccctcttttttggcattgaaatattcgccgatggatcgcacggcgaagtcccatcgctccaaagccaaatgttcaaagagagtgtaatagggacgagactcattctaaagcaataaacgcaaatattaccaactaaaaataactaatttttagaggcgcttatgaaaaggctaccgtttttcaattttatcaaaaacaaaaggcacttttggtttaatcgaaattttgaatttttcaaattttgattttttgtttaaatttagattaaaaaccccagggagtaaattttcatgactatacattaaattttgcaaaccaaaagggtcacccttttgtttttactttttgataaaatcaaaccggttactttccataaagtgccattttagacaatgtcatggcaatttgtctttgctcaccactcacatttcttaattcagcaaaaatcgcgggcacatccttcggcaagtccattccctctctccgctgaatgtccgtcgccaatgccatgagttcgccatcctttttcttgtgctcttttaacagttcttcgtccaaaagtgcctcagcggcacagctcaaataggcccacaaccgatcctcggtggacagcgcatgagagaggagtgtggccaagtcgccaccaaatgtggcccaaatgcattggtcgcttttctggacacggtcatcgtcctaaaagcattaattcgccaattaagaaataattcctctttacttaccacaggtaccaattcacgagccgtttgtttgaagaataaacgatttcgtgcaaaatcgtgcatttcatcaaaaatatcagtcggagaaagactcggattggtaaggaattcccgaatagaaataaaagcagcgaatgcgggcaatttgacattggccagcaatattttagcatcttcaagacgacccgtgcggaggagggagaaaatcattcgattcaaagtttggacggcttcttcatcctccgccgcaattcgatcgacaaagcgcgaatcgatgtggacgaaacaacgaatccgtgtgcaggcactaaacaaattcattcaacaaaaacattaaaattgacttaaatctaaaaaattcccctaaaaataatttactaaatgttgtccaaatgagaaagcttttccacattttgctctgtgattttggaaaattcgctttgagagaacaacgcgttttcttcactccaaagcagaagcgtctgaacaaaatttgtatgtctcaaaataaatgttttacgcaccgaaatccggcgaaattggtcgttcatgcgaaataaatttgtaagaaacgaagttgaaacctgtggaaatattattttttaggatatgaggcactttttccgttttgtcctacagcctgaacagaggcgcactgaagcattttaacggagccgttttttggggacactaatgtcatatttatattg

SEQ ID NO: 17238 - DNA, 2562 bp, Heterodera glycines
gagataattgagattctggaaaattactgtgctgaacttctggtgtctgcggctgctctttgcattgaacggtcatttcagaataatcaatatcaatcaattcatattgtccattcaattattaattttagaaaatagttaattacttacttaattaattagcaactaattaagatgccataaatgcaaatgtgccgttgagatagatggtccttttcctgctggttgtgataatgacacgaataatgacatcagcgatgggactaaaggagtttctgattcattatttaaattgctaatatctatagctaattgcctacttttgctcaatgaaacaaactaggattgggcccccgaccgtcggggttggaaaagtcggggttcggcgtcgtcggggtcagcaagttcggggtcggggtcggaccaaatcgttcgggtcggggtcggggttcggggtttttcaatttttaccttatgcctaatagtcaaaattttttaattattttttctgaaataatattttttaatttccataataataattgtatttgtttttatatttttttatttcttttttatcagaaattttgtatagaattaattttttttcacgaaattttaaaattttttattttttcggcgacattatttttaaaattactgtttattttttccgttataaatataaaaattacttataaaaaatattatggtagcaaaaaaggcaatttcgagaaattacatttcaaaaataaattatatgcaataaaaaaagtgaattttattcaaaaaatgatcaaaaatttattattacttttttgtttttcaaaacattttttcgcggcgcgcattttctaaagacttttagggagaaaggggtccggcggtaccgataggcgccgccgggaaaattttgaaaatttggatagatctgttaacagattttgtccagaaaatgctaaatttttgcggttttgagctaatttttttaataagatttacgaatttttgggcccgatgaagccgataggcagctccaggcggattttgaaatcaagctctattttctaacatttttcaccaaaagatttatgaatttcccagaaagttttgttttttctcttgatattttgtaaaaagtattttgaaaattgtagagtacattgttaaatattcaaatttacttgaaatttcatcgccccgaatgcaattacgaaatgtgtcgcaaatacaatgaaaaatgggctgaagaacacaacgatttgacatgcgaacagttcgccaaacaaaaaaacgtgaaggatattttaggtatttgtgtgttacgcatttttgtatgtaaaattagtcttaaaaaagaacaaaataaaatttttctaaattttttacgtttttatcatataaaaaacaactcgggaaaatataaataactaaaaaattaattatataattaatttaaaaatttaaaaatatgtagatgcaatcaaatttagagacaaacagaaaacagaagaagaaatcaaaaaaagagaatatgccaaatgtccgggatgtaaaactcatgtcgagagaattgaaggatgcaaatttgtaatttgggaggattatttttaaatttaattttttaaattaattttatttttcattttttaaattgtaagttgaaatgtcgctgcggtacctgtttttggtattgttctggagagaaagctgatccgaaggctttgaaatcgtgctggggcgtttcataaaatccgccattttagtgagtttttcgacaaaacatggcataactttgcttaaaggcaatcaatttttacattcgttttggtaccattcaatagccaagcttttttgggatttttatttaccgatttttaaaatttcgagttattagcatctattttctaggtttttatttttaaaacataaaaaaacctaaaaattttgaacaaaactattttaacctggtttcgcgttttgtgtaaaattatttacaaaaatgcaataaaaaaaccctaagggtcaactttttgggaatttttcaaaaatacaccactaagaaacggcccaaaaaatttcagaaaaatatacccttaagaatcgatccaaaaatacctgaaaatacacttttaataaatgaaaaattttctcaataattcgtctccaaaatttatttatttattttcttgacaaattttaacattgttttggcttaattttgttgctttttttataaaagtttacatccctaaatttgaaagtttttggcacatattttggggtttttgcaattaaatgataaaaaaaattgtaataaaataatatatttaacttcattaatataaaacatcattctgttttctgtagtaattagggatgggaactttatgtaaatacatattttttttcatggattctccttattctgaacagtagggaaaaaccttttcttttttttgtgtttgcgaacaaaagttgggacttttatttacatatggcgcagcgtttttatgtaaacaaaaaaaataaaaattaaaaaaacaaaaattaggcaaaagt

SEQ ID NO: 17239 - DNA, 1553 bp, Heterodera glycines
gtcaatcggccaagaggtgcgcgagttttgttgcgcgattctcgggggtgcgcgagggggcggggcgtcgggaaaactccgctcaaaatggtgccagaggcgaaattctttcgccgttcagcttaggagatgttggaatggcggcctgtgaaatttgaagtcaatcggacaatgggtgcgcgagttttgctgcgcaagtctcggggtgcgcgagggggcgggcgtcgggaaaaaatttcgctcaaactggtgccagaggcgaaattctttcgccgttcagcttaggtggtggtggaatgacggcctatgaaatttgaagtcaatcggacaagaggtgcgcgagttttgctgcgcgagtctcgggggtgcgcgagtgggcggggcgtcgagaaaacttcgctcaaaatagtgccagaggcgaaattcttacgccgttcagcttagtgggtggcggattgactgcccgtaaaatttgaagtcaatcggacaaggggtgcgctagttttgctgcgcaagtctcggggtgcgcgagatggcggggcgtcgggaaaaaatttcgctcaaactggtgccagaggcgaaattctttcgctgttcagcttagttggtggtggaatgacggcctatgaaatttaaagtcaatcggacaaggggtgcgcgagttttgctgcgcgagtctcgggggtgcgcgagggggaggggcgtcgggaaaactccgctcaaactggtgcctgaggcgaaattctttcgccgttcagcttaggttgtggtgctatgacggcctgtgaaatttgaagtcaatcggacaaggggtgcgcgagttttgctgcgcgagtctcgggggtgcgcgagtgggcggggcgtcgagaaaacttcgctcaaaatagtgccagaggcgaaattcttacgccgttcagcttagtgggtggcggattgactgcccgtaaaatttgaagtcaatcggacaaggggtgcgctagttttgctgcgcaagtctcggggtgcgcgagatggcggggcgtcgggaaaaaatttcgctcaaactggtgccagaggcgaaattctttcgccgttcagcttagttggtggtggaatgacggcatatgaaatttgaagtcaatcggacaaggggtgcgcgagttttgctgcgcgagtctcgggggtgcgcgagggggaggggcgtcgggaaaactccgctcaaactggtgcctgaggcgaaattctttcgccgttcagcttaggtggtggtgctatgacggcctgtgaaatttgaagtcaatcggacaaggggtgcgcgagttttgctgcgcgagtctcgggggtgcgcgagtgggcggggcgtcgagaaaacttcgctcaaaatagtgccagaggcgaaattcttacgccgttcagcttaggtggtggtggaatgacggcctgcgaaatttgaagtcaatcggacaagaggtgcgcgagttttgctgcgcaaatctccggggtgcgcgagggggcggggcgtccgggaaaactcccctcaaatggtgcccgaggcgaaattctttccccgttca

SEQ ID NO: 17240 - DNA, 1825 bp, Heterodera glycines
tatataaaagaattgttaaacctacgcggactctaaccaacagtcaacctaacagcactccgctctttgaccaccaaatatgaagggaaaatacaagctaaatttcgatttttgaagcctataaactttttgatttctttctatgggggcgtaatattaaaaatacaatagtatagaatttaattttttttaataaaatcgtatttaataattacagtaatttataaaattaaaaaatagtatatttccatttttaaatttgtcctgaattggagaaataatgagaaaatgttcacttcaaaattatcatatgcaaagctaccactcaatactaccgcatctttattttggtgcaaatgtaaatgtttttcagttcaaactttatgaaaattggaaatattttgggttttaaaaattatcagagttataatttttatacatgtttttaataatctgaattattggtattttgtataaaatttaatatatattttcaataaaaataagtttttcatttgcataaccccgacttttcacttcccgaatccattggacttataaagtgctaaaatggaattttttcaaaattttctattagctaacatttaatgctctcgcatgatacaaagaaaaaaaaatcggggtgttttaaataaatataaaatgctgcacctatgtttatgacccccaaaaaaaatattttttgttttaggcatttccttcgtataataaaaatgggaaatccctccgggaccggcttttttgagaactggaacctaaaagaaccgagaatcccgcccggcccagaccaactcttgttaaatgtttggacttattttgtaatataccaatcataaatcgcagaagtaatttgatagaaaaaaaggtaaaatcaaatccaaacaatttttatagaaaaactttccacaatgattcaatttattcggtcatcatttattgaattatttctgctgatcgattgggtcgagagtttcatagagaaggctaattaaaataaaatattcagttaattatgtactcgaattacgcacccgtctccgattccctcctcattaatgccaatgtcaattttgctccattggccacaaatgttcagctcaatcgcctcctcttcccatttcgtccatttgttttcatatcgcgaaatgggacaacggaccagcaaaaagcatccatcgttgttaatctttttcattgctaatttttctccagtgaatttgttgttcaattcaaaaattgagtcatcagcaaaagacgacgaacaaaagcaaacgaaaattataaaattgacacgataagaagcaatcgaaaatgactaaaattagaaatagaaaattaaaacaattcaaattgatttatttagtaaggtttccatttttaggcaattgccagccataagaattgaaaaattttccagaaaaattgattcccaaaaacctatttatttttttcttgtcaatgattttttttgtttaaaaatgtccttaatgtccttattcaaaaaaattgaaatatttaataatttcatttaagtgaaatatgaccaaaattaagtctttttaattaagtttttatgtgttttgttacctaaaaagcgttaataaaaaaaattaattgcctatttttatgcctataaataattaattaatataatattaatcaccgctttcaatgctcccattttggaagaccattgctcctcattcccccggaatccgcatctgagcaacttcggcaaaccgtccggacgaggcgacaaaagccatttggccaccgcttggccatccgacgcattggcactgtc

SEQ ID NO: 17241 - DNA, 1896 bp, Heterodera glycines
gagccgtttttagacgaaaaaagcgaaattcgaaaatttgaactttcgacttcttgttcgaattctggtcaagtgttagaaattggtcgaaatgggtgccagattcgtattcattgtgcctgaaaaccccccataagaacttgtttttatgacttttgaaaatttaaaaaaaattttttgaaaaaggtgtcatatcattttaatgcatcaatttcaagcgcttcctcaactttggttttttaaaaattttctgtaacatttgacgattattgatttccccttaatgtttctcaaccagaagcataattaataggttaatgggaaagttttacaagctgaaaaaaggatgagagagataattatttatcgcttattaggtgtcaaaaattaataagatcgatgacgtcatttttcaaaaaatgctcatttctgcgttcgtccgcccgccagtgctcttctgctcaggcatttttgctgtacccagaaattacatgttcatgctctgtcgccccaagctgaggccaattgtttaaagtacgcttcgttgtcctgattttcttgttgaattcgttcactaattggccttccgtcggtgtccaatggttgtgccgtttcttcttgtggcgaaacggtggacgaatttctcaacaattgtttaatggtcgctaatgacgccttggcttttctgttcagtaatggatgataactaaattaaaaaataaatttaacattattaattctaaatgtttttaaaataatatttaatgctattctcacaaattattatttcatttaaaaaatgattgctatttgatactgaaaatttactaatttaatttgccaaacacttgttaaaaaataataaaattgattaattaattaattaatataccaaagcattgcaacgggaagcgcaaggtcattgaaagcatgtgaaagaaacaaaacttggtaaaacatggtcattggttcaatatttgttataataccaaactgggaattcattgtcacaataaatgtaataaaaacggtgataaaatggcacaaaaaattgggtgccaattgtcggcccgtccgaatattttcatttaactaaattgaaatgcaaaatgtatttttggcttattcccttttcaattaatcaaaaagaatgaaaacattttttgaaaatttcttggcatctcaggtccaaataaaatattattttgattttttaagcaatttcgaaatctaggaaaccaaaaaatttaccaaagttaattaattttttaatttacctgatatcgaacagagagttgctgatttgtgccaccaccaacacgtgaattaaacaatttttggttaatttttgtgatcattgaaagagcctgaaattgcattttttattattattataaataattaataattaaattttcatatttcttacaaaaatttcaatcaaactggcaatagttgcgccaaaataaagaacaatagcaatataagataatttataaaaggaatttgatacgctgatttgacaaattgtcaccgccaaagaagtggtaatctatacaataattataaaattaataggaagaatatttaataaattatctttaatttatttttaaaaatgtaagtaaaattttaatttgtaataatttttctatgctttttcaaggtcaatggtctcggatgttgagctctaagattcagtaataatgtctactttgtatcttttaacaacaaaattaatttataataatgaaaattattgctaaaccaactatcttaccataatgaaaagccaaacgatcgtaaatttccagctactgtactgctcgtaagtactaacgtaaattgttgcgcaaattcgctccacaatcagcacatgacctgccataatgctga

SEQ ID NO: 17242 - DNA, 1797 bp, Heterodera glycines
  misc_feature (1676)..(1676): n is a, c, g, or t
  misc_feature (1744)..(1744): n is a, c, g, or t
  misc_feature (1761)..(1761): n is a, c, g, or t
tttaattaatttttttaaaaaatccccaacagctatcgcatcgcggccatcgtcacgagcagaagagcgcgagtggccattcccgtgagctccgggtgcactggcatggcttcagcttcagccaggattcgtgggaggacgaggcggccatccgcgcggtaagaaatcattaataatttaattattatataaataaataaaaaccaaataaattccagcaagcgccattgatatatgcggcgtgggaggccgcccacgacgcggggcacacaccggaacacggcactgtcttcccattgcggccggcgccgtggatgaccaacgttcgagtgcagagggatttgggagaggccgaaagggcctatcccgggcggcgcacggcggtgcgacaaatttttggtaaaatgaatttaaaaaataaaaaaaaatgaaaataataataataatagcaaagtagcactggacgcgaatgccgggactgaagcggcggcggtgccattgacagagggagatgcggcggcggtgccattggtggaaggagggaggcattgattgatgcgccagcaccaacaacagcagcagcagaaaccaacgcatgttccactgatccatttcttttgagttttagaccgtacttaaaattaacatttaaattgttttattaatttgttttactacctgtttggttcccccactgcagtactcaacaatttcatggtcgggatattcgtccgtgaattgaccgaggtgtggacctgtttgtagagggcaatttgcaatgagatgagcaaatatgagcgagtccgtgtccgtatacaaaagtctgcattctggtgttcgaccaaccatttgcatcgctctcaaaaggagaagccgagctgcagatgttgtccaaagagaaataactgaaaattttaaatttcaattaaaatttcaatttaattgtctctcaccaatattttacattcatgttcttcaacccattcctttttctgcatgtaactgatcagaatcgttgtctcattcagttcgtcgatggacatcacatcgatggatttgttgtccaagtactcagccaaaactgcagggtcatctgtgatcaccgtttgggccaggccaaagtttcgcaaagaaaaacggcccccttaaaataatgagctcaaactaggcataagccgattaagacactcacaaaggttattcaagcatagcttggcgattgaacgctttcctttgttcactgccatctgctccgggtcgatggtgatgccgaacatttcatggcactcattgacaaactgctcctccaactctttgttgcctttgatgttggccgcaaagtcggatgcttgtatttttttgggccataaattcagcgatgtaaccacggaagagtttgtcgtcgctgtgctcatactcaagcacgcggaagagcttggtaatccggtagccttcatccagcgctgcgttcatttcaatcgatgtacacgtgctcacccatccgcgctgttgatcggtgtgctcgcaatggtagtccgggtccacgtcccccatgggatagtcttgagcgcaacggtggcacaacggaaaacatagccgctcattgatcctgaccggcagcactggcacatcacacttttttggcggcaccacaaagactttgagcaaggcaaggnggtaagggttgtccccggaacgagtccatgtgacatcctcgttgaacacgtgaacttttagatgaccnaaccgataccgcgtgancaagctgaaatgtaacattaatttttgaaatccatt

SEQ ID NO: 17243 - DNA, 702 bp, Heterodera glycines
aatcatggtatcataggaaagccctagatgtttagaagatatttataaggtatttctcagtgattaatcagctctcaaaatagttgtcagtttaaaaccgcaaaaaaggcagaattttcaaagttttttatttctatctttttttatagttcgaaattttctgtaatttttagtaggctaatagagcctgtgaagagctttcgaatgatatcaagattgtttgattcggtcaataacttcaagagttatattgactcaaagttggctcagacggagttggccagacggagttggcccgttccgccagttttacgataagttcaaaaaaataaacttatttaatttcacacacacaaaaatatcgaatattttttttcctccagaaacgacgaaagccgaagagccaaaggggtttgtggatttgttgtacataaataatatctaaacattactgtaaattagaattctacctagactaggatccagggctggttttttccatagatccaagtccagctcaaatatccaggcacaggttaggcatctgaatttcctggataatattttattcatgttaaatgattaaatagttaaaaaatatatcgtattgcctattagatacctttagattttcctaagcaattaattgatttttccaaacatttgtttgctttttaaaacaattttcaaaaaatccaggtc

SEQ ID NO: 17244 - DNA, 280 bp, Heterodera glycines
cggtgtcatctatgttactagatcggggatcgatccccgggcggccgctcgagcaggacctgcagaagctagcttgatggggatcagattgtcgtttcccgccttcagtttaaactatcaagagagggaggggagcggagcgcgtagcgggggaggtgggtggcggaagaagaaaagggtggggggagtatgagtatgatggtcaatatggagaaaaagaaagagtaattaccaatttttttttcaattcaaaaatgtagatgtccgcagcgttattata

SEQ ID NO: 17245 - DNA, 1762 bp, Heterodera glycines
agttatgaatttttcaaattttaacccaaattttccaagggcccaaaaaaattaaaaatattttcgaaattttaaaaaattccaaaaaaatctgaaacttaaaaataaccatcatatttgtgttcaggaccctaattttcccccagaaaaaattttttccccttttttttcacccaaaaaaaaatttttgaaaatttttagggggcctagctcgaaaatttttgaaatttttcgaaaatgaagtataccgttcgatagagcttaaaaagctctacaattttgctctaaggccattttgggctaaaaccaacccctggacgagttatgggcccgggactcaaatgtcccgctcaggccaaaaattttttctatttccggaaaaaaatcgaaatttttccaaaaaaattaccagtcgatagagctcaaaaaatgatgttttggaagtggtctccgtttttcctgaaaaattcgttaaaaattcctaaaattcaaaaaccaaaaaaccgttttttaggcctagcatgaaaatttttcaaaattttcgaaattttaaaacttggttggatagcctttcaaatactacacatttttgctcagaaacaatttttcggtcaaagcaacccctggcgagttattcgcctggtactgaagtgtacacttttgggtaaaaaaaattagccaaggctacagccttgggcgcccaacgtagggcttaggttttgctggcaaagttgtcggggatagtctgacttaaaatcctaccagcaagagctaagcgatcccggtccaaagaaaaaatttcgtagaagaaaaactgcaagaaaaagtgagaaatcgcttctcgggactcagtcgtccgcgctgaatttttttctatagttttcccggatgcgcctcaaaaagttgtaagacccttccactactttcagggcgctcccggccttcggccgggagattttgtttttgcaaacgaaactccttgtcaatataacgtatatattaataaaaattaatattttttaaatcttttataagatttacgcgatacaaattaaggaaatagtgaagttcatgtgatcttaatagaaaatggataaagaaaaggtggtttattgaaaaaaatggtgtttattcgcatacaggatctataaataaattaatattattttaattattaaaaacattttagttatataaatgataaatcgaaatttattaatgctctgataaaaaaatcatttgataatggattcaacagaaacggaaaaattagcactttgtggaaaatattttacttacagatttgaaggtttcagacgcggtgtagaatcttaaaaaattaatattatttaaatcttttataagatttacgcgatacaaattaaggaaatagtgaagttcatgtgatcttgatagaaaatggataatgaaaaggtggtttattgaaaaaaatggtgttaattcgcatacaggatctataaataaattaatattattttaatcattaaaaatattttagttatataaatgataaatcgaaatgtattaatgcgctgataaaaaaatcatttggtaatggattcaacagaaacggaaaaattagcactttgtggaaaatattttacttacagatttgaaggtttcagacgcggtgtagaatcttaaaaaattaatattatttaaatcttttataagatttacgcgatacaaattaaggaaatagtaaagttcatgtgatcttgatagaaaatggataatgaaa

SEQ ID NO: 17246 - DNA, 1586 bp, Heterodera glycines
  misc_feature (1538)..(1538): n is a, c, g, or t
  misc_feature (1571)..(1571): n is a, c, g, or t
attatgaattcatcatcaggccagcgacggacttcgaggttaacgacttgtccttcatcacgaacgacgtgtcgaaaatggaacgaccacttgagcaattccttaacattgcaacggcgcagaaggccaacatggacgggtatgaatttattcgaaaccaataaacgtgttattttaacataacatttggactagtcagcggattgtgtagagttatagtccaaatccaaatttcctaacaaacattttgtggtatgatgcattcagggccaaatttaaacatttgaattcaacctaactgttcagaattaaagttttcttttttagaaagaaattctttgggttttcttcgtctcctgtttacttactggcgccattcgactatggcttcaaaaccaacgagtgtcctgtcttcgattccaaccactcattccttggtgtaggagtgaacaagagatgtcgaattattgaaggttttttcaattttcttttatttcactcataagaaaatcaggagatcaaggccctggccaaatgacacctgccatcgtcatccaaacgaaaaaggtttatctttatggtttttaccatgttccattcattccttagtccgccttccacattccggacatgtgcattttggacaaggcaaaaacgctccttttccgagaaaatcagggaagattcgagacaggcggctttactcaaagtgactacgaagcgctttgcaatggccttgtcggtatgttaattttaatgcgtttggtatgaattattttatacccattctccaggaatttatgctgaaccacgctatggaacgtcgggacggtttttccgcatcagtgacattacaaaaccaaacactggaaatggtcttaacgcggagaacacattcatcacacaccaagtcagcgggaaaatcagcgtcaaacaatatttcgaggatacctatcggaaaacgcttcagtgagtttatccaactttcttaaaagaaacattttggtaattatttctcgatttcaggtaccctaaagcaccacttctcgtcaattatcgcagaattggggacccggcgtattatcccatggaggtacagcgaacaatgcaatttattttctctttcataatttaattaaaacaattttagctttgttttgttttggattgtcaacgcgtcaaaagttctcaacaacaccccgagcaaattcgtgtatgtgtttagcgtttcaatttctaatcatcattctattccaacattaacagtatttgtttagaaaatgatcaaagagacggccgttccgcccaccgttttgcaagcgcacaacgaacgggtgaaggagtcgcttcagttggtcgacaacgaatacttgacaaacgcgtccgttcactttgacacaacgccactccatgtcgactaccgtgttcttggtccgccagcaactctctatcggaacaaccatcgtgtcactcctgccgcgtcaaactgtgaatggcatccgggtgacgctttggtgaatgcgcaaattgacacctgngtagcctatgcgttgggaccctgcgggtgactncgtgcgacgattagg

SEQ ID NO: 17247 - DNA, 1322 bp, Heterodera glycines
cctgcgggtgactcggtgcgacgattagggtttaccgaaaaaggatgtggaggtaattaccgcttaaatttcgattgttttaatgtaccaaaaaaaattattgtagtaatatctgtcaacttaaaacagaaatttccgtggacaagtatgcaggtgaaatgcgtaacaagggaattgtttgtaaacctccggtgcgtgtctctatttgctggtttacgtccgtgaacaaggtcttggaggttttgcacaaggaagctctgaacggcggcgttaagttctgtctcattggtcatgcgaaaggctctgagggtgatgacgtgcatggtaccatttattagccgttgtaaaattaggcccctgattgtgagtttcttatttagctacgatcaaggcgtttgaacaacagactgaaattgtcactcaagcaattacgtttgacgttctcaaggatgtgctcgataaaggcagcccattgactgttgcgaattgcattcacaaaacgaacgtgaaaatgggcggtctaaattatgctcttcatgtggatgatccatcgtgcgtcttttttccccttttttatatagtcaatacaattcattttagtgttgccgaattgttcgacggtcaaacactgtttcttggttttgcaatgaacttcccggatggattcgctccttccgaatctgctgcccctatcaacggtgtgaatggtgctgtgccttcaggaagtaaagctggaccaacgctgcctcctcctcctttgtgcattggggtaataaaaaggagaggagctcattaactcaattttgaaggagtaagtcaatttcaaaaatttcagtgggccgcgacaatcggaaaacgacacaaggatgaatacattggtgactttgtctactaccccccgcaccaatcgaagaaaaatgatgttattggaagcgttgtcaggagatgcattgagtccttcaaaaaaaacaggaacaaaatactgtaagttttggacaatttgcattttatttgttgcaatgattgcttagacaacgcgtggtcattttgcgcaacagatgtaccgagggacaattcgaagatgtcatgaagtaatttttcaaaatgatgaaattatttgaaaatttctattaaaatagtgaaactgggctcttcgaaaataaataatgtgccatattttaaggtatgaaattccgctggtcaggaaggaaatgaaggaattgggttgcaccgcaaaacttactgtgattgttccaaaccgacttcaggtgcactttcccacacatcaaaacggcaccgcctcgtataatttaacctttttt

SEQ ID NO: 17248 - DNA, 3714 bp, Heterodera glycines
  misc_feature (26)..(26): n is a, c, g, or t
tttttttttctttccccccccccttntccgttttgctcacttttgcgtgctttcgcggcccaatgagtccaaatcgtcgctcattgccaacgaaacgtaagaataatttacgaaggcataagtgagcagaaagggcatggaggagagaatggccatttggttgaggtttccgagtagaacgagcagcacagcgaccgcagtgaccaaaacggtggcctttagagggtctttggagggcgaatccttcgagaaaagagccaattggaaatgccgaataatgcaacggatgggagtcatttgtcatacgattagccattagtcaaatttgtttgtattttgctgctccttggcgatctgccccccccccccctcggccaatttgccacctcctgaagcaatttgctcagctgtggaatgagcccttcggaggcgatgccctgcacaacgcgagaagtgccgagggtggaggagagaatggcggagagacaagcgatgtaaaggccgccgaggaacaaaagtttggtgagcgaaagtcgttccgaaatcataacatcgcaaagcaaagagtggccaaaatggaaggaaagtgaggcaaagggcaactgataattgtggtgattagttactaaactcaccgatcgacggaagcgccgaggataagcatgatcagaaagcagagggcgaagcttgctctgagatcaaaaggaatcaaataaacaataaatcaattgaatcaaatcgaatcgctcaccccaaagcactgagttcgccctcggcaatgtttctcagagggtccaccaaattgccgctcatattcactccttttacgaaagagaaacggtaaaagtgaattctgtgacgaaaaaccggccaaaactccgatgaaattggcgaacaaaatgccaaaaacactgaagaaactctcctggccaagaagagccattgcgttgttttggtgttctctgaattgagttcggttcttttcctttttcgctgtgattcgttcactcatttgccgataattcggagaacggcgtgcaattggccgggccgtaatgggagtgccaattcagcgacagtctttcggcactcatttcgccgatgccggcctcttaaggagtgccaaattattttcttccgagaattcgaagggtaaaatacctgagtccaatggagtgaagagaacggcgccaagaaggaaatcgccaatggctattgccagaaagcacatcagaagcagctgaagacggatgatgaagcgaagcccagcgaaattcattgctaatgagagaaatgccgagaattactgtatttaccgtaactacgcaatcgaagagcttttaaaaattaaacgcctcaaggcgaggttgtgcccgtccgtttaacaaccgaccgaccgttgagaacgaccagcaccaacacagagagagttttgatggccacggggctgaaaatgccggccaatttggccatggactcgccaaagcccagcgcgaccagtgcagttgcgcatgcttgaccaaaggtgtaaatgaggccaacggcaccaccgattcgttttccgagcacatgggaaaccaaaaagtaaatgccaccactgcgaatctaagcgcaggaaaacaattgggttggagaaacgcagagagaaaagtgaatggacgaaaaaaagaaagaaaggaatatttgcggaagggtaaggacaaccaattgggcggtcattccgatcagttttgagaatgctgatcagcccaattcaatcacccaattctgtgttttttgtgccgatcagccgatgctcacctgacatcgctcacaaattccaatggcggaaaggacagtcactgaggagaaaagggtgcacagggcgagaacaacaaatgcctggaagagaccggcagtgccctggacaaatgggagaacggcagaaccaatggcaccgaatcaaaggcaaacgcacgacgatccaacccatacggaggaaaatgacaatgccgaaaatgttgacgacaacggtgggaaagacggcattccaagcgttcaccaaagtgggctgttgcagcagaaaattccttttttgtgaggggatttgcaggtaaaaacacatgcaaaaagtggttgtcaaaatgccaagaaaaaatcccaattccccggatccaaaatgccgagactgactaccaccaaagggccgagactcactcccgaccgacctttgccaccacggaatgtcttcgcccgcgacgctttgctgggcgaacagcgaatcgggctcagcatttgggggcgactgttgtgcaatgaccgcagctgtcggacaattattttgaggattcatttttcaccattagccaaaagcaatgggctaatattaattaactttttctgcttaattccttagggaacattcttttcgccaattttactggtaaaagaaagcattgcttaaaatgccctcgggtgcaatgcaattagcccattatttagtaataattttgactttcccacccgccttcgatgtttttagagagtgccaaggcgaatgagaatgaatgctccgtgagttgagaaggcattcccaataaaagaaaaagcatttttaacattgcgcccatttggcggcacgcaatgttagcacgagaaaagagcagggaaaagagagagagagagagagagagggaggaagtgcaagagacaagagaaagggagagagagaataggggaaagagaggagagagatagacaaaaagcaagtgagttagagagattagacggaactcagagaaggaaagaaaaaggaaaaacagccgaaatttggcgtcgtgagagagcgaatgaatctgtgccaaacattgtaaaaatctttttttgagttaattcctttttgggtggcgaatgacgcacagaaaacggaaaacagccgaagagaagcacttcacttattcactatttcttcttttgtgtatttttcggggcaaacaaaaaataaggcaacggaaggccaacaaatgccctcagcagcgggcgacggcccaaaggcaaagaaaaggggaaaggacagcgcaaaagagggaaacgggggacagtccaaatcgatattgtaaaaggaaaagcatccatttattaacaaaaaacaaaattcagccggaacacgagatttacaagatggggaacaattgcagaaaaacaccattggagaaaatagcatgaactcgtaatgcccttttacatctgccaaaaaacgaatacgcacatttgccgtcacgacggcggttttggcgaatgaccaacggcaccagacgcgttgttctgtcgtggcggtgcttccatttgccgaccggcgccaaaaccgagcatttcgaaactgaacgactccaacgaatcccaatcgtcgccgacttcctgaaaatgccaataaccgtatttgtccacacaaccaatgcctttttagaccgacttctgcaattctgtgcaagtctgggttcattacttgttgctgttgtcgtagggtttcgttggattcatacgacggatggtgtccttgaagctgttgttgggattgccgttgtctgtctcctccctcctcataagacggatacacatagttgccgggagccatgttctcgtctaatgcaatgtcatgcatttcgaaacgggagcgtattggagagggagcaggggagaaaagcaacagataaccgaatgatgaatgtgtttctt

SEQ ID NO: 17249 - DNA, 1401 bp, Heterodera glycines
  misc_feature (1240)..(1240): n is a, c, g, or t
  misc_feature (1360)..(1361): n is a, c, g, or t
  misc_feature (1365)..(1366): n is a, c, g, or t
  misc_feature (1373)..(1374): n is a, c, g, or t
  misc_feature (1393)..(1394): n is a, c, g, or t
attttggcgttactttcaatatgtgtaccgttgaaattgttttttgacactaatgtgtgtttaatttgattagttagttttttaaattcgtgccgatattttattttttattttattagccttaactattttgtttcaagtgtttttgctgtaatgagtagaaataatttatcgtaggttaaaacccattaaaataaaaaataaaattttaaatactgttaattagtcgaaaatgattgtataatatgcagttgtatttttattgtataatgataatggacctcctgaaattagcataactgatatttgtatgaaattttttagggataattcgtcatatttaaataaatttatttctattagtccttagcatttttccatttaagttctcgaacaaaggaatatgtataaattttattttttattggataaaatcaaattttattcactttttcgaaaccggttatttttgtgcaaaagcaaataaacataatgttattgtaattgtatattatgcagttgtatttatataatggtgagggatctgtcgaataacaatcattagcatagataaattttacatgttttatttaacttttttaaaatcagcaggtaattattgaatgcatataaaaagtgttatttttcccgttgatttaatgcattatactcttttttgatcgcgataattacttttgcctaaatttaatgtcattagctctttcaaattcgatttttcacaataataataataatagtatgagactttttccatttcaattggtaaacgaaatggtcaaaatttcttccggttattccaattggcaccaatgaacccctttttcacttggactcccattctctcagaatcacaaatcggtcatttttgtgcaaaagtgttaataaacttctggcacgtcgtgcccggcccgttgaaaaacaaaaaattttacgaaaaataattcttttgaccccaaaattgttgaaaaagattttctgattcttgagcccaaaattcgattgtttttttcagcccaattttctggctttgaaaaatttttgttctgaccccttgctcaagtgacaaattttgttggcgaaatgtgcaattttacatgggtggcgaaattccaatggcttaaatggcaaaacgtccatggcgggtgacgaaacgcactgaaggggacgagagaacgtgctggcgcatttcttaaaatttccaaccgtgcgcgtttcttanaactgccatcattgaaaattgttcaaaaaattttcaaaaattaatttttttttttttaaatgaaaattttcaacgaaaaattctaagagaaaattagaatttttgaagaaatatttctannatannaatgtannaaaattcataactttactnncactgca

SEQ ID NO: 17250 - DNA, 2109 bp, Heterodera glycines
tacgctgttttcggcacttttgcagatttttggtattatttgatagcccaaagtgtcctttattagtctacaaacattccctaccaaaaagtttaatatcgcgatcacagcaggagtttcatcccgcaaaaatggcaaaagatttacttagcaaatggggggggggtgacttacctatcccatgaaacgctcaaatacctattttttgtcaggccaccggtcggccaattgtacacaccttttttgtagtcaaagtgggacaacacccaactatttttggacaaactcgcttttggcgaagaggaaaataatgaaatatggcggaggaccaaccacttttatactaattttttcaatttttacacgatttattaaacggtcattcgtattcgacgcattgctataaaagccctcccttctctcccattttctttcattcgctcacttttccttccctttttgcttctttttggtgtatattttggaaaaatcacatttttaggatttttccgaaaatccatcgacccctcaaaaattaaagaatgagggtaatttcttagaattccgatactctgcataattaggagccttttttgtcatttgtcatttattattatttttttttaattttaaaaagcactccgttgggcggacaataagtgccttaaaaatggcaaaaaaaatacgggagcaaatcgtcgggaaatgcttggcacggcactgttcaaaatccatgttcagaacattccgcataagttttttacaagaaatattggtaatctcaatttaaaaaaaaataaataatttaattttttagttgtttgtaaagtcttttaagaatataaataaataattaaaaaaaaacattttagaaatattttgaaaaaatttagtaaatgttaagattttttaacatttgaggagccgaacaatacggaataagcattttagcaaataaaaaattttccaccaaattttgccgtttttcctttttcgttatttatttttttatctaattttttaaattaaatttgcctctcaaaaaagaaatttttacaacaacagtttcaaccggcgttctgacaaatgcggaagtgatcagtgtgtttctttcctgccgtgctggcgcgtttcttaaaactgccatccttgaaaattgttcaaaaaattttcaaaaattaattttttttaaaaacaatgaaaattttcaacgaaaattctaagagaaaattagaatttttgaagaaatatttctaaaataaaaatgtaaaaaaattcataactttactcaactgcaaccaatattttatggtatcattcaatagctttaattattttctattaaaatattaatacttaaattttttacaaagtatataaaaaagtttgtattaaaatttaaaaatttttagtttttgaaattctagtgtttaataattatacaaaaggttttaaactccaaaaagaaattaaatttcaagtcattaaaatgcaattcaaatgattttttttagaaaagttcataattttttatttattaatttacgaataaaaattaattttcccatgtttttataattataatattccaaaaatttttaaaaatatttttcgttttcaaaatttttcaagaattttcttgaaattagggggggtggcagtttttaagaaacgcactagcacccgagagaatgagggaaagggggaggggaaagcaataattaaaatatgaaaaaagtttggagtttggataactatttataagtgaaaataaaaagatgaatttaataaatatatgcatttaatggataaattttggggtgatatttttgaaatgagacgggccaatgaatggggagggggggggggacggatttaacggacagcacaaagtccattaaatgcaaaaaaggggcccgccaattttcgctaattttattttgcacaattgtattcatttaaattttgcagatggacaaacgaagaaacgaacgcccgaaaataatgggagagaaaaacaaaaaaaaaaagagtacagcagcaagagaagaaaaggacgaagatagagcggaggaagagaggaaaagtaaagaaagagaacaaggcaga

SEQ ID NO: 17251 - DNA, 3752 bp, Heterodera glycines
  misc_feature (21)..(21): n is a, c, g, or t
  misc_feature (841)..(841): n is a, c, g, or t
  misc_feature (849)..(849): n is a, c, g, or t
  misc_feature (2204)..(2204): n is a, c, g, or t
  misc_feature (3702)..(3702): n is a, c, g, or t
gcaggtcacattttttaaaantccgaaagcaaattgatagtacgcggaaatgccaatttttttttgtttataatttgttaattaagttttgtgaatttagacaattgtagagtcaaatggtgccaatggcgaaaatagggacaaaatgaaaaccctaaacgtactggattacattaaatttgcaattattacttgtattttgctatatgtactggaactgaccttaacgatagcataaacgatgtcatattttatttaggtcaagtttccgccacttcaatggactattttcgtttttcaattcattttttggtattgcggcaacgaattccattgtcagaaattgtgccgatgagaaatttgagcaataaggaaatattaaccgaattggtggaattgcttttgctgaaaaagagccaaaagaatagagaagaacaaacaaatgggcaaaaagaggataaaaaaggcaaaaaaggagacaaaaatggagaaaaaagaaacaaaaatggggaaaaaggaaataaaaatggagaaaatagcaaatcgggaaaaaagaaaaatgctgataaagccaaagagagtcgattgttaaggcttatgaatacaatggtgaacaatttaaatggcacggcaaacttaagaaagggaggtaaggacaaattcttagaatttaagaagcaattaatttgtgtgctaatgatttatcaaattcttttcttgtttgttttttgagatgatcaacggaaacggagaaaaaagcgaatgcccgacaatttattacgttttatattgaatttgttattcgtcggcataatcttttgcctggtgatgatgctaattntcatgtcnggagaagcgatggttttgacgggaaggaatttgaaagcaaattttgaggaacaaacaagtaatcaaaacgagaattaaattaacaatatttattaactattcatgctcattttattaacgtttaggcgggtttttttgagtaagagaacaaaaaaacttaattataaattttgggcttttttccagttaaatcgtgaaatacagaaaatattgttattcatttagtggaaatatttttatgtattaagttacgaaggctttgagtcgtttgtctcaatatgaaatgcttaaggccaacggagacgaatgtgcgatttgcttggattcttataaggaggggcagatgattcgtcagattccgccatgtcaggtgaatgattaagccgaataggggcaaatgtacgaagtgattttggtaggaaatttgtaaatttgtcaacgcaaaagttatggtaggaattgcgtagatgaaatacggtagaaacattggctattgtagcagaggcacttaatttgttgaaagtttgttcttttgttgagatttcagctttgcttaatgtacagtttatgcatccaatcaaatctcatttaatatttttatttcaattttttgactgttgacaaaacttctttcaacaatttctgttaaggtttttaaaattatattaatttgtttttccaaattgcttatctaatcacacaaattgtgtttcaaaaaaatacattttttaatatcagaaaattatattaaaaaaaaattaaaaaaaacaaaaaaaaagtgaaaattttaccttttatataagatcctggcgcagcgattttatgtacacaaattttgtaaattatacattaatattaattttgcatttagcacaattttcactcggaatgcattgatttttggtaaatgaaaggacaattaatttctttaactttaacatttacaaatttagggttaaacagaacaacaattgtccgatttgtggcgcaaaaacattcataatttcattaaaaaacggtttagttattttaatttgaaaatacagtaattttttaccatttatttaattaatttagcgaaaccaaacgcaaatttgaactcagaaattgttggcgatgaaaatgtgtaatttctgagtttgttcattttttgtttgtttttctctgatcattcattcattttgctttgttcgggatgacatttgctgctcgttttttttgaccaagaaaaactatttgcttcttaattttcaatgattttctttcttatttaacacggccaaactgatttatataatttttgaaaatcttagaaatatttttttgttcctaaattgaccaaaataagccaaatntagtcagaaaccattgcaacaacagaacaaggtcattctgcacagaaacgaacataaaagtgaatttcagtctttcgaatgatatcaaaattgttcggtttagtttgtaatgaatagggctgccaaaaatatgcacaaaaagtggccaaaatatgcgcataaatatgcaaataaagtcgtgaaatatgcacaaaaatcgcaaaatatgcaccagatatgcacaaaaaaaaacttgaaaattaggggtgtaaaattaatttaaaaattttattttctcataattattaatcgattatttttcaattgcaaatcaaaaatttctggcagtgaagctcactgttgacccactcgcgcatccattcagatttggatttaatttaggcataatcaaaaaatttttcctaagagatattcaaatcggaaaatatttgacgaaaaatggcaaacgatgcaaaaaatctgaaaatatatacaaaaaatggcaaaatatgcatgaaatatgcagaaaaaacccaaaatatgcaaaaatatgcaaataaaggtcccgactttcatacactaacacaaaaaagaaagtgttttcctactatttagagcatggagaagccaggaaaaaatatacatttgcatatttttgacagccctgttaattaccctttaagtaataaaaaaattaataaataaccaaaaattgtaatttttttatttagttgaaaatttggaaatttggaaattttaagcaaaatggtttttatggaaatttagttgttttgttaataatttttaaaacttaaaatgtaagaatttttacaggcaccgcttcaactgttcaaatgaaagagctgaattttaaaaaagagtgccaatcattgaactaaatttgtaggaaaatttataagatacatttcatattgaacattaagaaactagcattagcgtccaccaaaataataaaaacgggtcgggtgagccctgccgttctgtccgttacgaagcagcactaatcaaattatatctgtttttgggcgccaacccatttgcagggaatattttgtaagatttttgcggaccgggtcgattgggccccgccgattgggccccagcacgattgggccccgccgattgggccccatggggcagccacttttttttcgtttcacatgttttaaaaaaattaaattattcataaatttattaagtatgaaattctatccattcttacaaaggcaataactcgtacaatagcagttcgtacaatacatttttttacaaaattaagcttatagcttgggccaaatctaacaagggaaccgtcagaactgtgtcagaaaatgcatgtatcataactatttgatagtgcagggcggctactctgaatttttaatgttagcggtgtgttgaagccaaatagaaaagttattggacctcaacaatcaaaattttgactgtgttttccccttcagggaaggtggtgaagtggggaaaattttaaaaaacnggtggatctagtgggttaaattcctatttttcggaggtccaggttcgaaa

SEQ ID NO: 17252 - DNA, 1020 bp, Heterodera glycines
  misc_feature (12)..(12): n is a, c, g, or t
aagtgcaccccntcttttacaccccccccccccgcctctcccaatttaaaaatgtaagcagcattggcaggcccctctcatcgcaaaaatggccccacatttaccggcatttgccccacttttggtgtcgtccatgtcgtacttcacgtagcacagctggggccgcgtggtggtgaaggcataggcggcgattttgatgggtttgtcgggcaccagcgcacgcatcagcgtcgacttgcccgcgttggggaagccgatcagcccaatgttggggcacagcttcaaattgatggtggcccaaaaggcggtgcccggctcggcactgaaaaattggggggcagaattgaaaattgggataaaaatttaaaattgatgtcctaattaggcccataaaattcccctcttcgtaataaaaaaaaagtattcaaagaaaaattgatgcatttgggtgaaaattttatgaatttctaaccaaatttcattacaatttgcaaatttttaattgacaaatgaaacggctctaaaattaaaaaaaaattacccaaaaatgctcaaaatttggtgtcattgttgaacaacaattgtcgctattaacttgtataaacccaattttttctcatgtatggtatataaattttgggaaattacacaaaaaaattttttggggaaaacacaaaaaaaaaattaaaatttttttttatgttttttggttggttatgcgcctatggaaatgatggtatgacaaataaaatgtttacaagttttatataaaaaatgaattttttttttaatttctacatgcctagttttgaagaatttattacccattgaaattgtctgaaaatatgaaaaaataataaaaaatgattttccattttttgggaggaggggtgacgagcaatcccaataaaaaagcgggaatcatttaaattaattaccccccccccccccggtggcagtgcccccaataatttacttgaatttgttgtcagcgcaaccacccatcccccctttggccaa

SEQ ID NO: 17253 - DNA, 2255 bp, Heterodera glycines
ccccccgcccgaaacccaaaaagtaaaaaattttcagtaaattttttttgaaattctaagcaattttcttaacaaaatagcattaaaatactcaaaaattttcccggcggcgcctatcggcaccgtcggacccccattttagcatatttttgaaaaatggaggccagaatggaaaaatattaattttttggcgaaaaattttgtaaaatacaccccataattcgggatttcaaaaaaacccaaaatacacccttaaaaataacagcaaaaaatggcacttacgcggatgtcacccttggtgaacaggaaaccgttggcaatgtattcgtattccatcctgaaatgagggggacggaattcacaatttatttgccggggacaaaatgttcgatttcgacctcacctcagccccaacgatttgacaaagctcatcatgtcggtggaatgaatcaacgagtcgatgaccttgcgcacgaccacgtcctgaaaaggggcaaaaatcggcaatttttgaaaatgggcaaaattttctgaggggtaaacgatgcgtttagggggaggaaaaggcaatatcgcaaccaaaaattgcgtttaaatgcaaattataaaaattttacacaaaaaagtggctaatttttaacatgcgttggtcatggaacgggaggggaaacggaatttttgcattcgtcaaaaaaattgaggcaatttttgtaaaaatttggggggaaaaatcaaaaatccttttacagactgatgaaatagcgaagaatttttcaatgaatttggaaatttggataaaatttttacaaattccatttaacaatttttgcgttaagaaaaattgccaattttgtaaaaaaaaaatttttcaagggataaattcttatattttaaagtacgaactctttaagtgaataattctaactgtttttgccaattttatcgtttttcgacaatgcatgaagcctctgggcggcattttcaatatcccatgggtttttttttgccatttttttgtaaaaattttatttggcactttttccggcaacgttttggacgaccccgcccggctcatcacccgccttaatgtgtgcctcgggttgggacacgtaacggcagtgccaatgcacagtgtccactttgaaacgacggcgcatttgcacttggacaggcgactcaatgcccgtctctgaaattgttttagagcaatgagaattgggcaacaaatcggaaaatcatttataattaggaaaataaacgcgtgcaaaattacgggttgttaaacattttgctggaactttaaaggatcgctgactaaaaaaaaaagtcatacattccagcgaattcatcacccggaccaaaattcgtaaaaaaaaaaaaaaaaaatcgaaaactcaaatttgtgaaatccgaatttttgggtcgaaatatttactaaatacatgaaaacgaacagaaagacatcaatattgtaatgcatgatttcaaccggacaaaaattaaattttttagttgtacggtttaggtggcccaattttttgaaaaaaaacaattaggtctgcaaaaaataattttcaattttttaaataccaaaacggacccctctctttttcaaaatttggtccacctaaaccacatatacaaattccgaattggcttaaactgaactcagcttgaacaccatgttgtgctcaaaaaagggcgtcggtccgtccgggtcgcacagacccttcagccgttggatcagttggtctttctgatcgttgaaaatgctgccgaacagcacgcactccgtgctctgatattggctgaccgggggccgacgaacggacgcggaagaagcggtggcggaatggtctttggcaccggcggaaagtgccgaaactccgctgccaatgccaccgccgtaaacactcaacggcaattgagaccgattgttgagcagcatggaaaatgaatggacaggacaacaaagagggaatacggaagcaaatatctaataagtctgtattgagaaagaaaaaaatcttaagaatatatatatcaaatctcacaaaaagcattttgatcttttgtttcgttaattaatcctagcccaagcttacctaatttgaaattattatttttttatggcattttgccaataacaaaaaattttgctttttttgtgcctttggcgaaatttaaagccgtttacccatggcaaaatgactaagggtttgacagaattgaccgggaccgggcttccttcggga

SEQ ID NO: 17254 - DNA, 796 bp, Heterodera glycines
gttaaaaaattggttgtgcttcaaaaattttcactacgcataaaaaatggttttttttacaacagcaaatgcaacatcaaaaccatcaaatgatgcaaaacccgcaaatgatgcaaaatccgcaaatgatgcacaacccgcaaatgatgcaaaatccgcaaatgatgcacaacccgcaaatgatgcaaaatccgcaaatgatgcaaaaccagcaaatgccgtttaaccagagtggcaatttcagtggggttggcatgatgcctatgttgcaccaaaacatgggagcaatgggcatgggcatgatgaatgttggcagtaccagtttcggcaatttgcaacaatccaatatggttcagtttcaaaaggcgatcggggaagacattgtcggggatatcctggagaaatattttaaaaattgttgtggacatttttcattaaatgaaaaaatcgggaggggcccggcagtgccgaaatgcgtcgccttgggaaaaatagaaaattttcatgtttttagccgaaattaaacaaagaattttcgtgcttattcgctaaacgatagtcgctgaacaaattaagaaattataaaaaaataaaattaacgactaattcataacagtgataaataagacattaaatttatattgtttcatttaacagaacaaaattttcccataaaataaaataaaattgtttggtttttctccaaaaaactaaaactatgtttggacttcaaaattattcttctgcgtaaaaaggttttttttttaattttctaaaaatattctgacaacactga

SEQ ID NO: 17255 - DNA, 990 bp, Heterodera glycines
aactaaaaatgctgtagtaaaggcaggaacaaaaaagaaacaagatacagtggcattgctgttatgggaaaatgatggatatgactagggctgggaattatattggatataaaatccaaaaatatgtccataaaatatggaccaaaaatcgcaaaatatgggcataaaattacaaaaatatgggtcataaattttccggattggagggaaaattttccaaaattttaaaattaattcaattttactaaatacatctaaaaatggctaatatggtattaaaatcagtttagaagaagaaaaaaaacatgttaaactcgggcaccaatttttagtttcgaaaaccgttaaacctaaacccacaaaaaagtatgctaaatttgatgatgcatatttggggatgccattttttaatacagattaaaaaaaaatcaattttgttacattgccgaaaccagctgttccattgagttttgcggaagagttcaaagtggtaaaatcaaattttgtgggcccccattgtggcgcgttaatttcacgttatataataatatccagatgaaattttgcgtattacaatccccgaaaatccattttacatttgccaagaaaccaaaaaaacacattcatgttcctaaaattcagacattggcccgttcgatattcattgacgcgctctatggacgagcatttctgttggcagtgttgttatttgggaagttggaacgtctgtattggtctgcatcagaaaaatggccgaaatggcagaaggcaccaactgataaaaccaaagaattgagtgatgcgttcaacgacgcatcacgtctgttcctgttgcatggccctgttcagctgtgggaaatcagtcaagtgtacagtgatgccatccaaaaattcataacggaagaaagacgaaaattcacaaaagcaaaatcggaagtataaatatcattagggaattcgaaataatacagaaaaaagtcgaccgccagg

SEQ ID NO: 17256 - DNA, 2739 bp, Heterodera glycines
aaaagtaaaattactacaaaaattgggcaattttttgctttattatataaattttatttggcatttctatcacatttttaaaaaaagatacaaaaataaaagtgattttggggttcgggaccaaagggggtggacaggatttttgagtggaaaaatttttccacccaaaatctttcaaaaacatgtctttaggcgttatttgggccgctgatcacgaatacgtgatcagattttacttttgacatcgtcaagacctcagaatccctgtgtgattggggattctgggacatgttctgaggggggagggggcaggttcggatccggacggtgtaaattattttcgttatatttatggttatttaaatgtttttaacattatttttctatttatttttgagttattttcaatgattttaattaatttaaaatattttgttgagttaataaataaaaaattatatttaatttaatttttttttgataaataaattttataagtttaaattaattattttttaattgatagaatttcatgtatttttttaattaaatttgttaaaaaatattttcattttaatttaatgaatttactaatcactgttgtaccacttttaatcaattctttagtggttatttgggccgctgatcacgaatacgtgatcagatttcaattattacatcgttaagccctcagaatccctgtgtgattggggattctgagtcatcttctggggggggggggggcggcaggttcgaatccggacggtgtaacattatttttctgtgcatttttacgttatttttaatgattttaattaattttaagatttgttataaaattatttaattaatttatttaatttcattatttatttttatgaatttataaaaaatgaatttcatttcaaaataaatattcaattattaattttcaaaattatatttaatgaataaaaagagtattttattataaaaaaatttttaaattaaaatgcattcgatttttataaaaacttttccttatttattggggtgttcggaaagttctttcatacgaccaaaaatttcattaaaaaaatcgtaacaaattaactaatgaaccaattttaatcaaaaaatgcccaattattctccacaatcttctcccatttttgagaatttaaaaatgatctgtcgattaaattcaagatagttaaactcaaataaactgatcggtctacttaaaaaagtcgccaaattcaaccactgatttcttggccaagaaaaggctaaaggcacaaaacaaattatggttttgtagagcaaagttgggactatctgacaagctgaaaaagagtcaccaagaccgacgagttatttctttaaattgtcctgtctgaaaatgggtgctcaaaagtgccaagattcagcaccctctttgtacaacattgttctgaaaggacctaataaaatgaaattgatgttttcatgggcaaaccaaacccggagaatccgaatatcgcctcagatttagtcagttgctgttctatgaccctgtactgcttcaacttcttgtcaacgacatggagcagtacaatgccagagaaaattcagagatcaaatctgaggccagatttggattctccggacttgagaatttttggaattttttaaaaattttttattttttgacaattttttggccctcgggattttggcctaatatttaaaaattcataacaaatcgaagggttgatcaattttacaggaataaagccttaaaaatagagaaaaatcaggagaattttatggactttatttggaatttctatctaaaaaaggaaaaaagttattccagaatttctggaaaaattcgaattttcagaaaaaaaaatcataactcggttctgaaaagatattctggaaaaataaaatactacaaaaatccgcaatttttttctttataatataaattttattttaaatttttatctcttttttgcgaattgttataaaaataaaagtgattttgtgcttcgggtccaaaggggtgagcatatgatttttgagtgaaaaaattttttcgacaaaaatcttccaaaaacatgtcattaggggttatttgggccgctgatcacgaatacgtgatcagattttacttttgacatagtcaagacctcagaatccctgtgtgattggggattctgaggcatcattttttgggggggggcaaagttcgaagccgggcggtgttcattatttttctttgtatttttgggttatttttaatgtttttaattaatttgaagattttataaattatttaattaattaatttaatttcattatttatttgagggtgctgatcactaatctgacatcagattttagtttatacatcgttaagacctcagaatccctgtgtgattggggattctgagtcatcttctgtggggtgggggcggtaggttcgaatccggccggtgtaaattatttttctatgactttttacgttattttcaatgtttttaactaatctgaagatttgttgtagattatttaaaaaaaattttttacagtaaagaatttaattatttattttttgaattttctaatcactgttgcacctcttctaatcacttttgtacctcttctaatcgcttttgtacttcttctaatcacttttgtacctcttttaatcacttttgtacctcttttaatctctttttacctcttctaatctctgtaaggcctaacaaa

SEQ ID NO: 17257 - DNA, 1848 bp, Heterodera glycines
  misc_feature (354)..(354): n is a, c, g, or t
  misc_feature (356)..(356): n is a, c, g, or t
  misc_feature (1744)..(1744): n is a, c, g, or t
  misc_feature (1779)..(1779): n is a, c, g, or t
tgttgtgttcgttaattatttgaattaacgccaaaagatgctcgtttatcgatcattattttgaccccttcgttcagtccatttaaacccgcccttttcccccatccgtgcatttcttcctcatttcatttgttgtatttccaatattattgtgaccccgctctctcccctcgctttttatattatatttatttgtgttgaaataaatcaatatttatttcattgactgttgacggacacaacaaaattttttcactattacacaaattatttattatcaaaatttaacaaactgtctggcaaataattttgctttaatatgactatagacatataaacccataacaaaaaacncncgccgtgcagattaaaatatttctttaaaaaagtaatattaagcctagcattaaatatttaacaattttgcaaaaatttatttaaaataaaaaatgctaatcaataatcttcaatttagccaaaaatatatttttatttccttgttaatattgactgatttatttttacattatatgcaaaaaataatatgaatatggaatatgctgaaaattctcttttttatataaaatcatttatatatatatatctctttttattttatactttttatatttttgggtttccgcctctgaaaatattagttcgacttaatttcagctttaatattcctaaaatataaaaaatctattttttttgaaagtgagtgaatttcatttattatttcattatagaagagtgaacaaaatggtagtcttgatgttgcttaaagccatgataattattgttttaatatgctatgtgattagtaatgacaaagaaaaggataaagcccatacgagcattggtaatagtaaagctcataaatctgatctatattctgataaatctaatcttcaacctgatgatgctcaaattaatcaacaacatcttaatgctaatcgagatagtaacaaattcgatcataatcataataatggaactaataccaattatgatgctaatcaacatgaccaacatcatcatgctaatggagttgatggtgattcggatgataatcagcttgatcagctttatgcaaatcaccaactcgttcaattacatgcaaatgggaacaatgatcaccccgaaaatgacaatcttgatgataacaataacagtgataagtcaaaaatagttgaccttgacgatgaattttgggatcagttgcctgagctcaccaaattgccagaattaaatggagtagagtttgttgggaatcatataaaatacaccaatcaaccaaaaagcgacacgcataaagacaaggaaattaataacagtaaaagaaccttatcttagagaaatttaataatttaattaagtttcggtaaagatggacggaacacagcagaaatcaatttgacattgaaaaggcaagaaaatagctgattaaatgctatcaaatgaaaagattatcggggttttaggttttgaactggatcactaaatctacacaatcatttctatattttccttattttcctgagctaaactttgtaaaagtgatatcatttctattcatgcataaaatatttttgttctgataaaccacaaaatattttttataaaatagccaattttgattttgcttggttaaacaaatcccaacataggtgcttttatgtataaaaagagaactctatcataaattcttctcattgaattaatcgtgaagataataacggtnggcgatcatttcgtcactgttcaattcttcacagntcatttcgactgagaaatatattttttaaaattggctaaatatcgaaaaattttattttatatcttttt

SEQ ID NO: 17258 - DNA, 1190 bp, Heterodera glycines
  misc_feature (27)..(27): n is a, c, g, or t
gcacttcgggcgctcgatcagcttctnccacgacgggttcttcagccacggctggtgcgatgacagcagcgggtgccactacaggcaattgcgcttgtccaccatgctgaaccagcggtggtgccaatggcaaatcaaacgcatcattgaacacgttcaatgcatttgtgccgttttcgtcagtgcttctcacaagcaactgattggcatggaaccgtccgaattttccgtcaaaaaattcgacgtcgtaaatgacacctttacatttggtgacttttccggggcgccaaggctgagaaagacgatgccgagcgagaaccttatcgcccacggcaaaagatctcggtttggctccatggcgcctattaaattgcttctccatggcctcgtctcgaattatcggtgcctttggctttggcctcaacaagtccaaagtcgtgcgcggtttccttcccaggaacaattcggccggacttttgcactccggcaaagcctcacaaggcgtggtccggtatgttgccaaaaatgtggtcaacatttccgaggctccttctcccttgatcttccggcatgtcctcttgaacgtatcgacaaaacgctcggcttgtccgttcgacatgtgattgtacggagcggagaacagatggttgatgccattttcggtcacaaattccttaaattcttttgaagcgaattgtgtgccgttgtccgtgactaaaatttcgggaaggccataactggcacagagtgatcgcaatttgtcgattgtagccgcggaattcgatgaacgcatttcgaagacctcaggccacttcgagtatgcatcgacaattatgagaaacatttttcccataaacggtccggcgtagtccaaatgtacgcgtttccatggtccgtcagattttggccacgagtgaagctcagtcttcaccggcgcttttgcttccattgtgcattcgttgcacattttgacaaaattctcaatttgttcgtccatcccaggccagtaaacgtactgcctggcgagacctttcattcgcttcattccgggatggcctcgatgcagaagttgtaggacatctttttgaagcgatgccggaatcacaactctgtccgcgtaaagcagacattcatcctcgatggtcaacgcgaatggtcgtcgatggaacggaacaatgtctgcggccatt

SEQ ID NO: 17259 - DNA, 3118 bp, Heterodera glycines
  misc_feature (1506)..(1506): n is a, c, g, or t
tttataaataaaatccttgttaaaattaagtcccaaattgttttgttaatattttttgacctttttctccttttctttccaatttttcatttaatttaatttttattttgtcatataattgatctaattgttttaatatttgaagtttttcctcttccgaatatttattattcattccaaattcactgttccattcaaaaatttttagccgcgaatttttgtgcaatttttatttcaattttagtccattctttttttgaaaatttcatttccatttgcttaattttttccttaattttgttaaatttttccacaatttcttttcttttgatcaattgcttttaaaaatgatcagaattaagtccattatttgttggcaattgttcaatttgatcactatttgttgaagtttctctttctatttccaaattttcattaaataaatgattaaattgttctcttgtaataattgtataattttttcatcattttttgtctcattttggccatccgtttgtccaattatcccattttgatcagtttcattctttccattttcatccgaattttcttcccatcttttgccaaatatttgatcataactttttttcttcctttattccaccagcataaattttattctatctattatattagattattaaaaaatgtataaaaagtatagtttataaagtaatatattagtaatattaattctataaatcactaagtagaagtgtgaagaaaatcattataaaaaaacaagtagaattttctgaagccaagcaataaataaataacagcataaataagggaataaaaatgaatttgtaaaagtatttgtattagattttaatggttttattcagaaatatgaaaattaatataaaatgaatataatttataattacaaaaaaccttaaaaaataaattgatttccttggattttcatcaaagtatgattacaagaaagccctaagtagaattttgaaacatcattataaaaaaataagtagaatttgcttaaataattagcaaaaatttgagaataaaaccaactagaaaaagaatttttttattaattttattcagaaatatgaaaattaaaatattattttcaatattaattttcataaatgcaatttttaatatttatacgagaaagataaacgaagaaaaaagcgttgatgaaatatttggcctgggacgaaaaatcggaggaaaatggagggaatgaaactgatcaaaatggaacaattggacaaaaggatggccaaaatgtgacaaaaaatgatcaaatttttgatgaaaatttggaaatgaaggaagaaagtgcaagaaattgtgatcaattggaacaaatgcatttttcaaatgcaattgacaaaaagaaaagagaaattgtgaaaaaatttcatagaattaaagagaaaattaagcaaattggaaagaaatattcaaagaaagaatggcaaaaaattgaaagaaaaattgcaaaaaaattgngagtaaatcaaaggaaaatttacaaatggaaaagagaatttggaatgatgaagaacaaaaattattcagttgaagaaaaaagaataatgtacttcagcaaatttgatcaaatatatgcaaaattaaaaatgaaattacatgaaaaattggagggaaaaagagaaaaatgcaaaaaaataatagcaaaacatttgggcatacatatcaaaacaattttttattggaagaaacaattaaaagttggaaaatattttataaatcaaaaaaatgatgatgaaaaaacggaaattgttgaaaaatatttagaaataaaaaataaatttatgaaaaatggaaaacgaaaagattggaacgaatttacagcaaaaattaaacaaatctttggtgtgcataataaaacaattgaaagatgggccaataaaattggaattaatcaaaagccgctaagcgatcctcatagtttaggaatatgagaatttggaaatgaacaaataattaattaaaaacgatattgttttaaatttaatttaaatgcgatatttttatttaaattgatttaaatttatttttttaattgaaatagcttagctatttaactttatcttcctcttccactttctgttcctcttccactttctattcctcttacactttctgttcctcttccactttctcttccactttctgttcctcttccactttctgttcctctccactttctcttcctcttccactttctcttccactttcactttctcttccactttctgttcgtcttccacttcctcttccactttctgttcctcttccactttctgttcctcttcctctttctgttcctcttcctgttcccctttctgttcctcttccgctttctctttctgttcctcttccactttctgttcctcttccattttctgttccactttctcttccattttctgttccactttctcttccactttctgttcctcttcctctttctgttcctcttcctgttcccctttctgttcctcttccgctttctctttctgttcctcttccactttctgttcctcttccactttctcttccactttgttttcttggcgatgtctgtcggcactgccgaaccctaaaattatggttattaatttttggggaaattctaattattatttatttatgttttgtcaccgctgtgacgaacgaattggaaagaattggatttttaaccattttttattaatcaccattatttgtgccaatttttggcttatttaacgattaatcactcttatttactaacaattttccatatgattgtgcccctcgccccctcattttgtaccatatttaaccctccatttgtaccttccatttctactccagtcactattcacacataaccaacacaaatccattcacatttcatttaatcaccgataaatctgcaccaactaatagctgtcaaccacaaattaatcactaattaattactaaatctgtacttgttaataaggggaattaacaaattggtgccacgaccaactaaaaaaaaaataaatgtcaaaaccaatacgcatgcgtattaatccatcatggagaaatctgagagaaagattaactcaaa

SEQ ID NO: 17260 - DNA, 953 bp, Heterodera glycines
ccacactgcggaattgcagctcttttttgcggcggaatacggcgggattaatccaaatcttatctttactaataattctatcaatctagttgttgaaagttttctttttcatacggtcttcggcaacccgactcttcccccccccgcccccggcctgctgatgttagcatggaaagtgtcgaagtgcgactctaataaaatagaaaaaaaacattaaaatgattacatcaataaaattgtaaattatgcggaataaaaatatcaaataaactaattctgataattccttcatcattttacacgaaattggatttatattatattgtaattattagggttataagttgtatgattttgaatattttttctgcgcatatgctatgaagaaaggggctcaaaaatagcatttctacgttaaaattttttgatttggtgaaggtttttagtgcatataaaagcatattttggggttttcgagaataaatgtatatttggccatttttgcgttttgagaacatatttcggtcattttggcaaattttcataaggaaaatgccaaaaatacacccctaaggatcgactttttggaattttttaaaaaatacacccttaaaaacagaaaaaattttaatttttgtaagaatttttggaaaaaaatttatgtatataaaaatgtaattttgttttatcatataataaaatttataaatttgtaaatttcaatatttttgcaattgtctaaaaaatgctccttagcccttgttttggtttatacacaatttttggcattttttgagggctaaaagccatttttggcagttttttaaggcatattttagtgcatatttgggcatttttcgggtttttagggcatatttgggggatttttagtgcatattttatgcgcatatttggcattttttagtgcatacaacttataaccctagtaatta

SEQ ID NO: 17261 - DNA, 1662 bp, Heterodera glycines
  misc_feature (1610)..(1610): n is a, c, g, or t
ctcccccccccccccaatttcgcctttccccataaaagcggcgattgattcctccgaggggacaaagacccatttgggtggaatcaatcgagtgaatgaatgaataaatgaggcggggggagggtgtcgggagggggacagtctcgactctctcgactcatttcgtcagcggagatttgcatcatatggcggacattggaaatgcaatggacagcagcaccaaacggagtgatagtgataaagtgaatggagagagaacagtgataagaaaaggggggaaaggggagggacagagtgactttggcatttcaccgaatgaatttaatttaattactatttttttgtaaatttaaatggaaaattactcggctcagctgttgaaatgtgtggtgagtaattgttgtccgcccaatgttttccaatgaatcagcgaatgaatgccttctcttttcctatttttctgttcgttttcccattttcgtaattacggtgactaattaattatttttattcaaaaaatgaaaatgaaaaaacagaaaggaatatacataatacaataacatttggtgaaaatcaacatgagtaaataagggatgtaaagcttttaggcattgtccgtcttccttcgcttcgctttctttcaccacattctcagtccggtggcacttccgtttcttatcatcgtattcttttcgtccgaatgcaggtcgggtactgtaaaatgcaaatttagtttaaatcccgaaagggaacgaatcacccgtgggacttggcaaatcggccgattgttggtcatccaacgagtcgaacttggtgggcaggagcaactcacgttgggaatcggaaggcaaaaggacggtgggatgctgtggaggtacacggtaaataaacgaaaaacggtaacggaaggtacggtagaggaaaagttaggaaaattaaacaaaaatataaacggatgagcaattttttcacctttttgccaagattttgctgctttaagtcgggcaaagcgtcaaaaagaattgaagcgaaaaaagtggacttttctagagttaaatttaaaatttaacaattgaaattaaaataaataaagagaaaattgaccatttaaagaggagagaagagaattagtgccattgggagaacggaagaagacaaagtaaaagccgaggccaagcacacaaatggaaatgccaagcgaagtgacggcgaactcacgccaaattgggatggccacgagaacgatgttgatcagaaggaagagaaaaatactaaaggaaagagagagaaaaatgatcggaaaaggaaaagagaaaggaagagaaaatggtgaaggaaaagagaggaaaagtgatcggaaaaggaaatttttaaaggaattgatcaaatataataaaaggaaaatttaaaataataagaaaaagtgattaaaggaggaagaggaaatggtgaaaagaaaaaggaaaataaaagcaaaaataataaaaggaaagtgatcagacgagaaaccgaaaccgaccaaggcaacggaattcgaatgggcgtccgaatggacggggatttgacgatagcgaatggtcagaagagcacaaagagtgaacacacgttgngcccaaagccgaacataacgtagcaaatcaagtgaggggggggggggggggg

SEQ ID NO: 17262 - DNA, 898 bp, Heterodera glycines
  misc_feature (872)..(872): n is a, c, g, or t
tctagagtctgaattctcttgctcccgtctctttttttcttttattcccttacgtcggcgcgtgtcgcccctctggcgccgattgattttattgccattgacgtgccaattgctatgggccgtcgcggatgattgttgtccatggacagtggagagcggccaattttaatgcagggccaaaaagtgaccaccgaattgtgcccgacgacgaatggtcaacgtttgccaattctcccccatgtacacatagtgggcgattgttgggcggaaaatgccgaaataaaaaagggagcgtaggcggcaggaattgaacccaggatgagaatggcggcaaaggcgagcatacaggcgaccaaccgatcctcaatcctgcaatgccgccaactgttaccagcagtgatcggtgccgcaaaaagtgtactaccgcactcactattcacctttttgcactactttttgtccaaaaggctaaatgcgcagaaatttgtgtccactttgctcagcgtttgctcaattttgattttgcatgaaaccagaagacagacagatttttaggaaggaaatagccaaaaagcaaaaaattttaagacaacggtctttaaaaacggcaaagcaaagcaatgattggaatgtaacaataattacaaaaagaggggggtaatgaatggtggtatcattggaaagtccacaaaatgtaaaaaaatagaaaaaaacagtcaaacaaatgaattaaataaaaaataaatttaaaaaattggtaggactaaagatatggccgtgactgtagtacaaactgaagtgttgttgaggaacacatgcgcagttggaggatgcctacgaacaaataacatcctccaccaaataggcaactnttttattttgtacccctcctcttttc

SEQ ID NO: 17263 - DNA, 1020 bp, Heterodera glycines
tggcaaccagtcaatggaccaaaagaaagaaattcattggaagttgaatcagtcaaagcgctcttactggtgaaggtgacttttgatctcacctgcgcggaaatgaggaaaataatcagtgaaaataaaaaaatatggaaaaaatccattccggtgaaaaatacaagccatttgaataatattattgatttttcattgcatataataaaaattttaaatgtccttggatttcatgaattttccacactatgtccttgcaaatcggcatactcgtccttggaaacggagcatggacgatggcagccctggtattatgtaatgaataaaaattcgaataaaagaaaaatttgttatgaaaagcctcagaaatggattatttaatattttaatccgtttttaactgtacaagaaaaatttttgaaaaaaaaagttctggtctcgagtctctacctcgagaaaagtgttggttttttggggctcgatctgaaatctcgagaaatttaattttgttgcgggacgggaatcccgcgcagaaatatcgcaaatcccgcgggagtcacgctcccgtagatctatagttagttagaaaaattataatcgctctttcatttcggtaacgaacaatcatttcaacacggacaccctgaaaatcaatgaaaatcggaaatatttgaaattcaagactgatggttatccaacacatatctcatccaagcgactttctcttttgcttgttgttaaggaataaatttgttataaaaccaatatgcatacttttacatacctatttcttattggccacttttttggctttctttttgtacatatctgcagctttatcgggcttttatcacctatttctccctatattaatacttttcgccacctatttatgtacagattgttagttattttgctgttttaatcaccacaaaatactaacttaattaattaaagaaaaaacgattactacttgtcacgaattcgtcacaaattctcacaaaatggattattgtcatt

SEQ ID NO: 17264 - DNA, 1887 bp, Heterodera glycines
  misc_feature (721)..(721): n is a, c, g, or t
tatcccattttaaagtacacagattaaaaaaaattcttttactaaacttttttattttttaattatacacacaagataaatatctgaattgggtggatttgcatatccgtaaaattatcggggagagggagataaatttttttttcaaacaatgctaatttgtcagttggttaaaatttgtgtttgcggctcagaggttcaagcccatttgcctgcaaaatattaaaaaacgagcggttgggcgccaaccgctctattttaatttttaaaatgatgtaaaaatttttttaaaaaataacttctttccatcgtggcttcaattttcttctctcctattctcggtcttcttctctcatccatatttttctttctttctctctcactcactcactctctgtattttctccctttctcactcactctatcccagagctgcgatctcaaaattttgaaaatccacatttcagccataaaaaatcctcatttgccactaaaatacctcaaaaaatcctcatttggaatgaaaaatactcattttttaaaacatcataaaattgcgatatggaaaatatggatatagaactccttcatagaggcttcaaaccaagctaaaaacatgtttttcatgcgtttcaggcctccaacagtacaggaaaaaaatatgaatttccatataattacaaaccctattataagcattttatggaagtctgagctcganaaatcgaagttgcacttcacttcggccaatgctttcactgtgcatctcttaaattttttgcttttaaattgctcttttttggtgacgtggttttccaaaaaactttttggactggggagggggggggggggggcgcccggggcagtgcccagataggcgctgccagaaaaaaatttgagaatttttgagtgcgatttgttaaaaatttttgtcaaaaaaaatgattttgactgagtatttttcgaaatgtttaagatttgaagaaaaagttcgaacattttgccaaatatacctaatttttcaaaaaatcatgcatttttgtcacttttttgtcaaaagaccacaaaaatacgcaaatcctcatttttcaaaaaaatcctctttgaccctctaaaagaccacaaaatgagtaaaaatactcagatatcgcagctctgctctatccctttttctttttgactgccgatagcggtcagttccgtcccgggggaccgtaccgtgtgccgcgcgcggtattccaagcaccccaccgcaagttgttcgaaatagtaaatatataagaaaaaatttatctctcaaatcatgagcccttctcagaactaagtattgagttgcattattaacatgtaaataaaattttgtgcatttctgagtactttcttaaaaaaaatcttatgaatagattttgcaaaaaaaaataaataaaatagtggaaaattttgtaaaaaatttttttttaaactaataagcgttgaaaaaaaatgcataaaattttacactctctcaattcccctgctgatagtatcacaaaaaatttagtttttatacatattcaagcatacaataagacaaaacaattgtatgaaaaatgaacttgttcataattaatcttaaaaagggtcggacataaatcgcggaacagtcatacatacgtataaatagaaaataaatttgctctccttaaattacggtttttccattttttggaaatattgaaaatccaaaatgaccatgccctctgtgatggtagacaaacaaaaaattcacatcaattttgttctctacaattctgtttttgttgaagttgtgccggtgttgtggttgatgtcttagttagtgccaatgacattttggcatcccctgccgggggaggcaagacaaaagca

SEQ ID NO: 17265 - DNA, 1323 bp, Heterodera glycines
agcagccatcgttgggccccgagagttgtggtggtggtagcgatgaagggctgctggtggagcgtgcaatttaaattggtgccaaattttgcaatttgttggcattgtatggcggcagcagcactagacacagtgtgatgatgagccgccggtgctggtaatagcatataatgactgtgggctacagtaggaccagtagccggcaactgaacgttgttacttggcattgcaatgcctatcggatgagccggagatatgtgctctgaacatttaatttgtttttttttaaatagcgatcatgttgaaatgtcaaaggtagggggaggaagtcaaccaaatttttgggtgcactacgttccgccccccccccccccgccggttcctcccgacccgccgtttcaccccctcccccgaattttttttaaactgttaaacttagtgaattttttataagctttttttcaaaaattctctaaaccggcaatcaaaaaaaattttcgggggggggggggagcggaacgatgcgggagggtgtgggactgagatggtagggaacggcgtatggaaacaagctgctcccattttttgaacaattcaagcgatgtaaatcgaagattttgcggttaagttttttcttctttttccattaatgtttttccaaacatgaaaacaatttgcacaccgtttgtacaatacgcctgacgctgatgttgaagaacaaattgtgatggcgcaacaaactgttgttgttgttgttgttgatgatgatgatattgttgcatttgcggcactccaattggcaaaccagcactggcacgaagattgaagcatggctaaaataaaattgctttttaatcatttaaataaataaataaaagaatcaaaaaatagttggttctaattgttggagcaactttggcggatgttgtatgaaaacatttttccatgcaacccccagccttaggtcaaatcatccgttgtatgtggtgtttaattgtgcatgtataagaggggggaggggaccccgtttcaatttgcgatgtttcacgactcttttcaatggcatttaaaatcttttatatctatgccaatgtgtcccctagttatgccatcaagtaaatgaacacacacaccatcacaaatttctcctgctgctgcggttgttggtgttgctgctgcaccaattgaactgtttcaacgggttgttgttgctgctgttgctggtggtgttgtttgtccattgtccagctgaacctgttctcgtactggaaccggcgctccgggttgctgtcccgtgcctgttgccagcacatttttcgttgc

SEQ ID NO: 17266 - DNA, 2784 bp, Heterodera glycines
ccggcacttccgatttttgtcgatcgttgttccaacttcatcaaatcgtcagcaaaacaggaccaagagcgcacttcaacttaaatttgttatttacttagcaactaataaaaacaagagattaaaataattcatgttaaggaccgatccggctctaatgcacgctttatgagtccaaaagtattttatgagtttaatcaattaaccatccctggtttttatacaataaccttgtcatatccgataaaagtcgattggactcataaagtgtgcattagagccggcatttctctgaccccacccttgcacagttaaaattaagaaggatgagggagggagcggaggaaggatgagggaggggagagcgggaggaaggggagcgggaggaggaaggatgagggaggggagcgagggaggggagagagcgggaggaggaaggatgagggaggggagagcgggaggaggaaggatgagggaggggagagcgggaggaaggggagcgggaggaggaaggatgacggaggggagcgagggaggtgacacagcgctggggtggctgctgctggtcaccaccatttgcggtggtaccaccaccaccaccgccgctgccgattgatgcagacgaaatcgagtcgatggctttgaacaatgggcgaatgtgtgccgtgttgtggtgggacaacagtgcccagctgctctcaaacttttcatcgcatgaaatgcagcccaacacgtccggctcattggctgcaatatatttttttcaaattttttccctcatccttaccaaaattgaaaaataaatgaaaaaaaaaattctttttttttgtaatttttccataaattttcaacaatcagtcgatttatagtaaagtaggacttattgttaataacaagcattttatttttatcaatgaaaaagtctacaatttgtctaaatttcaatttcaataatttctggggttcccaattgacctattttggatggcaatttgcaaggacgctttcggtgctccacaaactcggccaaactgtgcgtcacgaaacggcaccctccgcaaatcaatgtgtcaagaatttctgaaaaattttgtttgaagttagttgaataaagcaatttttttgatgagtggaaacggtgtattccccaccctccaaatatcaccgactaaaatacagcaaatataaaacaaaaattgtcaaaaaataataaaaaatttattgtttaagtgtattataattaaataagaatttggaaatgtccagaaaaaaaaataaatttttttttgttgccctgaaaattccttaattatttttgccgaaggctaggtaacgaaaaaaattttttttttctttgcggcgaggcttccctactccagggacgtaagtggggcggcggtgtgcaaaccgtgccattaccggcattcgcatgcggcggcacaacagtgccaatgccagcgctgtccatttgcgcagcgaatgctttgtttgcgccattctttggcacgctttcggtcaccgacccagcaggtgctgctgctcccccgcccgtcccaccagtggccgtgtcaattttcatgcgcttcaagtccttggcagccgcctcctgttgtggctgttcatttttgttgcgcttccttaaattggggacgacacaattttttttttatttgaaaattttcaattaaaatggacttttttgatttttttaaggcccatagtccataatttttttttaattattcgatttctaacccgacaatgctttttgtaggagctccaattggaaaggcgccaaaaatgggtttcagcgcttgcgcaggcggcggcacaccgggcgtcggttgttgcccatgcattgccaatttcacatctgtcaaatgtgaaaaaatgaatgcttttaaatgggaaaaccgagttaatatttgcactattgaaacgccaattttacaacaaaaaaaaggaaataaaattccagcgaatctcctctatacggtttttgaacacgacgaggtagtcgctttttggaggcacccattctgattttcttctagaattaagcgggtccgggtattttggcaaaaaaaaaactgtccgggtactaccggatacagaaaaaccaggctcgggtccgatggcccaaatttttactgggcccgggtactgaaaaagtcaggtgtcctggttttgacccggtcgggcatacgggcccgtataaccctactctgtactatatatactttagcgatggcgataagaattttcaaaatttttgttaggaaattggcccaaaatcttaattaaaggcaatttctgctgattacagaggcctaaaaatttaaaagaaatgtcattacctagtgttgcgccgtgccaattgtatccattcagtgcggagaccgacaaatccgcctcggtgccgtacgaaaattggacaaatgcgtaccctttgaacacggtgacgcccaacaattttccataattgctgaacagttggatgatctcctcccggccgacctttgacgtcattatgttgcccacaaacactcgagccctaaacaaagcaaaaaattattaaaaattttgtaatattagacgaaaaacagagtaggaagcatttttcagtttaggtgggacgaggaaataacatagaaatgactcgtttgacttgtattttttggagaaattttacattttcggggggtctcctgatcatgaatatgctcctaatcatgaatatgtgatagattagactttattatgatgaaaagttacaaatcaaag

SEQ ID NO: 17267 - DNA, 1009 bp, Heterodera glycines
  misc_feature (55)..(56): n is a, c, g, or t
  misc_feature (63)..(63): n is a, c, g, or t
attaattaaattgatgcaattttttaatgatttttaactccttttcaacatatcnnttgtggntttaaaaaaaaagttcttggctttcccccctccgaaattttttctggcaactgaatgaatgttcgttaaatatcgtcgagatgccgattttataccccaaaaattttaatgtagggcccaatgagtgctaattaaattaattaattattttttttcaactttcactaaaagatttaagcctagaaatagtgagaccttttcttattttaagcgaccagttgctttgatcaacagcagacacaaatcggtcaccgtttttcatgcggactttactcaaagcgtaaatatttatttttgatttttatatcacaaaaattcgaaaatttagctaaaattaaataaataaagatttaaaaaatggcttaattaattttcaatatgactactaattttgtttatatgcttaaggaacacccaaaaataactaaggacaagtatcaacaaatttgggagttggaagaaaatccgattgtgatttggcacgatggttcagttcatttcaacagtgttcgattggtaaaatagagaaaaaaaattgggaaaatcgtacaaaatataaaataccgtatttcttgtaatagagcccccgggggctttatttcagagggggggggggctattacaggaaatacggtattttaaattcttgtttcaatacaatgctgggtaaaacagttcagggtcgagctctctttagctgaatttatttttcaaaaaattctatgaaaattttgggtttttttcttactgaaaattaaaaatttcaaattttattaaaggttaaaagtggcttgacccggagcaagagccagaaattcacccaacatgtttcgacacttctcgattgtttctcaccatttaatgtgctccgtaatttgaaactaatttaaaaaaaaatattttttaattaatttgggaaagaagagcgctaaaatttttcgactat

SEQ ID NO: 17268 - DNA, 2189 bp, Heterodera glycines
  misc_feature (11)..(11): n is a, c, g, or t
tagaaaaactnattccaaaaatttcataattttccgtaatggtagaaacataatatctagagctcgaccttggcatggatccaggcctggatttttccttgatcaagatccagaccaatcatttttgggctacctgggtttttcctggacctggattttcctgggtttttgtacaggaaactccaggtaaaatatgaaaaaaatccaagtcttggtccaaattaggcacaaaaacctggatttcctgcataattttgcccaggccaggcaattttttggcagctgggtttttcatgggattggatttccctggatttttgttcaagaaatccggtccaggttaaacataaaaatccaggtctaggtccaggttaggcaagaaaaaacctggatttcctggataataatgaagaatttgttatttcgagtgaccatgtttcatttcaattttcaaaaaatagttaaatagattaaaaaaaattattattgttggttatccaggcctgaatccaggccatgaaaatcctggagttttcatggacctgggtttttgtccaggaaatccaggtccaggctttttttctaaatgacgaactctaataatatcctttattttgccaaagtcgttatccggcattcttgtacgtttaaaattactatctcaatcagaaaaatgtgatccaaaaattatttccaatcaaatcattttttaaaaatttttcggcattttaatatcaccaagaattttcaggtggattatcctcagcaagatgacactgatgattcagcagatgatgaaagtgacaaagagaaatatgactttttgtcatggcaaaaaaaattgcgtcaaccgcaacgatcatttaaattgccatcggagagcaaatacaatccgttccaaagatttgatccatttcaaagattgggtccgtttcaaagattaggagtttacggtagtcgaaaggaaatggaaaattatttggacatttttggcaatgaaccgtcctcttccgtgacggcaccgctaattggttccatcaaaaatgcggtaaaaaaatgacgggaatgaaattaattagttaatgaatataattattgttgatataattgcttttaaagcccggaatagggctcgttggtactgagatgggctttttgctcgaactttcttagagaaaaattttggaaaacatctcaaaaaatgcggcaaaatttttccgctcctggccttaaaatttagtttgtaggaaaaagccgtcaggcaacagcatgccaaaaagcccgttttggccaacggagcgccgaacgggacttttccacggctttttaaaacgggcttttcgtaataaatttctttaccaagattgggtattaatcaaatttggcttacaaattagcattaatgttagcatgagagatatttttgagaattacaaaattttcaaaaatttgataaaaaatacgcttaatccaattaaaaaaaatcgacaatttgaaaaggcctaagtctattcgataattctttaagataatacattttttcgaaaatttccgagatgtcagatttgcagaaaacgttattaggtgtacaatttggcaaaaaaaaaattaaattttccaattacctaactgaaaattcgttggatcaataagggcaaaaattcaaaaattaaattccaaataattttttaggagattgatcaacagaacagtgaggacgagaaggggagcagcaccagcacaaagcgtgtaaatccattcctaaagccggatggaagcagctacaacaaagacaaggatgaataaacagaatgccaaacattcgaaggaattgatcaaattcaaaaaaaacgattgtatttatagagccctcacccaacaaatattggcacatgttatgaaatgaattagttaataaaatctgtatgttggtaaaggtggtttttaaaaattacaagaatttacgttttatttttggaaaatttttagagatctgcttttttgaaaaatcatggacctgcattccatgttgaacctggaactggatttcctggaaaaaatccaggtccaggaaaaatccaggctcctcgatgcctggacccaggcctggacctgggtttttgaaatttctttatcattttttgaaagtgaaaaaaacatcggtcacttgtgataataaattttaaaaa

SEQ ID NO: 17269 - DNA, 3597 bp, Heterodera glycines
atgaccgtttcttcgccgaattccctgccgatgactgccatggcatcggatggacaaacggtggccaaatggctttttcactccacttcaaaacaatgtgccaaaggtgctcaaatgttcgttgtacatggatgatgagaaatggccgttgaatatcgaaccgttcaaagcggtgctttcatttcatatttctttaatcaatttttcccaaatttcaggcttttcccagtgcttcatctcctgtcaatttcattgtcgtcattttgtttcgttcgtcttttgctgcctccgttttggcctttgattttaccaacgaattgactcatgaacaattggcattgaaaagaactgacaatagcgatcgttttctgttggtccgttgtccaattgcgcgagacgaaagcaaatgggcgaaatgggagaaggaagcgattggcttggaatctcttgaactatggaatcgaattagcattaatacttattatgagaatgacatcggggatgggtcagtgaataaccttcaataaaaattcaaagtcattgctttttctatttttagacttctcgacgcaatgcccggcccaagtgatcagcagtagaagtgaatgaatgatttgctgagaagtgattgatcaatttgaattgctgtgtaggatatgatttgacgttatataaaatttgttgcggtgatcacaaattgtgttatacaatatacagtttgtgtatatctctctgtatatgcccttaggataaatttaatgattttctgaaacagtggttggctttaagaatgttttttttctgatttcttaaaattcttcagaaaattttgtaattttatgtcgtaacgtcactcagatttccataattttccacatcggtgtctaacggcaccgccggacactaactaaaatcctttgtttttttataaattggctcaaaatcacaaattaaattgttaaaatgttctggtttttgaccccaaagcttgaatttgtcagtaaaagcattacaaaacaaatttgttttgttttttttaaacatttttttggcaagtaaaaaattttattaaattaatcgaatattcatccgaattcgttcaattggctttgcttcgtggccatcccccccactgtcgcttttggcgcttttcgctcggcttcttctccaagttgggcctaccttaaattttctagtcaattttacttttttgaatgttttttcttgccatttgccgccgatttttggccaatcttaaagtttggaattaaattttagtgtttcaaattatcacttttcacttttggttggccaatgccatctcgtttgtttcgtccgttctaatgccaacaaaaatggggtgtacgaaattttgtgtcgttttcgtgtcgtccccttttttcatcactttttgagtttcgtttttgagttttaaaatttttaatttcctttcgttttcgtgaaaaataaatattttcgtttcgttttcgaaattttgttttgtggttttcgcacacccctggagcgtatcttaaattctcgtcaattttcttttttgagtgctttttcttgccatttgcctacttggcaattaggacctctcaaatcttgtcttaaacattattaaagcaaaatatggtttcagaaaagggagtggcggttggggtaccatcggtcgtattaccaaattttgtgcatcatcgtttcctaggcaatctttcggttcatttgtcccgaatttttttttctaaaataaaattctggaaacacattaaaaaaaaaattcgggaccaatgaacaaaaagaattctgtgcatcttaaatggtaattaattaaaacccatttattggagggaaagtgacaaccgactttatcattaagtcaaaagaatgagcctggaatttcagtcaatttatcctaagggcaaatatatatatataatacaatttgtgatcatcgcaacaaaacaacaattttatatacatcagatgggctcaaattcattatccaactccacatcaattaaatagatcatttctcaacaaatcgttcagtcatttctgcttctgatcacttggatcgatcattgcgtcaagaggcctaaaaatcgaaaagcaataaatttggatatttgaataagcattattcattcactgacccatctcaaatgtcgatccgattccactggtccataaagttccatccaatcgcttcttcttcccatttggcccatttgctttcgtcgcgcacaatcggacaacggatcagaagaacacggttgatatcgttcatcttcttcatcgtcaattgctcccgggtcaattcgttgatcagatcaaatggcacaacggagaaaccaaaaggcgacggaaagtgaatgatggcaatgaaattgactggagatgaagcattggcaaaagcctaaaatagggaaaaattggttaataaaagataatgacaatttacggttgggggaggaggcacgaaaacccagagagggtcgggatcactttggagcgcgacattttggcgccgccaaattaaaagtgtgccaaaaaacttgccaaaaacgagttgaaatattgtccaaaataattttctcaacgaaccccacaaagaccataaaaatgccaaataaaacaatcaaatcgaaatcaccgatttgaaggcttcaatccttgacgaccaattctgaaaattcatgtacaaccagcatttgaacacctttggcacattgtccgaacggggagtgaaaagccatttggccagagtttgtccattcgaagcattggcactgtcatcgcatggaaattcggcgaagaaaccataggaataggcattgacaacgcgaagcgatggacagtcgtcgagaaatgacgggacgaattcacgcaaatagcggaaaaatgtggtggacaattggatggcacaaatgtttgtcgcgatcattggccaaatgttgcgcaaaatcaattccatgtccttgaatgtatcgatggtcaaattaattggacgggcggcgaagattggacgaaaacggccgagaaaagtgatcacattgtcgttgaagtacctgtgaaaaatgatggaatcgtgtttacaaacaaaaaagcatcaaaatctatctcacttcaatgaaatggctttgaatccgacgactctctttggcaacggcttttgcgcaattccaaacgattccaaattggcattgacaacatccatttccttggtgccatccgcttcgaacttcattttgattttcatcgatcccagattccagcgacgagtcttgaagtgttcatccacgtagaagtcaaaacggtggctgatcatcgcaattccaaggccaagttgtgaagccggaagcagatcgtacacacaaagccaacaatcggcggagataaagctgaaaaaaaggaaaacaaaatttaaaattgaaattttaaaaatggcattttaattttacattgctttcgccatcttttgctccgcttcgtttcggttgtcagacattttgttgaggggaaattattaagacagttttcgtcggatttcaattggcttagcaaagatgaaaaattatgtgaaaatcagca

SEQ ID NO: 17270 - DNA, 1995 bp, Heterodera glycines
ctacactctacactatagaacactctacactatacctcttgtaaaagtgacagcggatgtgtaatttcgctgcgcttatatagacttctggagagtagtgtagagtgtagtgtagtgagtctctacactatagaacacacctacactctacactatagaacactctacactatagcacctgtaaaagtgactgcggatgtgcaatttcgctgcgcttatatagacttttggagagtagtgtagagtgtagtgtagtgagtctctacactatagaacactctacactatagcacctgtaaaagtgactgcggatgtgcaatttcgctgcgcttatatagacttttggagagtagtgtagagtgtagtgtagtgagtctctacactatagaacacacctacactctacactatagaacactctacactatagcacctgtaaaagtgactgcggatgtgcaatttcgctgcgcttatatagacttttggagagtagtgtagagtgtagtgtagtgagtctctacactatagaacacacctacaatctacactatagaacactctacactatagcacctgtaaaagtgactgcggatgtgcaatttcgctgcgcttatatagacttttggagagtagtgtagagtgtagtgtagtgagtctctacactatagaacacacctacactctacactatagaacactctacactatagcacttgtaaaagtgacagcggatgtgtaatttcgctgcgcttatatagacttctggagagtagtgtagagtgtagtgtagtgagtctctacactatagaacacacctacactctacactatagaacactctacactatagcacctgtaaaagtgactgcggatgtgcaatttcgctgcgcttatatagacttttggagagtagtgtaaagtgtagtgttgtgagtctctacactatagaacacacctacactctacactatagaacactctacactatagcacctgtaaaagtgactgctttattcaggttgccaattaactaaaacactggatactctacgctagtgcatttgaactacattagcctagtgtaggaaaggctagtgtaggaatcctacgctaggtcattagtcagcgtaggattcctacgctagtttttcaaaaatgatccgaggaagcgattttccactcccttttatagactttgagctcgagtatgataactacattagcctagtgtaggaaaggctagtgtaggaatcctacgctatgtcattagtcagcgtaggaagcatggggtgttaaaagctacactatacgataagaatgactttcgcacagaaaatttctccctttatataggctaatcaaaagcatagaaaataatgataaaatgcaaagaaaaataatgtacaccgcccggattcgaacttccccccccctcagaatgatgcctcagaatccccaagatgctagtgtagcatcgctacattaggttattaagctagtgtagcatggggtgttaaaagctacactatacgataagaatgactttctcacagaaaatttctccctttgaaaaagggtagtgccaagtattactaaactgaatattaaaattgtaagcgaatcatatttatccgctgtgattcagagaatagtgtgatttataaaacaaagtcaataaaaaagctttttttcaggtagccgatttaaaattaaagctaacgctttgggctgccacactccgaatcacgctcccaaagatccattccttcgggcctggggacactgcatcttttcaatcatcactctttatgtactgctctagagaactgaaaaacatattttgaagctatagtcgccaataattaaagagccaatcatttttaatataaatataaatcttctcacattttcatcagggtcaacaaattccagaaagggtgccagaactgaacaaaaaatttccttggctggatttgaattctgtttttgatgctt

SEQ ID NO: 17271 - DNA, 1977 bp, Heterodera glycines
cccccccccccgcccattgtcagaagggacctcccgtcggttggtggtccgtcgcccattttggccttgccaattttgcccgttttgctgctgtcgtccgccgtccttcgcctcttccgcccctctccccacaattggccgccctttccgccattccgccaaactttcgccgcccgtccgtccgaatcggagaaggtcaaccggcaacgaactgctgaagcccccacaagacgaccaccaatcggcagcattcagctctttgctgcagcttcttcgcccaaatgcgctcagtgacaaattataaacggctaaaaaaagaacaattaaacgtataaagttgataattggacgaaggaaaaagagacaagcaattgtccatttctatttctgtggcgaattatgcgtctcctccatcactctgtgctcgcctgctttttgcgagttgacgctcttgaccccggcgagcactcccgccgcaatcggcgacttctgaggatctggtgacttgggctgttccctgctgctctcccgacatttgtccaatttttccgtgccgatttcttttttggcctctttccatcccaccatttgtttctggtcaaatgaaaggtgagcactgttagaaaaagccaccgaagcagcggccgcgatcagaggctgttgttgatcggcctaaagagcgagcgactgatctttgatcatttgccattactacagaccatcagactctctcggcaaacacttcgcatgaaagcggcactttctgagtccagcggaaattggtccttggcaggctctttgatcttcagaaggcgatttcgggcggtgtacgcgccgaaaagatttgcctaaagagggaaacgaacacatttctcgtctgtttgtttggtaggcacctcataagtggccacgacaaagtccttttcgtcggacatcgcttcccgcgtcactttggcccctttccttcgcctcctttccccaaactttaggtccaattccctttccattgcagaagttgatgggcacgaattgtttagttctggtgacttttcaaaatgaagagccactggaagaagccccttcaggaaatttattttaaaactcttctggcgaagtatatttctttcactgtaattacagtaatcaatttgcgcgcgatgaaaatgccctcaaggggccccgaaatgataaggccctgttggttcagctgaatttgggtgttcgttctgaatgcgatccatcgtacggctcctaaagatggcagggctgtgggacgaagttcgaattggcactcgaagtgaagttcggcacccgatggcttaagagaggagaggagacttacagaaaactttcggaagcactcacaaaaacgccgattaattggcaaactttgccaaatgtccgcagcatttccaactcattttggacattcgacctgaaacggaagtgatccttcgataaaaaataatttcaaccgcatcaaaaagtgcagcgagcccatcagaggggggcattggctgacgaactgaacggacaaatcgctgccggagggaaaatgccgctggagctgagtcgggtccaggcgcggctgaagggcgtacaaattgcggccggcatcaagttgaatggtcacggcaattgtcagtggacaaatagcctaaacaaaaagccaaaagattgccatttgggaatatgcgcctctgtatgaccctgatcagttctcttgctttctcaacatcctttgcacatcccgagatggacacttggtcattcattgtagtcatcgagttggaaagcgatttgttggagtcggggaagtgaatgtggcagttggtttcacgcattatctggtcaaatactcttcgacaaaagatggtgaggaagaggaaattgtaagtttcgctttggggtctcctttcccagttcttacctcttaaagggaatgggtagggttggagagggagggggggggggggg

SEQ ID NO: 17272 - DNA, 2839 bp, Heterodera glycines
tgataaaaaagacatctttcacatttactaattcagagtataatcaggaaaaaattgtgagcagaagaaaatccgaccgggagattccgattctaaaccttaccaatgttgtatattatctacagtagttttacccaggttatcgtatttaattgttaaataaacacgataataggatttaattctgagtttattataatacaaatttttctaaatataattttattttaataatgtttgattgtttgtttataatatcactcaactatggtcaggaccatacccgctcttagacttaagcctagcttcggcatagttttaatttaaagcctaggccgagtacggtacttccaatttttaaattttgtgtataatcatagatatacccatattaaaaaatgctttctcgtttccaaataaaatccacatataaacgcgattctgctggccaatttgctaacccaaaaaacgtctcagacgttaaggcattcaacggggcaggtgcatttattgtacatgcgcttataatcgacctacagtataaactgtatgaagtgagttttatctctgtaatgctacatgcatacagtctgtattgtaacccttaggcttgcccaaccgtagctaaaaatgggctattatgcaaccgtaagctgtccgatcagagactttgttcgagttgcggttttgctaccaaaaatccaacagatgctgttatccttcgacttgaacttcaagatctaatggataaagaatgccgccaaaatacaacaatgttcaccagcagtgctcaaaagtatcttggccgtaaagcaagcgaaatccggatgatggaacaggacggagacggggaagggttggctaggcttttagattccttcattggaaagaagattgtagccaaaatagctattaaggtattatgctctataataataatcgactaaatttaacttgttcacttaaaaaaaattatcatatcgataatattaaggaaaaagacgccaattggggaggtgaaggcagcagtttgaataaatttgattgggtcgttacttctgttttcgtgcaatcattggagcctgctgaagcgtacgctaatgatgacggtgaacaacagaaaaccgaagaatgatcgtcataaagccaatatgccggagattaagagttcaagcttggaatgaaaagaagacctgatgtatctgattgtagtgtagaaacgattgatcaaatatgataatattaaggatcatgatttcagataaatataactgtaatcatcaaatttcaaccatttagggtattattaccctgttaatacttctaagaatcaactgaatccgatgttctgtaattaatatattcagcgacatggcttctgaaagaaaaaaagcgaaaattacggaaaacatctgtgggcagagacagcctcatccaaaacaaccgaaatgggatttccgttcaattgcatattttgaacaatatccaaccgagtcccaaatggatgaaagtgtgccaacacagcattcggcagctgacattcgtcaaacaggcatgggccaacacagcatatcgacaaatgccgatggtggacaggaacagaaaccgttgtacgaggaaatcaccaatcatatacacaagatggagcgtttctcggtgcaacgccatgtcactgaatttgtgcttaatgctcagcatgaacagccagatgaagcgctacgtcaagcgttacatcaacttgtcaatagagctgtacaaaatgcggaaaagcaaagcggacgctctgtttcaaaattaggaataatggtggctggaaaaggattaaccgatccggtagtgctgcctttgaggcctccagcacaaaacaatattgacgttgtaatggccgagatggacaaacttggccaaagcgagggagacgaaggaggcgttaacaaaaaaactttgctactcagcgagccggtggagatcatcgttacatgtttaactattccggcaggatcggcaccacgattctttccacatcagaattggggctacaatcaaacgcaaataattcatatatccaaccgagacaactattgtctctttcatgctcttgctgcaggccgagcttatcatgattatgaaatttttcgctccagtcgtagtccaccagataaccaagctccactttttgcagctataaagaatagaacagacttttgcaaggattatgaagcgtataaccgtctattatcaaacaccgggcgaatggaatctgtagttgaagatctgatgaagaactcaggcatcattattggccaagattcttatggaattgaccatctgctacctgttcagcaatactgggtaatttttgtctacaattttaatattttgtgctgaaaatttaatgaatgtgcttcaggattgcgtttttcctggaatgtaccgtatagtgttatttgaagaccggccagaagagttaccccgtcccttatggaaaggagcagggggacatcgttttaacgtcacgctttttctctctaacaatcactatgatgtgataaaaaagattcactgtttcttcaaacttggccggaaatactgtgttgattgcgagtgtacgtacactgtggatgctaaacatacaataagttgtaggagtagatgccctcaatgttctaaaggtttgctttttcatgaacattttgaaatgaccgatattttagttgggcctctacatccgtgcccgaaacaggacggtgttcgtattttctgttcagaatgtaaccgttactttttttcgtcgccttactataatggtcatcttggcctatcatgtaaactctataaa

SEQ ID NO: 17273 - DNA, 3054 bp, Heterodera glycines
aaatttaattggccgaaaatgatggaattttgaatgaaaatccgaaaataaccttaaaaacagtaattgaggcacaaacaaaggtaaaggaattggccaaaattttctatattaaaaaccggaaagtgtccaaatgatgttctgaaatggaaaagagttgtttctgattattgcctaataaatggggccatttactttataaaaggcaaagaaaatatcgaaagacctaaattaataatccctcattcattacgacaaaagcttttcattattttccattcagaaggcaattttggagtcgtaaagacttggcacgaaattaaagagcgattttattgggtcgaaatgaaagaagacgtgaaaatgctaatcgaggcatgtgaaaagtgccaaatgaggaaaatccagccagggcaggccaaatcggctccgagtgtccctatcgaaccatcaaatagcccatttcaaagaattcattgcgacttaatgggtcctttaaagagaaccgaaagagggaatttgtatattttcttggcgattgatagtttttcaaaatgggtcatggccaaagcaatcccggatcagaaagcgaatactgtatcagaaatttttgttgaaattgtggtccatcaacattcaactcctgagattgttgtgactgatcagggaagacagttcacttcgggaatttttaatgatttggcaaaaatatatggttttgagcatgtcactacaacaccatatcatcaacaggctaacggaatggccgaagggacgatgcgtataatggctaatattatttctcaaatggtcaatgaaaaagggaataattgggatgaaattctgccgcacgctattttttcatataatgtttcaatacattcggctaccaaattttcgccattttttatcattaatttacgacagccaaaattaccaactgatcgattacttaaactcccatcccccgatgagcttgtatcagatatttcggtctataccagaattcagactgaaaaagctgctaaagcatgggaaatagtgcgaaatgaaattttaaaagcgcaggaaaggaacagagaagagaatgatcgaataaggaaagcaagtgaaagagaatttgaaatcggtgatttagtgttgtttaaaaaagaagttttaagccataaatttgatcagcgttggctgggaccaatgcgttgtgtaggcgttgaaaaagaaaagaaaaatgtcattttacagtcaattgatggaagagccaaattaagaaaagtacaccaagaaaaagtgaaacattttaatggaccagcaattcttcctctaaggcagtcagatgaaccattaaattgggaaaagtacgtagatgatccgaatttagaacaggaagaaattgaaagtgaaagtggcgaaagtgactgtgaaaaaacgcaagagaatgaaaatgcgcaaccaaaaaacaaaatgggattaaaagtttcaaaatatggctttgagagttctgacgatgagaatgattggaatattgttgcgtttgtaagagaaaaccaaaattctgaggatgatgaaggcccggaagttataatggacagaaaccccgaaatcgaaataatgccaattttcacaatactcgaagtccttattgagggttcatttactgaagtatacaccggatggagagaccccgtaacaatctcattaatctcaagcatacctgaaaacctagtaagggaaaattgggaaatttatgttaatggaaatggctcacgatttgttatggcatggatttttggcgaaagttttgaaattttcattgtcaacgaatttgatcaaattatgttgggaattgatgcgcaaatgttgttgggtgaaagatggcgaataaaaaccgaaaatgaaattgagacatattgggaaatttacttcgatgaaaatggacgcgaattcgaaattcccagaattcctgaaatccttttttcagaaaggaaaacttggaaattgggtatgggccaaactttgtaactctccgagattcagaaggaatgataagtgatcaggatgatttagaggaagtaaatgatttttcaagaacagacattaatgtgataaattatgtaaaaccgtttaaaaatttattggatttttcaaacgaaattgatgaagatgaaggaaatgaagaattagtggaaaatgccggagaaagggagagaaatatgaataattctctagaaattttaggaagaatggaaaacgaacagttgaatgaaaaagggcggctgaataaattggataaaaaacaaaataaaagatatgaaagccattcgtttttcaaggaattggaccgaatgacatcaccggctccattacatttcgaatctttgattgaggacgaagaagaatcactgagacgtttggaaagacgtctgcaggaacagctgaacaaagtgaggcagacgttggcccaagaacaactagaggagagccacgtgaagacaagggaagaaaaatgccttgagcaactgaagcaacaaacggtacagagtacggtaaaccaaaaaggaacggcggaaaaagaagaaaaaagtggagaattatgtaaaaaaagagaaagtgaggccaaaaaagccgaaccggaagcaaaagaccgaaaaacggatgaggaaggacttgtacaagcaaaaatggagaaagagaaaaatacggtggaggatgtgtgtctttaggagatgaagaagaagactctccttatgaagcagcgaaggtattcgagacggggacgtccttttttgagagcgcgggggtgcgagtgaattcacgtcgggaacttgaggaattgacaaaatcccgaaatgaagcaaaaataaaggccaaaaatgagttagagccgccggcgctgttagacatgccaaaagaaggacaaagtgctcgaaaacgattgcgagaggggtcgccaaacaaaggcgaattgttgacgaacaatcgttgggatgagaagatgcgcgagatcgaagaagtgaacaaaaactcaaaagaagtgcgtaatgccttgaatggact

SEQ ID NO: 17274 - DNA, 3264 bp, Heterodera glycines
  misc_feature (44)..(44): n is a, c, g, or t
tcagctgccatataacgaacacgccaggatttgtcctgcaccancgaaacagcgatcggtttcacttgggccaattttgccgagtcttcggacaacagaccaacgatcacaatgccagcctcaactgaaagcagtcgaacagagtcctaaatagagaaactaattagacaaaatttcatcaattcttcacttgttcgtccttggccaagtcctcaaacatttgggtgatttcatttttcaaatagtcctcctcctgcactttggcaaagtcgcccaatttggatgcggcagcacggcgaaccatcggtgtatcgtcgcgacagaggcaccggaatgcggcacgtaattcagttttttgagcaggattggcacgagcgtatgccacgctgaacaatccgcaagcggaggtgcgcgaagtaaaccaatcacctgaacggagaaacaaacgcagtcagtggaggaactaattaagacaaatgtgaacaaaatgcaaattactgaccagctgacaatcgcagaaccatcggaatgaaatattcctcgagttgagctgcactgtgtttttctgctattttttgcaacgattccaccgctttgtcacgcacgacagtctcctcaatgttcgccaaattttcaagtggcggcagcaaacagtgcacatactcaggtccgccaaccaacggagtgaaattccccaattgttcggccaatgccaatagaacttcatcctcgtcataaatggtgtctgaatttgtaataaatgtagaaaatttatttatgcaatatatttttatgtaattaggtaatcggattattagtattaaaataacctgtaaggaattgaatcaattctttgcgcgttcgttcaacgcccaatgccaaagcaatcgtcgacaatttacggattgagttgagacgaagcttaaaattgatcaattacaattcctgaatggttacagcgaacattcatatcaaaagaacgaacctgaacatcttcgttacgaagctcatcaataagcacagcgatagggtacaaactgtcctcaccctcttctgtcgcaataggcgctgtcgtagtcattttagccaaaatcagaaaagtatttagctaccttcgtttgtttttaaatgaaattatacaataatgaagcattgtggggttaaatgcttcaatctttttcggttttagacgtcctatgggcttttatgtgtttcttacttggtcaatgcttagattcctggtatcaatcaaaaacttaaaaattagtcaattctaggctagaatttctcgtataactgaattctaggctagaatttctaggcttaattaagctaaaagcagcagacaaaaaattacttttgaatgtattcgaattttcgattattttcacaccgagtcaaaaacgagagacgaaccaataaatagagagtgcggagaaaaaaacatctctcttatttttttatctctgataattgtgaaaattaattcacttcactctaagagattattatgaaaatttaagttacaaaaaatgcagacattggccggcttttcccgcggccgcggtaatcacgctaccgccgggctattattatacattcgcatttttattttttatctttttttaatgcaatttttttacaaataggtaaataaggagaagcaactttgattaatccaatggaaaagagattgaatccatctgcacttcctacgcttatgttatcgaatttcggtggttattcggtggagacactttgcacgcttgggaaggagttcgtattggaacttatgactcggatgattaggtaagtcgtcacttacagtttaatagctaaatttatttttcatactcttattgaatttggaattcggtcccacccttggagaaagattaccgataaccaagcaattaattttaaatcttttcagcattgtgagcactttaaaaatggatattaaaggagacaataaaaaagtaaattttaattttgatttaaaattcatttgcctttcaaggatctagacattgttcgaattcaacttgattattctcgtctcatttttctctgtcttactgaggttttctcattttgtacactgatatttctacattgaaaatcgtttttattaggtccgtcttcgcatcgatttaaaacttgctgagggaattggagagaatcagaatttgaaagatgttcgtccttctgatgaacggctgttggagctcctttcagagccgaatcaaccggaagaaaatgcgaaaaaggcaaatttggcagagagattcgaacaaaacagaaaggagttaattcgattgaattgtcatttaaaaaaattggattggttgtcagttaatgcggagaatggagataaataattctgcgactttttgacttaatcttttgttgtttttgtaaatacactaacttattccttactatttgtctttttatatattatttgattaatttagtgtcacattttatggcgttaaataattgttttactgagaatagatatccaaatgaatgcattctttcctatggctcgatcgctgtttcggatccggtatgttctggcatttactatgctcaatctcaccctccgactaagcgattgaggattttgcttggataacaatcccccggttcatttccggtttgactttttcattcggctttagctcgatgcgttcgtttgttgtcgtttttccatccatgaacaccaggagaacatctgcgcatttggcacagaatatggcagagtagtgatttgcgatgtgacagctccgattaagggcgaggattttatcaaacatcgtgagttacttctattagtctacgacggttgaaagaaattcatcaaaattcgaaaaatttggatgcttgtaaaaagttatgattaaagttcgtgtaaactacaatataatagataaacttttgctttttttcgcacaggatttgccactggaaaaaatgctgtgttcgacttatgtttcattcctgatcgccctaatttattactttctctttgtggtgcctcaaacctagagcttttggacatcgaacggtcgtcgtccatttttttgcttggtcatcgtgacacggtccgatgtgcttccgtgtggcctgaaaatccctgtattctttgtttgttttttcctgtccaacctcttcaaatttcagtttgcgttttgactggttcaagggacggtgacattttgctttgggatttgcgtgaaaaaccatgaaaagagaaat

SEQ ID NO: 17275 - DNA, 2811 bp, Heterodera glycines
tcccaaaattttaccgaaaaaattgggacaaattgtccattgggttttgttcattttggagcccataaattggttgcattccgtctcattgaacatgttttgaatgttctagcaaattcttggcatcatttttcattggacggtcaaacaaaatgtttggagtcgcgcaagaaaagcattcgttcgccccaatcattcactgcatgaaaaacaaattataaatttggatataatttgtaaaaattaaaacaattaataaattttaaactttgataaaatatgcactttgtataaatagatatttttgggcacagttttcctaagcataatgcgacttttgagccggacaacaaaaattgacacttgcgtcggggatatttgcaccgcgacatggccacgcagtcaaaaattacatttttatataattttcactattattcaacaaattttattaaaattataatcgattgacaaaaataattaatttaaaaataagcaatgccaattactcattcaaaacgatagacatttaaaaaaatttttgttttgtgcttttattttatctgttaagacgattccccccccccccccccaaaatgagaaaattgtgcttttttttttgtgtttccgaatttaacccagggatctcctatacatattttgcatatttaaaattacacaatttgaaagccggcaattttgcccataaaaaagtcattggaaaattttaagttttttggtcagcaaaatttctcaatttttgcacaattttcgcatttgtttttctattttctccttattgcatctttgaaatatataaccttttcaccgatcacttgaacaaataactttcgctacgctcctcattcgccattgccccgtccgatcactcttctgctgttagcctttctgatcagcatttgtccatccccttttccgatcactcttctattagctcgatgtgatcactttataaagctgcatcgctttattcattcatctctctccctctctctgaccaccctaataaataaatatgtcaccctgaccaccaccacttcgctttgctggttgatctacaattccttatctccttccaatagactgaaaaatagtgtagctccaaataaaacattctgatcacttataaatcattgtttatatttagtacccaccggttcctccgacttcacaatccattagcacctcctcattcgctgattactttaataaatccgtcaccatcacttcccatcaaacacaaagtttcttgacactcgcccctttatccgatcacttcccttttcgctccacttctggtcacttttatgaatccgtttaccatcacttcccataaatgcaccaatccttctgatcacgcacttttccttatcgtagttcttcgatcgcttcacaatctccttcttcaactgctttagtaaatccgtcgcaaaaaccttccgatcacctcatattcattgctcccctatccccagcgtccattcatttaatcactcacgccccccccctccctccccctttcccgatcactttgtctccaattctctctcacacctcatccatcatacattttgtccgtcatctttcccgcgccctcattaaatccccataaatcctcgactactcttaatgatattgtcgtcgtccaacaaattgtgtgtgtgtttgtgcgcgatttattcgcgcatattttgccctaaatttggcgtcctcgtttattcgtcgtccttccacaataatttcgcgcacaaacgccaattcgtgcattcatccctcccattcacatgatgacctcgaaaagtgtccaccaattcgccgttctgtgatatcggacaccaatgaatggaaattttcgaatttacaattttaagatgaaaacttgtttatttttcgggttttttcaacctccttccacctcagagcattttatgcatgaaaatttgcatattttcgtaaaaaaggactttcaggaaaatacttttaactgatttccaccattaaaatgcactttgttctcattgccttctgcattgtttggcaactgtgagtttttattaaaaaaattatttaaaaatacccatatttcttctcttacagacagaaaccccttccattagagccccccccccccccgattaaagctctcttcatagagggaatttaaaaatagaaatccccaaccacttgaaccccatttatattagggctctctcccatatgagtggagttgaaaacagtgtccccgcacccctctattagagccccttctgaaataaagccgtagaaaaataaaaatcccagggatcctgttaaaagataaacggtaaataaattttaaaaataaatatttttaaagaatcaacaattttcctgtttttttcccaagggttgtcgccaataacgtggagcagccggccaaccgtgccaagcggttcacctcctttggctcattgtccaccattgggggccgcgttggatgtgttgtgtcggtgcgtgttcagcccattgggatgtgatataagccgatcccgcttctcgtccccttattcccgcaaaaattttttaacaccaaaatttatcgttttttcgaagcgcgcgtcggtttgcacccctatagcgtatactaagtacggtaggggtcaactccgtctcagcaatgttcaaaaagctataacttttttctttgttggccaaacttcacaatcatggtatcattcgaaagccctagatgtttagaagatatttataagctatttctcagtgattaatcagctctcaaaaaagtgtcag

SEQ ID NO: 17276 - DNA, 1015 bp, Heterodera glycines
ttttatatttagaggttatcccagaaaaatggatatccctcctttgggataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaagcgcttgcgtatgagacggagggctgtgcacaatcgccattttatttcacagaggatttt

SEQ ID NO: 17277 - DNA, 2046 bp, Heterodera glycines
aggcattcatttcagcaaatcagattaaaccttaattctttttctcataataaaataaaattaattaaaaatatttttaatacaatttatattacggtagtcttaattaaaataataatttaataaattcagcaaaataataataagctaaagcaattctgatttcccgaacgaggtgaacgactgaaaatcagcacaacaaattggtggagtcaaaaacggagctcgggaaattgtccgaaagtttgtggaccaacggaagtggaacgaacggactgaaaacaaagccaaattgggttgtcatctgtgcattggaaaagtgccgagactgtgaagtcggttggtcttgacttttcgaaatttttgaatgtaaataaaataaattaaacatcggaaaatcttaaaatcaaataagattaaagaacaaggcaaaactaaataaaattaaaattaaattagacaacaaatataaataatacaaaattaaacagtcaaatatcccggattatttaactaaaagatttgttgaaaaaagtgaaggtgatagggaaagggaaagaagggcacaagaaagagaaagaagaaaaaagggtcaagaaatagaagaattaaatcgaaaaatggccgatgatgatttggaaattaaatttaagaatcttcaggggaaagtcagggacttggaagataaattaatgggccataaaataataaatgtaccatcggggattaaaatgcctaaatttgatgggaacggtgacttttataaatttttgagggaatttaatatgtatgccactgcggcggggtggcatccgccggaatgtgtgcgattatttcctctcttcctagaaggggaagcaaaggaaatataccagaacattccaggggatgaaaaaaagaattggcgaaatttaactgaaaaaatggcagatcagacaaagcgtctggacggaccaatgtgggcacgccgaatgttggcaaaaataaaaatgggaaaagaaacggtaacagaatttgcaaataaagtgcgggagttggtagagcaggcatctccgaatcctgactacacaaacgatgctcgtgaaaatgagagcatccactactttttaagtgggctcccgacaaatttaaaacgcaaattgtttttcatggaaaaaccagatacgcttgtcgaagcgatagctcaaacaaaaagggtacaacaagtcagagaagagttggaaaatgacgaaaaaggggatgaattgagaagtcaaattgctgagctcaaagagcaagtcaatgcaattgaaattaataataaaccgaataatgaaataaacggaggcagacaatttatgaattcgaattggaggggaaacatgcggggcagaggcaattttcgcggattaaacagggaaaatcattggagaacgaaccaaaatgttcgccaaaattttgcaaatagtagaaatatcggaaattatagtaataattacccgaggaatcccaattatatgcctctgggaggaaaccaaaattggaataacaacatgggaaacacaagaccaggaggattttggaaccaacggggcaattttccgaacaatcgcggaaatttcacaaatttcagaggaaatttacggggacaaagaaatgaccaacagagatacagaataaatatggttggtgaagaaagtgaatctaaaatacaaaaaagccgttcaccaaccccggcattaacttttttaacaatttctacaattttttgcttattatttgggggatcaatggcacagtaccaattatgttctgaacgagttgcaatgaccaaagtttcattaccaaatatttcggactgtaaaataccggaacagcaaaaagcaacagaacgaaaggtgaccttatttttgcctgtacgaatgcctaaacaatttccgatctataattgttatcaaaaaattacaaaaacatgtacgggaaattttttattcatttggtaggaagtaaaaagtcaggaaaaagttaagaagggtgtcggtgcggaaagatgccgaaaattaaaaa

SEQ ID NO: 17278 - DNA, 871 bp, Heterodera glycines
ttattagctttcaaatcttgactgtgccaaatgtgtgtcattgacgcgaaatagttttttgctgaccattttcgtgccgtcgtccatcggtgccatgccgtactcgtccaacttgatcggctgctccatttgtctgatcagctgattttcggcacgactagcaaccattttcgatgccattccatccgtgtcaaaaaattcttccacctcaaaaaattggtatgaaataaatataatttttgtgcccttccaggtacagtatgcaagggcgaatccgtcaccgtagtatcatcatcttccacaatagccaaagttgggttgtactgattgcttttcaacacgaaaaaccataagccgagtgcaaaaattgcagcacaaattgcaacagttgcaagcacataattagcggccaaaagtggggacggaattcgcatcaaaaaaataaataaataaaaattgaaaaattaaaaaatatataaaattaaataatttttccgttgataattttttttttctatattttgtctaaataatataattttgaattagttttaacaaataattataattatttaatagaaaatattaataaaaataaataaattttaaataaaattttaaaatttaaaatgacattgtttttcgtttaataatttatttaaatcgataaattgttgttggtaagtttcaaaatgggagatttaaaatctttttaaaaaattcagggctcaaaatgtgaaaaacagctgatgctcttcgtcgaagtaaataatacatagaaagtcattgaaatacttttagattaaatttctttaaaagaaaaaaaaagaatttgattaaatatttttaaattatttattttaattgataa

SEQ ID NO: 17279 - DNA, 2171 bp, Heterodera glycines
  misc_feature (2143)..(2143): n is a, c, g, or t
tcagtgtatttttgtaattaaaatttaaagaattgcaatgtaaaaattaccaaatattgtagaaaatccaatggttttttataaattacaaaataaaagaagaaaaatatttcaggctaagtaaaacttttcaagaaactaatttgatgaaagcgtttttttaaattttaatgaactctttcactaaatttttttattttgaaatattaaattgtaaacataaaattgttttttttaataaaatttatttttataacaattaattaatatttctcgtatattcaaatttattttgaaaaaagcaataatcattgaataaaaaaatcatttttcctttaattttttatccattaatttttacaccatttctcaaaagttttctcatacaatttgtacatattgtatatttttcaatttcgtagtcgcattctgcgctttttccgctgctgcccgttgttcacttttgccggcacaatcggtgccaccggcccaaacggaccaattcgcattttgtcagtgattgatctgacaaaaattaaattaaaaattaaaattaaaaaataacaggaattaccatttttttaatatatatatatatatattcccaaagatttccaaaatttaataccaattttaatattttgctttctttgacattcaagaaaaagtgccaaattcgctcccaaaatttagaaataaatttttgaaaatttggaaggtaaaagacgaaaaagttgccattatttatttgtgtgtttttttttgcccactttgccgattcgttgtaaaactgttcgccaaattggcggacaagctgacaaaagtagggagcatcttcccggctgcacacctcacttccggtcgacgctatcttaattgtataaaattgcattaaaatataattaattttattggtttttaatccggtagaatttgaattttttggaatccaacaaatacatccataagggtaagttatctatggcacatccctatctgtttttccgctgattaaattagaagttttttttaataaaaattgtgaaaattttatattatatttagagcccggaattttaatttgccgggaacgagagttggaaaatggagcggggcgggattccgggacctagactcccgttttttccgggactgccggttccagtgatttgacaaaaaaaaagcgggatcagggccgggaggcctgacaaaatcccagcggggccccgatctctaattatattatcataaactaaaaaattttagtgaaacaaaaaaattatgacaactgaaaagacaaaatcaaataaattttgttttgtaaagagaatatattctttaaatttattattttataaaattaaatattttaaaaaggataaatttaattttacttctaaacagttgcagaatgtgtcatcacaattcttaaggcccttttggtctccatagcagcttaaaaacaaaaataaatttaattaattattcttttttttttacttgtcatgcgccacgcaacagttgttaattgcatcttcattaggcgcatattagtaattatttaattaatcaattaaatttaaatttaaatttggcaaataacttttcttttccgggcagtctttttcgaccgttgattcggcgagaaactgaaaattgtttttgtgataaaatttgaataaagaattaatgaatgtttttatatcataaatatttttgaatatttgggtatcgaatataatattaataattaattaactaattagttaattaattaatactagtaacaacaaactcgtgagaaactgtccgttccgcatgcccattctgcgtccagcttgatcacttccacgggctgctgttcgctgggatttaaactcaaattttggccaaaacacaatgccaaaatggtaaaaaataaagaaaaaagaaaaggcattgaactgttgtaaaaatgaaaaaattcttgaatgaaaaagagaaagttctcgaaatgcggacagggtaattcggcgccaaacgctagatatttttttgtttcataaaattttaaaattttaacgtttttcgaaggagtttgacaagctaggttaacctgcaaatttaataaatttgtggatatacccggggggagtatagccanaaaagatgcgaaaatgactttaatgtaa

SEQ ID NO: 17280 - DNA, 899 bp, Heterodera glycines
atcctccgttcattactgtatatgttagtgacactttcgttatgtgtccattcaggagaccgccgcggaaaacgttgtcttttgcgtgttgcacgaccttggcaccaatcagtaccgtaacgccgaccgcgccaacaaactcgcgtcgtccgcgcgcaaagcgcgaaatgtggacgccctcgtccgtctcgcgcaccaaatgaccgttcccttccgcgcccgcccctccgccgcgcccgcggcataaaaacagacgcggaggagaaggagaacaaccaaagccaaattgaccattcgattgactgaatgactttaaattatttttaaattatttattgtccatcccatctcaatgtaattaatatttccatttgcaatcactcaaatttcaatttgaataataataataattaattgctggtgataaattggctaatatttaattttttttccaatttttttttcggctcattttgcacttttcatgcaaaaagaaaattggccaaagattcgaagttgtcgtcgttctgcccattaattaatcatttgatggcaaaatgactttcctttttggtttttctccttttggctccctcttttccctgtctaagttgtcccccccccctttttgtgtaatttttccctccccccggggcatttcttccaatttcctcccattttttgcacattttctcctcccaatttgtccttttcctttgcatcatcttcttctctctctctctttctgatcgttcttcattcttccatttcattaatattaactcctttctttttgtctctttcccatctctctttttccctttttctttttctattttccctttgattaaaggacaaataatttgtcaaattccattattcaattgattaattttgca

SEQ ID NO: 17281 - DNA, 1519 bp, Heterodera glycines
  misc_feature (41)..(41): n is a, c, g, or t
  misc_feature (43)..(43): n is a, c, g, or t
  misc_feature (89)..(89): n is a, c, g, or t
aattcattccatcagttgcccttttgggagattttctaaantntggaaaaaagtaaattgactaaaaacaaaaataaaagtaatttccncaatagtgacgaaataaaggcacatggccaaggaggaaaagggcaatgacagaagagaaagtgccaaaacaattcaaaggaaacggaagggaaagcaaaggaaaaagaaaagaaaagaaaagaaaagtgcaatgggaaattggaaattgaaaagattaatttgggggaaacgaaattaaatgggacgataaattaaaagggaagtaaaaaacaaacaaatcaaagacataattattgggttattaaaccaatgaaaattatcggaagagagaacccggcaatgaattaatttattgccaattattgcacatctttattcaaatgcgttattaattattattattattattcaaattgaaatttgagtgattgcaaatggaaatattaattacattgagatgggatggacaataaataatttaaaaataatttaaagtcattcagtcaatcgaatggtcaatttggctttggttgttctccttctcctccgcgtctgtttttatgccgcgggcgcggcggaggggcgggcgcggaagggaacggtcatttggtgcgcgagacggacgagggcgtccacatttcgcgctttgcgcgcggacgacgcgagtttgttggcgcggtcggcgttacggtactgattggtgccaaggtcgtgcaacacgcaaaagacaacgttttccgcggcggtctcctgaatggacacattacaaaagtgtcactaacatatacagtaatgaacggaggatgggaaaagacagtacccatccatccccaggaaatggcactttttattggcatggcgtgtaattaatgcgtgcgtgcattaattgtggtctaaatgagagggagggccagacgtgtgcatttggccaaagattggcctttcaaatgtactcttttgtctgccggggcattttctcggcgggggaatgatgcgcgagcgatgaaagtgccactttggtgcaattgccccccccccccatgtgagcaatgaatttgccaattgcgtccgatcagtcagtggactgtccactcaccggttcgatcagcatgtgcttgagaaagaagagcagtttccgcgtcagtttggagccaacagaatcggccatgtgcgtcttcaccgcccccggatgcactgcgaacgctttgacgccctcgcgcgtgttcaaatgctgggcgagcagtgcagtggcgaatttgctcagggcgtatgccctccagcgccttgcgccgtcaaacatccgttcccacttggaggggtccttctcgatcgagaaaaggttgccacataatctgaagggcgtcgtggatcagtgatcagtccatccgagctttggtccctctcctccgctcaccggtgcattatggaggtcaaagtgatcaccctgatcggcttggccggggattggtgcgcgatgattccgtcgatg

SEQ ID NO: 17282 - DNA, 1254 bp, Heterodera glycines
ctgaatccaacgcctgtacattttcacgcgttttgctcttttcccacaagtcgtttgtccatgaaattttgaatcttctcgaggcccgcttcgcgaaataattcgtccatttcctcggtggtgaagaaatagacgagagtgtcgtccccgcggcggtacaaattgtgttggatgagtctgcctgacttgaagcgcagttgggtaaggtcatgacgaccatagtccttcagcaacagcattccgccgggccgtaacagtgcgactaaattcgaaacggcggcacgcaaccgatcgggccgaacggcggagagaacgaaaatgcaaaggacaaagtccaaagtgccgtcagccacctgacacgccaatgaaacgcattaaatggctcaattaaaaaaataatcacttgagtctgatgagcattctcagtaatgtcccaaacgaatggacgacaccgttcagatgaaattctttggtcatttcgcagcgtttcgatggctttcttcgaaaaatcgcagctgtacaagaagaggtgttcagcactttgcagcagaggaattgtcgtattgcccatcccacagccaacatcgagcacattgattttggcactgtcctaaagagaagaccaaatacaagttaaagcgaggagagagagtgcggcaaccaccggaataaggccaacaaacctttggccgaacgaacagttccgagaattcccgtgacagccatttccggtccatgaaaaacttattgttgtgagtctcaaagaaggcctcccatcgatccttcgggttctcgagaagacttaacgacacactctcgggaacggcgtcggccatttgcgcttggatggtttggtgaatttctgcttccttctcctctggccagtcaacgtcgtcccacgcattgtagtcaaacacagcacattcgtccctcagatagcgttgtccgaaagggtcgttccgcatcgtttgctgccttttctcgattttgctcacctcaccagtgtaattattggaggcgctatttgtcgttgtcattgcatatcaaattacaaaaaagtaatataggtaagtaataacaaattaagtgaaatacgtgttacttgattatctctcataaaatttgccattgggttgccctctttttaattaaaaaaccttcatttgctctcgtaatgaatctgcgaagagatcctcctttttgctgctttattgagtatttctgcagcctctgcatgaaaaaaattcatttact

SEQ ID NO: 17283 - DNA, 1488 bp, Heterodera glycines
acaatatgaatcggagttccattggaccacacatagatagatacataaatacatatgtgtacgcatatagaccacatcaatacaattagaacaatatgatccatggtatggaaatctgcaagaaccctcagatgaagatgatgcgtcctactgtgctttcagaagcggcgtcctaagtcccagaactcccctctgagccagagacgtacgaatcgttctggaaagggggaattttaatcaaccacacgcatgccacaattcacttacgggacgaggcggtgcgttggcccccaggtgacaaaactcctccaccgagccagagcccgatgctgaagacgatcccgagccggaagttcggaagtctctgtggtcgatccttccgtcgtttccgtggtctcctccgtgtcctcggtcgtcttctcctttgtcgcacttttctccgcttccgctgcctccgcggcgccttctttcggttgttcgtccgctgccgccgcttcctctaccttcttctccgctgtttggtcgccactaaaaatggtaaattttaatgtgtaaaaaatgatccgccgcctttgcacttacccctcgtcgtcctttttctgctcttcttcgtcttgctccaacggcactgtcacgcccgaaagagttgctggagattcaattcgaggctccgtctgaaaatgaaaaagggaaatgattttaaaaaatcagccacgacagaagcatcgctaccttctgtccaccgccgcagcattgagtgatgattagggaatagaattacatggaaatccatatttttttcctggactgtgggaggcctgaaacgcacgaaaaacatgtttttagcttggtttgaagcttctaggaaggatttctatatccatattttccatatttttccatatttcgcgatttatgtccatatttccatattttggcattttggtccatattttggcatttttcaaaaaaaactctattagaacggcccccagcagctaaattagcctttttgagcccaaaacccgaaaaatttttcaaaaaatctttttttcgccaaaatttctcgagaatattgaataaatttaaattttcttaaaaattaataaattatgtcaaaaataagcaaaaaagcgaaaatttcgcttttgttgttgattttgcgctaaaaaattaataaattttagcttttatgttttttttcttttaaaatgattgcacgtaattgccgaaaaaattcgagaccaatttccgaatgttgaccgactaattgcaaaacgaaagccgtctttgtcagagcgccttaccgagtcaaaaaatttggaaatgtatctcatatgcaatttcaaccaataaatttgaagaaattttgcactcaattttgaaaaatttatgtccatattttggcatttttgccatttatgtccatatttcgcgatttttgccattttatgtccatattttgcgatttttggtccattattttat

SEQ ID NO: 17284 - DNA, 2487 bp, Heterodera glycines
  misc_feature (2369)..(2369): n is a, c, g, or t
  misc_feature (2435)..(2435): n is a, c, g, or t
aattaattgattaatttggccaaattattttgctcccacctcttctgatttgtaactcccctcttctccttcttcctcttcgtcaaatcgcgcgaatttcgtacaaatgtaattttcggggaataatttgcgagtgatggcaattggatgaccaaaggcgcattgggcaaaagcactggcggaggaggaagaggaacaaaaagggaaaataattgtaaaaagaatgagaaaggacggaagaaaagagaaaccacgacggacaaaatctctaaaaggaacaaaacatcgatcgaaatactgacaaatgagcacaactaaaaaatgggtcgaccgtgccttgcttagacaattttttccatttttggctgcgtgtgattgggattttgtccgcgcgtcaatgtataaaatttagtaaaatttactcgttgtcaaaactgtccccgaagggcgttccttccgcgcttcccatgccaatttgaccaattttgctttctgaaaatgcattttgctgatcaatcccatttgatcattttaaaataacgaacccatgttccgatcactcattcgcttttggcattgttttttcgcttctgaatttgtgccattttttgcgcttttttttttctgattctgtcgcgccttttcattgcctcggtgcagagaatagaagaaaaagaggacaaataacagaaacaaaaggaaaatagtgcacagggaaaagagaaaaagggatgagagattggaggaaagagtgccgacagaacagcctgagaaatggcaaatcgaagttggaaaagagtggtcgaaatcactcgccggttggcaaaatgactgccgacgaatgatcggaggcggagaaaggcggccgcaccgattggacgaccaattcggcacaacactttgagtccgggccaaggttgagctttgctgagctcaatttgtaagttgagcccgaagtttgggcctaaaatgtgccggaattggaattcggagtttaaatttaaagcattcgcaccatttcttcccaattgcttttgccctcttttttcgcgtcacaattcttccggccttttattctgtacgaattcgcctctttcacttcgtcccattttaaaatcagaactccgggggttgaattcacgagaagaaaattggtgggtctgtccaattttgagcacgcttaattaagcgccttctttctttgtttgactcacccgccccttcctactgtaatgagtgccgggtatggtacaattggtcgtcccaattcggttgcttgcttccagtttaaattcatattcgccaaacaattccaaatgatccacgtgcagtttggactgatcagttcgttggccagtcaccttccatgcctcattagcagtaattggtggtgtgtcattccgaatttgctggtagaaaatccgaaaactctgagagtgatctccgccgggatatcccggcatccaatacactgcgagtcgctgctgtccttcgcattggacgcgaaagtttgttgcacattggggggccgtttcctggagaaatcaaatgagggcaaaatgagaagagagggagagaaggcattcacatgcactatcagttgcacttcacgcgaaacagtggcaacggaactgatcagaacgcagcagtaattgccatggtcagagtgggcggcgttggcaatcgcaaatttggcctcggagaatgagcggtgcctctgaattgggtggcactctctctgttgatctatctatctttatctctctctgttctctctctctctctcccctctctctctccttctttctgttgctctctctctctcggttgctttctcttctctctgttgctctctctctctctctgttgctctctctctctctcccctctctctctcttttccgcttaccccgtcctcctttcggctccacactcttctgatcggcacctccccaaatccctcgcattcgatctccaccctttcccccgccttcactatatattttggtgccgggcttctcgtgaattttggcgcttctgccaccacgacatgaatttccaaatttggctcggtgactccgatgatattttccgcttcgcatttgtaaatgccggcggattcgcgaaaatttacgaaaggaatacgcacggcacttcgcagcaaattcccttcaataagaagaattcctttgatcgcccagtttttcatacgatcgatggttttctccgtgtgctcagtgattgttcggccatttttcgtccatttgaccaaagtcggcaacggattggcctcgagcagacactccaattccgccggatggtccgagcgaagcgcgtaatagcgacgactttttcgggacacttcgggnttatctgaacagaatgccatagcattagctacctgctggagaatccgtccggtctcacattgcacngtcagctgcacttttacgctgtcgctctccaaagtgcgtccgctgagtccaa

SEQ ID NO: 17285 - DNA, 3247 bp, Heterodera glycines
ttagggtcctgacttttttctaaatttggttgaaaacggaaaaagtatggtccaaaaactcgtccaatgttttttgcctttcgactagacattgcgttttcaggtttcctaccatttgcttcgacgtcttcttggagtgcgcactgaggcagggaaaaaagcggcgaaagtgagcaaacttgccaagggcgaagtgctcatggtgaatattggctctctctccaccggaggtcgtgtaattgcagtcaaaggtctgactccttctccattccaatttatatttaaattatgcatttcttatttaatataaattaattttaggcgatgcggcaaaaatagcactgactgatccaatttgcactgaaagtaaccaaaatattgcattgagtcgacgcattgaaaagcattggcgtttaattggatggggcaccatcagaagggggacgaccatcgcagtgccccaaccatcgatcggataatttaaaaactattccaattgtaaacggtttttaataatgtgcgtgtttttgcttcctttcatgcatcttatttttgtggaaaggtactttgttgatcaaaatatacccataagaaatgaaaaattttctcaaaaattcaattcttaagtttatttatttattttcttgataagaatttccgtttaaaattatctacatatttcgattgttgccagagtgcgtatttgatgcaaaattgttgtccaccgctctgtcatcgcgcgtcccaaaagtgttggcatcggatttcccatcaccggcacttcacactccgtcgtgctgccattgaccaattgttaaaggccaacgagcgtcgcttcatcctttctgatgaccaccagcagtcggtattaagagtggacgttgcccaagtcgctgcaaaccgaccaatcgaggacttttactccgcttcaaagtgtctccattccaatgcctttttgtttggcatttttgatggccatggcggagcggcgtgtgcaaggcacgtgtgcacaagggtaagaggagaaggaaaggggcaaaacagaagggtttttattcatttttggtactcgaatatttagattttgtgggtcacaaatatgaaaatggtaaaataccttctttccatgcactttcagttgttcgactatatttgttgctctgcgctggacaaacaccgagtggtgcaaatccccgtgggggaacaaatccaatggcttggggccaatgccccgcacagtcttccacaagagaaggacgacgcccatctccgaaatgtgcgcgagtatcacagaaagttgttgcctgccccaagtgttgtccatgccattgccctttaggttcagaagcggcgtctcccccgccaccaccgtccgttcgtcccttcaggcggcctttttggcgttggacgacgacctttcgaagggtgcgatgcctgaccaaagcgggcgcatttgcaggtgctttccgaatttgcccacagcatccaggattttctgcacgctttctgagaattatcttttttgtgtccccctcattttcggtagaatttcttcctcttagttttacaatccttccaacttttctcatttttctccttttcagaatgagtgtcaatgttgcggccagcggttcgtgcgctttggtggtgcacgtgcgcaagaacaatctgtgaggactgaatgacacgtgccccgcccccgaggaaaaatggcaggaacagattctaaaatttctggtgaaatgaccctgggacaaatactctccgatatatttgccttccgcgagtcattcgtcctttcgttaattgaagtcatgtggccaatgtcggcgactcttccgctgtcctcggcgtttgtcttcccaatggcttaattgctcgccaactgactcgcccgcacacttcagaaaatgtcaacgaaattcataggatccgatcggcacatcccgccactgaaaatcggactattctgcgtggtacaataaattttcttaattatttaattttgatttttttttgctaatgttgaggtgatcgccttcttggagagctttaccccctgcgggcgtttggcgatgttcgttacaaatggccattggaattgcaaagtaagccctcccccctcacaaaaaataggtcaattcaaacgcgggagccataactgcgaacaaaatagacaaccgaatcgaaatttaacaaatttacaggtattgtattttctatttttgtaaaattttcataacaatggcggattttctgccgtttttgcatttttaagaagtcaaacgacgctcccctagtcgaaatcccttaacaaaacttttgcgtatacaaatttgagaatttaagtgtttatacattcatttccgtaccatttaactctccccgtcagaagtcgttctcgaacccctcggaatgcccgccccctccaatctgttgagtccgccttatctcactgctcttccggaagtgttttaccaccaattgaccaacaatgacagttttctcgtaagaaagtcttgtcttataaacacttttgaatttttcagatattggcatccgatggtacaattttttggaaaaaaaaaactaaattcacgttttaggactttgggagttccttgacccggatacggtaatcaacggaattttgtgactgttacataaaagttgtaatttaggctgtacggttagttcatgtaaggaatggatgtgctgcactttccttttggaatttgcagtttttctttattttttcaaaggatcacgcacttggtgcacaaacgttgagtgatttccgacccgattctcagcaatcactgggagaagtaagtttttggtggcacaaaacccggaaaagcagaaattgccatgtgccagttatatgaaacggccaaccccatgctttttgaaacaataaattcaaaccattagaatagaaaaattcggcgtttttggactccgcacaaaacgaaatttattatagatactcgggagccttgaaacgagaaaacagggctatgctagcaagccgctggatgaaaattcggcgacccatttgatccgaagtgcgttgggcggttgttcaggcggaacggagctgcaatacgcgcggttggaagaatcgctgatgcttccccctgggatggcgcggaattaccgaggtgaaatcgccttggaaagcaattaactgttgctttaatttagacgacataacaataatggtggtgcacttcaaaacaccgtg

SEQ ID NO: 17286 - DNA, 1836 bp, Heterodera glycines
taacatgtcttttgattatcaaggctcaccttctaaatgatacacatagaattggtcaaacaaagaaaaaaaaatatggccgcttaaattttgctctggcacaattgcccccaactgatcagggatcagcagcaggtcatgacaaaccagttcagaccgagactaagtcgaaatagctttccaagatcagcaattcggtaacggctccctcgcccattccgcgcccaccaccagtgactcacccaaatgccgatcagatcgtattgtgccgcccacagaccgcgaacattgatgtgaccgccctgggaacggaattggaccgcatttggggccacgaagctgaagttgaaccggggcgactggaaatgttcggccgggattcgcaattggctggcatttacacggcctagatgtgcaaagtgacggaattggaattaacaaaattgtgtgaccaattagactaattggggagtaatgattggattaagcattaaatggagatttacatcaattttggcacaaacacatttgaaccttggaaatatcaaaattggcataattacttttcttggattctcgactaggcaagaattagtgatcaactatcttccttaaggtacactgatcagccagcgtttttcttcctcggactgatcaggatactaaagtgcctcaaaaaggaaaaccgtcttattcccggcactgatcagcagacggcttgatctctcgaacaattttcaccggcttcttaccggtgcccggcccagcgtcaattggcaatgaaatttgcgggaaacggactgacggcagttccctctcgacaatgcgatggccaatggagctgaagaagtcgaggccacggggcgagagacgaagtgccaaagttggcggagaaagcgcgacgacaacggcacggaaaaatggggacacaaaaaggagggagaagaagaaaaagcgaacggagaagggagagggggaggaggagaagaacaccatcatcaattaggaaggcaaaataaaaatttaaataattaaaaaacagggctgccatcgtccatcctccgtttccaaggacgggtatgccgattttcaaggacatagtggggaaaattcatgaaatccaaggacatttaaaatttttattatatgcaatgaaaaatggttaatatttattcaaatggcttgtatttttcaccggaatggattttttccaatatttttttatttccgctgatcattttcctcatttacgacgacttttttctgctttaaaaacgcttttttcgtggcgcgctttttccaaaaattttgtgggacagaggggggggggggatccggcggtgccgacaggcgccgccggggaaaaattttgaaaatttgaatgcaatttgttaacagattttcaccaaaaactgcctaatttttgcgattttaagccatgcgacgactttttttgtttataaaatgggttttttttacggcgcgctttttaaaaatttttttgaggataggggggtccggaaaaatttgtaatttttaatgcgagttgtttacagatttttgtccaaaaatgaccaaaatttgcgatttttggctaattttttaagaaaaatagtgactagtgacttaatgccataaaatttcaaaaattctcaaaaattacatttttaaatgacataatgccataatttaatcaaaatattgttgaaaattacaaagatttctcaaatttctttgaatttttttaaaacttttctaaatgttcattttcaaggacgtccttggcatccaaggacgttttttattttcaagaaagagggcccaatttcaaggacg

SEQ ID NO: 17287 - DNA, 2112 bp, Heterodera glycines
  misc_feature (100)..(100): n is a, c, g, or t
  misc_feature (105)..(105): n is a, c, g, or t
  misc_feature (119)..(119): n is a, c, g, or t
ataaagttttcgtttttcaatgcttctacagtgccaatatacttttttctattaaaacattttaattaactgccgaataaataattttttcatttatttnaaatntcatataaatattntagttcatatttaagcagctttcattaatgaattacctcgcgtagtgcaattttttcttttgatcgtttcatgataaagtatttttcaatttttagtattgtcagtattttatttttgccttctatttccataactattctcgccatcaaataatattttctcattttttaaagtttcctttgaattttaaattttctatttaattatttatgattttgaaagtttaaattagaattatttatatttctttctccatttctcgttctggctgcgggtttcccaatagtttttgtttcgccggaaacttattcgtcaaataataataattattagggctgccaattttatgtaaatacatatttttttttcctggcttctccttgctctaaatagcaggaaaacactttcttttttgtgtttgcgaacaaaaaccgggacttttatttacatatttttacatatttcggtgtttttatacatatttacatatatcgggattttcaaacatatttgttcatattttggattttttcatatatattttcatttttttacagattttgagtattttttacggaaatttttggaaatcctcaaaaaaaaaatccaaaatttcggcaaatatttttgtacatattttaatttttttacatattttgaaaatttctaaagaaaaaataagtttgaaaatgttgcctaaaaataccaaaaaagtaattttatgtcattttgtggctatttcatactttacggggattttctttcccaaaaaataccattaaaaaaaattctatttacatatttggggttttttgtacaaattttgggctttttcttacatatttatgtacatatttggaccatttttttgtacatattttttgcagccctagttggagtctttgagagcacaatttggcaaaatactttaaggaggggggggggggttgacgacatcaaaatttgcgcagggggtcatgccattgacatttttttccttttcaaacagctttttttgcgacgtttttttcaaaaaaaaaaatttggaatgggggggaggggggtctggcggtggcgatagcgcctttagacaaatttttttgtggattttcctctttttctcgcctttagacaaattttttttgtggattttccttttttttctccttcggcatgggcgaatcaataaacaaatattgttgccatggccattttggaaaaagaaagaagtgttggagtaaatatgtgtagccaacgactcgagagtgccattcgatgactgctcaagagtgccattcgatgaccgactaaagggccattcaatgaccgactcgagagttccattcaatgaccgactcgagagtgcaattcggtgaccgactcgagagtgacattcgatgaccgctcaagagtgacattcgatgaccgctcaagagtgtcatccgatgaccgactcgagagttccattcaatgaccgactcgagagtgcaattcggtgaccgactcgagagtgacattcgatgaccgctcaagagtgacattcgatgaccgctcaagagtgccattcggtcactcgagactcgcgccgagttggagccaaagctcttgttgataattttttagatacagtgcaggaaaaaagtgttgcatcaaaaaagaaaaataaattttgcataatttcaaaaaagttaagtgcacatatgggtgatctgataatggttacttttactggtccctaaaaaaaaagaaaaaaaggcgtttttaatgatattttgttctactcgggggttatcggggacgctgatcacgaatatgacatcagatttgtcatatgacatcatctaatatatgattttttcaaatctatgatttttcatcaagtaattttttttcaatttttttgttgatggcgaaacaaatgcttttatgagaagcacttttcgagatgaccagcattatgtttaaagatccttttatgcatctaaagttgca

SEQ ID NO: 17288 - DNA, 4032 bp, Heterodera glycines
aaagcaaaaaatcgttgtataaatgtcggatgaatttgagaaaaactcggaatttttgtaattgtatgttttgccaaaaagtgtggcttttttgttgaatgaacggagtttttaaatttaaattgcaacgaaaaatggcaaaaatttgttagaaaattgcattctcaaagagtcccaatttggttttcgacctcaattcgtaaaagaattaaagctcaaaaatagtgattttgcttgtgtaacaatttaatcaattaaaatagtatcaaatttcgtatttttcgcctcccctgatcattttaaacaattttggggaggaaataagcaaatcgtacatttaaattcaatagtgctcaaattatcagatttttaagaattttttttttaagaatctgagtgacattacgccataaaattacgaattttctgaaaaattttaagaaatcagaacaaattaaaaagtgttctaaaccttgtttgaagcttttaacatccattttttgtgacttttttcgtgttttttatgcctattttaagtgcctatttataaaattaagtgtctaaaaatacgatcaaaatgttattctataaattattaaaatgggattttcttaactttcgcctaatttttcaggacttttttgcatttttacgtgcttttttgtgttttttcgtgactttttggcgattttttagtcgactttttgaagaattttagtgacttaaatttcgagcatattcatgactataaaaatctttttttacacttgtctctcattatattgggttggtaaataagtcctgtccgttttttacattttcatttaaattactgttcttacaaatcgaagaattttgctaatattttgatatatagcctcaaatgtgctctacaaaattgcattaaaagattttggccgactttcaaaaaagtttaatcaatgaagaaaaaatttcattaagtttcttttattttcaactgttgtgcctttgcacttgtccaatgaataaatatttatttattccaatttggagaagacacaattaaataaagagagaaatggggacaggagtatcgattgagggaaatgggcacatacaacaaataaatgagggaaatgaacggatggtcaaagggacgggggtatttatggaggaggcaacagagagagagagtgggaggggaagagatagaaaggaattaaataataattaagcgggacaaatcagtacccttcccaacatctccccccttaaaaaaaataaaagtctgtcctcatccatcggtccgttgatcagtgatcagtccgctcaactcggagaatagcgttgaggaggatctcgattgcgttgcgggcgatcgacacggacatggcctcgtgaagcatttgcttcgtccgtctcttgtgcaggtgccgcttgttgatcagctggcagagctgcttcgttgggaccatccggcggtgccaacggaagaccaaaagcatcgttgaaaatgttcaactcatcattgccttggtgatccatgtgacgggccgtcatttggtttgcgtggaatcggttggaagtgccattcgggaactttacctcgtaaatgactccctgacattggctgacgattccagcgcgccatgattgcgattggcgatgacgagcaaaaaccttatcgccaagacaaaactttcgaggttttgcaccaaaacgacgattgaactgcttttccatcgcctcgtctctgatcagtggtgccgatggttttgctctcagcaaatccaatgttgtgcgaggctttcgcagaaggaaaagttcggcagaacttttgctgtcgggcaaagcgtcattcggcgtcgtccggtatgacgtcaaaaatgtgttcaccacattttgcgcgccctcttttttcagtttccgacatgccctcttaaaggtgtcgacaaagcgctccgcttgtccatttgacatcggattgtacggcgctgagaagagatggttgatgccattttctttgacgaattccttgaattcgttggagctaaactgtgtgccattatcagtgaccaaagtctccggcagtccaaaacgagcgcacaatgaacgtaattgttcaattgttgctgctgatccggtcgaacgcatttcgaacacttccggccatttggagtgtgcgtcaacaatgatcaggtacatctttccaaagaagggaccagcgtagtccatgtggacacgtttccatggcccttccgcttttggccacgaatttagctccgttttccttggcgccttcgcttcggtggcacaaggctcacattttcttaccacttcttcgatttggtgatcaattccgggccagtaaacatgctggcgtgcgaggcttttcatgcgcttcatgcccgggtgtccacgatgtagcattttaagcacttccgtctgcagcgatgcagggacgacaatccggtcggcgtacatgatgcatccgttttcgaatgacagcgcttctcgccttcgatggaattgtaaaatgtcatctgacatatccattttgtttggccattggttcatgatgaatcccttcacttcctgaagcaaattatcggctttagtggcattgacaatgtcctcgtggacaattggaaattgtgccgtaaaggcattcacagttgccaaatttgagctttctgtaattgttgccacaataaattcatcttcgggcactggcgcttttgcaattaagcgcgaaagagcatcggcttgaccaaaatcggcagtgttttggtattcgatctcaaaatcatacgccaaaagtatgagtgcccagcgctgtaagcgatttgctgtacacgctttaatgccctttttgttatcaaaaatggtcaacaatggcttatggtcggtttgcaggacgaagtgtcttccgaaaagatatttgtggaacttctgaactgcaaagacaagagctaatccctctttttcgatttgggagtagttcatttcggcaggcgacaaagagcaagaagcatgtgcaattgcattcaagctgccatccggaaaacgatgggagatcactgctccgattccataatcagaggcatcggcagatacaatgatgtccttttccgggtcgtaatgggtcaagagttggtcagatttcagcacttcgatgattttgtcgaagcattttggcattccgttgaccagacccaagccacgtcctgtttcagaagttcgtccaacggctgtcgaagaaatcgcatgttcttcacaaattgttggtaatgattgatcattcccaaaaatgatcgaagctccgaaacatttgtagggacgggcatttcagaaatcgccttaatcttggatggatccggtcgccttccatttttgtcgatgacgaacccgagatatttaatctgtctctgattaaaagagcacttttcgggtttgatccggaatccaaaatttccgattcgtttgaaaacttcattcaaatgttttcgatgctcctcgtgtgaacgactgaccacgatcatgtcgtcaaggtaagcaaaagcgaactgaaaatcggccaaaatcgaatccatgatcgattggaaaatccctggcgctgatttcaccccaaatggtaagcgcaaatattggaaatttcttttgtgcgtggcgattgtgcacagttctttcgatttctcatccaattcaacctggagatacgcatccttaaggtcgatctgagaaaaaatttgtcctccattcaatttggataaaatgtcttcgggcaacggcaatggatgctgattcaaaagcaacgcgttgttcaagcccgttgaaaaatctgcacaaacgcgtgctgctccgttggccttcttaacaaccacaataggtgcggcccaacgggtgtgatcgatcggtctgatcactttctgcgccaacaatcggtccaattcggcctcaacaatcaaacgtgtgttgaatggcctggacgtggcctgcagtacacggggaacagcatctgccttcagctcccaatgggctttggttttg

SEQ ID NO: 17289 - DNA, 1755 bp, Heterodera glycines
ctgattgtcgaccaaaaaaaaacaaattttgtattttgattttgaaaattttttagagtccatctttttccccattacatcaagttaaatatttaaagatttttttttctttatgccatcaatttttaaattttttggtgaaaaaattgggttaaaatttgtaatgaaatttttttagccataactttttgaaaatttttcgttgacctcaagaagagagaggcaaaaaaataacgaaattagtcaatttaaggccccttcgtgacccccccccccccatttacaaacagaaaaagaaaatgccgcctaatttggtacaaatcgtaacgtaacaaatcattaaaagcaaatttgatttgctccaacccaaattcatcaacacaaaaataattaaacagtgaaaagacgaacaaaaaaaacgccaccatatcaaatgaaaagatcgttcacagaaaagcccacaacatcagcagcaattaaagccgatttggctttatttgatctgtttgcggcctgaaatttgattcggcattcattgcttttgggcagaagctaaaccaattggaagggcaggagcagaagcacgaccagaagcagcaacagaacgaccgtcgagtgcagcggaagctccaactgcagcagctgaacgtccaggtcgagcatgggactgatgcggctgttgatcattttgctgctgctcgtgtttgtcatcgttttgcgccgaagggttgtagccgggcggctccaatggctgcgaatgcatccacgaagggattttaccacgagggggataatgtggtgatggcccttttggataggcaggataatggtcattatcggcatgcacagcgatgacaaaggcagcaaagaccaaaatgaccgcgatgggagcagcagggagacggacgaccatctttctgagttggatgggttcaattttttgggtaaaattaattttataggggtctaattttcgaaaaaaactcgaattccatgaccaaaattccaaaaaatgttcgatggaattaaaattaattttataggggtctaattttcgaaaaaaactcgaattccatgaccaaaattccaaaaaatgttcgatggaatcaccaaaatgttcaaaaaaacttgcaaatttggaaaggcctttttttggcattatttcttaaggctgcccaatgctttcaaaaatttctttaccgttgtgcttttatatgcaaattctttaccttttttttgctaatttatttttgtatacttcagttttatgctcatctgtcagctaaataaacaattaaattgagcacaattcattcatttgttagtcagtctcattaaaatttgcaaatttccaattttaaatctttattgcagaaacaacaaacacacaaaagagactcactcactgacagaatattcaaatgtttgcgattcgcaatttaaaaaaatgaatttttttatttatgcaaataatttttgagtgattgaaacaaactttatttgcaattgtcgcctgggttttgcaaagaaacggggacggggagtgttttgtttttgcaggaatggataaaatgggcaacgccatttgagcgctgccaatgggcgccaatcaaatgggcgccagccgtcttaagaatgaaagttttctcttaattgatcaccaaattttttatttgtgttttttcatttgattttcactttttaaaaaggaatctgctgatttcacatacctaatttggttttttcgattttaag

SEQ ID NO: 17290 - DNA, 2461 bp, Heterodera glycines
  misc_feature (20)..(20): n is a, c, g, or t
ttagaagaattatttgatantttttttatgggagtgggcggggagaaataaagcacccgggaaaaagagaggctaaaagagggaggggggcacactgcacaaattagcggaaatgagagggaaaaatgagcagcatgaagccaagataacggagtagtaagcctcgaccctgatcaaagccaagttccagctcggatcatctaaattgatcagggccagccgggatttaaattcattataactcgaaaaaataaatcccgatcccgttcaaagccaaatcccggctcagactttcaagatcgatcttagccgggatttaaaactaaaacggaatcgggaaccgaccagccacaaaccctagtcccaatcttcgagactgctcgagaccagatgaactaactaatatcggtgatcccgtaaacaccctaattccttgggaccccctgtcaaatccaccaatgattttaccttaaaaaggttgggccaagccgtctgtcggtttgtatgtgccagatcaacaagaacaaccgaacgcagaaagagagcagaagcaatttgggatcagcaacggatcaacaacacccaacttgattcatgcatgccatcatttggctataaattaacggcggctgcggcgcgcaaatttttggcccgcaagggcgccacccaaaacaaagcggcagcggcagcgcatcaaataaaattgccgccatgccttaggcaattttctttgtcatctcttttctctgtttctctagcttcaaaacacacacatgcactctctatagctcttatctggtggtttctcgcaatcattgattgaccactttttaccgactgaccgaccgaacaatggaacaattagcgcaaattaaaattaaattatttgtgcaatgaatgaatgggttaattaaaaacagtgcaaataccaaaccaaaataaaacaccgcaaaatgatgttagtgcataaataaaataaaattaataaaagcattttgaaaccaattgatcagcagctgattgatctgctctgatcaaaacgtccctttgctgatcactaatcaaaaatcgcccccaaagccctccaccaaaatgtgtgacaataaataattgtgctcccaagcggtgaatgacaaaatttaaaatatttgaattggaaaaccaaataaatttagtaattaaggggacaaatggcatcaccaaatggacatccgactgggcccaacacaattaattttccggctactcaaattggtggaggaaagggggtggagacggggaaatttatccttaattaacggtaatcgatgcaaattttaaaatttgctatggcaaaaagaaaatgccaacggcagcagcagcaacagcagattatttcataatggggggagaaaatctccatgaaacacaataccggtgatgctcccaaggcatgcttggtcccaaattttgaaaactcattgagttggctcgggagttcttgagccaattttgtgggaatccgttcaaggaaggccgagaattgattctcgacaataatttcagaatgtccgagaatatcaccggtggaggagataaaacgacgacagacaagaaaatgacaaagacggcacaaaatgccgtcctcgtagtgcaccccggcgattgatgtgtttgatgatgtcacccacctgttgtttgcggcgccaattctggatcagcacgttcacaatgttcttgcgctccaggatcacggaggacagttcggcaaaccgtcggttgagcagctccaactcctcggtgaccacggtggcacccgtcttcggctgtggcacctggcgatgcaattcctgcttcacgccgggcccatggatgctgatcacgctgtcgtggtattggctgagccgcaggtcgtaactctgtgaaacatttggtgggtcgcatagggttacggtatttagttggccaaaatttaaattttttcaaaaattattctcggttttacgcagggtgagtaagccccaagacttttccgtacccaaagttttagaggaaaaaatagtatattttggagaaatttttcgattttttttgtttgtacccctccaatatttacctcacctaaatttgcccaaaaaatttctcgattttttctgaaagttcgcaaaagtaccaattttttgctgaaaatctgttaaaaaaaatcgagagaaaatatacaaaaactttctcgatagtgcctaatgcacccaggaccctgaaaatccttaactttcttaaaaaaacgtgctaaaaatcgaaaaaaaaaatgttgggaccatccagcatgaaaatggatgaaaaatagttttttatttaaaaaatattttattaattttataaaaaatttcaaaaaaaatattttactttttccatgaatgctattttatttaaatatgccatgccaataataataataataattcctctccccgaatgttct

SEQ ID NO: 17291 - DNA, 1249 bp, Heterodera glycines
  misc_feature (25)..(25): n is a, c, g, or t
taaatgtaataaaattttagttatntggagaagcagtcgttcaattgtccttcaacttctgctattcggactgatgtcgatacaatggaaaagaattcgacccttcaaactcctgtttttatggactcaagaattgatgaaataaagaaaaaggtaaccgacaccccacttaaaaatcaaatatttttttaaaaatcagtttcttcttgaattggaagaaaaacaacagaaaatcgttcgcttggaggcgaaacttttggcagcagaaactgagatcgattcgtttgatcagttggagggtgggccatccatctctccctgggctttcctttatttgaccttttatagaagaaatgcttgcagagaatttcaaattgcaaagggagcttcttaaaatcaaagtccgtttcggtttgattactattgaaaatgcgttcaaagcgctcggctgttgtgacaaagaaattctggaggagattaaagccgcggcctgtcagtgattcgatttaacattgtcttatatttcatcagatctatttgtgttaccgattatccgtacaagtacatggtaatcgtacgctttactggtcccacaaaaaaaaggaatttccaactttgtggggttttcgggggcggtgatcacgaatatgacctccatttagacctatttcgaatctcgaacaaaagtcgaaaattaataaatttattttttcgacttttgttcgaattcgagtccggggttcagaattgaccaaaaatggtgttagattcgtgattagcgaccacgaaacccccaggaaaggcgtttttgacaattaatttttaattttataaaaaatttgttcgaattcgggtcgggattcaaaataggtcgaaatggatgtcattttgtgatcaacgcccctcgaagactcccgagtttttccaaaattttaagaaaattagtcgggcgtaataactcagacattcgaactccgaattcgaacattttttaaattctaattttcaaaaaaagtggctcgaaaatatggggctcctctacgcgagtcgaacgtgtccacgatgcggcggaaacacatgaattaggacaacataataaaaattcaaaatctgtgttcagatccttgatcagcgcatcttttaagcctagagaaaaaacctgcgaaaattttaatatattttgttcgtctggacaccaattcttgaccattgcccaatttgagtggatacacaaaagtccattggacgc

SEQ ID NO: 17292 - DNA, 1835 bp, Heterodera glycines
cgtgtattccaactgagctacgctcccctttttccccatttcacttatcttagggctaaattaactctattttcactgccgcataggcacaaagaaagagagggtgagagagaaaaagaatgctgcatttatcacatccgcgattcgtgaaattaattttgcccgcctttccttgctcaatttaaatgttttgcgtgccgcttcgtacatttcatctgagaaccctttgcgtaatttttccggagcaaaatcggaaagttttgcacagtttgcacaatcgacgtagtcgcgcataaacaaaaaagcgtctgagggactttcagctgaataatattaaacattatgtgccttcatttttaactcaccagttacgcgttcggcacggcataagtcattgtaaacggcacgcaatagtcgcggacccaacccaatgcgccggtaagttggtggaaccagaatttgtgcgatgcgcactcgttccttgtccggatggtggtaaaaacggtacaaattgacgtaaccggcgaaccgatggacggaagaaccatcgccatcggaagatggacgcacggcaaacagaaaataattgaaataacgatggtcatcattgtcagtgtaagagacctgaaaagagggaacaaatggatgagtggaaaatgggaaaatgaaagagcgaaaacactgaccgcatcgatgtaccaatgggccaacgcttgcactcgctccagaaatttacagccctggtcaaattgagcatcgtttggtatagattattggtcccgaaagtttttttttaataaaatttaagaaaattatttttaggggtaatcttaggcgccgagcacgaatccggccttattttgtctcagtctcgaaccccgaacccggattcgaacatttcgtaatactgtcgaatgtaccccgcaccctttttttgaaaagttttattttttttctagaaacaaagttgtttaggggttttcagggtcggagatccgattctgacatcaatttcgaccaaattcgaacccctgacccagattcgaataatagttcaaaaatttaaatttttcaaactttacatttttacttcaaaatggtttaaataatcttttattgacgtattaattttcgggaccaataatctatacctttgccttccctcccatcaaaatttcaaatgaaaaattcaaattgtatcactcacatgttctgcgttgcctgcaacagttgttcaagcgtcgggttgaaggtcgaactgcccaccgacagaggcggcggtgtcaacgatttttgctgcgaaattgccgaagaaaactgtcgatgttgttgttgctgcaggatggttggcgacgagccggacgacgaactgagcccagcagcagcggtgccattgctactgtggaacaatgccgagccaccaccaccaccgcctccaatggatgtgatgtcatgaaaaccgttggacggtccgcccccctgctgttgttgttccttgttggtctgtttggggtacagacgagctgcaaagaacgaatgaatgatgaaccgcgtgttttttagttagttatatcccccgaaaaatgaaggatggaagttgggacttgaaggcaaaaccaaacggattggaatctctctcttttctctctctctctctctctcctcatcgtttctcggtcctccagaaaattttttaggaaaatttttttatagattttaaagcaaccagcaaaagccggcatcgataaccgggcgagcgaacacagagccaacgattgttgtgctcttaattatttaggggagacaggagcagctcgatcgttcattttttctta

SEQ ID NO: 17293 - DNA, 1081 bp, Heterodera glycines
ggcgcatcggctcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtccttta

SEQ ID NO: 17294 - DNA, 3097 bp, Heterodera glycines
tatcattcaatagccctaagtggtttctattagtctataaaatttttaaaaaatttcattgagttacaaaaattttatggacaaaaatgttcgtcgttaaagtgattttttggaatttttgaagtctaatagaaaacactaatgacagttggatgatatcaaattcattcaaattttgacgactatgaaaggagtaataccccaaaaatggacccaagggccaatttaaaaacaaaaacaaaatctgacagttttcatttgagcggtccaattgacatcggatcgactgaagtaagttttgagcagtttaggacggccatctgcacggggcgtgctcagccattcgtacaacgcttggtcatcaggcgtatcagcgccgttaaattcatccccactaaatcgtttttttatttttgaaattttttctgtaactggaaatttttgcccattaattagccaattacatttgcccagtcagaggccggtaaatgtgattgacatcaattgaacgaagattggcacaatcgtgcagaatggttggcgagatgtgtgtttgtaaagcggtgacattgttgatgttatggaaacggattttaacaatcccggcggcattcagcgcgggccaaatcccgtaggtcacaacatcccaactttggcgttgtctaaaaaatatggccaattccaacgtgatatctgttgcgaaaaggcgttgaatgcggtggagaaaagcgatcacttttcggttgatgtgactggaacatttacaaagaatggatgattggacggtcattggaatgatcggaatcaatcaatatttggctgatcagaaaactcactaaacggcaatccgcttgaaaccgatcaaattgggaggaagcggctttaatggaattggcaaccgtttaactgtcttgtcactgttacatttgacaatttccgctccgtcattcgtgctggaacgttcaattctcaaacttccaagcttccattttcttcgtttaagatgagtgtccaccactacatcaaatctataggagacaaccgcaaattccaaaccgatttttgcgtgcccacaaaagggcaatgaatccaacaaaatgtcattgcagataaaactgaattttgtttaacgaattatggcattaaaattagaattttatacaaatttatctcacattttctcaaaaattcgtttctcttcacgtggatgatctgacatagaaggatatatgtacagccagtcgatgatcaaattgaaaattgttgcattattaattaataaaatattaattaggtaattagtgtttatttacacacaaaaaattccctaaatgaaagaggatttattttttttaatttaaaataagaagttgattgaagtttcaaatttcaacgtcacatgaaatttctcacaacggtgtcattctttgaggctttgttttttcgttgacgttttattgacgaacaaatacaattcaaccaaaccaaaccaactcaagaaaaaacaaaattttcgtttttttggcgtaacgtcactcgctgataagggccaggagcaattttttttttgtttgatcacattttcattcttttgattttgatcgactgtttggaatacacaatcaaaacctaattgtttgttacgcaattagagtagataagaaatgaatatttaaacttgccaactgatcattactgattaattcaattcaatttcaacaaacaggaaataattaattaattcaatttgtattttctcgcttcttatcaagtgctattagtagaaagaaatgaatcgtattggttcagcactttcaaaggtattttttgcatcagttttcattgaaaatccagcaaatttttggttgttgcttttgtacttaattaagagattttcgttttgggactttaattggaagccatacatttttttgccattcttggatctaaacttgagtttggggagattgagatcgagattaaaagcagtacggtgaatctaaaacatagtagaaaaaatagttaaattggaatttaaatgcgtttctcctgttttagtcggttttcatccctcgtttgttctgtcaccgtttcttcgccagtggacccaccgatgcgcgacaaaatgtgctcgttgtcattgtcgatttcaacggcgaacagcaattgcttgtcaacggttaccaatttcagatacttagaaaaccaacaatttttcatttttctaggaaagtacagcgaattgctcggccgttcccccgactttccatttcctggcaacgtgaaaccgttggctgaaatgcaacagcaacaacagcagaaagtgaaccaaccatttattaaactgcaaataaaaaaaggcacttttgcctgtttagggcccccaaaaaatacaaaaagtggacccttttgtagggacttggaattagttgaaatagatttcagacgattcgccgtaaatcaccaagtacagttttcaatacttatgacacgaaaaaataagaaaaaatagggtcttcccttttggaattttttgcgggccttaaacagcaaaaatgccaaaaaaatgcatagtaaatttaaaaaaaaatttttttcagtttccattccctttggacgccttgccaaccaaacaactcggcaatggcttgggtgctgtcatgccactccacaaaatcgtcgagccttcatttgttgtttcggacgatcgtaccgccataccacgagcgttaaggcatcaccgaatgtggcaaatgggtgaaaatgatggacggatgacggctaacacaaccaccgccaaatatgaatggaccgtggccggggtggatgggattcgaatgctgtgcgaaggtgggggcggggagagtttgaaaatcggggaaaaactaattttttttggcactttgcagaatagctgggcacatttcataattttttagtgttttaagagcaatggtcatcatgaaaataaattgactttaccccccccccccacatttgttaaattttttggacagttgattcttcaaaagtgctaatttgaattttgaaccaaatttgtaccatcaaaaaaaaaaatttttttttttgattctcg

SEQ ID NO: 17295 - DNA, 1013 bp, Heterodera glycines
ttagacataaaatgtataaataaatatgtaagggcacatgcattcattgtttgttcaattaaaatttttgctttttttatttcgggaggcaaggcaattaaatatgcattaggtaattaggctttatcccgagactcgcgaggtccgtctctcgaacctgggggttcctggcctgaattttcgattttcccgaattttttttggtcaagaaattaaagctcaaggtccaaaacggaagcaaggtccaccatgctcatgctaaaatgtcgaaatctaatttttatacatacatctactgtcgaaaatcataaaatcggtcaatcaaattcaatcccgagtcttttgccctcgagaattgcctgtacaatcccacctggaggcaagagcaaatccaaaactgtgccgggctttgccgtaccacaaaataaatggtcttgccgacgtcaccaacaaaccacatcagcaccattttgacactgcaacaaatgtttaaaatgtatgcataatgtgtaaaaattgaggcctaaaaaaatttggaaaaataaactatgaaatttagatggcttttttatatcctttttaagaaaaaaaagctataatataacgaaaaaaaattggaaaatggcgccatcaaatgtttttaacaatttgtttagaagcacagcttacgacctatgccaattggaaaagcggaaaatccctccgatcatcaaagtggaaattcaacaccgcttgaacggatcaacattatctcatcatccaccatcattatattaaatacatcaaaaaaggctcaagggcaattgattatttaaaggaaaaaatgaatccctctcaatggataacaattgttaaaatatgtattgtttaatttttcttaatgaagaaaaaagaaattatttttcaaatatttgtaaaaacatgagtttttttctgttgttttttttaatgaaaattttttaatttaccatttattaataaaactaattatcactcattattaggggtaggtc

SEQ ID NO: 17296 - DNA, 991 bp, Heterodera glycines
ctctgttcttttctcctctcctctcattcccttgcactatttttctcctctctctccctctctttgtcttcccctctcttcactgtctttctctcccccgttcaccaatcacatttggtcattgccaaaaaaaagttaagtttggctttggccaataaaaatgcaaattaaatattcccttaacatcactcttttaccgctcccctttcttcaggcacctctccccgaaatttgtttgtatgtgcacacactgctgaatcaaatttgctcataaagccggcgcttcgatgttcgccccccccccctaaaaaaccccctcaagcaattttagtcttcggcacaatgcatggtgctttcggcaaatccggattcatttttttttctcactgaacatgtatatatagctgtcgcatgccattctttgcctccaactttataatctcggcatgacgtttaagtgccaatgaattagtaagaagtccccaatactcaagactctcgaccttggaactcgtaattagtctcgcgaaaagaattatatatatatatatatatttaattttgaatcttgaatttaatgaacttcatatggcaaaatttcaaaaaaacgggggccaattcggtgccaattttgcccaccttatggaacatggcgttcaacagcgagcagagcacggtgaacaggcccagggcgaagatgtaactggacaggtcgttccatttccagaaggcgttgcaaaatttaccggctgcaaaaaaaaaattggccatcatttaatggcaaaaaaagccaagaatttcagtccctctttcaccccttcctggaaaatatccaaaaaaaaaacatttttcattcctcacaacgtacttttcttctattacccacacccatccaacccgcaaaaaacaaacatcaaactcatttgtcttccctccgtttatgtgaagtcacataaaagtgccgccccggggggggggggggggggggggg

SEQ ID NO: 17297 - DNA, 1302 bp, Heterodera glycines
tttgttgatgctcaccttacactgctccatgcacgccttccacgtgttcatgtacttttgggtgcagggctgaatttcggagcacaggcactgcttcaccgttggtgggttagccgcggcgaaaaacgccgccgaaatgagcgcggccaacagagtacagcaggcggaagaagaaagcatttttgtaacaatacgattattctacaaccaacgggggatcaagttcaagcagtacattcaacgatcagttgtcattgcctgaccctgatcaattgacttgggcaacatttgaaaatttaaaataaattgggcgacgaagcagagagatactcgattgatagggcttaatgcacatttatcagagtcaaaaatcgggcatttgggagattgagcaacatttcatgccataacagggtctggggcttaattgacaaattcagtcttataaaaaataagcgtccaagattgggtaagctaatcttgcgaactgtcgaacgaatttgatcaaaaaaggcattgaatttgggttatgtgccattgcagatgcgctgatcagtagggtgaagcaaaaataagacgaatttatgctatactgaatgaatgtgtatcgtcgatgcagaacaatttatacacaaaaatttcccctaaatttcgccgaaaataacacaaaattaattaatttattaattagttaattgcattttccccccggcgctgttgtgtgatggcgtgagttgtttagttgtttttaggggtatcaaagtctcacttaaggaggttaaacgaataaagattgaaaaagttgaccaacagtcctttcggaatgaatgggtgggcgatcagcgatcattaattagttaattagtaatgtgaaatgtcgcacatttttggccttttaccgcgcaaaatttgtccaaatgcaatgattaggagagctgctgaagcaatcatttataaaagaaggccccaaaaggcatttcattttaattacgcaaaaaattcagtctctgagatgaaaaccaatctctgatcagtgatcaatgtttcctcttgatcacattggcgatcgaatttttctctaatcagtgatcaatatttcaattttggtcatattattaatcttatccgtctctgatcagtgataccaatctctaatcaatgatcagatactctcttgatcacaatgttgatccaatccttctctgaccagtgatcaatgtttccttttggtcatattattaatcttatccgtctctgatcagtaataccgatctttgatcagtggtagtgatttatcctgcc

SEQ ID NO: 17298 - DNA, 1125 bp, Heterodera glycines
  misc_feature (1072)..(1072): n is a, c, g, or t
aaaaaattcttatacataggatttgaaatttttttaaaaacaaattcataaaatgttttacaaaatcactgttttctttttgaaaacgcgggggattagtccctgtggatcttttccggcaaaattttgttttaatcccacagcgggatccgcaaatttgatttttttttgtgcgggatcaataaaaagcagcattaaagtgaaaaatgccaaactctgaataatgaatagttcacgatgataattgggatatctcttactttatcttgaccgaaactctttcgaaatttaaagaacatttatgactaccgaatgacaccaaaacaaaagaaaaatgtggataatttgagaaaagttttgttttttgtcaaaattttctttttgacggagatttttcaatcacttcgtttcttagctgatcaaaaagaggggcgaaactgatcaaaagttggcaaaaggcgagcgtaacaattttaaaaatttccaattgcattcttcggcatttcaagtaaaaataaatcacttttttccgtttttgtcaattgccattggtcctttgctttcaatgcctccaaatatgacttgttttctagtcccattttgaccattattttttgtattccttccaattcgatgtcaaaattttgccgaagtaagcattaatttttggttattcgttcgttttctattaaatttgcaaaaaaaaaagagtgcgaaatttcaaaaatttacttggtcccctttttcggcattttttgagtttagtgcttagtttttggttttcgtacatccaaaattgggaagaaagagtaaaaaatgtgccaaaaaagaacccaagtctctcggcatttatttgttgcgtttttcatttgccgctgaatccgtcgtttctttcgccatttgtacaacattttcttcgaatgtcattttcgaaatgtcttaatgtggttataaaaggtcttaaattatattttagccattttcatggaattttttaaacccctttttagtgcaccgggcgaaatacaaccctaaaaaaaaaaccgtcagcagatcataaaaatttagtttnagaaactaaaaaaattatttcagttttttctttctgatgaaaaactaaaaaaa

SEQ ID NO: 17299 - DNA, 904 bp, Heterodera glycines
  misc_feature (873)..(873): n is a, c, g, or t
gaaatatgtaaaaatatttaactataagtcccaacttttgttcgcaaacacaaaaagaaagtgtttttcctactattcagagtatggagaatccaggaaaatatgtatttagataaaattccattcctaattatgatttttgaataaattattaaataatgaaattcaaaattacttcaactctttcacaggccaatgagtgaggccaaagagggcagaaggaatttggaaatgatcaaacggagaagaaaaatattaattcgctgataatgaaagtgattcttttaagttacgcctaataattcgaaagttaaaaaaatttgaacaaattttggaattaaaaccttaatttgtacgtgaagaaataaactgtgacacttttaacagcaattataaaacaaaaatgaatttggaggtctgaccagagtacatatgtattttctaaaagaacaaacagctttcaatccttctttgaatattttatttgtttattaataaacaaaaacgaataaattgttatttcccgtttattatttttcggtactgaagtgtccattttcactgggactcagttgtcccagtgctcagatggcgtcggttcgaatttataccttgttttttagacttagctcatcaagactttcgaatgataccaaatttgtgtgattttgaccgttttaaaaggtcaggtgcctcccttttcacccaaattttcgagttttaaaccggttcaaaaagcggacgcttttccgcgcactttttttgatggtttaatattagagtgccacgggaccgggaattcccggtcatccgaggtcccagtcccggtcccggattttgaaaagctcaggtaccggtcccggtcccggattntgaaaagctcaggtaccggtcccggtcccgg

SEQ ID NO: 17300 - DNA, 1303 bp, Heterodera glycines
  misc_feature (1243)..(1243): n is a, c, g, or t
aataataaaaatgaataaaaataaatcaaatgctttattcacaggtgataaaaatatagtgtaaatatggcaacatggaaaatcctactcagaactcattgcttttagtaaacccctgaattcctttgccttattaatttgcaccgctaccactggaaggttattccagctttttactattctattgaaaaaattattttgagttttggccgtgtggcgctttacccgtaaaagtaaaggcctcctgggcctttccgagaaaaagaaacttttcccagcatcgaggctggtgaacccttttataattttaaaagctgttgttaaatcattgatttttcttctttcttctaatttgtgtaaatcagtgattgttagtctttccccatattttttgtacacaaatccacattttctaaatgcttttctcgtgaaaaacttttgaacgcgttcaattttatctatatctttttttaagttagggttccaaacttctgtagcatattctaattgaggtcgtacaaaagttttataggctgctgttagagtctttatttccttgctttttaacactctcaaaatttggaaagttctaagatatgcatttcgtacaattttgctaatatgttctgaaaaattaagttttgagtcaattataattcccaagtcacgtacattatcagattctgaaattttaaccttaaaactccgattttttaaaaagttagttaaaaatttataaatttttccttcaattccaatctttttgattttttgaagtaataaatcaattggtacagaatcaaacgccttgacaaaatcaatatagataatgtcaatttgttgatccttttgtagagaattatatatatcgtccattgtttttaatatttgggttgtagtcgacctatttttaaaaaacccaaattgttctttatcaaaaaatcttataccgttcagaaattctaaaattttgctacttaaaattcgttcaagaactctacagacagtgctgattaatgaaaccggcctgtaatttaatggatcagttttttcgccttttttgaaaattggtaccactaatgatgttcgccatatttccggaatttgaccggaatccaaagcaagtcgaaatatgtcagctaatatttttgtaattggctcagcacaattttttaataaaatgtaaggaatgttatccggtgaaatggaatttcgcctgggaagctttcttaatatattccanaattatgccagccatttaatgcaatatccgaaagtttaattttattctgtgctgattgag

SEQ ID NO: 17301 - DNA, 2276 bp, Heterodera glycines
gtttttcacaaattagttttgtttccagcaatattccttcacgggtctctgcccgagttgccccaatgggcgcaacaatttgccgatcgaatgccacagaatggtaagaatcaaatgcaaatcattgcattttttgtgccaattcggtgcccgattcaactttttgtagccaattttgtgaggaatgtatgccatttttaagaccagcgaccataaaatctcaaaaacgcaaaattttacgagttgcacaaattttgttggtaaaagggctgttgttatggaagacaaaaagctgtaaaaagaggggggggggggagcaatggcattggcacagagcttggcactttttgcaaattaatttttcgcccctatttagttggttcacttcgtccgcaaaatgaaagtgtggccaaacaaagtggcactgagcggcaaaaggcggaggtaattaatgcaattagaatttgctgtaaaacaattaatttcacacttaatttaggctgtgaacgcccaaaagattgccgaactcgagaaacaattggcggaacagaaagtccgatttttccccacattttttcactgaaatttgttggcattttaaggcattggaacggcaaaaaattgcggcagcggtcgaagagcagcgcaaaaaggacgaaaggtattccatttgggggcttgttatcaatttgatggaattttgcgaatgcaataggcaaattggttccgatggcattacaggcgccgtcgggcaaaatattggcgcaacaaatttttagaatttctattttttgtcacgagaattccccttccgtcatcccttttattaagggtctttatgggctattagctgacgcttaattcaatgacttttgcattcaaaacaacttttttttttgtatttccagaaaggccttcgaatcctccgagccgaaacgaacccgtgacagtgcagcaattgacccggtcgacctgaaggtgtgtttcaaaaggaaaggcttacatttgtgtccttatctgtgattttttgataggacgatgaggagttttcttggaatgaggagtttataggtttttttggaatttttgagttttttttgaaacaaaattacccgttttctctcaaaatgctaatagtgtcaaaaaaggatggatttttcattgactttgatttgcctaaacccaaccaactacccgttattttagaacccggatgtttttaaatttccttctcagttcaggctaaaaaaggaggccacgggcgacccaaagcgacgccgcggggtgtggcagacaacgctttcgagtcgcggctgacggacgcattggacacggcgaatcggcacgcaaaagcggcagccaatgcaaagtatcaaactgttcaggtaaaatgggagcacagaaaacatcaatgaaaaagggggtggcggaagtcagggatggacccaggatttcggctcggtgagggcggcgtttccaaaaaaattatgacaagtgggcctggtaatgctgccaggcgccgccgtgggaaaaatttagaattttggcactattttttaacaatttgcagcaaaattacttttttttgtgtatttttgaaaatttagcaaattttcttggaaaattatgttagggaggtcggtcttggagctgggttcaaggtttatcattggttaagcctgccgctctgtccaaattaggccaaccataaatgcctgggttatggacagtaaaatccaggcggagaaagtaattgtctacaaaattgcatgagaatgtttacaggctcttcaactgcacaccaaactgatgaaggaagcggtggacagcgacgtgaagcaaaaagggggcgaaagaggcggcgattcggccaaatgggacgaagtgatggaaaagcgaaatgggaaaacaaaaaatggattttaaatggtgcccttttcaaggtgaaacgcgcaaaagcggaggcggaccgacgtgccaaattggacacggaaaaggaaggcacggcacgcgacgcaatcaaagaattggagaaagtcggtgttgaataatggggggggggttagttcatttgaaaaaatactcggcgaaaagtaaacacgacagcccctcccagcttaaatatacgaaatttattagaaaattgaaattttggtgaaactctttcagaaatgtttcacaaaacgatatttgggttccgaaattaacagaatttttttttgaaggtattgtaatttttaggattttctatctagtattttttccaaaaactaaag

SEQ ID NO: 17302 - DNA, 2448 bp, Heterodera glycines
ctggggtaaattagggtcctgagcaacatatgatgtttattttaagtttcagattttttggaattttttaaaaattcgaaaatatttttaatttttttggtccttggaaatttgggttaaaatttgaaaattcataactcaatggaggactggtcaatttaagtgaattaaagctttaaaaatagaaaaaaatcgggagaattttatgagatttatttgaaatttatatcacaaaaacaaaaaaagttattccagaaattctggaaaaattcgaatttccagaaaaaaattcagaactcggttctgaaaagctatttgagaaaagtaaaatactacaaaaatccgcaattttttgctctattatataaattttatttggtctttatgggttatttgggccgctgatcacgaatacgtaatcagattttacttttgacatcgttaagacctcagaatccctgtgtgattggggattctgaggcatcattttgagggggggggcggcaggttcgaatccggccggtgtacattatttttctgtgcattttttgattacttttacatgtttaatttcatttcaaattaaataaatattatattattaattttcattttaataaatataaatagttttgtttaatctataaaaaataaaattttttaatttaaattaaattattttttgtgaaaaatcttttaaattaaaataataatttatttacttttattaaagaactcctgtatttttaaattagaatttgtaatattaatttcaattcaaataaatattcaatccttgtacttttcaaacactctttttaattaataaaaggaaatttattttatttttaaaaatttattaattgcattcaatttttaatcttactttttaataaacgatttccttaattatttaattttaataccatgattgtaccctttttaaccattgttgtaccattccaacaatttttgtacctctcctaatcactgttgtacctcttgtaatcacttttgtacctcttttaatcactgttgtacctcttctaatcactgttgaacctcttctaatcacttttgtacctcttttaatcaccattgtacctcttctaattactgttgtgactcttctaatcactgttgtgactcttctaatcaccatctgttttacctcttctcatcactgttgtacctcttctaatcactgttgcacctcttctaatcacttttataccccttctaatcactgttgcacctcatctaatcacttttgtacctcttttaatcacagttgaacctcttctaatcacagttgaacctgttctaatcactgttgtacctcttttaatcactgttgaacctcttctaatcactgttgtacctcttcaaatcactgttgtgcctttcccttccgtggttgcacctcttctaatcacttttgtatcactttttcactgttgtacctcttctaatcactgttgcacctcttctaatcactgttgtacctcttctcatctctgttgtacctcttctaatcacagttctacctcttctaatcactgttgtacctcttctcatctctgttgtacctcttctaatcacagttctacctcttctaatcacttttgtatctgttctaaaatttaaaaaacggcgcgaagcggccgttcgaggccgcaaatcggcctaaaaaggccacaaaaagggcgcgaatcgcccgtctgagtccatcaaaatttaataacgggcgcgaagcgcccgtccgactcaacacaatttaaaaaacggccgcgaagcggccgaaaagcacaacaaaaattagaaacgggcgcgaagcgcccgtctgaggccgcgaagcagcctaaaaatcaccgaattttttgaatcgcttcacagtctaggtagcgaagctcccaaagcgcgaagcgctttttcccagctaaatagccgacggttcacgcacccgctagttaatatatacgttatattgacaaggagtttcgtttcaaaaactaatttgagcttaacggctaatgggacgggtctgaaagtggtggaagggtcttacaactttttgaggcgcatctgggaaaactatagaaaaaaattctcgacgcccaactgagtcccagcggctgatttctcattttttcgtgcatttgagggcccctaactttttttctgaaactcggatcaaaaaattcccgctgtgagggcactccgcagaagtgtcctctataatccagtattttttattttttgatcagaccaaatcccggacccgtacagacacggagactcagttaatttttttttcccacttcagtaccaggtgaataccacgtcagggtttggtctgagggagggggtgccagcgaacttattggaaagtttaatgagctctaatttttccaaattttaaaaatttcaaaaattttcaaaattttt

SEQ ID NO: 17303 - DNA, 2724 bp, Heterodera glycines
  misc_feature (2655)..(2656): n is a, c, g, or t
atggtgctaggtcgttccacaaaaaagctcagtgatcgataaaattaaataaataaatttaattattcaattcacaaaacacggtgccgtccggttaatactaatgtacggcgggacgcaagtcattttcaaatcttttaatttttcaatttttgacatcacttctcgccaatttcctccatttgtagtagacatagcctaacaccattgataccattttgtagagctcatcgagctgtacaaaaaaagccgctggtaccggcacgcttagcttgggttggccatcgacagggtcgggggcgaggctgagggtcctccggcagatgtgcccgacccatgacgggtccaagtgaatggatcaagaaccggacccggcctgggagatagcccttgaaaaactgaacaaaaaattgttcttaaccgggccgatccgggttccggatcaggcacttttggtgccccgaaagtggtgcgataggcttccggaaaatgaccaatcaatcactgagttttttgtggatcgcccacactgagcttttttgtggaacgactcaccacggaaaattatgtcaatattcgtcactagttcggactttttgccattattttggaatttttactcactagttaactatttcgaaatttttcgttactaaaagttgcgaccctatccataaatatgtaagagaagatccggattttcctgtttgactgccgccgaagccctaggataatttcagcaaatgtaatggaatgtttccaccatagaaggggtgacaaatgggtgggggggggagtcggggtcgttttggcgcccacgttttggcgccgacgttctggcgcccacgttttggcgccaaggtcgttttggcgccgacgttttggcgcccacgttttggcgctagggtcaggtttttaaattttgtttatgtttgaataaatgaaaatatgtattcgtcagttttctgagtcgctaatcacgaatattgtattcatcttgacaattgcgaagcccggactcgatttaaatgaaatacaatttttgaacatattagatcaggccttctatctgttttgttttatcaaatgttttaatatggtgggtccaaatctgagaaaatgatttaccagattcaaaaccgtagttgtacctgtttcaaaaaatggcctgtacctaaattttgtcaccttttttaaaaagctattttagcggtttgggcgtgtgcaaattttttgatgaaataacactaatccgtcaataatttatatcatagacaaaaataaaagtcagattctttttctgcatgtaaaattaccctagaaaaaatttatttatttattttactatttaaattattaaataaatttacgttaaccacaactcgagttgtggttaagattccttaagaaagattaaaccacggttagatgagcataccggttggaaataaaccacggttaacttgcgttaaccgtggttaagaagggagtaaaccacggttaactcaaccgtggtttatccttaaccacggttaaaaagggaaggacgagcataccggttaaggatttttaaccacggttaacgccgttaaccgtggtttagctctaaaccgcgagacgagcataaggcccctgattcccgtttttgtttgtgagaaagtttttgcttttacttttctacattatttaatcgtttttttcccgcgtttttcattattgaatttgttaattctataaaagaatttgttattgttaaagagaaaagaatttgatagttaaagagacgtgtttttttgattttgcttagtaaaaaattgaagaagcaaaggatttttaatttgttttcactttgtaatatgaaaaagatcgactttgaatttgatttgtgattttatttgtaaatggttatatgtttacacttattttggtattaacgtttgccaaataaatttttaaaattgttgtcattaaaatattgagaagaaatgtctgataataagaaaatgccaaaaaagggtgcgaggccgtgaagcagccgagcgacaaagaaattgttaataggaaatgttagtaagtgagccgcttccgaaccgtccccccgtctggtgcaacatcctaagacacccaaaaaagaaaaatgctgaaggatttgctgaaattgagtcccagtgattgaaatgttggtgggttgagtcccagtgattgaaatgttggtgggttgagtcccagtgattgaaatgttggtgggttgagtcccagtgattgaaatgttggtgggttgagtcccaatgtttggaatgccggagatttgagtcccagagattggaatgccggaaatttgagtcccagtgattggaaagcttgagaattgagtcccagagattgaattgctggtgggttgagtcccagtgattggaatgctggtggattgagtcccggcgattgaacgatggtggattgagtcctggcgattgaaatactggtgggttgagtcccagtgattggaatgtcattgaaagttggtgggttgagtcccagtgtttagaattccggagatttgagtccattgtttggaatgccggagatttgagtcccagagattgaaatgctggtgggttgattttcagtgattggaatgtcattgaaaagtggtgnngtgagtcccagtgtttagaatgccggagatttgagtcccaatgtttggaatgccggagatttgagtcc

SEQ ID NO: 17304 - DNA, 748 bp, Heterodera glycines
atcagacagtgatcactgattttgtcacctgtaatggcgtgcattgccggccaaagtggtgaaggagacgacgtcgagaaagaaaatggtggccatttggaaggactcgggctccaccgcctcgcccagcttcagtttgtccgccacctgccgcggcagcatccgatagagcagaatgtcgctcttgcgcttctcctccaccaactctttggtgcgctcctccacctcctgctccagcgaactggcgtactgctcgagcatgccgaacacgtagtccatcaggttttggtttctgaacatcaaaagggcaatgcttcttcttctcctgcgtctcccacccgtcctggaccatctgcttaagcatcgtccgcaccatatccatgcgcgggcgttcggccggcacttcagcccaacagtctctgatcagatggacctgaggaaaagcacaaatgaattggaaagaaaaggcgatcagcagcagcaaatcgtaccaaactttgattggtgtcttcgcgggggcggagctgaggacggtgagggattgtgttgttggtgcgtttgagccgataaaggatttctgaggagtgagaaaaagtcgatgagccaaaggaatgaatgggcacggcacaacaaatccaataaactcaatttagaattgtggtccgtacttaggatgaaaactcgactttggtcagctcccaataattccccctcaaatgccagtgcccaccatccaccgtcgtccctc

SEQ ID NO: 17305 - DNA, 1419 bp, Heterodera glycines
  misc_feature (76)..(76): n is a, c, g, or t
cgatgagagattactgtattgcgatttggggatgaccaaaagcaaatgcttaatagataaattagacaagtattanaatataatgtcgtttattacacttagaactctgttcaagttccgcttggaccgtatcccagaaaaagtactgtaaccaatttcccggtcaaaagtaccgtaggcaattccccggttacttttcgtctttcaccttacgaaggaagtttaaatcgtcgcccaaaatgcgcactctgacatggtatttgatggcgagcacaatctcccggttgtacacaaacagtgcgaaattggccgtctccaacactttgtggctgcccaccgtaagttttgtgcttcctcaacagtagtccagttgattactgtacctaccattcgttaccggaccatttggctacggtacgagtttttttctcacccgaatgactgctgtgcatgctccgcatgcttttctccgtctccgacttcagttcttccgtactgcgcaactctttcggatttcgtagctccgcaaatggaatcagacactcgcgcatcagtcgctctttctcgcgcattttctccctgaaatccgctaattagccaattagtcttttccaataatggtttgatcagtgctttggcaattcgacctcagtgcgtatccgatgccgagcaaagcaatgaagaggagaagaagcacaagcgcacttccgatcagaatgtacacagtcgcattttggccacattgcgtgccgttgtagccgcacaacggcgtggtcagcggccgaacgccgccccaattgacccaaagggacgcttcgctggtgtaaaggcggtccaaattctgaacattggcacaaaatgttggaaaaattggcaaaatgccctcctcctcctctgcttacaagcactcctttgctgatgttcactgtcattgtcactgtcggcacattcgctgcgtttagcatagtgacgaaaaaggtcggctgtctattgccgtccgagtccaaagtgatgcgtccggtctcgcctgaactgctctcagtttctcttaatttgccccccttttgcttcaccctgaaatgtgccggcagtttcggtattcatcaacgatccgttgcggaacaaatcttttgaggttgagtcgaactgttccatcgtgcgatttagtgccaaaaaatatgcgtaagaagtgtcgaacaatgctcgagcatattgcgaaggcttaacaaggccaatgataaaatgccgaagggtttgcccaaccgatcgttccgatgggtcgcccatgcaagtgccattgcagaaaaagggataagtgccgaatttgttggtcagatttcggttgaattcgttcgtttggtcaatcgtttggctttccaagtcgatctatttgctcattggtcattcaaaattgccaaa

SEQ ID NO: 17306 - DNA, 2156 bp, Heterodera glycines
gggtgaaaattcgtttccattttttagcttcgcgcactaaaagcatcaattattattaaatttcatttccatgcatttttttatatgtattattttttagcaattaaatgcccgcattattcactcaatttgcttttttttcaattaactccaacattaatattttttagcagatttaccgtatatgctttaattatagcccatgggggattatttttcaacctcctcagaaaaggggggataattagagactgggggattatgatagagggattatttttcaaaacacctcgtagactgggggataattggagactgagggattaatagagactgggctataattagagcatatacggtagtcgattttctgcaaataaaatatttgctaaatttacttatttacgtaaatcttacaaaatgggattggagattgatgagaaaatcattagacaacctaatcaattaggaatgggcaataaaaagtctttataatgtttatttatttttattatatttaaaattaaattaaaaaaccccccaactaaaatatacataacaaactcgaaaaaaaagttaagggctggcgcaatacataaaagggttggttaaggtggatgccgacggtacagcgggccaaaggtaccggcccagaaaatttcacaaatttttaatgaaatttcaaatcccgcgaggggatcctgtcccgggtagtcaatggcacaactttaaaatagtgaacatttaatcatataatttccttattagtgactgactttatgacatacatttttaattttgagggctttgctaaaaatgacaaaaaattgttcatgaaaatatgctttttcatcgtaaattttattcattattaataaaatattttttacataaattttaaccaaaatttaataaaatgaagcgttattgaaaatagtttgccaaaatttattattttttaaccaaaatatataataaaatggatgttcttgaaaaataatttgccaaaatttatcgggcgtcccgggcccggtccaaaattttgaccgggcgcccgtacgggaccgggcttttttcaaaatttttggaattttgattaaaaattcgaaaaaattttatagtcctttattttagcttagaaatgtcaacccattgtaaatcgaccttttttactcttcaaaagaattttaaggtgtattttttcaaaaagattttgacgacattagggggggggtcgcggcagtgccgacagggccgccgggtaaatttttgaaaatttgagtttggtttgttaacagatttacacgaaaaaatgacaaaactttgctattttgagctacattttagaaaaaaatttagctttttgtactaggcgacactgaagaaaaactttgacttttaatgaaatttattaagaaaatttttggtttttcatgaaatttgaaattttttttttttttattattaaaaattgttttttgcactttttttttgtgcccaccaaatttgccgattggcattttgttttccgccttcggcggactgtcactgcacgattgtcaatgtttttttaataatgtaaccaaaacaaaaaaaattgtacttaattagaaaaagaagaaataagtacaattttattaattgtagaattgcaattttctaaataaataccttatatgaaaatctaaaaaaaatttgccgtacgttcgagcggactcgaactttaatgaatttagccgacatactgcaacgctaacgactgcgatatgtgcacgacggcacacaaacatttatttcaggtccgaaaattttccgatttttagggcgaaaaaattccattaaaaattgtggacatttttgtgtcaagtcaatctgacattgcacaaatattaaaaataacgtttaaaaagggcagatttttaattcgtactttaaaatagtgaaagtaaacttttcttttttgtatattttttataagtcaatttaatatcactttgtaatgatttttttacaactattagtgtaatgaaaacaaaataattgtattttaattaattgtttttgtacaatttttttttgttaacattttaagggtcaatttaaggctgccaaaaaatagacaaaaagtggtcaaaatatgtatgcatactagccgt

SEQ ID NO: 17307 - DNA, 1681 bp, Heterodera glycines
tttgagctttgacattgttcccccattttcgctcccctcgagagttttgactaattaccgaagggggccgggacccgcaccgattttgctggactcaaccggcattcccgcatttttttgaattggatgaatttgcagagctaatcccgaaatccgacccggcaacatttttgaattaaagtcccgcaaccgaatccgcaaatttgaatttccggcctctgatctcgacattggttccgtccgttcgtccgtctgactctctgctcacctgaagtgtgttctctgtcttctctgtctgctacagctgttcactccgattggctgttgtcccctctctctctttcgttctgctgccgtcgtcccttttcttctctcgcttatcccttaacaatcttttatctctaaccctactctctccccttttctcttcatttgccccatctctctttttcgttttatctctgcatgtctctctgatttgcttactcttttcttgttgctgcttctgctgatgctgcttttcttcagtctttgactgttttttgcctccgggaaaaggctcctctacggtaaaagaagttgggttactgtacatggcaaaatgatgcgaaattgtggtggaaaaggaaggaaaggccgctggagagcaagctgaaaatggtggcccaataaagtgctcttcggaaaagtaagtttgggtttttaatttagcaaaatttccgaatccaaatctgttttttgttgtctgtccgacttaccattgtatgccggcaaaaagagaggcgctgctcttaattggccaaatccgccgtaggcacaatccgcggggccaaattcaatgggcggcaaatacgggtgatggtggtggaggtgatgaagctgatgggaggaggaggaggaggaagggacggaggcgaaggggtggagagggggcgggggaggcggaaggagcggaaaagcgagcgcggaagaggcgggggcagagaagtcggccaagtgggacactgaacagaaaaaggcgatgaaatattgatcggcgcaatcggaatgccaattttctaacggacgaggcgatgaattgatcggaaaagcgatcagaatgtcagggagaagggatgtctgatcgggaaaagcgaccaaacgggcggggaataattgggaacgctaaagtatgccggggggtctaaggggaactgattagagcggatctttagaggtatttgctgaccattcgaattccttccgttttcactgaccaagagactgatgagtcactgccactccgtttggtgctttcatttcacaatgcaatcccccaaaagtgatgccgtcgtcgttcggctgctgctgattgtgctggtggcactgctgccctccctctgggcccacaaattcccctccggcgccaatgggcggtgccatcggcggtggatcatcggccgggcacggcataaacatccttcttaatccgcctaaaacaataacatggccaactcagccaaatcacaaataatcccgtggaattacaagtggactttggtgagaggggggggggggggcggaagaatggtttaatgtgacagaaacgcaaaaaaagccattgggacaaaattagaaaagcaaaggggggggaggtaatgccatgccagaaagagagaagaatttttaaaaccccacgggg

SEQ ID NO: 17308 - DNA, 1910 bp, Heterodera glycines
  misc_feature (58)..(58): n is a, c, g, or t
aaattatgagatttacatatcaaaaatagttctcgatattttcaatgaaaatcggggnaattctgtaaatttctcattagctttttggattttcccattttttgaattgtcacattggactttttttgtttttggttttctctgttggctttcggcattcgtttgttttttgtttcgttgtggtgaaattttgtaaaaaaataatcttctttacctgattaattttttttaattaaattaaaatataccaacaatcataaacacgaaaaaatatttttttaatggattttaacttttgagcttttctttatataaatctgagttgtgttgtgttgtgtttgttctttaatttaattggaaaattcttttaaagaaatttaatattcccttttttcaaatgaaaaaatgagtccattttatttttagagaaaaattatttatttatttattttcaattggcccaaaaagctttttcttaactgttttaaagccaaaagatgcaaaaaatcttttttgtttgatttgtaatttgagttgaatgagtgggcgaattttgtacaacaaaaagtcacaaaaccatcgcaattgtttcaacaatttgggcaattttcttttgccatttgtccaatttttgtcggtataaattaatttttaattctaatttaatcttcagacagtcataaaaatgcttttctacccaatttctgtttctttgattttgttcaccttttttgccggaagcgctgaagcgcaggtaaattcaacaaaatattaatgttattatttttggtatatttcctcaattatattaataaaaaatatatatgcataaaaatgaaattaatgccaaaagtaaatccaaaaatggaaaattttcggttttttcttgttttgtatttttttctgaaatggttttttcataccatatttagctatttttgagattttagcttaaattaaggaattagaagaaattttgagaaattatacccttatttggaaaattatctgcatgttttacagtttttatatgcatattttgcgatttttcgtgcttataaattaaagtcctaattattttattattttttaaaattaataacttttgtttatttctttttttagctttagaattatcccttactatatattaagcgagtaatagccccgccccttttttggctttttgaattcgcgccgaaatcgcactttttgtgaagcgcccaaatttgcacttttttttgaagggacctagcaccggagagagagaatatagattttcttctatttaaaaatcatttgagaacaaatacagagcgttttaattatcgcttttctcttcaaaaactatgatttttaattcaatttgaattggcacagaatgatgctggcgttttgggacccgtcgaggaaactgctgggcaaattggccgcaatttaagctgttccgctatacacgcggctgtccgcgccatcattacagcacatccggattggcaccagtggttctacgaggcgaggcacgaatctttttttgtgttttaatatttaaaattataaaatattatttattaaaaattatttctttttcacttttagacaaaatcaaagtgatcacattgaaacgtgcgcaaacacggaaagtggcgacgtccacgactatttgtcggaacaagtggaaatgctcagatgccccgagtcgcgcagccgtttgatggtgaattaaactgttaattagtgttaatggagggaggggggtgggaaaagtgaggcgattagagagtgtgcggcagaaaagagagcagagggtacgatagatggttggttgctggttttttaaagaaaatacagaccaaggtcgaacgggaattcagtcctgacggctcagacatgaaatcccaagacctgca

SEQ ID NO: 17309 - DNA, 1289 bp, Heterodera glycines
  misc_feature (1058)..(1058): n is a, c, g, or t
  misc_feature (1083)..(1083): n is a, c, g, or t
agagttggtcagtaatttatatctttagccaaatttgaatccataattttttgaatttgttttcttttcagtttctctcacaaaagtgaagaagaagagtcgcgagggcaaagaaaacattttgaaagaggcggaaaaatttttttttaattttaaacaaaaaatttcaggtcagagaatgcgttggtcagtacaaacatttgtttgtcttctccacggagaatttgcgctctgcaaggctggcggaggtaaaatttaaaaaaattgcattttttttgtcataaattgttttttttgggtgggggcataagtgccacgatggggggggggcaatgggcgacagtccgatgtttttgagtattcctctttttgtagttctaatttctctaatgcctgcaaattttaaaaattacattgagtttcaaaaagttacgcccgaacattttcgggaaatcagtttttgctacctcacgaaaaacggactcggaaaaccattttaaaaattttgtaagcggatagtaaaacattaaatgataaatccccgagtttttcgtactcttccttgaattgtataatttttcattatttttggaaaactcgaatcaaaaaagaaattttttttttgtaatttttgtttttcacaaaggtccgccaacatttcaagcagaattcgcggattttcttcgccaaaaacaatttgatggccgtggcattgggcagatcggcacaggacgaacaggtggagagggaaactgaaaacattgacttttggccatggcaaaacgcccatttttagcgggacacataccagaaaaacaaatgactttaatcgctggttttccacgaccctaaaaaatgacaaaatgggagggtaaaaattaaatttggcaaaaaattccacccttttttcgccatagacctttcatataaagcgataaattggaaaatgatatcaaaaagataggtttttagaatgctaaaaaatggaaattttaatgaattactcccctccgatgttaattaaaaatttacaaaaaaaagaacccatttcgtgcccngaaactttttgcgccctttgtccanaatcggattcaaaattatggttttcaatccccgatcacctaaacagctttaataagcgattgaaagtagttgcatccgatcatttgattataaattaattgttgaaaaaacaaataaattttcaagcagcagaagtaatgctcctaacaaacgagaagacagtgttttcttaattaatgctgtttaggcgattagggattgattga

SEQ ID NO: 17310 - DNA, 1077 bp, Heterodera glycines
gatcttttaggcgaacgaattgcacaaagtgagcgcacttttgaggggccaaagcggactgatgttcaccaatgcgaaggcaaaggaagtgcaaaggtcggcggggacaattccttatttttgcaatttttgagaggggcacattttggcgaaaaatttcgaaagaaaaattccgtgaaattttttattttttaaatttttttcggggccgctgacacaataacaacacatccgatttgtagtcaatcgtattctatgattattcagcatttcccggagtttgaccctgaaaaaccgccaaaaaatttaaaaaaaaactaaattttcaaaggtttttcgacgagcacaccgaggcggagtttgcccaggcgggcgccgtcgcctcggcggacatttcgctcccggccggcccaatgccggcggaattgcacttgcacggcgccatggaaccgcagctgcgcaagttgggcatgcccacacggctggaaaatggttggcattttggttaaattgctgaatagtcgccgcaaaaaaaaaatttaattttttccttgaatttttttagtaaatttttttcaaattttttagaattttttcgaaccagactcagtagttgatcagtaattttttccagaaaatctaaaaaaatttcctgtttgaggttttataaagtattttcatattgaacccgaccgagtatttttgtgtcaaccaccgcccttggaaattcataaaattttgctgcactttcttcgatcgatatgtaataatatgccgtcccctttctcctgggcaggtgccattgagctgttagaggcgttcactttgtgcaagacgggtgaccaactgtccgcggaccaggcccgccttttgaagcagttcggccaccggttggcccaattccgcgtccgtctgctcgcccggtggagcaaaaagaagggatttgaacagattgaccgaggagcagaagaatgaatggattttgttgttatgtctatcggaggatttgattaaccatcattttacttttgtattaatttattgcgtaaattaaaaatgaatggttgatggattttt

SEQ ID NO: 17311 - DNA, 881 bp, Heterodera glycines
tctgtttggtttaagagagttccgttcctccaactgatgcaaatggctgcgctggtggcgctgcaacgcaccaatccgacgatgaaatttcaccgcccaaatgcgaaacgccacgcaaagttttatcttgttttttcaattggaaaatttgaattttgccaggtttttcgtaaggatggcgtcaaaattttcgctgcctttgtgcccgattcgcctgatcgctacgcattttctgagttttctgaactgaaaacctttttaagctcgccaattggcaaaaaaagaggtcagactcattgtacaatataatttaatgctacgtatgaaataaattgaatatttttcttttcaacttctatttttcttggctttttgttgtaatatctaaagtttcaaggcactcggttcaagcagtgtcaggacgaacaggcggtggactccttttacgatgagcagcgactgttgttgtcgaacagcatgtaagaaacgaaccggggggggggggggaatggggcaccaaaaagcggcactatttgtgcggttgattttctcagtggaaaattctctaaaaacaatttttcataaagaaatgatggactttaacgattttataaagtaaaaatattttaaaacaaatcttttgttctttctacctttgtgggaatggaagcaatgagtcaatggatgagcatttggacgactccatcaacagcagccgaagcagcacagcgagcggaagcagttcgatcagcgccgaacccgaattgccttataaggcatcacttttccattaggggaacatttgttacttttctggcttatatttaaactgttcatttttttttctgttctgaatacataattctaaaaaacagtcattt

SEQ ID NO: 17312 - DNA, 1866 bp, Heterodera glycines
  misc_feature (1675)..(1675): n is a, c, g, or t
  misc_feature (1702)..(1703): n is a, c, g, or t
  misc_feature (1709)..(1709): n is a, c, g, or t
  misc_feature (1759)..(1759): n is a, c, g, or t
ctgctgatcgaccactccgatgaacaaccaaatttgtacacattatattttcatgctgcttatactttgattgaattttgtttcccagccaccaaatctcatctaatggtattttacttttttgagtttgtgccggaattgtcgaattttattctttctccaaacattacaaatatatgcatctttaaaaaaatcatccgccaaaaatattacacgaatttgcttatgattctgcctttattttatttcaatcacatttttcttttcttttttgtgcaaataaaattagtgtaaaatcatcttaactttaaaactgttcaaaaatgtttaaatacgttgccatttttcttttattttttatcattattcttacaattacgaaggaatgactgtcgttacgcgttcgaagcacattcatgcgcccggtgttctgagtctagcgatcgatcagagcggaagcgacgctcaaaccgtgggttctgtttcataaaaataagcaattgggatgaattctcatactcatgacataataggtgtcattaattaaagcctaacgggtcagcagtagatttttacaatgtgttagagacgtgaaaatagtaggggaatggataggaaaaaaattaaaatttttataattccatgactttctagcaacccttaatttgctcttaaaaacataaactctcggtgtgccttctatttattggtccatctcatcttttttgggacggggtggttaaataatgatgtttagtaggacaatatttatgatacgacccaataatgtcggcaattattctgtcctttgctatccctccccatttcacttaacttaagtatttgcaggtgttctgctgcagttccgatgaaacgctcggcttgtggacgtgtgccggggctggcgcgttggaagtggacattcgcaacacggccaacaattgtcgcggagtcatagcagtttttgtcagtcttcttctcctttttgctgcctaatcggtcaattttgcctaatatttgcctcttttggtcagggcgaggacatttatgttgcggagcagggccaagacgtgatcaccggcaacgaccaacacgtggtggtcaagtacgggttggccgcctttctgtcctcgtccccgttgctgatgttttctctggaactgaccgcgttggcctgtgacggcacccacctgatcgccgggtcgaggtcactcatttcaaaaatagcattgacccaatttctgaccgatctcaacgggacgggcccatggattttttgtgttatggtctccaattaatcaagaacatcccgataatatatttggtttatggctattttttatttggttgaataccacttgggtaactctttttggttttatttggatgactacgacggtcacggaatttaggatttttgagggatttggctacctgtgattagctgcttgtgttttaactttgaaacgtatacgctcttgcagcgatttcaccgtcaaatgttgctcattgggaagcggcggagagaccaactttgaccgatacgaatggcgacggtttgtttcgtatctgaataaattatccccccccccccccccccccggcatcgttttactcctgaaaaaagctccaaaaacttttaggtcaaacatgaagaaaacttaaggtccataanaatggtttttaattcagctgattgtgnnagtggntggtttacggaatgttccatggtctctttaagcaatttagaaaaggattnttttttttggtcggaacacgatcgagggggagaggggggtgaaattagtcttattattcaattctctctttagctgccattgttaacctttcaatttcgcccaatgg

SEQ ID NO: 17313 - DNA, 1205 bp, Heterodera glycines
  misc_feature (1157)..(1157): n is a, c, g, or t
ttaattttttaaagtttgtgatgtatgcactggtcacagtaaggaaattagatgtttatctctgtgattaatgcttttctttagttaggcgtttttttgaaattttagtcaataaaattgttgaaattaaaatttattaaagcggcgcaagtgtcgatttggctgggcggcgcaaaaatcgcggcgcaaagtcggccaaccttaattactttccttttcccgcgtttctttctctccccgtcacttccaacaaagaatctgctgctgctggtcacatttttttgttgttattccgaatcgataaacgaaagagacggacggacagatgagaatgggaaaattggcgaatactttcggcaaatttaattttcaattttaaatcatttaaatttggcggaaattaaaaatttaagtgcctcggggcttattgaggagtgaatgttttattatattttaaaataagtgccaattaaatgtcttctccccctccgtccgtccttctcctcctctgatcatttgaataaatcttttgctttgtttttcgaactcattttccattgatttatttattccaattagtttttcattactttttactttttatactttgtgattaatgtcttttcaacaattgctaattattaattcataattaattatcgcttctgttaatcaatgggaacaactctttcttaaccaattaacgacaaatgttttactcattatcatttttaatttgtcgattgctcagcgaataatttgttcatttataaataaataaataatttaatttttttaattaaaattattcattttttcctttgcatttcgtttcgatccgctgattatttttcccttttcttttttccgaatttgtcttctccgatcgcttccgtctgatctgatctgatctgatcaactcattactcccaaatcggttttatttgttcccctcactttcttttcttttcattttcctttttcttccgcccatttttaaagtacaatttgcggagacaccgccacacattttgttgttatttattatcagtcgaaggcgaaagaatcagcgcttttcaaatattaaataattaaaaaacgcactttaatggctttatccacacaaaaataaaaaataaatattttctattctttcngcatttgtccgatcgatggttcagtcgcccaaaaaccaaacgccaaac

SEQ ID NO: 17314 - DNA, 1957 bp, Heterodera glycines
ggccaaaagtgcgcttggctccgtcgactgtcctttctgttggcagtggggaattcgcgtcactccgttgctcggcttcttctgcataatcactttgctgctttttgtcaaagaaccggtcaattaattaattaattaaatggaaaacaattcaaagaaagcaattaaaatattaattaattaaatcgcaggtgaggggacaatccgaacaaagtgtggcacaactgatgccaacaaattacgaaacgtattgaaaaaggaaaatttaaaaaagagaaaaaaaatttaaaaacagcggaacgatcagtccaagttcaaggcgaacagtggcatcagcagaagcagaagcaccgaatgagaacatttggaaggagtattaccatcggatacgcactcacactaaaagttattgcgcagacattggacatttaattgcaaagtaattgaacagccaattaatttattaacagccaattaatttattaacagccaattaattcattaacagccaattaatttattaattaggccattttatgcaaaataatgggacagtcaattattattacataaattaattggactaacatttgcttccttcgtgctttagccgtacattcgtgtggtcaactttggcctacaccgccgtggtttttgtcaccggaactttgtcatggtaataatttcctaatttcttttttatttcttcttttatttttggtggggtcccaccgccatggaacacgccaaagcgatggacgaacatttgaacgacacctcaaaattgagacctgccgaaaagaatcaaattgcgctaatttttggtgcaaattattccccttcaattttacggcgtataattaactcttaatttgtcaggagtgatcacttgcgttgccggaatttttggcgtttcgttgggcagtttaattgcgcaggtggcacggattgaaaaagcagaaaaatgccaaattaaattcagcattggaagacgggcaaattttgttttgcgcaccaccgctcggaaagggccgatccgatcgtttccgcggtcggttcgttcgtcgccgctccgttgatgttcgtcgcgttctctttgatcaccactgatcagcttctgtcatgggtgccttttatgttccattcactcatctagcaaaaaaaaagtcaaagaaaaaaatttaaaggaacagtaaataattaagagggacaattacggtatcaaagaggggcaactactgtatcttatatttcgaacgcaattaattaattattcatatcattcacctaatgtttctgttcaatttccattcagttcgtcgttttcctcaccattttgtgtctctgtttgaattgggccattaacgtggacatgctaatgtaagtaactagtcagctaattagtcaattaagactaactagttattacacccagtttaaatgcttgctttcccttttttcaggagtataatcgtccccgaaaggcgtagcattgccagcgccattcagattctcttttcccatttgttcggcgatgcctccggcccctatttggtcggtgccatctccgacttcgtccgcggctcttccgatttgccaaccgatcgtttccattcactgatcgtcgctttttatctgcccaatgctttgctttttctcagcggcgcggcatttctcggcgccgcttattcacttcccgcggatttgaaacgaatggaagcggaaaaagctgcggcagagagtgagcggcgggagaggagtaaaaattaaaggggcgggggagagaggtaatgagagaaaggatgaagaagagagaggagagataaagcgagaggggagggaaaaggaatgagggagagaagggatgagagagaatgtatagttggagagggggataattaagggaaatatttaaatcatttaattttgtcttttaggaatttattcgcttatttta

SEQ ID NO: 17315 - DNA, 2156 bp, Heterodera glycines
actttcattattttcgatgtgtcaaaattaattccacaaggggatataaaatttttcattttttctttaccaatattttactgtaattaaatttttaattaataaaaaaaatacacaaacttttatttttaaacagcctataaaatacaaagtaatcaaatatttggtcaattttttggcaaattttcaaccaaaactttgatcttttttgttacaaaaaagttttttgaaaaaacagcaccacaaaaagagcgatttaaaaacaaaaaatttaagagatttcatttattaaaacaattgaaaaacaccattaaataaaaaaatactcaatcatttacatagagaaatatgtattttgtgtttaaattatcattctaatttatgcattttgatgaaaatttttggaattttcaaaattttttctattggaaaataaattcccggttggtcacggctttttcgcggtcccggacccggacgaaaactgaggtcccggtctcgacttttctggtcccggtaagtccggtcccggtttttgtcaaaattcccggtcccgtgcaactccagaatttaacctgacaagtttgatatatttgactattaaagaatattaaaaagtagtaaaaattaaatcaatatttaaatttttataaagaatttcttgcaatcagaccaggatggtttttaacaaaacatatatatttttttgtttttctgtttaaatttcttaatttttattgttcgttagatagataaataatttggtgccaaacagtaccgaaaggcaccgccgaaaacttttttgattgtttttattaacataattttgaaaaagtgaaaaaagataacgaaaaatattaactcattaagttatcagcaactaccggcatggtcaattctataaaaattatcttaatacttactagaaatttatttataattgtttaaacgcattttttcttttatattttattatttgtttgaaaataaattctaaacaggaatattttatttgaagttcaatatagaaaaacattaattcgtaaatataggtatgcgaaatacataaaaaaattaaattcgaaatatataagaatatacaaaccctaaaatgtgtaccaaaatatctaaattaataattttttattatttgtattaatttttatcagataatttgtctcatcccgtctcgacgtcccgatgaaatcccgactcagctcaatcccgatgaatttagaaacgctcgggatgtatcccgaagtcgggatccctaatactatcttgcaggacctcgatcccgtccggtctctagcttatgtgttttttcaatgcttaattcgttgagtttagcttaaaacttaaagcagtaactaaatttgattacttatttcataataaattaattaaaatgttatcgtagaaattcatttatatttaaatatttacacatttttaacaaataaatgtttttcagcaaatcattatacattttaaaaaataattataattactcagtagtcataaaattgaaattgtcaatttaaaaattattttatttgaattattttttctataatattcatttttaaaataaattgttttttgttatcattttaaaatatctataattatttgctatcaaaaagtttatttttgggacgcgtacaatgccatggtacgcgtaaactgttgttgggacgcgttattcccagcgtataacttgcgatgatgtcatatatcctcaatttaaatttggtgaagattggtctttaattttaaaataattttaaaaacttaattatttaaaaaaatttggctttaaatttcaatcatcttttgttcctataacggtttagaaaatgttgaaataataaaaggtttaaaagattaaaactgtaattttttggatttaaaactttaatctttatggtaactttacgaaaatattgtttaatctttcgctatacactgaaataatttttaatatttagaagtaaggtgatgattgttagtggcaaaaatacccaaaattatgaattagaatgttatggtatataagtttttgcttattgatttttttatattttctaatcattaatcatttttagttaactttaaaggaacatagaaatattatattactatttgaataatat

SEQ ID NO: 17316 - DNA, 2241 bp, Heterodera glycines
tttttgaaaaatgcgacattaaaaaagtgttttgaaaagcaaaaaaggtcgatttacatagcttgatataattctaagctaaaataaaagaatataaaaaaaattttcgaattttttaatcaatattcaaaaattttgaaaaagtcccggtcccggcggggcgggccctaaattgggaccgggaccgggggtcccggaaaaacgggagtcccggtcccgggggtcccgtacgggtctattttccaagtcccgctcccgttcccggccatttcaaaattccgggctctagtaaacaatcccctctttgtttaaaattggaaatatgtgcgaaaacgtaaaataattaaggaaaaattatactaagaaatttttaatttcttctataattttattttgcgaatccccatttccgagggtctccgttttttttatccccgcttcccccgtttttcgttttggcgaggatacccctgcgccaaacctaatttagaacgtcttaaattcccccattaattattttatattaattcgagaatttcccttgtaaaaatgaaaagagccgatctcgagttaaaaacataacttcaaaaaaataaacagggattcggtagagggggtaaaaatattggcctatgcaaaatttcaagaaattttaaaagctagaaaaacttttagaaagggacgaacattttactaaattactgtccttttaaaggttaaaaatggtattggcacgtaaaaaacgaaatataaatatattcttcagaattttcccttcaaaatgagaacaaaatggctctatttggtttattaatgaccaagttataagcattagaaatttcagaaaaatcactgttttatcactttttcctcttggcgcactggtatgcatttaattttcattaactttttttagtgtagtgtctgactcattgtgtctgctgtttcttcatgttttatgttttttaattttcgcttcaacactcttttttttgataatttttgtcaaattgttgatatatgtcgagcaaaccaaaggcacattattagcatataatattcgtcaatcttatgaacaccgacaaacattttgtgtagcgggaaaaaaccccgaaaatccgcattgaatcgttctgttttaaaatcaaatgtcactttcttaaaaagagattgattttaaaatatttttgtttgaaaaaaatttatttctgttatttctttaaaaaaatcaaaagcaaaaaaggatttataaaagggcaaattttctcctttataatagaaaatctctcccttttttgatattgccttttgcattggttctttcttcttcatttgacccccacctttggcacccatttgtttaatcttttttgtttaaattactatcatttatggcattttaatttttggtcattttctcaatcgatcattagtgtaattaaggacaataatccaactatactaaaaaataattagtaacattatttgaattttcatacacaaattaataggttaattcttatttagaactcatttgtttttaattaaataataaatgaattgaagaacttctctgcattgaaaatttcttttattttttcctttttattaaaatttcatcccctctgactttcttggcatttattcggtattctttctgactataataaaacagtaattttcctgctctaatttaggatttaaaaaaactatagagttcgattaaagtttacaaaaagttacagatagataagcaagccaaattaaaaaatacttttctagaaaaaaactgggggttaaccgggcgatgtcaaatctgtgaaatggtgtcacagattatgtatggcacgcacctttctctgttaccgaaaccaatgaaaaaatatacaaaaatttattgagaacaaaaaactaagcattcatatgtcccgcgacagtaattggaaaacccggaccaggacaaggatttttgatcggactctttttactccgtacaaaaagtactgtcttaacaagactccggtcctgttgcattttcctaaaccttaaccggactacatatttggcatcctcaatcagttgtccatctccgtcagaaaaaagtaaatttaatttttaacatttgaaaaccaccctattataaaatcggtattaatcataaattgagcaatttgtttattagttgttttgttgtaatttgcgtcttttcttctttccatcaatgtcctcctccattatttt

SEQ ID NO: 17317 - DNA, 1727 bp, Heterodera glycines
  misc_feature (489)..(489): n is a, c, g, or t
atggcagaatggtaaattctaattcttaaatcattccttttatttgcgccgtaaggcattacggcatattttggcaactaattaaatccaaataacaataagttggatcagttcaactgttggctctattgcaatttacgcgtccaatcaatgactatcttcagtttctttggtgcttgaacgcgcaaacagcagttgagcgctaccagccaaattaatgtgtcaaatgcaaattcgtgtaaaataagtttttttttttgaaatttaaggtttttaaaaaaacttaattctgaaacaattattttgccaaatttgctttattgttagaacctatgctgaccaatttgaaaagattcaaaaataataataattaggtaatacattttagaaaattttacaaaaaaatatactggcgaagttcacatttaattgtcccataatgtcttttttaaaaagatgtggatcggaactggaaatttcggaattttntccctttaagtattattttatttatttcttgaaacttcacctgcgtccattgttatgactcggacattcatgctttgaagactttttgatgacacttagaattttacacaaaatttttgaagctaaaaattgaaaatttttattttatgacgaattatgactttggaaaaggcggattgatttcacaaagcaattaacaaaatgcagcgaggggagtggagtgctaaatccataccaaaagacagtgggaaaacgaaatgaaaattttaaattccagtcatagaggttggccaatttaagtctcgcttgctatcccgcggaatgtgcgaattaatttcttttccagcaatttaaatgaaaaataaaaggaatttacataaaaagttacattatttaatcggccaaatttgggttttcaaatttttttttatttaaatgaatgatgtgttaatgagtggagggattggaaagctgaatcagccaaaattttaaaaagagagaaaactcgtcgtaaaatatggcccttcaatttgtcgttgttctcttatcttcactcttgacaaataattgtcggatactccggtcgatgtgtggtggtactaaaaacacaacaaattgattcatcgttcgtccctctccccttcttcacaaacactttttctaatgaaaatgaatggaacggaacggacgaacaacgaaagaatgaaaatgaatgaatcatcaatgctgaatgaggagagagcagcactatttatcgcataattggaatgcctatcaaattttttaaaattgtgctttttgtccgggagaaagcccctctcccgccccccttcctcaaaaaggtggtcagagaatgagtgcaaattttaagaaaaaatctctcctcgaactgtacttgcatataataaaaacatatatatttttaagagaatgccggtaaaatggtcgcaatcacatttttgtataatacgaataaaatggttttggccaattttgggaaggagaaagaagagatttgctgaaaatggttccgactgctctgctgctgttggtgatggtgggagcaatgacgacgggccggggatggaggggtgaggggtgagggggggggggggggggagcgtcggaggagtacggacaaatgcacaaatcaatactaaaataaataggcgcgatgaatgagaaaatgtacagccagcagcatcagcagaaagtcattgccctcatacataccgctc

SEQ ID NO: 17318 - DNA, 841 bp, Heterodera glycines
aatgattagggatgcctaaaatatgcacatgcatatttttttcctggactgcgggaagcctgaaacgcacgaaaaacatgtttttagcttgatttgattgaagcttctatgtaggatgactttccatgtgcatattttgcatatttgtgcatatttcgcgatttatgcatattttggcatttcgtgcatattttggcgtttttccaaaaaacctctaatagatcggcccccaacagacaaattggcctttttgacctcaaaaccaggaaaattttccaaaaaaataattttttagcaaaattttcacgaaaaatattgaataaataaattttctcaaaaaatggttaatttatgtcaaaaataagcaaaattttgcttttcaggttgatttttcgctaaaatgagtaaattttaagctgtatcgtgttttttgctcctaaaatgctttttaataccacatttagccatttttgaagattttactttatgtttaacaaatttgaagaaattttgagaaattacaccctcaattggaaaattttatgtgcatatttttcactttttatgtgcatatttcacgatttttggtgcatattttatgcgcatattttacgattttatatgcatatttttggcatccctacgaatgatataccgatcgattcgtctcaaggagctaagcatggaaaaatatgtcgcgagttgcggaaattccaaaaaaccggtttttgaaccagttcaaaactcgaaaaattgagagatttcgcactataactttttttcaaacgatcgaatcctgacaaatttgataccatttgaaagctcttgacgagcttaatct

SEQ ID NO: 17319 - DNA, 1380 bp, Heterodera glycines
cggggatgaaaatcgttgccacgttttcaatccccccccccctccccgcgtttttttgtgccctttgttcgcttcccttcccacccgaatgttcgtatttgtgccgtgccaaggagctttgcttgttgaatgatttgtcgcacagatcgcaaatgtaagttccgccgcctccgttttcgtccgtttgttgagtccgccgccgtttcgctggcgtcgcttgcgctttcctttgcctttccgccgtccctttcgccgttcgttttttttcccccgcggcgtcggcactcgtcgtttccttaagtcgaattcagaagtgaaaagagatcattcttttgatgagcacctcagtcaaatggggaagttcagctggcgagggatgggttccgagcattgagaggaaagtcggggaaaattcggcggaagagggccaaatggaggaggagggccttgggttttgggacggcgacagttggcggtggaggtgattctgatcagacaaagaagaagcagaagaggtggaggacgaggaggaggacagcggcaactccccggcacttccaagcgcaggcgaactgtgcccgctggtcggccgcagaagcatttgctgcagcgattggcaccctttgtccagaaagcctggggttgggatgggctgctattgtggccattcgaagcagcgaatcgcataccgaagaatggagagggcatcggccaaacgcggcacgcgtccgcttcagtcccccttcctgtcgttctttgctccttctcttctctttttatgtccgtcgcctccaacttttcattttcttcaattttcatccacttttcctcgtcctgttcatttcgccgaaacgacaaatccaacggatgttcctgaagaagtcacttcagtcaaaccttagcgcaattggccacatttttcaatcatggcgaattattcatcgtccgacccattcccatcccatgctttatctcttaatcccatcccatgctctttctccacattcccataatatccttccaattgttcccactttttgcgaccattggtcatcatctcctctcgggaattctttccccatttttttctctttttggcacttattcaattatgaagtgaatggaaggcgtacgcaatagtagaaaacaatatatgtgtagcagtaacactaacaatgaggacacattttcgcagctgcctgccattactctcgagaaaccccccccccccccggcgccaattcccgaaattcgaccaacccgcagaatgagtgaccattccgctcctccacttcatccctttcccattcttcatcccctcgattaccctcttcttccataacacccatccatcatcctgagcaattatctcgcggactt

SEQ ID NO: 17320 - DNA, 829 bp, Heterodera glycines
tatccctccccatgccccttcccccgttttcccctctctatccctccccctttttccctctctttattcctcccctgtcccttttcccctctctttatccctccccctgtcccttatcccctctctttatccctccccctgccccttcccccgttttcccttctctatccctcacccttttcctttctctctttctctctatccctccccttttcccttctctctccaccccctcccttctgatcacctcctcctcctcttcgcttttctgcgaagagtgctctttgttggtggcggtagcagcagcaaaagcagtttgagccaaaaaattctgtaagccaaaagttgaagcagtggacatttggtgctgaagagatgcggaagctaaaacggactgtagctgttggtaataaagtcgaagctggtcaagaaaagtcagaggcattggcaaggacgaaaaggaagaaaagctggagggaaaaagtgccgatgaggagggcgaagaggaagaaaagccggaggggaacggtgccggggaggaggaaaagccggaagggaacggtgccgaagtggacggcgaagaggaagaaaagccggatgggaacggtgccggggaagaggaaaagccggaagggaacggtgccgaaaagggcggcgtggagggcacaaacggaggatgagtaacaaacaaagctgagggcaactgaacgggcactagtgttaattatcacgagataaatgatttttggtttttaaccgaaagagagggcgtggcgggggaggggccgtacctttgctgttcaaattggcatttttgccgcgaggcgaa

SEQ ID NO: 17321 - DNA, 2313 bp, Heterodera glycines
ttgtcaaatccatgtgtgttgctttgtcggcagttgtcaattccatttgtgttgcgttttcggtagtttttggacggacacgcacacggcgcccgctcggagttgccgtcaacggcctcgggctcgaacgcgggccttaatttaattttcgcttctaaaatagtgctttttcgacatacgaaggtcaaaagttgacgttgacggcccactttcggtggcttgggttgatgtcccctctccttctgctgttggcacggcttcggtctgctttagcgctgaaaaatgcagtgttttaaaataaaattaattttggtcaattttcgtcactttttggcgtcaaaccgcctttctgagcgcgcttcctgcgccattccttccgttttcggtttgcttcggtgctagaatttctcatttccttgaatttttcagtttttttacgtgtaagtaccatttttagctctaaaatattgaaaattcgcgcagtcgtaaaaatttttccaaagttgcgattttcttgaaattttgcatatgcccatattttgacctcctctatcgattctaagtttattttgtgaaagttaagtttttaactcgagatcggctcttctatttttacaagggaaaatccccaaaaaattttaagttttgcaaagttttggcgttctgattactaaataaataataatcttatttgcactgggagcccaaaattgggccgctgtgtttacacgagtgaataaaattggacaattttgatatcattcgaaagctcttgatgagaagaagctttttctaagcaaaagctaagcaattgatcaataggaaaaaaggtttttttacggtcatcttttcaccaaaattcacgtttattgcccaaaatcacttttagggcacaccatcccagaaatgagctcctgtaccagaaaagatttgcatgtgtggctcagtggtttttgtaagatagtaaagggacaaagggtggtggttcgagtccgttgtgcaacatgaatatttttatttatttttgtccaaaatattaaaaaatgccgaattttgggaattatttttgaaggtttttcccaaccaaattggaaaaacttgatatcattcgaaagctctttatgaggagaagctttttgtaagcaaatgctaagcaattagatgagttagaaaaaagatatgatgctttgaaattttgttttttgaataaattctcgaatcgacctattttcaaattaacctgacctatcattagatgcagaatttttttctctatcgatatacaaaatttggtgtggatttaacgtgcaggaaaaaagttaaacgtcacgaaataaatgttgtttttcctaataataaaaatattagatagtacgccaaaaggagacaaaaaattagagaaaaaaagataatgtttttctctggcattctctatttattggtacacatctcgttttttgggatggtgtgtatatcagaatcacaacaaatagcagatgactccacgtcaacagactattttataccacaaataatcaaaaagcaacaattttcgtattctgtcgtgtaaaaaggaatcagaaagtaattttgtgaggatacattcccttggcgaggtgaaaacgtgaacccaggtaggcgaacagcaatttcttctcgggatgtttgcggaccacttccataacctgcaagtcaacagttttttggtcctccttgcgctggtcggtcacagcgtactgcttaaatcgggtgaatttatggaaaacattggtttcatagatttgtcatttcaatttacggcaatgaataaataaccttgttcgctccctccgcaaaaattccacccttcgatttgtccgccacttttccactttgtcgtttaaagtatttgtcgtccaaatgctccggaacattcaccgtcgaaatgtccaatttcgttttggtcgctatgacaaaagcctgtgcgatgcggcgcaacggtgtcgcattcaacttcattgggcctaaaaatttgaaatattttaacacgtttaacataaatactagaaaagagttcgtttattggtacttctaccgtttaatgatacggtactaattcggtttgtttgatcaccccatttttggtcaattttttcaaaaatttttttttgttttaaaaaggcttgaaaacgaatacccgggggttttcgaggtcgctgattacgaaatatgacaattattttggcctattccgaaccccgaacctaaattcaaacgaaagtcgaaaactcaaaattttgaaaatttgcttttatgttacaatcagaacaaaat

SEQ ID NO: 17322 - DNA, 1846 bp, Heterodera glycines
ttttcatcaaaatcttttccagtgcaatttattacctttaattttttctaagctattgcttcgctattagacaatttccaaaaaagttatacatgaaaattgcgaaaagtcgaaatttttgaagttttttcgtaataaaattttttccaggcttgaaaatcttttcgcttttggtaaggctaatagagcatgttaagagctttcgagtgataccaacaatgttgtatttggatgtcaaagaaaaaagctatcgtagaaaaagagctggcgccgaaacgcgtgggtcccgtttgtacatttattctttctaaaatattttatgaattttaaaaaaatactattttttcagaaaatttttgtgttttaaaagtatttaaaattaaaaataacagaaaattttttgtttataaacacgaaaatatgtatatttttgcttttcccaccgcttctcccaccactcactttatcgtgaacatcattcggctgtccgtgttggtgacactcggctgtgcagttgctgctgtcgttgcggcgccgtcctgcgactgttgctgcggtgccgtcgttgttgtcgtctccgttgctgttttgtcgtcattggtggcagtggtcgctttcgttaacagtcgctgcattcgtcgcacactgtgtggccattgccatttgctggcgttgagcatcagcacgggctacaaaagtggggaaaaattttaaaatttccagtggcgcctatcggcacccttccgacggtcctcaaaatttttttccaaaaaatcgcatttcacacacctgcacagcatacgtgtacaaggggtggtcacttccaagggtcatacgacgtacgatcgggccagggggggtggtcatatgcgattttccttatgacggggtccaaaatttttgacgacctttttttttttttgctttttaaaatctcttttttttgcggcgcggtcttctcaaaaaaatttcgcgaacgcgggagccggcggtgccgctaggcgccgccggggaaaattttgtatttttagtgccatttgctagcagattttgactaaaaaatgcccaaattttgagattttgggctaattttgttaagaaaaaatagggttttttttgagtccggcggtgccgataggcgccgccggaagaaaacatgcggacagcgacgaggcgccgccaaaactgtggcccatgcacacgcagcgatccaacgcgagacgattctgaaaaaggggggagggaattttccattttttacaaactttttcactttgaattgtgcccaatcgaatgtttggccgagaagaatttgctgttgtccaatttggcgttcgttgttgttgtccgtcgtcacatttttcagcaaattggcgtccatttcggctaagatccgtcgcatgtgcaccgtctcggcaacacgtcgtttcacctgagtttaggggaatttgaaaataaataaaaattccaattataaaatattaaaaaggcatgaaacacacggaaaatgcatgaaaattttttgagaaaacacgaaaaacgactgttataaagaggaaattttttgcagttttcaaccaatttttcgaccgcctcccccccccccctccgctttagcccggtctcccaccgcattaagtgcacgtccatagacttcatttgtttccaccaaatcgcccattgcgatcatttccatcggctttctttcatggactggagtcttttttttgggtttggagctccttcggtggctggcggtgctggcatcttttcaagcgtatacgtccaacagcaggagccgtccctggaaagcgagagggggaggagggatagtttgaattttcaa

SEQ ID NO: 17323 - DNA, 3683 bp, Heterodera glycines
atatatatatatatatatatatatatatatatatatatataaattttgcctgaatttggtgtgcattttgctgttgcggttcgaacacttcttcaatcagatgctgattttctctcatttcttccattaattggtcaaattcgtcctctttgatcttctccattctgatcagttctgccaatgttccttttttctctgttcgatctcccattttcccgcttctctcttctttgatcagatcagataatgtcactctcagcggatccaatgcgaacagatcagctaatttgacagatgaagatttcgcttttgaagtgttgctaataccttgacttttattgctgctgcccgctccattgaccaaaatgaatgaacaattggctaagaaaaaccgcagaagagatagtgcgaaaaataattccataaatcagacagaatttctaagagaaaattaaaaggctaaataaaattttagctcttaagaaaagcgaaaaattactttattaacttggataattatatgtaaaacaattttttaaagaaaaatcatgcaataaatctatatccattcaatttataatgagaaatgtagcgttgtcctatgggcattttgcaacgtacgcttggatgctatattggattctaaaaatataatttatattaaatatttaaatttaattattagtattcaatcatatttgtagaataaataaatccataacctttgctcgaagtttatcaatttaaacaatcttaatatcgaaagataccgtatatgctctaattatagcccagtctctattaatcccgcagtctccaattatcccccaccccagtctacgaggtgttttgaaaaataatccctctatcataatccacccgtctctaattatccccccttttctgaggaggttgaaaaataatcccccatgggctataattagagcatatacggtagctctagttcctcattaccatgtaaagttataaaaaaaaaatgtattaaaaatttaacaaataactaaaaagattcttaaaacttaaatccccattttgccttttggcattttgtgccggaatggtttttggatttcttagcggaatacaataaaatgtaaaattggcacctcaaaagaatgactttaaccactaaaaatggttgtcggataactttcttaaaatcaccaaacctaattttcttatgaaattttggtttttgaggttttttctaattaaaaaaattgaattgggcctaggaaaaggcttcatatatgatttaaagagaatttgtgatgaataacaaaattaccatttcatttttcaatttctctgccgatttgctgttgggaaatttattaaaaaaagatttcaaaactcccgaattttttgctctttgattttgaaaaaactatcgaattttttgctctttgattttaatttttgcctgttcataagcatatttcataaaatggaaagtgaattaattattatggcgtcggcggcgaattaattctctcctaatttttgtcgcgggttgcggtggtgaggtggtggtcatcttagagcaggaacaaccaatttgtcgatcggattggcggacgaacgacggacggacggtcggacaacaaccttagttttaaaacaaaatttgacctactctgatcaataatgacaaatcgttagactattcctaatcattttaattacttcaaaaaatcgaagagtttttagtttttagggaagtcttttgccaatattgtgatgatttttaaataactaagttttatgcctagtttagagtataattattttccgatttttagggcatatttttgggtagtgaatcaaattaactcgtaagagatcgaaatttgaaatttgcagatgggtagcacttattttatttttttcaaactcccaatcattgaattttttatgaaatcaactttctcaaactccatcaattataaatacatacagacaatacacaaacatagcctctcattatcaaattaaatcaacattgaaatccagttttttaaatttttaattaaaaaaacttaattcgacggttgatgaataaaatgagttgtattagcataattaaatattattctattagattcttagtaatttatgaattactagaaatttttaaaaaaaagattcgatcgcttactaacctgtttgaattaaagatgaataaaaatatatcgtcaataattattattttatcacattttaccactttattcacaatgccatggccaaataacagaacatcattgtccaaaaacatacattttaatgaaaacggtacgcacaacaagcgaactggatctcgctccggatttgctaggtcataatctcaattccgcgcctttttcagcttttccttctgctgattttcggcatcgcctaagggattttgttggcggcaacggcaacagacggggcaaagggtcgatttcacgcttgtcattcgatggcgtggatccgcttcagttgccggacccggatttaagcacattgacacaagttgcggaagctggaacaaaagtgaagctggacaccccaaacttccaaccggtatttttggagaattaattacatttatttgcacataaaataaatacatcattaaataaatgattttagtatatttgataaataaaaataaaatttaagtaaattaatgatttttcttttaatttaaacaaggaaacattgaattaattaattttttggcattattttattgattatttatgtgataattaaataaataatttaacagtttaaaattgttatgccaccaaaccttggaaaaacaaaaaatgacaaccgtgctccaaaagcgaataattcttttacttcttcaaatgagaaaacgccaaaaaaattgccggaagattttgaaaaattgtcacaatttttgcaggtgaaagtcagaaaaataataaataaataatttatatattttttaggaatttatcaatcaccaagacaaaaaatcattgaagaaaactgtgcaaaaacctctcaatatttcaaaattaactgccgaagaagccaggaaagatgatgaacatcgagagcaaagaccaaagatggaaatgccaaaagagagtagcaataacaggcaaaatttcaataactatgtaattacaaagcgggcccggattaaaaaaaattcccagatcctaaccaaggaccggcatttggaaaattcaatgacagtaaaaaggacaaaagccgaaagatgctataggcaccgcgacttcccaattttcaagacttacgataataataataataaattccgttgaatatcaattgaatatgattagatttaagactagaccagacatttatgaaattaatttttaaaataatatttttttgccgtttttaagagcaatttctttgtttgcaaattcaacacggggaacaataattggcactgtgccattgtctgttgaaattggcaatgatagagatgaaatggaagagcagcgaaagttgacagatgaaatgtcccaggtggaagtgatcaaaaaagtgaaggaagaaggaattgacaaagtggacgaagcagaacatggaaaggtggacttttctatttttaattatttaaaaagaaatttttaaagacgcaacaaaggtttttaagaattccttaa

SEQ ID NO: 17324 - DNA, 1531 bp, Heterodera glycines
atttattgaaaatgttaaataaaaaggcattgatgaatatgcgaaatgcttttatttttgaatgaaaaagggaattggtgaaaaggaaagatgcaaaaaaaggaaaagaagaaagagcacaaaaatgggggaaaggcgcctaaaaataacggatgagctaattaataatcattaattaattggttgggtaattaaatgaagggactaattgaatttgctaaaagcagacacattaccacaaaaaagttgagtgaaaatggaaaaagaaggcaacaaagagggggaaaaaatcaaataaaaaaaatgcttagtataaggctggcacttttaggtgaaaaaactctaaaaaaaataaaatttcaaaaaattatttgattttttttattaatggaatagttttttaattcaaaaaaaaatgaaaattttatttaaaatgtacaaattttagtagaattaaaagcgccaacccaaaaaattatgagcaaataaatgagtgataattaaatgaaggcactaataagcaatgcctaaatcaaaaaacaggcacaataattatgagtttcccgccaatgtatttaagttacgttgaggcaccaaaacattaattaagcaattagtgacactaatgaatgctattaaaggccacaacaatatgtgaaatgtcagagaatgataaaactctatggttttattggccccattattaatttgggtaaataattatcatcagagcaataaataaaaatgctaatgagtgcactaattgcataatatgagtgcatacaattagcgctattacagtaagcactattacgtaactgaaatgtaattgtatggatactgtatgggtgagtcatcactgttacagaaatccgtctatgggcgagataaataatacacagacacacagactataatattgtctatacagatattgtacatgaattggtgctatgaatggttaaagcatatactgtattggtatacggtaatggtttctctaacactgtactataaataaatccccaaatgactgccacgttttctgttgagtgtccattttgattatgtgtacacactttgctgaaacggatcgaatgtacgagtccatccaataatcatcctcaacatgagcagatgatggcatcatctgtgtggcaaaaagatctatatttatgatttttcggtcatcattttaaaaaattagcggaattttagggttcgactgtgttgaaaataatgtgcctcctgggaaacattttgtaatttttagcaagattagcacgtaccccgttcacggtagacgccctcccataatttctgtttaacatctatcatgtgccgacttagcttggtgcaaagcatgattgtctgcccgaatgcccgatccgaaaagttttatcatccccgacccgaacccatgcatttttcttatgacttataactagagatcgacctggacctggatgcaggcctggatttatcctggatccaggacatgtccaggacatttttcagcaacctggatttt

SEQ ID NO: 17325 - DNA, 1400 bp, Heterodera glycines
aggtccaggttgaatgtgcaaaagaattcaggtacagatccagacaagacaggaaaaagcctggattttcctggcacaaactattagacatttattttttcaagtgaccgatcctttttcaacttttcaaaaacagaatcaataaatttaaatccacattattattattaattagatattattagatgattctaagcaaataactaaattattcaaacattattaagatgtttaaaatagatataaaaaaatccagtatcaggcctggatccaggtctcgaggagcctggatttttcctgggactggattttcctggattttcgtccaggaaatcaaggtccaggtccaacatggaatccaggtccaggtccaggcttttttcaaaatgtcgatctatacttaaaaccaaacccgaaaattttgctcatccagaccgaatgccgacttttttcccacctcgtcccctgctgttgttgtgccaaatgctgcaaattgcgtagtcgtggtgttggcaacaaatccctgttggttgttgttgttgccaaaatccaccgtcaccgtctcattgctgtgatgccgtggcacaccaaatcccagcggcgcaaccggcggtgatgccattggatttgttgtgccatcgctgccgctgttgtggccatttcttcccatcgctgccaactggcgatgatccgccgccgatggcatgaatccgtcgttgttgccgttgttgtgccgatgcaattccacctcgttggccaacagcgaggcaaggtgttccgtgttgtaattgctttgcgcgtcggcgacggaggcggcggcggcactgtcaaaaggccgcccttcaaccattaatgagcccagctgatgatgattatgatgaaagttctcttaatggataggtaattaggaaataattagtttcattaacatttgagatcgtgaatctcgagacctattctcgatctcaggcctccctcggtatcgagtttccgttctcgacttgcgtcagcccctcccccgctattttcatggcttcaagcgcctcgcccccatttttagtctgagagcatcgctaattacattaattaattaattaccctgctggtcgtcccgcaacacttccatcaggtcgtccatctcctgactgtggcacatggacattgtagcctcgggcgctggtgacctatttgcagtgcaagtgccattgctgctgcatgccgtagtggtggtggcactgtgaggagattgttggtggctaaacattgccggaagcggttgctgatggtgccattgcgcgaaaaaattattgttgttacaagtgccatcatcaacgtattggccgcacatggaatgttgtgcaccaacacagaaaggaggaatggtcaacaggtcgataaat

SEQ ID NO: 17326 - DNA, 2274 bp, Heterodera glycines
tgcgaaccttaaatagcaaaagccatcggtttctttcttttttcagaaatggagaggcgaaattaaacttttgccgtttttaccttcggtcggatgggcggacgcattgagtggttgcgaaaggaggcgaaatcgaagtttttgaacctaaaaaaggaaagaatcagtgcgttcccttggcgaaatgtgccggattaaaaaggcatttctttctgccaattggcgccattcctcaccaaatgtcctgcctgacatcctctatccgagcatagcccaatcgttgcgtgggatcgcgtcggcagaacttgcagatcaaattgcgcgcgttgtcccccatgtaccggggccaagccaacaattggacaccccttagaatggaattgtaccttaaggggggagagggttggttggcaattagttgactaattggtcgggagtcttccccggctgacaatccctgcctacgtgtgcattgggtcggtggacgcaaagggcggactgccggagagaagttcgaacataaaaatgccgagggaccaaaggtccaccgcactgtcctgccccttgttgagaatcacttcgggtgccacatattcctaaacaatttgcgtttggcattcgcttcattggccaaatgtagcaccgctgtgccacagaatgtccatgcccgtgagccctccgtcggcaatttcttggcaaatccgaagtcgaccaatttggggttcccgtcgatgtccagcagcatgttctccggcttcaggtctctgtagatgatcatccgccggtgcaggtaatcaaacgcttccaatgctgcggcacagtaaaagcgcgcggttgcctcgtcgaatcggccccaattccttagcattgtccaaacttcgccgccgggacaatattccatgagcatgtaaagtctctcggagtcgcggaaggttttgtgaagacggacaatgaaatcgcaatgacagctcagcaaaatgctgcgttcgttgagcacatgttcgacctgagggaaaagcgacggaaagtgaaaaaatggacgaaagagaaagtccaaaaggacggaatttgatggaccaatttcggagcatctccccacctggttcatctccttgacatgccgtttgttcaatactttcagcgcgtacacccgttcagtgtcgatgtgtttgaccaaattgacccgtccaaaccccccaactcccaacgtggagacggtcttcaattctgccaactccaaattacccaacatggcggtgtcacgttcatttgcttcagcactaaaatttaatgagtcagtaatcaatcagttgtctctctctctcccctctctctctcggcccctctaaattcgcttctccaatttaggcactttaatcgaccgggtctttaatgcccttggcttagttaattgatcagtccgtgcccaatcgtttgccccccgcaaatccccaaaaagtccgtccgcagttgaacacctccttttccgcatcattccgccgatgaatttgcttagtgtgcgctctttttcccttcttcggtcattcttccggttcttttccttctctaatattttcagcaaccgaaggatgaaaatttgcaagaaatttgggctcgtgggagggcattcccgcgcaacacttacggcaccatcggtgccatttcgttgtgggaaaaggggcggggagaggggacgacccccgccaaagcaaccgaacatttgggcgaaataaaagcacaaagaattattggcacagcaaatggaagcgatttgaaatgctaaacggacaatgacaagaaaagaaaaagggaccgattggaaaatggaaaagttacagaatttgcccattcgtttaatccccccccccccccgcctactctttccaaattcgtttttcctattttcatcctccgattggcctatcgcgcgactgtcttctgctgcagcagcagcagttcaagtatttgctgtgctcatttggcgggaattggtggtcaggacaaaggtaatttgtggggatgggtgggaggggattaagcaattgggacgaacgaacgaataaatgggagtgaaagaagggaaaaggaaagatgaagcggactcgaaaagggggtcaagtcgaggggaacacacaaaggcgcgcggttggcaaacattagcccttttttgtcacaatttttttctctttttttgagtcaaatgcccgacggtccatccatctcaaaatcggttgggggacgaaaaaaatttccttcctatgaattccttttttt

SEQ ID NO: 17327 - DNA, 422 bp, Heterodera glycines
ttagcatatttaactggcttcatccccccccccccctccaatttgctcaccattcgttttccgtcatttgtccgtcttttccttggccttccgccgccccctcatagtttggcctcgtccccatcgcgtcgttcgcattttcgtccgtcaacgaagaactgctgctggactgctgcaggtgcgggtccggatgttcgccctgaaagtggcaccaatttgcgtcatttggcctttgttttgccattccatcggcttctcttctccttcgctttccctccccttcttgcctggtgatgttccagcttcaacgagtggaggaagtgagaatggcacagcgactgggggagtttggccgcgacttgctcagcaagcattgccagcaaaaagcagccctccaccgaatcgacaaaataaggcaatcg

SEQ ID NO: 17328 - DNA, 1061 bp, Heterodera glycines
tttgcatttgcatgtcaaattgtgcaatcaatttgtcgattggtgttcgaaaaagctccgaaaaaatcttctgtgtcatttgggcgaccgttgggttacaacgttcagaagttgcaaaagcagcggaattcatttgatgctgctcattgtccgtcaccatgaagaattggtactttttgacgacacaacgctctttcgaattatcagtccaatggatttccaatgaggcaaaacatttttttttgtccaatgtctgattcgtcgttgcgacgactttggtcctgaaacgtttagtttaattagaaactggaacaattggccactgaattacctgctgctgaacattccgcacgccaaaattgtctccagtttgttttgcagaaacaattggacacaaatcaattccaagttcagtgacgggggcgcaacgggttgcaaagaatgcactaaaactaattattgtcagcataaaccaaatggggtaatttcgactttttgttcgagtttgggttcaggatccgaaagaatcgttttcccgaccctaaaaaccccaaaccagtttacccgtataaatttttttgaagtctggtgacagataaataccccattttttcttaccattgtccgacagagtgccgtcgtcatgcgttgagtcctcccgctgattctgctgtccctcccattccatcattggttcgtcactgtttcctccgtcagccaattcgaatcgcacggcttcggcataactttttgtcttcttcgccgatggattgtcaaattgtgccgaattctgttgacccttttgagagaacaaaccaatatttatttgtctctcagcaatggatggatggttaaacatacaaattgcatatggtccactggtgagagaacatcggccactccaatggcttctaaaattgtagcaatgtttttggttcggtaaatcaaaattcggaatatgtgccaaccgaattcgtccggttcatcgctttcgaaactgccgttgacactttgcattcgtgacaaagtcaattgctgattctccgcctcggcattttcaa

SEQ ID NO: 17329 - DNA, 786 bp, Heterodera glycines
tgagtaccctatttctttggtcatacctaaagcctatagaattttttgtagccctaagttttctcgttttttcattataatcggtagttactcttttcttgtatttatgaattccagggacttgaagctgttatttgatactcagaatgtaaacataaagcattaagaaaaaaagaaactaaatattctacactacaaatccattgggcgccaaaagtgcattagaatgggtttcttattgtttaatattttttaaaaaaaacgaactatttatttgttttccactttccgttccataaattatttttcaatcttaataattacataccttaaacattagcaattcggggatgaatccattggcgtcaaaatgcctctttggaaggccgaaaaaaggatcgccgacggggctctcatcacaattgtttggtacacaaaaacatcctgacaattaattaaggttaattattgtgttataaattaatgataattaatgtaaaccttataaaccaatgctcagcaaatccggcgccccccgcgccaaaaaacattggcaaagttgcgctttttatgcgcttaaattttttccaaaaattatggttaataccttgaaaatataaataaaataaacaatttataattgatataatggacttgaaaaataaaataataaatttacaaaatttattaatcataggattgatattttttagctgggcaaaacaaacacatttatttttaatggctaccgatttttctctatttctctaacgcaattcctttcat

SEQ ID NO: 17330 - DNA, 1227 bp, Heterodera glycines
  misc_feature (12)..(12): n is a, c, g, or t
gatttgtttttnttgtctttcggctgattcactcatcaaaaacattttctgtggagagtttgtgcaacaattctttgactacaattgaaccaccgccgattatatcattctgaatttaaacaataaacataattttaagaggtaaattgatggggagggtaaaatttaacaaaatatttttcaatcggaccccaagaaagtgtaaaaactaaagacaacaaatgttttgacatccccaatatccgtaattttcgccgctgacctctcatcaaaatttttcaaatttttttaaagatagaaagtggagtcaataacctaacaaatgtttcaacttaaaactagccttttcttacctttccgtacggcggatagattttgatgccgctgctctgcagagaaattaccgtcgatggcatttgtccctcagtctgtccattgtcaatattttgtactaaaacatgtggcttttcgctgaatttgatgccatatttgtttagtgcatcaatcagacaaaggcgcctcgaaagtgcgaattcgtcaaagattctcacagtttcggacagggttctgtaatgaaaccaagaccatgaattctgttcgtcttattcgctcgcctttttccatggctttcgattgtcgcttcgtcccccgactcaattccgtccgccttctcgcgcagttcggcattactcttcgtcccttcctccaattgtccatccttttttaccgtcccaattgtcccttcattaattgtaaccaatttggcagagtgaacagaactgccgggaatcagaatgaatcgttggctgcatttcccctgatccgatgttttattttgctgacgcttctcaaccaaaactattgagccgctctccgggtctgtcgttagtaaattgccggaaataattgtttttctgctccctgtcccaagttcaactctgattggctttccaatgcttgacgaagcaaccccaaaaacgtcggtttgatcggccatatctgattgtgaacgaaataaatgtttatgcataatgaccaaaatataaagaaataaaaatttcctacgcatgttggggatttaataaaagtgcaaaatctgtatttaaatatttacaaaatattaaaatcaaacaatatgtaaattaatgaaaaaacatttttatttacaaccagggttcgcagatgaaattttcaaaagcctcattttgggtcaaaaagcctcatttt

SEQ ID NO: 17331 - DNA, 1982 bp, Heterodera glycines
ctaattctcactacaacaatttgcaaaattttgctggtaagtttcaacaaaatacgcgttttccttttcatgaaataatttataaggctaatacatgtgaatcataggtaaaaaaagtctgatatataaattttttatttagatatcataaacatttattttttatgtcttttcagtatattttttagaataaataaatcttaattaaatctcaattattttttattgaaattagtatatacagaaagagaaaagcttgctttatctaaaattatcattttggttattttaaaattattggattaatttttataagcggctaaagatggtggttacttctgcaaccatgccctctcgcgcggtagctttttcaaccatggtcatagggttaaataaccatggtcgtctcttattctacgggttaaagttggtggctaaataaccacaaagttcatggttaaataaccatgaggtcatggttgcaaaccacgagctcttattctaccattttttactacaaggtcatggtcatttaaccactaccactctcttattctacgggccccggagaccaaaaatccctgtcccgtccatgcaaaattcccgtcgtatataattcatcgcttttggttcctctccaattttcgctttccaatttctctgcgcgaacgttcattttcctcctgcaattgtttaataagctgcaaatcctcttcagaaggattgtaaatccgatcgattatgatgcgatctttgaacatttttgcgagcagcaaataattggcaaacataagaaggaccaaagtgacaatttgttgccaatcgtttgtcaacaaaagaagccaaaattcgaaggcaattaaagcacattggaagacacaagtgtaagaagctaatgccacagggttcttcgcaattttcttaaattgagaatatttttatgggagggagtttttgaaattgaatgaaattattaaaaaatggccaaaatttatgatcagaatgccgaagaatttctagcaatataaaaaataaaaaactaaattttttacgtattaaaataaacatgatgtgcgagtattctttaaagtgattccaaacattgtagaccatttcttacaattagtctgttttgtgttggaaaatttaaacatttttgtgagtcaacggttggccctatcgtatttttacggtttcccattcctttacttacaaaaagtcgaaaatgcaatttgttgtccggttcagcagaaacagtgtgataatgggcatgacttctcgcgatatacaaattgcccttgaaaagcagtcgcgtcccgtcttgataaggcacagacgcactgacaataaaccgcacgatttttaacaaataaaaaatcatttggcaaaacacttacgactcactgaaagactcgtaagtttcattttgctgttgttgttcgttttgttgccgaatgccaaatcgctgctgttgggacggaatggcattgttttgttgtgagatcggctcaattaattcccaatggccaagatgaacagcacaacgatagagcaagtcgaagtagttgatggggaacaaataagtggaatacagcgaaaaggaagtcagggcgacgatgctgaacagttggaccacccaaacattgtcaatcagcatgaattgaggcacaccaatcaccgttctatgctaaatttaaaaaaaaatcagaaataagcaaaatttacggatttaccggcaaaaaaattcgcggcattaaaacggcaaagtaagctgttctaaaccaaatattaaatattgaatcaaaaggaacacttacaataagccagtgtatgcacaatatgcgcagcgaagttcgaagtcacgcaataacacaaccgcttcttctcgaatttgcacttacaattaacgaaaaataaaaacaggaaaaaagcggtcacccccagcgaaccgggggttgtttttacacaatggacaaggaatc

SEQ ID NO: 17332 - DNA, 2269 bp, Heterodera glycines
aaaaagtcactaaaaaatgaaaaaaagtcctgaaaaaatagccaaaaaagtcacaaaaattccaaaaaaaaaaacacgtaaaaatgtaaaagtcctgaaaaattaggcgaaagttaaaaaaagcccattttaattatagaataacatttttatcgtatttttaggcacttaattttataaataggtcctaaaataggcataaaaaagagattcttccaacaattaagaaaaaattctccaggtttcattgcctttttatcgatcgaaattttatttttctaaattttctttgtatttttcggcattttcttcgctaaaattcaaattttgcctcaaaaagtcaaaaaaatcacgaaaaaagtcgcaaaaaagtgcatgttagacgcttcaaacaaagtttagaacactttttaagtcattttaaggccatttagagtcagcaaaaaaagtcatttgacttaaattcccagccctattgatgaccagtctctaattttggaacagattcaattatggtacggttttaagatgagcaatttgggatttgaaaaaatgaaacaaagcaaaagaattgaataagtgtcgtcagcagagggaataatcactgatccgtagtgagctgatcagcagctgccaatggttgggcctcagttgggtcgccctctgtcggagggtcggcgatcaaattcagtgagtcattgggacagctccgatttgtcattttgttggcaatgaaaacgccgacgaacgtgaccagaaagacgaccccggcacagacaaaaacaatgccaacgacgaatgtgccccaaagtgccgtgacaggtctcgagatttgggcacgagtggccgagtcgatcagggcactttcgttgagccaaaccatggggacgaccaaattgctcatatttttggtcatccttgaagtaaatgaattggcaatttatccaaataataaacttatacctttttaatcattcattattaattattaaatttcaaatattcaatgcttttttgcccctcaaattgcctgaaattccctcgttgcattcccaaattgagctgatagcgctgctgcactccgaccactgccccaacaatcggttcaatgtcaaaaaagctgagatcatccgaatctgttggggacgagaaatttcccgcgagggaatggcgaagggccgcgtgggcatttcgaaaatgggaggccgaaaagaaaatggggggagagccggggaaacaggaggacatgtcgagaagaccggacggagcacagccaactgaaagggaaatggaaaatgcaccatggaagagcccatctcagaacgcatttacccggttggacgctctcgttgaagaaaagcggggaattcgggttgcaaaagccttgcgaccgctgcacagcgatgtccaacgccgagtcgggttgggcgtatcggaagacggggagaccggcggtgagagcgggctgacgaacttccaaatcgaaggaactataaaaaggcattaatatgtgtgaatttgaatgagttaaactgtgcgactcaccggcaaagttggccaatgaatctgaaatgcgaaagccagtctcaaattaccgccaaatcggcctttttacatttgcaatttcggcgcatccatcaaattcggtccaaacagttccgcgtccgtcccgttgatcatccgcgccctttcgccgtaccaatggtcgtcgctcagttttccctctatccctttgaaggagtacacgcggtccaaaaaatcggggtcgttcagtccagtgtccaccgcatattggccatcgtccgtgttattttgctgaacgaaagtaaatctaatgagtagaaataccatccaaaaacacgcacttacttagtggatttatggtccagaaaatcgccaaatttagttttaaacaaaagtttttacactaaaataagtacttttcaagaaaagaaaggtttttttcagtgccagaaaagcctggccaattcatactgatagtaaaaaaaataccccgtaaaagaggccaattctgtccggaatattcgccaatttgcacatcattttgaataaaacattgctgcaaatttcactgatcagcgggtcctggtaaccgttgaagaggagctcatcaaccgaaacggagatgaacacctaaacatgggatgcaaaatgcaaatcaaaagttttcccaaaatgctgacaagcatttctgttttttgatttgactgtggtgtatgttaaaaaattaataagtttactatttcca

SEQ ID NO: 17333 - DNA, 3461 bp, Heterodera glycines
cagcattcatctcttctccattggctgtttattgcatgatgagcactactcatcccttgcccgccttatgatcagaaagataaaatgaggaggaaaaagtggcggtccaaactgaacatccccgaggcgatgttgttgatcagtggtcaacatttgcaggtcgtcggcgcggcggtggaaagcggcggtggtggtagtacgtcttcagcggtcggggtgaaacggcgtcaaacttcgacgacaaagcatcgattgagggaaggcgacgctttcccaaaagcggaggattcggcggacacaccgccgtcgttgtcgcaggtcgccagcagttcgggtgacagttcgtccggcgtttcgtccagcgcgtccatccaatatttgggcactcgccgtccgacggccattaaagtgcgtttttgtgtcgaaaaagcgatggaaaatgagaaatgccaaatttgcttcacagattgaagaagaagactcgctgaccagcgcgccctcctcctcttcgtccacgtcagcgcgagcactcgctgcgcatattggcaatccgtcaaacggccgggcacagcgaacggtagcagcaccatcccatccaaagaagcagcagcaccaaacggaggacaaagggcacggcgagacgcacaaaccgcagcaaacgcatcagcggaaggacaaccaacgagacaagggacagggcattggtggaaaattggtcagtcatcagcggcgagtgggacaattttaagggcaaaaaagtaaaagacgaaggggaaaatggaaaggaaggcatagacattttagttaaattttcaaccattttaattgaaagagtggggcaaagggaagattggaagggatttgtttacaaaaccaccaccaaaacgaaaagctgggaactttttttcacaatttaccagtgataaaaccccagtcgaacttgatgaattggctaattttgacgacaatttcgggccgcaaatgtcaaaacaacattcgagaagttgtttgaataaaaatataatttaaactatttttttcacacgacgcattgtcacgtggcatttatcaaaaatttgttaatcacacttttacccactaataaatcacacaaacgtgtgatgtgtgcctctctacaaagtgcaaatgttgtacatctctgctcgtccctctctccacccccctccccctctctctctttctctctctccccctccccccccccctctctctctctctcctatcccctctctctctctctgtctctctctctcccccctctctgtctctgtttccatttttcgaattgaactttaatggggacggatgggaaatcttgtgcgttaacgatgcgtgatgacatacatatatattgacagggttgaaaattcattttcttttctttggtttacccggtctctccggcagaacgacggattccttccccactccctccccccgtcggtttactgctcgaacaaaaataaataagccatcatgggacggtcccacggggagggtgaggatggggaagtatattttacgcttggtagccccctcccccccccccccccccaagggggcattacaataaaccccaaagtcgaccctaaatgttttcccattttggtccttccatgtctccccgtccctaccgccgtcgtttcctgtttgatatccttattagcatttccaattgcagttgttcgtggacccgtccacctcgcatcacccgtccaaggcatccgtcgtccagcagccgttgcgcgacatcgaaatcgcggcagccgcggggaacggaatgttcggtggcgcaattttggggtttgtactttttgctattcaagcgaaatgttttttggcacgatattgcggcgcgtatacaacgccattttgaattttatattggcattctgttcctttcgaaattgtactccttgaccaatttacacattttaaatccaccaaattttagcggtggtttttctgtcgctggcaattcgtcgtcgtccgccgccgccgctctgtatcaacaacagcagcagcaacatttgtcgggccatggcttgggtgccgtcgcatcaaacggcggcggtgcttttctaatgaaaaatggcaccggttgcggtggtaatcttcgtgccgcggcacaccaccaccacaacaacacgaacagccatcacaatttcgtgcaaccgacgacgacggcactgctcaaaccgatgggcgggggaactcaaattggacaaacgcagcagccggggcagtcgaagcagcaccagtcgggccatcacaagtcacgacagagcacggagggcgagtatcaggtgggcagggattggggacgaattggatttcccggggacaatgggacagagcgggagacaaatccgagtgggacggaaattcccccaaatttagactaattagtgccaaaatggaccaattcatggctaattattgtgatcggattaattttgctgtttttagctgatcaaaaacgaagtgctctcctcttcgtacggcaatcagtacgaagtgttggaattcctcggcaaaggcacttttggccaagtggtcaaagcatggaaaaagggcaccaacgaaatcgtggccatcaaaattctgaagaagcacccgagctatgcacgccaaggccaaatcgaagtgagttctgttgcactttgtttctggcattttttgcatttatttattttttctttcggtgtccattttgtcccgtctgagcaacgaaaatgcggaggagttcaactttgtgcgtgcctacgagtgcttccagcataagtcgcacacttgtcttgtgttcgaaatgctcgagcagaatttggttggttttttgctttgccaatgggcagccggacgaatttcattaaaaaggcaccaataccttcaaaaatgacaaatttacttaaatattttggttggtacctggtgattaatttcgattttcgctatattttaaattctaaatttgccatatttttgaaacaatttgtcggcatggcaaccacaaactgaataattgaaacattttttgatagcgctttatcgggacccaattcccgacgcttttcacctgctgatgatcttttgcttgattaatgcctcctttcccaaaattcagtacgacttcctcaagcagaacaagttcacgccgctccctttgtcgtccattcgtccgattgttcagcaagtgctcaccgctctgcttaaactgaaacagttggagctgatccatgccgacctcaagccgggtgactaatgtcaaaaaagcagcaacaaaatgttgtttttattcattgactttgttttcaacagaaaacattatgctggtggaccccgtcagtcagcccttccgtgtcaaagtcatcgacttcggctcggcttcgcatcgcagcaaagcggtcaccaacacgtatttgcagtcgcgctactaccgg

SEQ ID NO: 17334 - DNA, 4089 bp, Heterodera glycines
cttagttgtgtttgtaccaaagaatggagcccaatagtcagtgaggaacaagttaaaattagtcaactcatccacgacaattccaaatggctttgtgcgctggccagaacgaggtccgcgaaaaagtgttgcaagctgatacggaaagcgaacgctgatcaactgctagcgctggtggaaatttgtttgaacattgtcgcatctcgatttcgcttgaacaaacgtcagaagaacaggctgatgccctacgcagattttgttcgctgcctgagcagagtgagaagtgaacgaggcgcgagacgtatgattgttcagaagggagcaggggttggcggactgttcgctgcactcctaacacccgtgttaattgaagttgcaaaatcatttgtgagcaaaaatgtataaataccgtaaaaaaattgttgttatttcacactcgttgtttcataaaatggcaaataaatttgtgcttgtaccacaagaaatttaccggggtctcacctctgcgacggacacgggtgacatcaatttggatgctgtacgacacgatttgacgcgtgccagggctgaacgaacaaacccttcagctaaaaatgtcagctacaatcaacagcttaggcgatacttgcaaatgagacgggaggtcgcggacaaaccagcacgggttgagctagtcaagggattgagtgttctgatgaggcgaggcggtgcggatgatgaagcagaagttgtagatacaccaccccgccctcctcgtcctcctcctccaccaccgcttcctggtcagcatcctcctcgtcgtccaccaagccctccaggcccaggtccgtccccgccggggagtcctccgccgcgtccacagcgtcctccgagaccacctagagctgctgcgccgccctcttggagagatgggcgtgtggaggaatggcgaaaaaagagaaacgacatacaacaacggcagccggttgtgcgggaccttcttgctgaagcagctgctgctccgctacccgaaagtgacgaagaggatgactacatgttggagagcgattcactctgccagcaccatcacaatattatggcgacttgcccgttctgcctgacaacgcggacgcaattgaggagatggacactgcacagcacaggattgcaaccagaagaaagttacataatggcgatgacgatttgcatcgcaaaaaataccgggtctattatcctcctcccccttctcgcccacccccgtctcgtccacagtcaaaaattgaaacacctcgacctccaccgcgtcctagcctcaagaaacaaccacaaccactgctcgatcctcggccatccacatcacaacaagttgatcgcaaacctaaaagggagccaaagttcgatctggatccgcgaccatccacatcacggcaagccgggtacaacccccctgcggaaccaaaacatgagcagaaaccgtcaaaaaagccacctcctcgcgccacaccctatcatattccgaaaagagagccaaaaattgaagaaacagtgccacggcaccagcaaccttctcctgctgccccacaagtgccgcctgttccgccgcctaggagagggaccaaacgtcgccaccccccggaaaatggtgatgagagtggtgagctgcgcatacgtaaacgagtgaggcaagcgcgaagagtacgagtgtattactcaccagagccgggtccatcaacatcagcacaaagcgatgaacaacaacaacaacaacaacgtgaactgtttgccattccgtcaaatcagctgaccatggcacagagaattgagctaatatacatcaaatgcaaccgttatgccaatcgtatgggtgtccggggaaacgcaattatcaacactcaaaatgctcaaccattggtgcgaagcaatttacgaacggccatcaggtatataattgacagaagagcgggtcgacctaccattagaccaccgggagcggaccaattggaggagcggcttaggcaggacccaattttgtattcattgacggctccaccaaagagaccatcgcagagcacaaacagcagaacgtcaataaagaaggaatttcagccgaaaaaatggaaatgatcaacaccactcttgacaagctgtacaacgatccatcctctcctgctgcgtttgccggtgttagtgcactgtggaaggaggcgcggaaaaagttaaaacaactacggaaaaaggatgtacaacactatttggagggacaccgcacgtacaccctgatgcgccccaggcgggtacgatttccgagagcaaaaactgtagctgctggcttcatgaccgacgtccaagtggatttggctgactttcaagcgctttctcgtcacaatcgcggtcaccgatacctgctggttgcggttgatgttctctcaaaacgcctgtttgtcgttccactcaaaaataagaaggccgaggagatgctggatgcattcaaagagcttgtcaagcaaatgccaatggtcccacaccgcattttctccgacaaaggcaccgaattcaaaaacaaattgctgaaggaattctttgaggagcaggagattgagaaacatgagcccgtgcattcgtcagtgaaagcgtcagttgctgagcgcgccatccgaaatgtgaaacagcgactgtacagatactttgccgaaagggagacgctgaattgggttgatgttgtacaacaaatagtggatggaattaacagcactccgtcacgggttcacggaatgcgaccaattgatgtcaattttgaaaatgctcagaaggtgtggaagcgaatttatgaatcaccgcaaaaacgcaagaagccacgtttccgtaaagatgaatttgtgcgcatgagcagagagaagggacagttcgagaaggggtatttgccaaactatggagacgaaatcttggaaattgacgaggtgctgaaggcggtgcgccccgtcagatacaagctccgggatgatcgtggtgaaaaattccggggcaccttctatgaccaggagttggcccgcgtgagaaaagatgccgacaccagttacagaattgaaaaagtgtacagaaagcgaagaaaaccggatggaaccacagagatgctcgtaaagttcattgggtatcccgaacgagaatggattgacgagtctcagattgtataaaagcgtttgaatttttgtgtatttctcatcagttgaataaatccataatgtcaaatagtttctttgtgtttttgcctagcaatgtgacggattatccggacaatcagccaaacaaattccgggtccggcttccaaaacctttgcatttcatcgggtcttgggtgcgtgggctgcacagcattagtcaaacgccgcatcgtacgcgtgccggtcccaaggtcttcacagaatcgagttgaacagctgagagactttttgacgacaacgctgagaaaccatgccaatgctaaactaaagccactcccgcgagaggaagaagcggaccgtaacaggacaaaaccactttactctccgccacctgcaaagcgtgcccggagatctctagcgctctcttcgcctcccagacatgaagaagctcctgcacgatcacttgaatcgcctcccagatatgaaaaagcgcctgcaaaaccacttgattcacctcccagatatgaaaaagcgcctgcaaagccacttgattcgcctcctaggcatgaacaagtgcctaagaagccacttgattcgcctccattgtatgacgaatcaaagctgcaaaaaccacaaaagtcacctgaaaaaccaacaacatccactccaactaaaccatctacaccacctgcaagtactcctcctcctctaccaaaaccagcaaccccagcagctgtttctaaaccgtctcaaccaattgctcctgcaacacctactgctaaatcagtagcaacacccactccagctaaaacggtttttcctcctccagctaaaacgccttctcctccttctcctcctccagctaaaacgcctaaggctcctccagctaaaaccgcttctcctccagctcaaaggagtctcctcctcctccggctaaaacggcttctcctcc

SEQ ID NO: 17335 - DNA, 523 bp, Heterodera glycines
  misc_feature (444)..(444): n is a, c, g, or t
  misc_feature (447)..(447): n is a, c, g, or t
  misc_feature (470)..(470): n is a, c, g, or t
ccgtcctgaggccgcgaagcggccgaatgttctcaaaaaatttaaaaaacgggcgcgaagcgcccgtcatgaggccgcgaagcggtcgaatgtcccacaaaaattaaaaaacgggcgcgaagcgcccgtcctgaggccgcgaagcggccgaatgtcccccaaaaaattaaaaaacgggcgcgaagcgcccgtcctgaggccgcgaagcggccgaatgtcccccaaaaaaataaaaaacgggcgcgaagcgcccgtcctgaggccgcgaagcggccgaatgtcccccaaaaaattaaaaaacgggcgcgaagcgcccgtcctgaggccgcgaagcggccgaatgtcccccaaaaaattaaaaaacgggcgcgaagcgcccgccctgaggccgcgaagcggccgaatgtcacccaaaaaattaaaaaacgggcgcgaagcgcccgnccnaaggccacgaagcggccgaaggngcgcaacaaaaataaaaaacgggcgcgaagcgcccgaccgaaggccacgaagc

SEQ ID NO: 17336 - DNA, 2091 bp, Heterodera glycines
ttatgtcgactaaaaacgaatgatcccacatttacatattttatatggaaagcaattaaaattcgagagctttttatgaagacagaaaaagatatattaaattattgctaaatttttttgtcatatgattagagggggcgggggggggggaggatgattaagcgaaaaaagaatgggaaatatgggccacgagaaatgactgaataatgagaatgaatgaattgatatatttttggacgcatgcaacaagtccaagaaacacactgcgaagaaagggacatttgcctctgcttacaaattaaaaagtcaaataatattcaaatatttatgtaagccctgacaaatgaggcttaagctgtctggtagagatcgacctggacctggatccaggcctggatccaaactttttcagtctttggtgttttgttagtaaagccatttgaaatgacgtttgatagcgcttggcatcttttctgttcattattttgttaggtgagcaaagagcagagtcatttcaaaacaaaacaaataaattggcaaagcaaaagtatttccaatggacgagaatcagaaatgatctgatttttatagacgaaaagtctcaatagaaaaagcatgagattctcaaaaccatggaaaggtgggcaaacgaaaaactcacaattgtacataatatgtatgtgccttttcaatttaattgaattgtgggcgaatgttggttcagattttaaattaatatagcctaattggggaaaagcactcagtaaactcaattttcgagaggtgttaaagcatcacatccttagcgacattaggcacaactgaacaaacaacaaaatccgatgaactttcagcgatgttgcctttgcttatttaaaaatcgcgaggacataaaaaattttacgtacctatttcgtgttgattagttggaaaaatttgtttgttaggtgattatatgttatccaaatgaggtaatagaagttagcaattgcccttgacatcattttccggtggtgggaaggaaatgggctaagagtcaccgcggaattttcatttattattttaatgatgtcaaaaatttaactttccattaaaaatttaatgattggttagggggttttgttttctattttcatttgtttgttctgtgagggatggaaaagcagccaattttagttggttttttgtaaacattttgcgcctcaggctaatctttaatcccaagaaatgtatcgagatttagggcaaagaaaaatcctaaattgacattgataaattcaccaaaattctgtgtaaaaaaggcgacttcactaagtcatttaaaatttcgagagcgaacttcgccaatccgtcatatttccccaattttctcactttattagcaccatttttttcacccgatgaattgagccaattttggaccaaatcatttaaaggcgaatttacgtcaataaaagatttttagaaaaaaaaatcgagaatatgaattaagaaatggccataaatggcatagaaatgcatgaattttttttattattctccccgttcattaagcatagaaaatggaagaaaatatcacacacgccaaagggaggaaggaaatggtggagaaagcggacggaatgggagaaaaagaacaaaacacgtcattgccgggagagggcggaggagaagcacacacacacaagcgacaatgatatttattcaagctgagaagtggcataaaattgcaatgaatgtgaaccacggcaatggttaaatgggggacaaatcgacgggggaagggaatttaaaattcgaattttgaaaatttggttaagagcaaaaagaaaagagataatggattaatgatactaattgggaaggaaaaaattaaatcagggcaacaaaaagccaattgattattgacactttttatgatcgacggaaataattaggggacacgggaggattaacgagaaaacaaaatgtgagcaaatattaacaacaataaaaattttataatgaaatctgggagcaaaacattcattttcacttgaaatcattcatcatgggacccctcctcccctccccccccccctcggcgtatca

SEQ ID NO: 17337 - DNA, 4870 bp, Heterodera glycines
gacaagggaacattccgaactgtgactgctcaaatcactttaataatgtaaaaaagtattttggtaaaaatgttaggtccaaccgaaatgtgaataataattgaattataaatgtcaaatcaattaatcaaaattatgcaggaaattagaaccgatttaatttgatgaaatgaaaacattacaaaagaacagcaataaaatggcaaaagaagctatatgaattgatcaaagaactgatcattttaatttcttcagcagagaacggagcgatcgaatttgaaattgggcccaaaatttgccacaattttgtcctcaaaactaagaagtgtagcaaatggaaacaaatgatcaaagtcaactgaacagtccaagtccaaagtgtgcgtgaatcctttaaaattttcattgctgttgaattaatttattatttccaacccaatcgttgtccatttttcgtaaaaaatatttgatgagtgccaaagtcaacgccaatgccaaccacatcgtcacgggaaaatttggcagtttcacctttcctcgagccattggcccaaaattcaccgcaatttgaaaatacgtaagtgccagtgtagtcctgaattttctcattcaatggcatcagctgtttgacggaaaagccgaagagaatggtcctgaaagtgccaaattaaaaataataaaaaaaacctttgccttattaattaaatatttattatttttattaatttaaattacgttaccatcgcattcttatgatcaaaatttcaaagtaaaaaatgttgtgaaagtcagtggtggtggcgtatggaagcggatgtttggcgaacacagaacgaaagactgaagaaaattaaatttccaaataaatgccataacaaaataaataccgtattccctttaatatagcccccccccccctgaattaaagcccccccagcaaaagaaaacatttcccataacgagttcaaacccaaagtgctaggtattttatctgttattttgtcttatacgtactccttcggtctccttcccattcttgaattgccgccgtcaatttttgggcatcagtgacttcaatttcgtagtgacaagcattcgcatcccaacaatttggctgctttacatttgaaaatttctaaatttgtaagtttcatttttaatttaaaagtaataaatagcgaaattaacgaattttttgtcatctttttcgtcagttcttccctctcccatttattcacctccttttgccgattctccaattcactgatccgttccaaaattgcctttcgatcattgtgcaagtgtgctgtgaattgatcatcagaagcttgaattaggaagcaaaaaattttataaatattaaaaaaaatatgattaatttttaaaagtaaagcctaattattataatttcaagtaatcaactttcttaccgtaattttccttttccattttttccaccttttcatgcaacaaccaaaattgctccatcatctgcttctgttgatctaactctgcttgaagtgcctactgaaaagcaaattataaatatttatgcaaaaagtaaataaataatttaatacaataagaaatttgtatgtataaatacttgcctcttcaattctgaggtcctccattatgcacaattgttccgtttcccgcaattccatttccatcctggcaagcttttgactaatttcctataattagaataatcacaattgttttttattaaatgtctttttattgtttctgttcatatttagacaaccttcatcagttgttgatcactggttgattctgaattgtccaatttttgaccaaaaataatcgaagaatcacaacaatacacttctgaaattttgaatgaaattcattagggaataaaagaatttaagcatttcaaaaccggaattttatttcaaaattatgttccaaagtgcaaaagctacaaaaattgtcgaaatttttgaagaaattaaaaaaaaatctgcatattccattctgaaatacataaggcctatattccggtattcggcaatttttgaaggcctgcggatatatatatatatatgccttgttttcgaacccaacaaatgaccatatgtcaatttaagatatttgaccaaaattcggcagctattttttatattagacagaattgaaatttaaaataaattcccttcttttcaattttttaatggaatattttttttatatatttcatcttttatttatccatttcaatgccaattcttttcttaccttcatctgcttctgttgacaaattggtaaaagttagcatttgttttttcaaataaaaagatccttgtgaaaattaaattatttctgatgcatttagtattaatgttttgattaatgctgatttatttgcaaaagaattcattgggtcaacgcaaataaaaaaatgtacggcaaaatgatgacccaaaaagggagagaagaacagaagggcaaataaataaggaaataacattgaagatatttgaatgattcttttacgacggggcaaaaaccaattaatgttaaggaaattttaaaattcaccataattgatgggaaattttaatttagcgaaaagactaccgaattaaaatatatccaatggagatcgggcgatagcactacaacccactacaacaattagttgtatggtggcaataaaaaatcttctaattgtctttttaaaaacattattaaataacgatgcaaattttaggtaggaaaatcgtaaatcatttactaaataggcacaagaaaacaatttataaaacattttttcaaaatatcccatttgtatgaagcgtaaacaagagaattattttgattctatcatttttggtgtgaattagacctgtattaattgaacaactctttctgaccgtcaaattttataaaagtaaggtctccagggtcggtcgggagttttgggaatgagtccgagtgccgagataaaaatgctaaagggataaaaaatggaaaaaaaatattttcttttacatatataatttttgaagaattcgaccaaaataattattaaaaagcgcactacctccacagagtttaaaagttttttcgacagagaaatgtcaatgtgcaaattactcatttattaaaatttcgcgaaaaatatacatgttcaaaggctaattctcattttgcgcggggaccgaagcaatttcgcaaaattaaagaaaatttttgaaaaacaaaagataagaaatttgcaaaaatgaattttttttcaaagttagattggaatttatcaaagaaaaaatattaatgatttttttgtctgtgttatggtttttttaaagcatccaaaaaaactgaataaaaagaacaatttctattaaaaaaaattactgcaagctttcaaaaaagaatttttggtcttttataaatttatttgatattccattatcgtgtgaattatttttattttattactttttaaattaaataggtacaataatataagtaaacagctgtgaaaaagagttagcccgttttgtggcattcattcgacattaatgagaccatccaagccgtgccaccacttctgaacatcgtgcgtccaatttggccgtcgcgaagggatccgcacgagtcgcgccgatattcacttgattaattgaattaaatggctctattgcagtttacacgatcataaaaataaacatgaccacaaaatagaatgacaactttaacgcttcaaaacttcttctagaagcatccaaattaaacattcttagtatcattcgatagctctgaaagaagaagctggctgggcggttaaaacgtggaaagcgggcttgataatccataaaagaaagggcggatgtgcctcggtagctcaatggtagagcttgcccatggaaagggtgcacgagtgggttcgattcccatccgaggcctaacatttgcccaattcttattattctaagagttttcttttaatctaagtgattgaaaaaaaagattcaaatgaaacttttgaaaatttattggctaatagcgaactcttagagctatcggatgatcattaatttagatgcctctgttggaaaaagttatgaagcgttaaagttgtctgttactttatgtcgtggatcattaaattttctatgataatgcaaagtgcaacagagccaattaatcatcctaattatgtgttaatgagttattaattataaattggcaattggcaccaatgagaatgggaaggtcgagcatttgtgcttggactgcgaaacgaaagccggacatcacagtgagtgaggagccgagcacaagcagaccggaacactcgttgatctgaataaagacgaaaattaattattggcgaaaaactcgatgaaacaaataaaaattcccctcattaaagaaactaaaattttacgataaaatttgacgaaatttaatcaaaaaaaatacggaattttactaaacaaaatccacaaagttaggtatataatttttgtccggagccgtaatccagaattttttaaaaagtataaatttttggtacccattagtttcactccagaaattttttttgaaaaattgaaattttcaatctttcttataattatatagaggttttttctaataaaaatagtcagaaaaaaacatgaaaaaaaatctcatttttcgaagcttcaaaaattatgaaaaaaattctacaaaaatcactaaaaagttgtttctgtcacatcgccaaacccaccttagcactgcagtgcttaaccgactcggccgacacagtgtcgccgaagaacacgacgtccgtcttcagcacggagccgggtcacagcgaggacagtgcggacaacgaaagagtgcaggtact

SEQ ID NO: 17338 - DNA, 3965 bp, Heterodera glycines
  misc_feature (3206)..(3206): n is a, c, g, or t
aacaacaatcacctcggcttttgttgaaaaatttctatgttccttgggcttgccgaagatagtagttaccgactgtggtacccaatttatgagctcaacattcaaatcattggcaaaaacttggggattcgaacatcaaaccacagtgccctaccatcaatcggccaacggacaagtggacgatataaccgtaccattgtggatatgtttgtcacaagtacggaaggaaaaaattgggcggctgcgttaccattaatttgcttcgcttacaattcttcaattaactaccaaatcggcaattctcctttttatgtaatgcatggcttcgaccctagactcccaagtgaagtgacactcggaaaggtggaggataatttttcggatatggcaatatatgtgcaggagttgacaaaacgaatggaagaagttaagacaacagtaaaagaaaatctgaggaaatgtgccgatcaaatgataaaacaacaaaaatggacaaaagagatcccatggagggaaggaatgctggtactgaagcggaaaattgacaaaagaaataaactggaacaaaattacgatggcccttttcgaatagttactgtagagaagccaaatttgacactcaaagagatgcatgcagacgctatggggtttacggtacacatggaccagtgcaaccgtatttttcaaaagaagaacaaattctggtaccaaacgaagagccaaatttgggatccaaaagaaaaatcggggacaaaaacttggaagatacagacggagaggaagagaccgaaataaatgcaataagcatggaaatgcttaccgaatttgatgatggaaataatttgaacaagcacggattattatttttgatggaaataattttggatggtattgtcatcaccgccctatacccgaaagactcttttgaattttcatcaatcccaaaatctatggttcaatcccagtgggaaatacacaagaccagagaaggagatgaatatttaaccgcttggatttttgacgaaaacattcaacttttcataactgaggaaagggaagacttaattattgggaacgaaattcaagcgtggttaaatcaaaacggaaatgtaatttgcgaaaatagagaagcaacctactgggagacttatttggacatggacggactcatttataaaaataaaatcacccccgaattttggataacctataatgagcccgaaatgtgtaaagaatacgaatctcgatcatgctcctcttcaacgatttttttgaatgccgaagaatgttcaaattcaaatttacaggacaaaaaaatcaatatcctacccctgtctctaataatggctaatgctgactcaccaatactaatttctgatgaggaactaagcgacgacgaaatacatttgagaaaattactattgtcggaacaacagcaacaacaactacgtgagcaacaattcaatcccgatcggccctactcgtcgacagtgcattccctgcccaccaaccaggtccaaattgtgaccccagcacaaggacaacagctaaagcgtgaccaacagctagccctgattaatcagaaaataaaagagatggaagccgcaaaaagacaaattgaagaagaagaaaccgtcgaagaagaagcacgaattgtaagagaaaaggcatggaaagcggaagaacagaagaaaaggacaaagagggaattggatgaaaagatgaagaaaagggaagaagaaaagaaagcggaagaaagggcaaaaaaagacaaggaggaagtcaaagcggcatttaagaaaattggaatgagtaccgaagtggggggaaaagaagatggaaacaaacaaaaaaagaacaaatcgaagaagaaccaaaagggaaaggatacggaaagtggaaatttggaggccgaaaaactcaatgatggacatagggaagctaagaaagatgcagaagaaaaggcgacgagagaagcagaagcgaagaaagatgcagaagaaaaggcgacgagagaagcagaagctaagaaagatgcagaagaaaaggcgacgagagaagcagaagcgaagaaagatgcagaagaaaaggcgacgagagaagcagaagctaagaaagatgcagaagaaaaggcgacgagagaagcagaagcgaagaaagatgcagaagaaaaggcgacgagagaagcagaagcgaagaaagatgcagaagaaaaggcgaatagagaagcagaagcgaagaaagatgcagaagaaaaggcgacgagagaagcagaagcgaagaaagatgcagaagaaaaggcgaatagagaagcagaagcgaagaaagatgcggaagaaaaggctaacagagaagcagaggagaagagagacgctgaggaaagggcgaagagagaggaagaggaaaaggaagcggcagcagaaacaaaaagagacgcggaagcaacggcaaaaatacacagtgaaaaagaaaaaaagggaaaaagagaagggaatgtctcaatcaatgtggagggcgcaaagaagaaaattatggagacaattagcgaaaaatggatacccaaaattgtgggaagcatttttgacccgcgaggtgaagaattgggggacgattggacgatcaaaaaaatgccaagaaaaccgggaaaaagaggaccgactgagagagggaaaaagcgaagagcgaatgaaggcgtggaaggaatggacgcagccaaaaaatcaatgggaaagtggtggcacggcacaaggagggaaaagattttttgagaacacgctgaaatccgcagtgatctcggcgaatgagacacgagccatcccaccggaaggaatgggctggaaacgtcatgtaccatgctttcaagcagcgccgcctggccccggcttcaagcgccgacaccacgacgtgagcccaatcagaagaatggacagcacgggacaagggacatcggcggcgagcggaacggaagaaaagatcgtgaaaattcgaaaactgttgctgcaggccgccgacttattgggagaaatggcggacgaattgttcccgtataagaaatagggggacagcaaaaggaatatcaaaataacaaaaaaaaaaaaaaaatatatatataaacaaaacaaaaaaccaccaaaatcaaacaaaatacaaaaaataattaattacatacattaaccattatttttgctgcccccccctttttattngattgcaaatgaaatgtttgggtaaatgactgccctttgccttcagtcattttctctctcctttttcacatcacacacgctaaaatttctcgccctctctttttctctcattctattttttcgttccatttccttttcttcatctctatctctctctcttcatctgtctctcgttttcgctcccctgaggaaatgccaatactcaccaatcacggcggacggcacaacaaggcacggcacaatcaaaattccaaccaccaaaacaacggacatcagaagtgcagcagccatttattcggaatttaaatctacaaaaatttttgagagaaggaaaagccaaaaagatgaaaaatgacgaaaaagttggatgaacaaaagagacggttcgctgctgcacatctgtccaaaaatcctcccatctcttcctattcattattcttcactaatttgcattttcaatttacgcaccattttccacgacaacttttgaatgcaattgaatggaacgccgagggcggcgttcagcagagagcggagaatattgtgcggcaattttcgactctcttccctctccattctctctcactctctcgctcgtccatttctctctctaaagcttttgccccaatgttgccattgtccccgcccccgcccattaacttaattgcttcgatcagatttaaggggaaagatttggggatttgagtcagttgttgatcatttcgccttttgaacattcaccattttcccctgcctttt

SEQ ID NO: 17339 - DNA, 2632 bp, Heterodera glycines
aaacaattaattttaaccaaaaaatacatttcaaaagtgttacacaccgccagatttttattttatttttcagtcgtcatttcagtcctatggtataataaatttcagtaccgtctcgaagatagacatttttcggaattatcttcactaaaagtcaaaaaaaaggtgtgataccaactaaactattaccgctgtttattattaaatgtactctccccggctttaaatcttccatgacgccttgtttttttttgttaattctcttttaaccattggtctcgtagataattattaacattaaaatggatccggcattactacgacaacgacaagagtttatgaaacaggccatcaagtcgatgggtgttgctcagcaaattaaaaatgacagaaatgaacaacagattccgacttcctccgctgcaagcagtgccatgccgaagaaaaagaagaaaaagcctgttcagacggcagctgctggccaatttggcacagaatttgccgccaatgcgaccactgctgaggacagtgcacagaatgcgacaaattttaggtgacttttttcttcatcaatcgtcagttaagtcgaatattatttcagcataatggcgaaaatcgttgactatatgaagaaaaggcacctaaactcgcagccgtgggcactttcgctgaaagaaatattggaggagatgcaggtgaatcgaagcaattaagaattgacaaaaaaagcatttccctatttgattaggtttacgatgtcaaccgaaagtcaatgctttggctccaagaggcactcccgcggaatccgcggctgcaatccgaggcggacgacaccaaatttgtctacaaaccgttgtacaaagtgaagaaccgagtcactcttttggcacttttgaagaagtttcacacggaaggaaagggcggaattttgttgtcagatctcaacgattgtgtgaacagcgcggaattgttggtaaaagcgttgggcaaccaagtgattgccatcccaactcaggttggaccggcagatcctttctccaaatttgctggtccttcaaaaccgttattttagataaacaaacggaaggacatcgtttatttttacaatgatacggaaactgatcgcgaaattgacgacgaatttgtgcaattgtggcgaacggctggcgttgagcatttggacgagaacaaaattgaggaatatttgcagaaacatgggcttgagacggccagggatttggcgccgcggaaaccgaacgcaaatttgggaccgaagcggaaacagccgaggcaaagagtgccgcaacggttgcacaacgtccatttggagggagttttggaggactacaaaacggatgactgaatggacaatacaatgaaagtccgtttgttaaattgtgataattaaaattgtggatcgaattaaaagaaatcgtcatttatgtccaataaaatcagcgttttaatggcttaaaatttcgctcgttttttaatgttaattcttaccttttattttgtattttttattttatctgttttttatctgcagtgaatggccatcaatgaacgatttttcgccgctcaattgggatgaatttttcgaccgtaaagaatgtgtcaaaacaggcgatgacaagttcaacgtgtatgtgaagggttcaaatggtccgctgttctttctgttacacggtggtggctacacgggcctcacttgggctgtgctttcggttggttgggtttttattagatttgagctggaccgagagtccaagaaaaaataatttaattatttctcgagagaaataacaaaataaagttagttttttgggaaggaggtgacggtaccgaaaagcgccgctggaaatttttagaagttccgatcccgctcaattctatttttttatctcatcgaattgtttaacatttatggcacctgttaatttaaaaaaaagcataaatggccaaaacatatgttatcttaagaatgtagcagtgcaaaattggtacccacttctagtagtgatccataaatgaaaagaaaatgtattttaccgtgtcacaatgtccccaattttaggaacaactttcttccgtcatcgaatgtcgcattttggcaccggatttgagaaaccatggcgaaacggaggtgaaagatggggacgacatggcagcggagagtcaagtcaagtaaaaaaacgctttctttccgtttgcctctcgtgcctttgactgtccgttcttttcttttatagtgacctttgcaatatctatcagcatttttatggacatgacagtagtaagtatccgccgaccattctcatcgggcacaggcaagtgaagcgggagggggcgagggattcgactatggccgtactcaaaatgccacaaaatgaatttaaccccgctctgtttagcatgggtggggccatcgcaattcgagcagctgccagcggaagattgcccaacgttttggtagtcagtgccatcgatgtcgtggagggttcggcaatgagttcgctgtgcttcatgcagcagttcttgcggagtcggccccaacactttccgtccatcgaacgttcggttgaatggtgtgtgaagagcaaaacgacgtccaattgagagcagcgaaagg

SEQ ID NO: 17340 - DNA, 1252 bp, Heterodera glycines
aattgatggtaaaaattaaatgggaggggggggaatgactgaatttggtgattagtgtttcacccgcttttcagacgggacaaatgcgtggccaatttcaactcgaagttctgcccaaagttgggcatgccgtccacgaagactctcccgaattagtggcaaaaattttcgttacgctggtgaagcgttacaatgtcatatttcaaaaatatttgtaagcgaaggatttcctatttgtgcaacaaattcttttgtactttttttcactgaataataaattataaaataatatgcgaatccacaagccctaacatcctttttcttaagccatattttatcaaagaaaaacccaagaatatattgacattgactaattgtaagaataaaaaaacctacggccaaagaaaccaaggatggttatcaattggacgcgtaaattggaataaagcaattactttttacaacaaaaaaaatattgtataccgtttatgaatgtttttgttttaaaaatgtggaggatctcttataatattatcccttagaattctcttgtggagttggacatgacaaacattggttgggagcaatgaatcgacgaatttagtgcccaaatttgggcttcaggaattttttgttttaagcatatcatttagtcggaaattcatgcaaaaagtaacactcgaaaactcccacgggtacaacagagaaaatgcaaaaacccaattcccctttttgtagtattctctaactcccaatccaatgccatgtcatctgacggactcagccgtttttctagcgatcgtatcaaaatgtatgtgcatgaccagacgaatggtttaatttccttcctccaacttcacagcttacgatgacccagtcccgaatttaataattaggaaaaggatgagagcaatcagaatggtcagtccgaaggcgagcaggcacaacttcttctaaaaagagaaagggacggaagaaaatggacgaaaaatgacaaaaggaaaagggggggggaatggtaattaaatgaatggttaaaagcatttattgtgttaattatagtgaaaaagagcactagcagaacaacaaaatggaagagttcagagagaatgtgcaaaagaaagaagggacacaaataagggaaaaacaattggaatttggctaatttacaattagaagggcatcaaaaactcaatcaaaaatttaaaatttattgctcttttgaggccgattaattaagcggagggggggg

SEQ ID NO: 17341 - DNA, 1612 bp, Heterodera glycines
ccggagaacactcaggcagtccctgggacacgtaggaacaggcagaacaccaatactgtccggagaaggaatagttggccacttgcaggtcgcaaatggcttgcagacggatcaacgaattagactgttgtgccgccaatgaatttgcgacggcggctgcgcccgtcggcaattgggtcggaggcacttcccggtactgaccgttcagaccctggaaattggaacagtacagagagagagaaaggcaggggagaatagtgcctggggacaaggcgcgtcgaccacttggccattgctccttcgcaacttccaaaacaccgccggacgaggattgcctgagggaggggggggggggcaatcgagctttgggaccagtgatcagcggtgtagggaccgaccttcgacgacgcaactcatctgaactcgctggcccatttcgacgcggtttccctgttggaagggcgcgctgctctgcacttgctggaaaaaattcatcactttggaacgcttgtcctcaaattgcctgaaaattgtcctgaattagccgggcggcggtgtacgaatcgatgtaaacggcgggcgattggagctcttcaccgtaaaggccattattggcggcacactgacaaagaaagcggcaattttggaatggcatttgcgatattcgacctgcagcgagtgtccgatcatgtccgtgccgatcataaactcgggcccatttccgccgctgatcggtccgccgttcttcagccagcggaaagagttcgccgcggggttcgcctgcaccgcgcagtggagcgtcttccgtcgggccgcactttgctgacactgtccgtccgtcccgcgcacgcattccacataaaatcggaagccctggttgggaatgtggacggggccctgcccgttggagtcgaccacgtgcactcccctcaaatattgcacgtcgacaaccgacggcggagagtcttttgtccccccattgaccgcggcctgaaatgctaattgggcgagaaatggaaagtgccttgctcacttggcaaatgatcgtggcaccggtccacgagggattggcatcgaccggaggcaattcgacggcctaaagggagagattggcatgccaattcaaagggaagcgcaggtctaacaatgcgaacatattgtaataattcgttttgtcattcccaatttcatttccttttaccccctttttcttttgtcccttttttcattttatgttcccctggctaattatctttaaatgaatggacggaaagggacatccctttcaatcatttgttctgtgaattcggcattttgtattgtattgtccatccaccagcggagggaaaggcaaaaacggaggtcaaacgaatggcattttcgggtgacaaattccccccccccccgccctttccctccccaaatgtctctctttcctctatacttccggttcatcgagctgattagcagtaccaaagcatatcgaaatttgactctcattaaaaatggcttgacccaacgctttagaaaggtcgattttgagatggagaaactctgctgaagtgcgcggaacaaaacgaaggtcatttgaattatgggggggggggggggg

SEQ ID NO: 17342 - DNA, 1045 bp, Heterodera glycines
aaaatggaaggggaggtcgaaatgccaaaaattttaatgggcaattccctcctcttcttaaaatgagaaaaagagattaataaaatggggggcggtaaaaagagaaatcgaagacaaattcaaaggggaaaagggggggggggggaaagcaaaatgggaagggatgggatgggtgtcaggtcaaatttgtgcatcatttctcctacctccctccctttttcttccctttggcttcttttgccgcctcggcttcttcgggtccattttgcctttggcttctctttctgatggcttttcctctcccttcggcttttccctcctttctttggtttcattataattccaaatgttttgacttttcacatgatccgtccgaattataattagaatgggtatcatagtttggtgctgattgggtggaaaagaggggctaagattattggattgcgcactgctgaggggcaaaagatgaaatcgatcgtattttatcgcaaagcgggggaatttcgggttcatcgggggtggggtgaaggggggagggatcggcgcgtgggaccatttaaaaaacgatttgtcttcgttgtcaggaggagcgatctcttcccctgctcatcggtctcttcaaacccttattccctcccccccccactcctttcttctccgatcgacgatgaactaacagatcgaattgaaatgggtcgttatgcgcgatgacggggagccagccgagaattgggggaaatatgaacaaatgagggaaattaagaacaaatgatgagtgatgggctattgacacatccaaaagggcgcaagtcaaagagagaagggaaacagaaagaaaaagggagttgctgctgaattttcaaaatttaagggaatttgaggggataaaggtaaaaggcaatgaatgggagggcaaatgagtcacagacggagaggggggggggggggacatcgcctgctgcacaacaaatcgccgggtttgaagggttgggaaagcagtgcgagggcgggggatgagggaatgaccaccgaccgaccattt

SEQ ID NO: 17343 - DNA, 1740 bp, Heterodera glycines
cctcgggttatcgccgctgtaccattctttcgcgcactctgcacttttccgcttcgtttggtcctcccttcccgcgtcattccgtcccccccccccccttttaaaccctttcctcgtcttttgatttcctccctcttctttctcctccccttctttttcctcctcctccctttaaatcccatcttccctatcgcttctttctcatctccccttacatttcgcaaccattggctgcataaataacgcccgtttgaccgaatgatttgagctaatcaaaatccttcccgacccaaactgagcaaaacgacgacgacgacacacagccgacggcacaaattgcatttggattagtctctccttctgcggaccattcattatttacaaaacaacaatttatttactcgctttcgttttcttttaaatcatattttatttttggtccgcgcatttccacccattgaagagagccatcttttgacagtttatcacagcctcaaattgacaatgaatgattgggagcagcagcaacgatgataatgaggcgatgtttgttgaactgtcatggactgctctcttcaccggaatggagatgaaaggagccttatttactttccactcaacagtttttcagcaaatgggatcaccgctgatcattcttccaaattagaaaacggacaaatccaacagatttatgtcaggccgttttaggcacccgaaatgtttgttgtccaggcttttcaattgccgaatccctaattcccacggtcagggtcgttttcgtaccgccgttttcgtacgggacattttcgtacgagttcttgtacaagcgtcagattcaattagaaaaacttagtggaaaatgcgtcaatggaaaatgcgtcagtagaaaatgcgtcagtgaaaattttattgtcataaaaacaagttccttgcgttttcgggggcacttaccacgaatctggtatccatttcggccaattctgaaccccggacgcgaattcgaacaaaaagttgcaagtctaaattttcgaattaagcattttttgttcaaaaacggcataaatgatctcctattgcaggattgatgtatttcagtttgtttctgtgtatttaaaccgatttgaagaaaaacactaatttcgaaaattttgactttcgattttttgttcgagtttgggtccggggttcgcaattgagaatgattttcttatagaagtttacttctatattacaatactaatgccatagaattttattttaaaatatttgcatcactgacgcattttctactgacgcattttccactgacgcattttccactgaccgattttccggtcacgtgattatttcataacaaaaaatcattcaaccaaagtgtgaaaggatttatatgttttttaaatttattactttatgtaacattaaatgaataaagaagtattgacaaatattaaatttatgcttaaattataaacttttttgggagacttttcataaattgggaagccaaaatattatttatatgaatccacttaaaggatgcacgtaactggatttgaagctgaaggtgatcatgcgcagaaaaatctttaaataaggcttttttgcaagcaaaacgaggcttggcatcgggtctccaaaattatacatatcatttttatatcccctaaatgtcgggtcccctaaaagttatacatatcccctaaaagattatattcccaaatgtcaactcgacaatga

SEQ ID NO: 17344 - DNA, 2877 bp, Heterodera glycines
aaaaaggataattgtccactatatgcttcaaagatgatcgattcaccactgcgaggggtactgtagaccggtgaaaattcgcaataaattctgccgcaggcaagcggattcgaacttttgctctccaccaacccaacacactaccactctgccaagagaccacttgccagaaaaaggataattgtccattatatgcttcaaagatgatgacgtcacaactgcgaggggtactgtaggcctgtgaaaattctcaaaaaataagccgtagacttttccgatctataaaactaaaaccttctagaacattctagaacatacaagctgtatgcttccagaaacttctacctattactaaagttcagaaacttttggaactttctagaacaaacggaatttattagtttagtaatcattttaaacaaaagttgaaaaaatttactttcattatttgtatacaccggtcagctatgttgctaatcgataataatgttaacctttttgcatctattccctctgctgcttctcggtagtcattgtctctgcagctataacctcacctctgcgtatactctcgctaatctattatttggaccaagactgcggctctgcacacagtgtctcaacatctctaacctctctttgcgatgtactctcttgccaatcgataattttgtaagtctctgcttgacagccccccgtctatgctgcacttattgtctcaccatctccaacctctctttgcgacgtactctctcgtcaatcgataattttggaagtctcttcttcactgccacgtctactctgcacttattgtctctccatctctaacctctctgtacgacgtactctctcgtcaatcgataattttggaaatctctgcttcactgccccgtctactctgcacttattgtctctccatctctaatctctccgtgcgacgtactctctggccaatcgataacaatggccgtcgctctgcgtctctaaccttccgtatctctgctcctccttatctctacatctctaacctctcctatatgcgtgctatctcgccgatcgataaaaatggacgccactctacgtctctgcccttctgcttctctgcatctctaacctctgctatatgcgtactatctcgccaatcgataaaaatagacgccactctgcgtctctgcccttctgcttctctgcgctcccttgtctctgcatctctaacctctgctatatgcgtactatctcgccaatcgataaaaatagacgccactctgcgtctctgcccttctgcttctctgcgctcccttgtctctgcatctctaacctctcttatctgcgtgatctctcaactaatcgatattgttggcgtacgtgtctgataggcccacatacacacacacttacaataatgttttaatttctgagctcaattaagtttgtcgggagtgctaccccgaccggcacatgctgttggcggggggacgaagcgcggagttgctgtgggcgcgcacccagcaacgggcctgggagctcgccgagctgcacgggatggaggtgctgttggtgtgggagtgccagttccggcgcactctgcgcactaacacccgccttcgaaagctgtacaaggagaggtccgttgatgtgccgggcccgctcgacttgcgcaagcatgctctgttcggcggccatgtggagcccttttggctgttgcacaaatgcgctcccgacgaagagattgtgtacattgattgacattgtatgtttttgagtgacattttcatatgaatttcattaaaaatatttttctctccccaaggtgtctctgtacccgttctgcatgaacgcgcgccccttccccatcggcacaccgcacgtgtggaccggagagcagctgtggcaggcgggcgcccaagtgtttgaaggtatttgtagctgctgctgctcatttgtccgtatttgaaaacagcattttcagcttttgctccacctccagaagggctttgtcctcctcctgctctgccatggcgccgcccggaggacaaccgttccgcggcttactcttctgccgcgtgctgccaccgacagcggaggagctggttgaccgcgagccgctgcttccctaccgcacccaggccgatggacgactcatcttcggcctttgcgctcgttgagccgagctgcgccagcagcgaatctgtcatcacacggagcgagagcgtgggtggaccgctgcctacacgcatgtggagctcaattgcgcgttgtccatcgcgtaccgagtgctgagcatccatgaggtgtggcactacgagtgctgggcgtcaccggacaacggcaacggactgttcacctaatacgtgaccaccttactgcggctgaaggcggaggcgagcggctggccggccggctgtgacaccgaagcggcacgcgcagagcacatccgccaatttgcggagcaggagggcatccatctccggcccgacaacattgggcacaacccaggtctgcgtcagttggccaaggatctgctgaactctctatggggcaaaatggcggagcgttcagagcgcgatgaggtggtgtacaccaacagcgcacgcgacttccacgagctgctcatgcgtccggagcaggaggtggtcagcttcacccacctcaacgaccagctggaccgctgtgtggtgcgcaagcgggagccgttcgcacggacgccggagcacaacaacttggccgtcgcatgttttgtgacgtcccaagcccggctgtgcctgtacgactggttggaggaggtccgacgggtgcgcggccgatctctgtactgcgacacggacagtgtgctgtacgtgaaacagtggcgctgaaggtgtgcgcgagggcaacgcg

SEQ ID NO: 17345 - DNA, 1578 bp, Heterodera glycines
aaccaagtcaagtccagaaaagaatatcttaaaaccttcctggtttggtttggcattatgataccgaataacattcggtaattatggaaacaaaattggagaaattcgaataattttttgacttcaaatttttttcccagttttgattgggttttaaaatagtagtttggttcagaatttttccctctacaaaaaaaaatttataatagaattttttattattaattcgaaatctttaatttattggacaaatccaagacttaaaattgggagaagcatggggctgtagctgaggacccaaaatggggccccattggggaattaaacatgatttctgaaaagtccctgaaatgtcgattttttctttctatagcttcttgtagagctcgagctgctctttccaatggtcttatcccggtctcgatccgtgcagaactcaaaaagttatgaagtgaaatgtgaaatattgttttcgccacaattgggagaagcatggggctgtagctgaggacccaaaatggggccccattggggaattaaacatgatttctgaaaagtccctgaaatgtcgattttttctttccatagcttcttgtagagctcgagctgctctttccaatggtcttatcccggtctcgatccgtgcagaactcaaaaagttatgaagtgaaatgtgaaatatgtttgcaccacaagggattttttctgaaacccatcggaaccaaaaatctagggtttggtataagcgttttagaaattgcggagaaaaaagcttcgatattgagaaaccaagtcaagtccagaaaagaatatcttaaaacgaattcgtttggtttggcattatgataccgaataacattcggaaattatggaaacaaaattggagaattcgaataattttttgacttcaaattttttcccagttttgattgggtttcaaaatagtagtttggttcaatttttccctctacaaaaaaaaatttataatagaattttttattattaattcgaaatctttaatttattggacaaatccaagacttaaaattgggagaagcatggggctgtagctgaggacccaaaatggggccccattggggaattaaacatgatttctggaaagtccctgaaatgtcgattttttctttctatagcttcttgtagagctcgagctgctctttccaatggtcttatcccggtctcgatccgtgcagaactcaaaaagttatgaagtgaaatgtgaaatatgtttgcaccacaagggattttttctgaaaccgatcggaaccaaaaatctagggtttggtataagcgttttagaaattgcggagaaaaaagcttcgatattgagaaaccaagtcaagtccagaaaagaatatcttaaaacgaattcgttttggtttggcattatgataccgaataacattcggaaattatggaaacaaaattggagaaattcgaataattttttgacttcaaatttttttcccagttttgattgggttttaaaatagtagtttggttcagaatttttccctctacaaaaaaaaatttataatagaattttttattattaat

SEQ ID NO: 17346 - DNA, 1284 bp, Heterodera glycines
  misc_feature (1236)..(1236): n is a, c, g, or t
  misc_feature (1245)..(1245): n is a, c, g, or t
cgcacatcgtctcttcgcggggctgatttctttcaaattccctcgggattttaagcgacttttatcacaaactttaccaaattgtaagaaatttttcggatggccttacgatggattttgggtaaaaaagcaattttgaagaaataattttaaaaaaatttcagttttgacaatctgccaaactaattttttaaatttttctcggtgacgaactgaacagtgacgaaatgatagggcgcctgtaattatttggaattaataaaattaaaaatccaaaaatagatttttaaatgcaattttcagatttaatcaatgatttttaaaattttataattgacttatcattttgcccattcaaaaaatccaaaattaagtacaagtttcaaaattttttggatggttataaaattaaaattatttaaaaattttatttttccgtgaaacagatgaataaaaattctttttgtctattctttttgcattattctatgtatttgtggtgaccgtagcacaaagcaattgggattacagtaaccagcagcaagacgacagtggcgatgattacgatgaatatttcatgactttatcaggttcactcaaaaattagcagaactcaaaaaaatttttggattttcaatttatttgtttaacagtaattattttatttttattaaatttaaaatttaagcaaaagaattggtttccgaatttttgaacaaattccaaacactagcggcacagacagcagatgtcggcgcgttcatgggaaggatttccttggaagcgtatgccctactcaaagggtgctatgacgttagtcaaaaaccatcataatgggcgttagtcaaaaaaccatcaaatgaaaatattttttgatataactttgttcaaaagcatctaaatttttaattcttgatatcattaaatagcactaagagtttctattagcctacaaaaaaaggtttatacagaaaaacattaaaaaattgaatttttaattattaaaaataataccgatgaatcaaagtgaaaattttcttaactaatttgctttttatttttagaatgtgcatgttccatccgcacatttgtggcaacaaattgactttttctgggacccaaatgttgacaaaaacgctgacgatgtgaggcgttttaaacagatgcgctggtgaaacagaaactcgggccagtccacttggcattttatacgtaaatatttttatgaaatattanaattaatanatattccgttgcggtaacttacctatgtctatgataaaa

SEQ ID NO: 17347 - DNA, 1771 bp, Heterodera glycines
  misc_feature (1690)..(1690): n is a, c, g, or t
  misc_feature (1709)..(1710): n is a, c, g, or t
  misc_feature (1765)..(1765): n is a, c, g, or t
cggtgcaccccaaaacgtcgtcggccgaaacgtcgtcggaaaactttttgaaccataactttgttcgctgtcaatcaaattaagaattgttggtgttgttcgatagctctatgtgtttattattaattgtcaaaatctcaaaaattttcgttaagttttaaaaaagttatggccagaaggaactcaaaaacccagtaattcgaactttttttgctcagatttttttgtgcataaataaaaatttttgaaaatttgcaggctaatagcatttttcgaatgctttcgaataataccaagaatgtttaatttggttgagaaagaaaaaagttatggtcgaaaaattcgttcgacgacgtttcggctgacgacgttttgtcctactccgctattttcatacagtcaaagattgcacaatcgtcgagtggcacagttgcttacgattttctttgatgagctggcgtcaggtggaaaaattaaaaaatttgattacattttcaattaaagggctacacctttggtttacaaaacttgaaaacatgtggcagaaaacgttttaaaaaatggaagaatccatacgtatatttttttaaatttaattttatttgagtttggatgtttgagtataaaggaggtaaattaaaaaaacgtcgggatttcttctttccatattcaccaatgttttgacttttggtctttttcgccattaaaattcctagtgattaaattttgagagaaacaacgataattggtgaattttcgattttagaaaaattgacactacaattcggcacaaaacgcatttcgtgatgtcaaaacaattttgattggaactggcactgaacctcaagaagtgccttctccaggacataatcagtgaaaggctttttcatcgcaaagcaatccaggaaatggaaaacatcattcggctggacgtgcttagaatggtatggacgtgccgaagactgagtccactgtttttttgaaaaattctccaaaattatccgtttatctcgtattttaatccatgttttggtgttttttaatcaatataaatcccggcctttaatatatgataatagatttattaaataaaaaattaattaaattaaagattattgtattctttaattaaatttcattataaacctactcacaatcagatggcgttcaacggcatgttcgccaacattacttttgacggttctcagtcgagaatggactggtatctaaacaaagtaaaaaggcgagtcacggacatcattgaccatgttcagatatatgtatccactgaacttgtaagtcgctttttaaaagattgtcgaaataaaaaaataatgcaaaattcggcgccggaccgggagacccattttcttgattcgggtccgggttttgtttttcacaaaaaaccaaaaatgtttatggaacggagcaaaaatcgaatttaaattaaaaataatattatctttaatgtttgtcattagaatgcaaaaaataattgaaataagtagaataatttcagcaatttatagtaacacttacccaacttgactttttaaaaattcaatacccggtgtccaacgggtctaaaaggcgtggaaaaatcccagtaaaagttttcatgaaaataaagaaagaaagaaatttttgaaatagttttaaatttttaattttaattatgaattcttttttnaaaatattatttgatttgnntaataacatcgaaataattttatttaaaaattgtaaaatgtaagtttattcatgnaatttt

SEQ ID NO: 17348 - DNA, 3178 bp, Heterodera glycines
cgaaaaactccttttttagtgcaaaagttcttcccttaaatgtcactattcgtcattagaaatgcagaaaatggtgattttttgcaattagtaaatccaattaaaaaattatccgtctgatattattaatattagtaatttcacttttcccttcattcgattggtcaccattttattcattttgttccttttctgttcatccccataatccattcaagctaaaaataagaaatatattttaaattattaaattcctttacattttcttgaagtatgagggggatgagttcttggctttgggtggatctgttctggccaacgttggaatggtcagcgtaacagcagcggtcgattgtggcgacgacgtggagggcgagggggaggaggaggagaaagagaaggagggatttgtgtggtttggggttatcagagacggcgaagaattggcctaaatatggctaaaatttaatttgaacgacttcctttgtattgctgcatggattatcataaaactgcccgagaattgaatttcaagagtctcgacaaagaccccaaaacctccgagaaagtctcgacttttctggcgagaccgattctttgagcggtgcccacccgccctaatgactgactcttccaacaacgatcggttgttgctccaaagttgagccacccacccctgttgctgctgctgaaggtaccatttgtggtgctgcaacattttgcacagattgtcccgcctttggctgcgtagcatcggccgaaaagccgccgaattgaaatggcatttgatgagctgaggaggaggaggagggcatcatccacgcctgttgctcccacgtcgttgttggctgtccgtggaagcaaagcatcacttccattccgccgtgcgccaacggcaccgaaagttgcgccggcgaacgaccacctggagaataagtgaatagagtggcatttaaaaagatgcaacaacaatttgattgtaatattttgattttaaataccataaaatttttatatttggttttttcaaaatcatacgacttcacaaactaaaaaaacaactaaattttagcattgacttcgaatttcaaaatttgcatttttgtctaatttcgtccattttctccgttttgtattttttttatccgtttttattttggtcatacaaaattaattatttttgaaaaataccatttttagcgaacaaatgtggacaaatttccctgaaaagttcagtgttttgctcttcgttgaccggcgatttgcatagcacgccgtttaactttaaatggtcgaaaatgaaattgaaaagtcatacatataaaattacgtctgatgtggcaaatatcaattaagttatttaattgcctcttacatttgcacagaattggttggccatttctttgaaatacaaattcataaatggccgatggcacgcactttggacggatgtccaactgctgaagcacatttggccaccatttgtggtgacaaaaagcgagaaaagaacaatcggtgcagcgaacaacagaagaaagcattgcattttgctatttaattcattttaaagaaataaataaaaaaagaaaatggaaaatggaaaatgttaatttattttattaaagcattttaataatatggaaaatttaaggaataattgtggcagccataatatgtattggccccgttcataataaatgcattaaatccaacaaatccgttctaattgcatttccatttttattataaaatgtgtttggccattaaatttttaaaaaattttatttttatttatttatttttctttggacgaatgtgaaaacactgtgcatttaacaataaatcatttggtgccaacatttcgttattggcataaatttattttatttacataagctttcactttttaaagtgtacaaactgacgaaaaactcggccaaaggaaatttttttttttaattcgtgaaaatttttaattttttaatattaatttttattcctttttaaaatttctcgaatattatataaacacatgttgtctactattgaatttttacctttttaaatttgaattaaaaggcaaatgcctaaaatttttgcgcacttcgattgaaataagcagaaaattgggaatggcatttttgtgagtgaaacgacgattaaaattgttctaatttgaattacattagcttattgtcttacgcaccgcaccttctttctccccttcatacccactacttgtgctttcggcactacaataatattgccgtggcggcatcgtctacgactcagtcacaacaatttggccaagttttgagttcaaactttttcgattacggttgacatttctttcttttctacacttttatgtattttccaaacttaaaatccatgaaaaatatttctttgctttaacaaatgacgctcaaaatccattttaaattgacacatttattcattttttgactaaattattgcaaattcatcaacaaaaactatgacaactgcagaagaagcggaagttgagaagatgaaaaatacttataattcgtttttttatttttcaatttttattaattaaatttgtataattttctaataattgcattttgcaatttgccagtttgtttattgataaacaattgattttcttgtgcgtcatcagaaaaccaccacttttttatagcttttgcaaatttaatgggcttttcattaataataatatataatatttttatcattatatgaatattaattaatatcattatatgaataaataatacaaaaaatcataaattcgctaacctaaaattttcactttttaataaaatcaagaaaatttgaaatcaacaattacatttttggcaaaatacatagcacatatttgaaatcaaaatttgattgaaaagctactataaaatcactttagctttccataaattaaaaaatcctccttaatttactggaattagaagtaaaaattaatttaaaagtttcagcatttttttatagaggaaaatgccatatttttgacaatcttttggcatttttagttcactttttagtgcctatttccacctattttgtcattttttgggcttttccatacctgttttggcacttttagcacctatttcgagatccattttgcaattttaggaacctgaaaacccattct

SEQ ID NO: 17349 - DNA, 3378 bp, Heterodera glycines
aaagttgacctaaattaatttcagtataagaggaatattaaacataaatttaaaaaagacggaaatttttttgaaatcaataaaaattgacccatttaaaaaaaatattattttcaaaatttcataatttttaaagtaatatttaaaagcaggactcccattacaaaactttcggctaaattttcagatcaataatttaaaattacaaaatttatttaaatgagaaaaatgtaccgatgatgaaaatcagtgcatttacacagcatgggatcaccaaacgcatctccattgagtgttgtgatgttgttgattcactcttgcgcactgatttattgcttaaaaaaatattaaaaataataaaaaaaaattctaaataggtaaagtacaaagaaaattccaatatatattggtcatagccccaactctaccataatcaaaaaaataaataaataaagtaaattttccaatttgtggatggataacattggctaaattatcaatagtttttcctcttttcaaaaaaggggataaatgtaatcctgaaaattataggcctatttctctaacctgctcactttgcagggttatggaaagaattcttagccaaaatatttacaacttcctcctaaaaaacaataaaatttcggaataccaatttggttttgttagaaataggtctacgacaagtcaactaataacagttgtgtagcaattataaatggaaaaaatgttgactgtatttatattgattttcagaaagcttttgactcagtgccccataatttacttttataaaaattgggaaaattggtataaagggcaaacttttattgtggataaagggctttttgagtaataggatttttcgagttaaaattggggattccttatcctcaagtaaaaaaagttacttctggcgtcccccagggctctgtcctgggccctttactatttttgatttatattaacgatcttcctgatgctttgccatcaggagtgaaaataaaataatatgctgatgatgttaaaatatatatatgctataaagcaagatctgacacagaaaatatgcataaagcattgcataacttattcgaatgggcaaataaatggcaaataaaagtttcaattcaaaaaacttttgtattatatttgggttcaaaaaacccaaaagaaacatacaaatttgatgggaatacaataaatgctgtggatacaattagggacttaggagtaaatattgataacaaattacaattttccggtcatgttaaccaaataacaaggaatgcgtatttacgtatgcgttccttgtttagaataattaaatccaaatcatctaagatttggattacgttatataaaacttatattaggcctttattggaatacgctccggaggtttggaatccgtctcttcaaaaaaatattaaacaaatagaaaagtgtcaaaaatatttcaccaaaagggtattttttaaatgcagccttccaccaattccatacctaaatcggttagaatactttcaactgccaacacttgagaataggcgaaaactgtttgatatctgttcatggcgcataaaattgtttatggccgaacagatctgaaactattttctatttttaatccctcaacgcgctttaacatccccttttacagatttaactcaaaatataaactgggcaaaaaattcattccctttgctgggagggtaacaaaattgtggaatcaactcgataaagaactaatcaaaacaaattctttaaatcaatttaaaaccaaacttagaagttcactagggtaataaaaccggaaaagctagaacaaaaataaactcataagtgatttggcatttttacgcgtggccctaattttgactttgacctcaattatttagttatttattttcacatattttgtctttttaattcctgtgatcatcactttattttatcacttactctacgacacattatctgaacagtcgtcagagtaagtggttttcgcccttctgatgacttttttatttttacgaataaataaataattaaattttataataaaatttcttcaaagttgcactaaaaatagcgctttatcccctcttaatcattttgaaaaatgtgcaccaaaaaattcttacgtacaaaaatgcggcctctttttttgcttcagcagactgtgcaaataaatttttctaattgaagttgagctcaacactgtttgatctttgattgtttgctacgaaatttagagagtttttatgctgtccattaatcttttcattttaaaaatgttaacaaaatttatttattcattcactccaaaaaattaaaaatattattatttgtatgtttaattaaactttgcttaattgagtgaatttaatttgtatacattttttattatttatttaaacattcaagaacaaaattgtttaaataatagttacttttttaattaaattttattttttatttaatttttattgtctaatggaaatgcaacactttgcattgggacgctcagcctttgaacataatgaaccgtccaataatttggatctgccaccaattcattcaaaaggtgaaaaaactcaattatattatacaaattatatgtacaatatttattatatactggcataaagctaaaacaatcaaaattacttaaagtttttccgaaatttttattttgcattatttttgactagggttcgagccccgcccccgtcacccccacccccgccgggggcgtgacaaatattttggcctcacccccgcccccgcgacccagacccccgcaacccccgcccccgtgaccttcacccccgcgggggcgcgtgggtgaaaaacacacccctaagaatggcatattcgtgggatataaggcaaaaaatttatacaattttgaattttttttaaccatcttgagaaatttttatgaaataaagtaaattttacgtgtgttttcttttatttgtggattggtggatagtgtttcaacactaacagtacttttgtcatgagttcgactccggctaacgttttcatttgtatttatttttttctgattaatacagggtttctttatgttcttatttctaagaaatgttctaatttgggggtaatgccttattttcatctaaaagaggaaaatttctgaaaattttggctaagttaacaaaattcatataaattcttaaaattttcccccggcagcgcctatcggcactgccggcccccaaaattcctatcttttttcttaaaatttagcccaagatcgcaaattttgttcattttttgtacaaaatttgttaacaaattgcattccaattttcaaaaaattttcccggcggcgcctatcggcactgc

SEQ ID NO: 17350 - DNA, 2823 bp, Heterodera glycines
  misc_feature (2625)..(2625): n is a, c, g, or t
acgcctccaccccgtaaatgatgagaatggtgaggtgcacataagaaaacgggtgaggcaaccgagaagggtaagagtacagtattcgccagagccaagcccttcaacatctgcacaagcttatgaacaacaacaacaacgtgaactgtttgctattccgtcaaatcagctgaccatgactcagcggattgaacggctatacatcaaatgtaaccattatgcagatcgtatgggcgttcggggaaatacaattaataccgcaaacggcaaaccgttggcgcatagcaatttgcgaatggccatcaagtatataatagaccggagagcgggccgccccaccattaaaccaccaggagcgaacctattggaagagcggcttaggaaggacccaattttgtattcatggacggccccaccaaagagaccgtcacagagcaaaaccacccgaacggaacggacaatcaagaaggaatttcgcccaaaaaaatggagctgatcaacaccactcttgacaaaatgtacaatgatccatcatccccagcggcattcgcaggtgttacagcgctgtggaaagaggcgcgaaagaagattaaacatttacagaaaaaggacgtacagcattatttggatggtcaccgcacctacactctgatgcgccctcgcagggtgcgctttccaagggcaaaaactgttgcagcgggattcatgacagatgtccaagtggatttggcggattttcaagctctttcgcgccacaatcggggtcaccgctacctacttgttgcggttgatgtcctctccaaacgcctgtttgttgtaccgctgaaaaataagcgagccgaggagatgctggaggcattcaagcaactcatcgaccaaatgcccatggtgccccaccgtattttctccgacaaaggcaccgagttcaagaatcgattgatgaaggaattcttcgaggagcgggagattgagaagcatgagcctgtccattcatccgtaaaagcgtcggttgcggaacgagccattcgtaatgtgaagcagcgactgtaccggtatttcgcggagaaggagacgctgaactgggtggatgttgtacagaaaattgtggatggaattaatagttcaccctctcgtgttcacggtatgcgacctattgatgttgatttttcaaatgctcagaaggtgtggaaacgaatgtaccgtccactatcatttttcaaaaaaacgcccccgcttccgtaaagatgaatttgtgcgaatgagcagagagaagggacaatttgagaagggatatttaccaaattatggagacgaaattctcgagattgatgaggtgttgaaagcggtgcgcccaattcgatacaaattgcgggatgaacatggtgagaaattcaagggcagcttctatgagcaggagttggcgcgcgtaagaaaggacgcggagacaagctaccgtatcgagaaggtgtacaggaagaggaaaagaacggacgggaccacagagttgcttgtaaaatttattggctatcccaatcgggagtgagttcatgagtcccaacttgtataaaagcgttcacatttttcaatatttatgcagataaacaatcatgtcgaacagtttctttgtgtttttgcctagtaatgtgagtgattaccctgacaatcagccgaataaattccgtgttcggcttccaaaacctttacattttaaaggctcgtgggtgtgcggactgcacagtatcagttacccctactcatggtcaaccattggcacattggatgagcaatggattgacattcacttcaccgaccgcagagcgaccgatgaggacagacagcgagtgatcagagtgccggtgcctaaggcatcgcatagtagggttgaacaactgagagaatttttgtccgtcactttgagaaatcatagcggtgcaaaactacaacctctccctcgtgaggtggaagagaatcggaatcgtactacaacaaagcctctcggctcgccaccgcctttgaaaagacagaaaagagatacggtgtttgacgcgagtagaaaacagattgcccctcctccattgcataatgaaaatgatgacgatgaagaaattattgaggagtcaccacctcatcatgaagaagaagatgatgaagggccaattgaggagtctccaccgcattatgatgaagagcaaaatgatacagtaacagctcctgtcacaccaaaagtgccggtaccagcgcctgtcacaagccctgcgaaaccaacaacagtaaaaacaccagctactccatctgtaacaacaccagcgcctcccacaactgcaaagctgccagtaaccgtcccttctccaaccacaaaaccaataacaccgacccctcctcctaccacaaccacacctacttcaaccacaaagtcaacaaccggtcctctacctaccacaaccacacctactccaaccacaaagtcaacaaccagccctccacctaccacaaccgtccctccagcaatcacaaagccatcaaccggccctccacctaccacaaccgtccctccaccaatcacaaagccatcaaccggccctccatcaacagaaaagccaataacaacggtccctccgccgccanagacaacaacaacaacaagtacgccagcaataagtgcagttcctagcccatctgttaagccgacgattccggtaccgccggcgcaactaaaaagctcgggactgtctccaaaatcaaaaaccccaatttctactgttaagcccgccacttccagcgttcggtttccgctaaagtgggcactaggggtcaaacgccgcc

SEQ ID NO: 17351 - DNA, 2506 bp, Heterodera glycines
caattttttgaaaatttttacaaaaaattgtctctaattcgggattcgaaataggtcgaaatggatgtcatattcgtgatcagcgcctgcgaaaacccctgagttcacaacaaaaaaagctcggaattccttttttcaccttttttttgtgggaccagtaaagcgtacgattaccgggttttcggaaatcgctgattatgtcatatatttacaattagaccaaatgtgaaccaggtcccgaattctaacaagtcgaaacttcgaatttgataacttattatttgtctacgggttaagagattttttgttaaaattttttttggaggtgaactgacttggaattgcgctgatcagccaccgaacacttcaaaagacgacaaatgaaagggaagcgaaaattcaggacttaaaaattgaaaaaaattatttaaaaatttgttttggacaaaaaattaacggagtcgaaaaaaccgtaaaagtggtgccgataagggcaaacaaaatgttacacatcaaccttatatatttaaaaaatgctacaactgcagaggccatcaaaacatgatcaatttcaattcgaacgaacgtcggctgtggaaggaccattcccttctgttggcccatgcgtatcatttgcgttacaaagttcctacaaaataataattgccttttactataaactcaacgacccacctgacagtcgattcttccaaatgaccaggaaaagcgacgacccattgagacaaaatgtcggagggctccaaaaaccgaacagccggattgatcttcaaaaaaagattaatttaaaattgtttgcttttttcgaactctgtcctggaaagaggtgacagtgttgccgaatttgatctgacaatgaaaaggaatggggttgaaaaaatgcaaatgactcgaaacacacctttggcatttgatggactccaattttaacggttgactcggcactgagtctgacaccaaaattggccaaaaaacccgacgaagtagcaccaatctgtttcattgtcatttcaatggcagcataacgacgggcgggaggctgtgtattggccttaaaattcaaagtaaatttaaaagaaacataataagtttacactgagaagttcgcgcgaaataaattcggacattttgtcgatggtcactcgctgaccaggtaagatgataacacaagacattggaaacagtgtctacaacagaaaatgtggttataaaaacagttctaattttgttaaaataagaacctctcggtcctgctgttggcgaacggccggcaactgtccgtttatcggaatgttcttcttagtacggaaaaagtcgaccatagacatagaacgaccatcaacgtcaaaactaaaaccatgttttatttgatccataaaaccctcaaaacctaatctcggacatcttccgttgactgatcgcatcaatgacaatgacgcgcgacggtgcataggtcagataaccgctaacgccgcgaaacaagtgattgaagtgggaccagaatcggtccatctgggaagcattgttgatgttgaaccgtcttttctgcaccatctccatgacgatttcctcaagattacgacttgcgaagaatgcacaagtcttcactaaagagaaacttaagcactcaaccaacaaaatacaaagtaaaccgtcagcaaccaaagccgcctttggttcaccattgttgtcaatgacgcgaactcccttagcaataccctcgcgcgtgacaatgccatcttcgagctctttgcagatctgacgcttaaaaagacgaccagcgccaatgatgtcatgggtcccactaagaataaacttaaaaaaaattaaatactgctaattacgcattgagaaatggctgggaagacagcatttcaaggaaagtccgcaaagatctgtccgattgttgatcaggatggtgcgaaatcgaagaaacaatgccgttgagatccagctcatgcttatcagtctgacaaggcctaacctcaattttgactggagacccacgcaggaaatcgcgaacgattccttggactttttccgtgtcaatttccaatgcctaaaattatataattacataatgttaaaagacaaaaagcaaacaaattgttcgattcgtttgttcgtgaataagattttacggttgtcgtaaacgaattgtgcctaaaatgaaggtaaatggtgaatgcgatttagagggaattaccgcttgtccaaatccctgcgtcgagtcgtgcacgaacttgatcaattcaaaacaaacgccgcggagcaatccatttttcccatcgtcgccaccgcccgaagtcaaacttttgtttctagtcagttgcaccatttcaacatcgtagcggaatgcaaaagcaccgccatgtgaagatggtcgggtttcgaacctaaataactttattgtctcaaaagcattaaactgcacacatacacataaacgcttgaaaacccttcgacaaatctggtacaaactgccgga

SEQ ID NO: 17352 - DNA, 620 bp, Heterodera glycines
agagggaaagtaatgatcggagagagtggcaaagaggaagagggaaagtgatgatcggagagagtggcaaattggaagagggaaagtgatgatcggagagagtggcaaattggaagagggaaagtaatgatcggagagagtggcaaagaggaagagggaaagtgatgatcggagagagtggcaaattggaagagggaaagtgatgatcggagagagtggcaatgatcggagagagtggcaaattggaagagggaaagtaatgatcggagagagtggcaaagaggaagagggaaagtgatgatcggagagagtggcaaattggaagagggaaagtaatgatcggagagagtggcaaagaggaagagggaaagtgatgatcggagagagtggcaaattggaagagggaaagtgatgatcggagagagtggcaatgatcggagagagtggcaaattggaagagggaaagtgatgatcggagagagtggcaatgatcggagagagtgggcaaattggaagagggaaagtaatgatcggagagagtggcaaagaggaagagggaaagtgatgatcggagagagtggcaattggaagagggaaagtaatgatccgagagagtgact

SEQ ID NO: 17353 - DNA, 1215 bp, Heterodera glycines
tgaatgaggaatagattctaaaattcaccagagatatcgttatgttgtggtgccgtttagaattaaaaatcaccaatttaagtgacaatacgccaaaatggtgccttatatcaatcactaagtgagtgccattcccttttatttgtgttctactcccttttagtttattgtgccatttctcattcaaatatgccaatgccatccaatttgaaagtgtgccattcccatccaaattgtgccattcatttccctctgccagccttccccccctccccctcacccacccgtcctttttcatccgatcggccattgtcgcgtcacttccacatgagcacattcccttgaacagtccgtccgtccacgacagaacaaaatccatggaagaagagaagagaaagaataataatattcaaataataaataagcgcagctgaaaaaacaaaaaataaaacaaacagaaaattattattttaggaaaatgaaaattaatggtattataattaattaattaatgaggatgaacaatcaaaaggcaatgataatttaaataaaaaggggaaaggcaaatggaaagtaaatcggaccaatcaattgattggccgcaatgatcagatgaaccaaactaattagcgattaattgattgattagggagggcattcgaacgatggcagtgacaaatcgacagtaaaatcacagtaacaccaatacattttgagcattatcttctgccatttgttgttgttttggcgttttctcgcctaaattctttccttttctctctcccactaattttctgtaaatcgcctcgactttctttaaatttgggctaattgttacaaaatatctgatgttttattattttagatgatattttttatataatttctaaaatgttgcaaattattattgggtgaaagctatcccattttttaaaaatgaaatatgagtgaaagttaaaaaatagggaaaatgagggaaagtggcgaaattgggggggggggggggagaatattttatcagataaaaaggacaattgggaaaacaaaggaaaaagagacgcaaacacaaacatatgatgaagatggaaatcttcgacgaaagggagggaattccgaggcaccaaaaattttcgaaagtcgaaatttttcaaaaattttaaatataataaaaatttttaaatgttttattaggctaaattttaaaattcttaacca

SEQ ID NO: 17354 - DNA, 1216 bp, Heterodera glycines
atcagcctctatctccccctccctccgctccactcttccgtccctaattcccttcatccccccccccctccctcctccctctcccatattttcccaatttggttgttttgtcactgcttttgttgtctcctcctcttctcacttcgttgtcggttgttcctcattacgtgcaaatagttaattatgtactaatttcgcctcgtcactaagtggtcttcgtgttcacaatcagcggcagaaaatgacgcggacggcccgcggggggagggaggggaagctgtaacagcgttttgtggtggtataaagtcattggcaggtgcagtgaacgaaatgggcgggggtggggcgggggacattgaatgactcggctgggacgacggacggacgtggccgcgactgtctccccaaaagatgattatgatgtgaaaagatggatggaaaagagatgagatgacaggtgatcatcatcactctgtgctgattagaccaaaagcaatcggatgaactgatcaatgggaggaagggggggcgagtgggataaggcggcgaagttaaagtttgaaggccaagtgtcactctgcccattcgtctgttgtctttgcttttcccatccgataactccgtccgtcactcttccgtcgaacagttcatcccttcccttctcttctcttcccttcattctcttcctctgtccgttcctccctcccttttctgttccgcccgttcatttgcaccgttttcttcgcctctccgttttttccatttcatccctttcaccgggtcttctcctcccccttcattcaattcattcattcattgcgtcaaaaaaggcaactcctcactgacaaatgagtgcagcagaagacgaacacaacaaactccctgctgaactcactctccccacaaacttcacaactcatcatcatcatcatctcctctcatcatcacgcccgatcatttcatctctatccgatcatttctccttttcctctttttggtgcttgtaaaattgttttgagaaagggcaaacgaagtaacaaataaactggttatgggaaggatgggcttttgggaagaacgaaagcggtggggggagggaagtgagaagggaacgctgggaaagggaagaggatcatcaaggtgagggaggaagagaagatgcgggagggaagaggaggggaaattgagggaaaaacataaagggtgggggagggcg

SEQ ID NO: 17355 - DNA, 3493 bp, Heterodera glycines
  misc_feature (125)..(125): n is a, c, g, or t
atgcctaattcggtgtcatgacaactcgtacaaaaggcaattcgcaatgtcgtgcaaaggaaaacgtacaattgcttaggctaggcctaggcttaggcttaggctcaggctaagctataaaatanaatatgagttgccttttgtacgagttgccattgacccgcaaatttattgaattattatgaatttcataaaacatggggagagggtactgtactttatgaaaactgtactttttgtaaagtctgtaaatgatcggcttaaattttttcaatttttttgtccaaaaaacaggaaatattttttctcttttttgtgtgtgccctcctcctcactttgctggtgagagtcaatttaaacgctattcatccctttttggcttaatccgacggcagtggcggaatccggaaaatgccaaataccaaaaactgtgccaaattcaatttttgacacaccatttttcatgtggtggccggaattttaaagcattaattttgatgctatcattttaaatatgaaatgttttagtttcattttgcaaaattaatttaaaattaaatttttaatgtgattttcccatttttaatttattttttaaagaaataaacgtgtcgccaaaatggcatttttttaaaattcgaacacattcctttttttctcaacagacaacttaccatttgatgttcgacacgtgctgtgaaaagtgcgaaccatcggaggagtcggtgaagttctggtccgaattcatcgagtacatgtgagttttgggagttcaaaaattaatttcgagagtctcgagagcctttgctttgattattttcaacaattcctgacatatacaaaagggttttcaatgaaaaaatgccaaaaatatcgtcaaaaatttcgggaatttttctatatgaatttaaaaaaattatctcatgctaacataagcccggaaaaaatgcccgcatggcgctcagttggcaaaaacgggctttttggcatgccgttgtgcccgccggcatttgcctttatttaaattaaattataaggctatgagtagaaaaaagtcgcggatttttttaaatttttttttcaaattttttcattaagatatttttgagtaaaaaaaaaaatccatttcagtactaatgagcctgttcgatctcgacttttttagactttttaagcaccccaattttatgaaaagcccaaaaaggcttttataatttaaaaaaatttttttgaaattcgctaaaaagaatttttaatgactataataaaaactcaaaaaaattaattgttcatcccaacgaatgacgaaagaattataattggccaatttattttattttgccaggatgggcatcattgaagatgacaaaaacatctacacaccagtgctcagtcaatttccacaagaattaaacggtgcaattctcgaatacatttctaattgaatttttattttttttaattaaaatttattacaaaattccattcgttttattaattttgaattttttttagttggccaactgtccgctgcaactctgtggaatttgtataaaacggaccttaaagatgccttattgggtaattttcaattttgattttttcacaattttttcctcgtctcagagcatgccaaaacgaagcgatgcaaaacgccagattatatggtacgggcacgaatttaaaaattctttttacattttaaattaaattttttgcaaattttagaacctctatttccgtgtcaagtcattctactcaaaatatgtggccgaactgccccaatacaaagaatccattcccgaatttcctgagtgagttttgcggaaaattataagtaatttttaaaaaattaaaaaactgtaaaaaacgaaataacaataattaatagggcgtcaattttctgtaaaaattgtttcgaattcatagtttaacattttaattctctatttaactcccctttttattaaaaaaatgtataaaatggtctaaaattaatatttaaagcatttataattttgcaattaagtttggatgggaaaatgagaaatttattaaaaaatgatttaaaatttttcaattttaattacattttgacatattattgcttattttgttcatattttagtattctatttatttttctatcgttttcattaattttcaattagcttttatgtttagattgtttttttaaaatagattatatatttttaaaatgctaatttaaatttaaatttttaatcgttaaatatttaaagaatgatttttaatttttctgccaattttcaattatcataggtatataaaattgattttttaaattagttacatatatatttttaaaaaggttaatttaaatataaattcttaatcgataaacatttaaaaatggaatttgaaattttttcagcccttaaaatctgtgccaaatgaatttttaatgcttcaaaatgccacccatcgcattttgtcccttttttcccgtgcattttcctctcttttctaatgagcatcgaatgggtgggcagacggaccaaaaagcttaaaaataaaacatttttctccactgtttttcccaagcgacttaatttgacgattttggctttttcgcattcatttcgacgatttttttagtaatttgaaatggcaaaaaaaaaacacaatgccaaaaagcaatgggaaatgaatttatgtattatttggaaaattgaattagaaaataagggagaaaattgtcaacattccaccatttgtttttcattgtttatgaattaatgagttttcctcgcttttttttacttttggcattctgtccatgccaaaaatcaattttgttcactttaggtggtttgttccgtttgtgatggattggctaaatgagaatgacgaacattcaatggtgaggcatttcaaaatttaattttttaattaaaagcaatttgaatttaatttaattatgctttttaattttttttttaaattaccaatagtaataataagaaaataattgtgcctaaaatttttctaattcatatcaaacaatttgaatcataattcagtatgttaattatttaatcaattcaaataaagtaattaaaagcaattaagaggttcatttgactaatttttaattaccttattataatttaataaattgcttattgaataatgtctataattattaaatttagttctaatttggcaccatttaaacaaattatttcatatgagttttattgtttttaaaaaaaatttaatttaaaatttaaaaaagcattttattcctaattaaggatattttgcgaaatgcatacaatcgggacaaagtggacaatttcccacaaacatcggagcacaccaaattcagcaactccgtggtggacgtgttcacccaactcaacgaggcgcttaaagtgctcaaacaggtggccaatttcaaacatttgaattcattggcaattttaatttttagcgccgcgaaaatttattt

SEQ ID NO: 17356 - DNA, 1626 bp, Heterodera glycines
  misc_feature (24)..(24): n is a, c, g, or t
aaaatttcgattttttgcaatttnttgtttataactctttttaataattgtctgatcgcgaagcaatatcttagaaaaagtttctaaacatattaagctttcgaatgataccaacaatgttggatttggattacaatgaaaaaagttatagtgggaaaacatgctggcgcccaaccgtgcgcgcccaactgaggtagaccggatctcgacagtgttggtttcgacagtgattgatttcgacagtaaagcttattttaaaaaaatttgttctatatggcataagtctcgttaaattgtgacaattaaaatgataagaacatggctcttatacttgcagaggggttcgagattttcgaattcttgcttaagagcctgcagatttgaattttggcacacaaacccggcattagttagcagattttcccacacgatttgagaatcttatctacgaaatttgttgtatttttgactacattacagcaggagagatatttgtatagaaaaagtgaaagcgataaattttttgcaaaaaaatcatacaactcttattttttattacttacttcaattataaattttgttatgcaaattgtatattcatataaattcatgtgtacaataaatcatgtagaaaattaattaaaaagtactttcgaaatcaactactttcaaaaccaatcactgtcgaaaacacctgctggtacgcatactattaccggatttttaacgaaaaaattcaaaaaaaaaaatgcgtacgaagtgccaatctgttccgcaaagatttttaaattttacgattttgttaagaatagacactcctaggctcactcatttctttttctcggtctcggctctcgttttttgctaaaaaataattaacaaaaaaattctttgtaaaattattcttgaatttgcagaaaacacccttcattcaacgaagccgtcaccagggatgtgcgaaaatcacaaaaaaaaattttcgtatacgaaaacgaaacgaaaaagggcattctatacgaaaacgaaacacgaaacgaaaaaagaaattttgaaaaccgaaaacgaaacacgaaacgaaaaaattttgacggacgaaaacgaaacacgaaaacgaaaaaatagccattttcgtacgaaacgaaacgaaaaaaccgaaaattttcagaagcagatttcattcatagtcaaacccataaagcaataaattgtgatgtaaaaataattgtttttccaaattttctgacgaaagattcttccgtagatcattcagcatgaaagtggcagtcgaaaagagtcgttccacctccattgtacccataggcgcggaatggtatttgcgaacaaggggaaccaaaagcgaatattttgctaaattggttggttgacgccaaaaaacagccgatgtgccctcgaacaaggccgagttcaaataatcggaaacttgctaaatttttgaataaacgataagacaaaaaataaataattgacattacccctgcagctcttgctttggcatcaattagcgacggcgtaggtgatgggaatgcttggaaatacaaaattactgggggactggtccataaggaatgttttaaaggggccgcgttttcttcttgaactccaaat

SEQ ID NO: 17357 - DNA, 1009 bp, Heterodera glycines
  misc_feature (984)..(984): n is a, c, g, or t
atccttgaaaatgtccatgtaagtgtggtcaaaatattgcactttgtatgcagggtcgagaattgtagccaataacaagtccttattccgctcccaatctatacttaaaaattacggaattttccagaattaatacaaaagacctttcattctttcctctaaagattcggcaattctttttctaatttctggaaaatcatccacagccgtccagtgtgtcaaattttgtttcaaaactttgtataacggaagaacaccggaaataccgcttttccgattctgaatgtgcattgttgcgcgataaattggttggagtattttgcataacgttctcatcattgtccactcggtactggtaaaacaagggaatttggcatcttgggctggcatcatttcaatggccgatttgttttcaagaaaacggctgaccattaaataagttgaattccaacgcacttcgacatccttaatcatagattttgccttgttatttatttgaattttattactttttgtaaagtttttagtggaagatcattttcaatttgcaatgctttgaaatcgtcagcaattatgcgcgattttattatgcgacggattgcttttttcattcgttcctttacatcgaaaaacccaccaaggagctttaagccatctccaacagccttaaaatagccaaatatacacaaaattaaatgtattttatttaccaattgaattttgtgggcaaaacattgcatggaattataaccgagcaaattggtcgccaatttcatcgcactttcgtcatcacgtagaatcaagtgcaattttttatcagtaatttgataagcgttcaaagtcttaaaaacacagacatacattttaagctttacccaaaaacaaacttttgaaaccatgttggaaaaattttggcctgtatgacgacctatcactggcatcgccgcgagcacaacgaatttaggttcaagaagacggatccanaaaaatggccaattataccaaaaat

SEQ ID NO: 17358 - DNA, 2556 bp, Heterodera glycines
agaagccccgggggcttataatcgaggaaatacggtaattagaaaattttccaattcttaggggtgtattttaattatacgccaaattaaaaaaaaggctcttaccatttccttttattgaccgaaatttcatagtaaaaaatgtcagacgaataattattgttcagcaaaatcggatgtttagcgaagacggaacaccaagcttttgagaaaaaatagctacaaaaatttgttcaaaaataccacgatcttttcctttgtaatgggcagtcaaacttttgccgccaatgattttgagatctttgtgacaagcggtgccatcccaaaaattttgtcggaaatttaaaaacacctttaaataattcattaaatttattaaataattgtttaaattttaaattattttttgaaatgaattattcacctttctctccatttcgttgattttttccaaaattttcttctgatcattttgtatttttgagaattgatctgaatttgtttaaattagtttttaaaatttaaatttaaattgggcaattaataaaataaaataaatatcctttacaaaataactttttaattagataatttattcttagctaaaattccctcgcctttggtcgtgtttacgttctgtttctccaattttgacaattgatccgcgttagcttaaaaaaatcaattaaatttaattatttaaaattgtcaatttattttttgctttaattcttctcgccttttgactgctcattttgcttctcctccaactcattgattttgtccaaaattggtttcatttggccggcagaaactgaaaagtgctaattaaaacaaaaaattatcgccttttgttagattaccgggacagctaaaaaatcgaaagtccaatttttggatttaacatttttggttcaaattcaatggtttcaatgcacagaaacaatctaaaagccataaaccctgcaatgaaagatcatttaagccgttaacaaaattgctaaacccgactttttgcatgaattcgggttccgagattcagattggtcgaaatgaatgccgaattaaaaaccaataaatgaaaaattttgtaactttttgaactgatcaacggatgcttaaactcggcaaaatatttgttctgtttaaattatattttttgataatcccctaccgtatttcccctgctgctcattttgttgcttctctttttccttttccatcatgtcaattttcgcctgcaacgcgtttcgttcagccatcaaattctgtttttctaattcggacttaagcgccctctgaaaaaattggaaaactgaataattaaatgaataattttaattaaaaacgacgaacattctcgagatccttcatcttacacaattgtttcgtctccctgagctccgtttccatcttggcacatttctcacaaaattcctgagaaaagttttgaattttcaactcagaaaaaactccacaaatcgtgaaaaaaacatcgtaaatcgcgagaaaaaaacgtcgtaattcactgatcgcgcgtcgcggtcgcgtcacaccactaatgtaaacaccacttaacaatgcgattcgcccaccttctgttgctgctgctgttggtcatcaacagtttcgattcgccccgcattttcctctgattggccatccgccatttttcgtttcagcaaattgctcattttaaaaataataaaatagatcaaaatttgagctgaacaaaattaaaaattgtttctgtaccaaatttatgttatgttaacaatcttttctgaattttcataaaattcccggcgatgtcttttggcaccgccggcggtgccgggacgaggcgaagttaaatttaaatgggaatggggaagacattcgaaaagaggcacgtacagggacggcgagtagccttttatattctatggcaaactcagtcccatccattttttttctaaaatatttagcgtgaaattttcgagtaacgaaaagcgaaaaaagttatttttatccagagaaaaaaagctttttcttcacaatcagtgaaaggattatgcgcgttttgtgtgcgtgtgttttgttatttgaggaagtgtctgaccaggcttaactttcgaattcgtttgtctctttctctgcactcatcttcttttgtctcctttttctaattaacaattattattttctctaataccggtatgtacatatacaagatgatccttcctgatttttgcttttcgaatgaatttttttttaccgaattgacaagcatcacccgtttttagaatctaaagttgtatgtaccaggaatggcattccgaggccccaacaatcggggttcggggtcggggtttttcaatttttgccttataccatatagtcaaaaaactttatattatttttttatacattaataatttatgtgcttttttatttcataattattttagtatagaattaattaaaaacgcataaggcatttttaaaatggcaaattttcagtgaaaatctgtaaaatagtcaaaatttcaaatttttcctagcccgtaaaagagg

SEQ ID NO: 17359 - DNA, 905 bp, Heterodera glycines
aacaatttttgtcaatttgcaaaaatgactccgatttgagcaaatcatccgcattctcatcaatataacgcaagcaatcgttgacaaagttctaaaattaaaaataataataatgattaaacgattaattaattgtgtgttattttatcattaaaaaagtaaattaatcgttgaaagatcaatcatccaaagaacaaatttaaaaataatttaatgcgaaaataattttaaaaaatagttcaacgattaattgtattgtttattgtcaataaagaaaaaaaaagtccaaaaagggaaaaatccgctcacattaggacaaaaacaaaaattaaaaagtcctcaagtaattgcagaaacaattaaggaaaaccatcaccgaaaatgtgaaataaataaaaggagtcaaaggtaaatgaccaaacaatttttaatattttggctttgatttttccggtctatttaattggaatagaaatagttgcccgccctacaaaagatataaattttttgcaaaatttgatatttcgcattttgaaaggatttaaatttgtatcgatgaaaatgcatccaaataacaaatttaaaaataattagtgcttaattatttaattttcttcccacctccaagtcgaaaagccgagcatgggcaaacgcgaagaaaacattgcgcaatttggagatgggaatttgcaaagctgcgtcgaccagcgcagggatgttgtactttttggctaattgcgagaattcaatcgattactataaacggcgagaagatgccggatgaaaatttttaaaaatcaacgttttggggtcgaaaaatgagcgatttgaaaaaaatttcgtttgcttattttcgtgccgggtcgggaattccgtgccattttatcccttttttcaattttttg

SEQ ID NO: 17360 - DNA, 1443 bp, Heterodera glycines
aaattggaaaaagacaaattttatacgcaattatttttctcaaagcatgaggggacaacacttaggcccatgactgtattttctttaatttcaataaaagagataattgcggaagggtattttttatcctaaatcaatttttgcttaataaaaatgtttttaaaattaattttttccccgtgcctgctgttccccggcgaatggtcctctccccgtgccccgttcgagatgatcctccccgtcaacattatcgcattttccgcaatcccagtttggagcattaaagacccattttttaaagttttagtttgaagtgaaaaatttcaactgatttttagcttttttgtttttataaattttatatgaaaaaaactcataataaaaacaatgatgatcaattaattataggaaataaataaaaagttaagaaatgaaaacattaagtaagttaattccctagagattagagcatcaaaagaataataataattaaagaacaataattaagggaagatgaaaagaaaaaagacaaaaagcatagcgagattacgtaatttatttccttattattaaattttggttttctaccgctaatcgcggtcataatcattagccaactcattagcaaggttgtatttgaagtttggaccaaaatatgctacaatttcagcgtggcggaagggcagcgagacacacggaaacaaattgcaaacggtgcggacaaaaagtccggaagtatctgaaaatttaaaattttaaaatgaatttggacgattaaatttaattgttttgtgatattcctacccaagcgatgcccattctttgtgtaaatgatttggcgagtgtccaaattcaccccacacccgacaacatctccagcagaaaaagatggcaaatcaccggacataaaccgacgattacctgtaattttcggagagataaaaggcaaattgcgtaaaaaaataattttaatttcagtaaaattaccagaatggccccagaaattggcacaatcgaataggccagtgccgtaggcgtatgtcccattgtaagtgccgaccatttcgtttaatggcatttgctcggtggcaagtccaatggcaatcctactgtaaaaaaataggtaaaaatgttggaattcaaagacttgcaaaatatcttacaaataaattctcatttcttgaagggaataatacggtaattcttttaatattttaattgcgaattttgcgacaaaaagtagggttgagcggtaccggtaccggtaccgaccggtaattaccggtttttttggtaccggtaccggttttttcaaaaatcaaagtatcggtaccggtttgtctagtaccgatacagccggtaaaaatttgccctggtaagaatgggggtctggatggaaaaaagagtagggaatggtgaagaaggagaaatttttgacctgca

SEQ ID NO: 17361 - DNA, 885 bp, Heterodera glycines
gatagaatattattcatattttctttacgcattattttaatcgaaattctaattaaaaaaaatattccaactctttttctttcattttaagcatcttaaaaacccaaaaattaatcaattggtctttttttacaaattctgttaacaaatcgcattaaaaaatacaaaatttttcccggcggcgcctatcggcaccgccggccctccttgttccccaaaagtcttgagaaaaacgtgccgcgaaaaaagcggtgttgaaagcaaaaaaggtcattgatttacattaatttacatggccggagaccccttcgcaaaattggaaaattggccgctgatcccttgttttgcattaatctgaattttgaggtctacatctgaattttagtgttctttatcctgaatttgaaaaaaaaacttggtcaccctcaatatacatatacttctgaacaattctaatgctaaaaaacaggcactcgcgcgaaaactgaataaaaattttgtatttgaaaaattttgtccaaaaatttttacgttggaaaattaccggtttttaccggtaccggtaccggtggaaaaagttggtaccggtaccggtaccggtttttgcattaccggtcagtaccggtaccggtttttttacaattaccgattaccgctcaactctaacaaaaagagttagaaagcagacactatgccaaataatttcgtgaaataaaattgcaattttctaagaaatttcgcataaatccttaggcattataacgtttaatataaaattataggggtttacaactgtaacgcaccaacgattgaggtcacccgtgcataaaattttgacttcgacagtagaaaattccccgcttcggaattggctgtttggccagc

SEQ ID NO: 17362 - DNA, 3537 bp, Heterodera glycines
  misc_feature (47)..(47): n is a, c, g, or t
agtgtccataaatttctataaaattggctgaagaaactcctcgaggngtgataatttaaaaaattatcacgtcatttacctttaaattttttatcaatttcaaaacatatgagaaaaatttttgaaccctttgttaccaagaaaaaccattttatagaacagtcgaaatcattaatttatatgattttttttattatcactaaaagtctcaaaaacaacaaattaaactaaggatttatggacattgataaaaacggcacacgaaaaactcattcttcattgtcaggctaattgtagactaaaagcaaaaagtaaaagtttgaattctaaattttttgttcaaattcaaagcccgtaaagaatcgcaaaaatttggcagtttttaatgaaaatatgttaacaaattgcactgaattttcaaaaaaaatttctggcgacacctagcggcaccaccggacgccgcaaaaaaaaaaggtcgtcaatttcatggctggaccatttcgcaaaaattttggttgacccccccccctttttttcatgtatgttggtggaattgtcatgtaactttgtgtttcccctttaatagttgttgcttggtgagctcaaaacagaattggatgcgttcaacagcagaaccaccggcagaacggagaatggcactgttaagccatcgctgatttgcgggaaggaggaggaagagacggagcaaatggccgagtcgaagtccgaattgggcgacgaattgtggacgggcatggaagggcctccggtgaaggaaatgaaactcgagacgagggcggaggaggaagaggacgagttcgacgaacagtttctgtgagtttttacttttcatcatcgtccgtttacactttccattttttcagaaacgaacccaaaacaattccaatggacacagaaacactcactgccgcggattctctccgctcgcatttcggctcactgaccaaaggcaatcagtgccttttttattgcacttttgtaaatatttccgtctcttaggaatttcaaaccgaatgcatcgttcgtctcttctcagtgcctgggaaccgccgacttcgtccgcatctattctcaaaaatcccgaacaacagcagccttcccttttgtcggacattacagaagtgttcagtgcacaacaaaatgtactcggtccatcgacttcaattgggaaaagtgagcgaatggccaaacattgcgacaattttccattttgttttaagttacggaaatgactcacaatgttccgttccaattcaacgccaaagttaccgttaaagagctcatctcccaatcatttggagagacaaaaggcgaagaattggccaaaattgtacaagccaaaggcagaccaataacaatggcaaaagacagaagcaccgaacagtccaataaaagtggcgaaactcagaggcaggacaatttgagacggaaatcaggtgggaattaatcgaattgcttagttgtgattttgaaagaaaaatttaaaacagcaaccttccgattttcagggttggccaacgctcttctgccttccccatttacggatggttttgctggttcaaccaacaaccgattgacttcccatcgtatcgcttctcccgcctgcgcttcgacttccaattctttgtcagagccgccgtttgaggaaaatccacaaaaaaattatgaaatggtcttgacttcgacaccgtcgacacagtcactcccatgttacgaatcgctgtcggaggaaagcgacacggaaacgggcggcgaaggtcagtgtttaagtgcaataacttaatgacatttgatgccattcccccaatattgcttaattcgtttccacaattctttttttcatcctttggtgttcgtttgcagaagtgacgaccaaaaagagttcctccgtgctttgttctgcttcagtcgctgctgctccgctgaacttcttctccctgttggatctgatggacgaaaacgaacagcagtcgcagcggagaatggaggacgacgccaccgatgccacggtcgacacggccccctctttttccactgtttcaccgctgcaaaaccaacaacaatgcctttcattttttgcgacagcggggcaatgggcggaagccaacaaaagggacaaaaatgggaccgaacgaggggaagcggcggaatgcgtttatgagccgctgtcagaggacgaaacatgacgagggagaaaacgaagcaaatacactcggattagtcattcattcatttgtggcaacttatttccgttaaaaatttatcaaaaatggcttcaatgagaaagacagacaccctttaacagtcagttgtttatgccaattgcacagtctaccttcatcccccctccctccaattgacatttttgaggctttctttttgcccaaaggtgcaaagaagccaatggcaccggcattgatagcttttccatcaaaaattcagtgtacaattgtatctgacggctaatgcatctgctgcttaaaatacatctgctgtccctctcccattcgcactttcttcatatttcatttgccagattcaattaaggccatgcgaagttttggcggaactgcgcctcaatgggcaattaaattattccatcatttgtcagccatcattggcttatttacttggcttttcctttccttctcgccaaaagtgatgcttattcactttataaggtgaaaacaatccgctaaatttggaagtgttaggttccaattaactatttgtcctccttcgacttggccatgtctttggccctttgcgcagctccctttttcctttttgctctttcttcggcttctcctcccttcttggccactttcaacggttgtccccaactgatcgatggccaattgctcgactttgttaactccgggggcattcggctaacaaaaagcaaaacggggaattgcgatcggttgatcagctgcgatttgatcggggctccagtggaagtgagtgagagaaggaaaagggacgaaacaatgccaattgatggcactacggttcagctaacaaaagtcgaatggtacgtaaacggaaggaaaatccaacggacgaacgaagggacggaaagggaagagacagcggaaaacgcacaatcagaaaacgaacggacagaacgaagcgcaattggagtaggcgaggcgagtcgaacgaattttgagggaaagggaagcaatttggaggagtaattagcgccatgggcaccgtttctggctaaacaaaactccaaaaacacaggcactttcccattgtgcaggtgagtcaccgtttctgtgccgacaattggctcgttgatgagccttcgcttaatgagaatggcatggaaatggaatttcgttgtgcggcgtcgttggactgcggcgagcaaaacatcgaaagcgaacctttgctttttgttggcactgcagggcgaagaaagcgcactgcaagtgagcacactctggggaatacactctgcctttttggcatttgccctccggcaattttgtttttgccctttttctc

SEQ ID NO: 17363 - DNA, 3603 bp, Heterodera glycines
  misc_feature (3527)..(3527): n is a, c, g, or t
  misc_feature (3574)..(3575): n is a, c, g, or t
tgagtgcttcttcgtattcgatgagtttcgctttcaatatctcatctctgcgctctttcctttcggcataaacatctaagctctttcgaataaccggcgcatccttctcaccgaagaattcaattaggaccttgagtttttttttgattaaataataattatggttaaattaaaatcttacatttttgtctccgctgtcaataatttcctgccaaagctcctcttccggaggcattttcccaaagattcgcttctcccactctatcacttgctcgggagtccatttctcaacttcctcgggtgacggatcggtatccacgtcatcgtcatcttaagttatgcaaaattttgtgttatgagtaataaataaaaataaaataccgtcatcgatattttttggaaattgtttgttttttgatgggacggacattattaataaattgtttgaaaatcagaaatgaaaaaatgcaactttatttatattaatattaaagtgactaaaaatgaatgaaaatctgtttttatacttgttaatgtttacttaacctatattcttaactattataaatagcagttgaatttcttttttttcattaatcatcttttacaaaataattttgcaaatttcctctataaaattaattaatataaatctagattaattagaaaaatggtccttcttgctgaaaaaattgcacaaattttgaattgtcgaattaatgagctccgtgatcgtctaaatcatccatcggattgtgaaatagttgtgaaagcattctatggaaagcatattcaaacaacatacaaggacagaaatggatacaccaaaacttggtttttgggggtattactgcgcaaggagctgcaaccacaatggcatatgggcgattaggtagaccttacaatgttaatgtggcggcacatttctacgttcggcaccgtattaaacttcgccatccatttcttcattgtgtcatcgaacgctttcctgaaggacaagaggatcgattttatcctcttgagttatgcaaaattgaggaagttgatgaatcaaaatggcttggtcagattttcaccgagattgacaacaacaatattagtgcaactaattcaacaaattttgctgacactcaaacttcaaatgatgattcgaaaagtgttgatgggcgcgatgaatatagccaaaatgattgctactctttgtggtagattaagcattttccattttgtatcttctctctcttaattttgccatttttcacccaaaattgacctcttctattcctaatatttttcaatttatatttccatttaaataaatttttctttttcaactttatgcaacgaatcaatgagtggaataaccaaaatcaagcacacgaaaatcacgagagcaaacaatccctttgccaacatatggtttatatattttttgaagtggtgcggaggtgacattcccatcttttacaatggggcgtaggaaatgaggatacaatactttgattggtggtgattttccggtacgtacaaattctaagacgcgagttttgaaagtgtcgtaacaaagcccctgatttttggtcacatcataatttagggttatccctctaagtttgagcacgtagttaaactcattttcgctgcccttcttccgaagcttcagaccatattgctttgctccaccacttataaattccaaaatgtcatgctgaatttaaatttatttctttaaaatcaaaaatcaattacctttggaaattcgtccgtaaactcacccaagtgaggacccgtctttaaaggatttgcgccttttgggtgaacttaaatcaacgaatccgtatcttaaaaaatttaattttttcattaataaattatatttaccagtgtataaaatagtacaaccagaggttcgcgcgactttctgcattgcttttagcaagtgcagccgagctgcagaagttgtgaaaagtgaaatgacaacgttggagcaggggtgttcctgaacccaatccttcttctgattgtagctgattaaaatccgctccggagttaacatgtcgagcccagtcacttcgatcctccgattgtcaagataatttcccagctctgatggatcatcagttataaaagtttgagagagtccgtaattacggagggaaaaacgaccccctaaatttatcattaaaaaattttggttttttatacaacatacataaattgttcacagctaatttggccaaggctcgcttccccttgtttggtatcatctttgctcggtcaatttttatgtcaaaattttcccgacattcctttatgaatcgttcctcggcttcaaaatttccgcgaatttcttcatcaaaccctgatgcatgtaacttttggaccataaattcactcatgtagggtcgaaaaagttggttgtcacttttgttgtattcaagaacgcgtaaaagcatggtgactctgtatccctcctccagtgcggcattaagctaaaaaatattaattaaaataataaaatatttaatacctccaaggatgtgcatgtactgatccatcctctttgtttatcagtgtgttgacaattgtatgtttcccttacacctccattagggtattttttgcaacaactcatgcagagagggaagcatagccgatcatccactttaactggcaacaccggaacatcgatttttcgtggcggaatgacgaacactttgagaattgcaagcggataaggattgtcctctggtctccgccaatcaacgtcctcacacggaacatgaagtgttgggtgtccaaccggataatcagttacacaactataactttttttttttggggaaaataaaattttcaattttacttgatgaatggatagagactggtaaagtcataataactgatttcttcgtccgctgccaactcgtggtaaagcttcaatgcacctgttcttccacccataaaacaatcacgaatattgattggcccgccatctcccgtatattctttgaatttctgtttcatttccctgtccttggacagcatttcctcaatctcacattgccaaaagatttccacatttggaactttggtcaatataaattccattctctgtttgtttctctcccgaattcggcctgcagatttgccacaaggcattacatcattatcatccggataacattttgagcatgcatgccatacacagccatggatttctagtccttttcgttgagactcaatccaaccgtccaaacgaaaattgccaactcttgagaataacttttgctcagaatccccactctaaaattaccttttctctccttcagccgaaaaagcattttgaatccgaaccgcatatttttcggcgtaccactgcataaaactcattgccaaatcactttgattgtcgccgcagctatcgtatcctttttccggaacaagagccaagtgaccaggctttaaatgattagttcggaaatgacgcatgcatgctgatgcaattgttatgcaatgcttgagcnggtcaattccgttgttgtggagttgtgtaagctgctcgattttgctnntccgtcgggatcagcaggtcgcttgctc

SEQ ID NO: 17364 - DNA, 992 bp, Heterodera glycines
  misc_feature (916)..(916): n is a, c, g, or t
agaaaacgaaaaggggaactcatcccccaactgtacacaatgtacggtagaaaaacgaaaggggaactcatcccccaactgtacacaatgtacggtagaaaaacgaaaggggaactcatcccccaactgtacacaatgtacggtagaaaaacgaaaggggaactcatcccccaactgtacacaatgtacagtagaaaaacgcatcccccaactgtacccaatgtacggtagaaaacgaaaggggaactcatcccccaactgtacacaatgtacggtagaaaaacgaaaggggaactcatcccacaactgtacacaatgtacggtagaaaaacgaaaggggaactcatcccccaactgtacacaatgtacggtagaaaaaagaaaggggaactcatcccccaactgtacacaatgtacggtagaaaaacgaaaggggaactcatcccccaactgtacacaatgtacggtagaaaaaagaaaggggaactcatcccccaactgtacacaatgtacggtagaaaacggaggaaaaagggaaggggaagtgccaaaaccgacccctactgtagttgaaagagtcctcacaataaactgccaaaaacattcattcattcgcccccaatgatcccaaaagggagcacagtccggccaaaagcatgagcatggtgttcgaacttgcgcaccacgacctgttcgacgagatcacgccgaagatgggaaacaacgaccaccagtgggtccgtcgcactttctacgacattttgcgcgccgttcggccggtgcacgcgaacggtgcgaagcgcagaaaattgaaaatggacacaattttaaggctttgtacacggagatctcaagcccgaaaacatggcctatttcaaggccaacgcgggttcatttccagcagcggacgatgccnaaacgaacgacggattcatactgaagccaatcgactttggcggatcgatgagagtgagcaatttggacagggcatg

SEQ ID NO: 17365 - DNA, 304 bp, Heterodera glycines
ataagtatttttatcactgacgcattttctactgacgcattttccactgacgcattttccactgaccgattttccggtcacggaccgagccagtcgattttatcattcataattctataacacaatcgtactgcctagcgggggatgcgccgaagggactgggtcgttttggcgccgacgttttggcgccagcctcagtttttttattataactttttttctttttgaccaaatctaaaaatcttggtatcattcgaatagcgttacaaaaaataaacaaaaattttaccttctaaaaaagtta

SEQ ID NO: 17366 - DNA, 1609 bp, Heterodera glycines
atagactttcaccaaaaaaggccaattttttcaattaaattaagtcaagcgacgacttttttgctttaaaacactttttttgcggcgcttttttcaaaaaattttggaggatggacggagggtccggcggtgccgataggcgccgcggggaaaaatttttgcgattttaatgcgatttgctaacagttttttgttcaaaaaattaccaaaatttaaatcaggacaaaatttgatcgctacctccaaatcaggacaaatctgataaatcaggacagatcgcatccctgtttaaatcccaaaaacattgtctgaattgaaacactggaatatgctattgctaattgctagctagactgcccctttttcaacttaaattgttaaatttgggctctactgcattttaagcgtccaaatgactgttaggtaattagccataacgacctattttattactcggacaatacatatctacattcttggcatcaaacaaaagcttaaagtctagaaaatttttcatgatatattctgtttactcttttcttgtgtttatgaaatttactaagaataattatgatcggataaaagaaagttatggcctaaaagtagaagacaggacttctaacagtcgattggacgcctaaattgcacttgagcccaaatttagcaatttttattttcaaaaactgaaaccataaaagaaatataccatattatctccatttaaccccccggggataaatagaatttttattttttcgaaaaaataatttcttttaaaatttaataaaaattaattaaaatcgaaactaatttaaatgtttaataaacatgaaaaaataatacagaaaaatcagttaggtacttaaccgggatccgaacctcaccccacctcaccctcagaatgttgcctcagaatccccatttatgcaggattctgaagccttaacgaagtcctaaccaaaatctaattccaaattcttgatcagcgccctaaaatacacctaaagactttcttcaaaaaagataaaaaatataaaataatataccttgcaatgcaaaaaattacaaatttctgtgtttcttaatttacgaaaagagcccggatttttcagcatcaaaaaatgctaattaagcacgaaataagcatgaaaatggcaaaatgagcacaaaaatcgaaaaaaagcataaaaatttggtgctttttagtcaaaaattttaacagttaataataaattctcaatttttcttattttttcttagcaaaaataaacatttttaaatcaaattttgtctagaaaaattttgggaatgaattttgagaaaatttgcgtaaatttcccgggctcaaaaatgaaaaattttcaaatttaaaaactaattccaaattttctgaaaaggttcatattcatttttgaatattttggggggttttgtcaattttttataaatatttttgtattttttaagcaaaatccaaaattttttaacaaaatggaacggcgcccccacaaaatgtcccagccacgaaatgtccaagagtaaaaacccacgaaatgtccaaaatttttcaaaatttataaaaacaaaatgaggctaatttggggttttt

SEQ ID NO: 17367 - DNA, 910 bp, Heterodera glycines
  misc_feature (7)..(7): n is a, c, g, or t
cggttanctgaaagaaatttttcaaaaacgacattatatatatactgtgaaatttggtaattgtgattggactaattcggacctgctgtagactacctaatttttgtccagcagcaaattttttttgtataaattcgcgaccaaactccattttttgtcattatttactttttttaaactgcacaaatgtcgtttccgtttattttatttaatgtcttctctaatcatacaatttccttgtaaagttccaaattttccctgtgtttatttttgaattccaaaaacattcattcccagaattaaaactttggaatatgctattgctaattgctctagaatagactgtccttttttcagcttacctaaattggacgcctaaagtgcaattgaacccaaatttagcaatttttgttttccaaaacttgaaccataaaagaaataacaaaacgcttttctaattgcttttttcagcgatacttaagcacacatatttgtctactaattcactgttgtcagagctgccaatcaatgatgaataatcatccggttgctccgctgagttggcgcagaatagttgagcatctccagtacatcaaggtaagcaagcagcggacggacaggggggttaaatataatccccattgattgtcctgatttccgaatcttttccaggccgtctttccgtatttttaggtacacgttttggaggcatctttcgcccgtgcttgggtccatgaagttggtcatccaggtgagacaaattgacaaatcaattttaatgacccctttcttctccctcattaaggctgccattgtccgtattatgaaaatgcgcaaatcgttgaagcatcagctgttggtggccgaggtgctcaaccaattgacaacgcgtttccagccaaaggtgggg

SEQ ID NO: 17368 - DNA, 3507 bp, Heterodera glycines
  misc_feature (25)..(25): n is a, c, g, or t
  misc_feature (3389)..(3389): n is a, c, g, or t
  misc_feature (3454)..(3454): n is a, c, g, or t
gcaaaaaaatttcaaaatgtacctntcttttaattattgccaaaaattcaaatttttgactctgaaatttcactttctaaacaaaaaacatcaatttcatccctttgtttttacgaatttactattttttaattttaggtcggctcaacgtgcacaactttatggaccacaaggatggtaacaaaatttgattttcatatcgaattggaattgcacttcgcttcggtttaggataaagccgagagttctgaacacaaacaaagcatttttggccaggactctcaaatcagtggaaattcatcggagagaccaacagacggagaaagaagcgaagagagcgcggaaagtgagggaacagacgggggaatgacagagacgaacaaaaacaacagcaaagataggatcgggagaaagaacatatcatcgcctttttgtatatttttggtaaaaaagaacttcagaacgtacactgaaatctgtattttgatattgtgtcgtttaaaacgaattaatttttaaacaacagagatgacggatattagagaattataaaaaaatttagaatcctagaaaaaatttatcatcaaaccaagataaaaaaattcattggtaaaaggaggacagcaatggaaaataattttattttgtctgtacaatatacattttgctatacgttttgtctgaagactgttcattgagtgcaaaaatggtcaatttgtttattgggtcttctgttcttcgttctgctgattgtgagacgaccatcggtcacagaatgaccctttcgttgttgttgttctctccgctgctggccacggaagatcttttcgactgatcaaagcctaatagattagatttggtagattaattagggacttatggaggaggatcaacaaggataattgtaagttaaccatccctttcaactgaccggacggtggcaattcgtctttcgaggagtgaattgcccgcccgtagccctgcgttcgacttttgatttttgagttctgcacaagggacaacatctttgaaattgcttggggactctccactcctgaatttggaggagttttaaattatttgatttgagtgcaaatttctcaccaaattttggtaaattgatcatgcctcgatgcctttcgtgcgaatgaactatatttgattggttggactgtgaagaaagactgctcggcgaaggagagggcaaccgacgccgggaaggaacatttgagttgctgtgatggaattgctgttgggaagaactgctcgcacccgaggcagaggaaagtggcggttcgcaatccaatgaaattcggtcgaggtcaatctgtacaatttgttggccattcgtcctaccgcttcatataaacggcgtacctccgaatcaatgattgggatgttctgcaggtacgccttcaccctgatctgcatcattgtgcgttcgtgcagctttttgcgcgacaccgccccgccactgctcgaggcgaaacggccgctcccgtggcccaatgcggcgacatttccgccgcttttgcgcattgtgcccgggtccaacagctgaccaataaaaaagtgtaataagccaaacaaacctcgacagagtctttgccatccaattcgaattttgtgactgttcccccgtaaatttctcacatttgccccgccgatgagcaccgattggtcgtagggtacgctgctgtatcgttggatgttccgcacaatctgcgcaatcatccgcagcttctcgaagttgaccagctgttgcgcgtcgttgcaaaatgtcgggttggcttcgtgcgcaaagatcaaatccttgcgcagaaccgggtaaatcggaatgaccggtgggtcctgcgcgaattgggccaattgctggcggtaacgggacatgttcctggacgggtccatcatctaaaaataatgcaataaaaccgagttgaattagtgaaagtaaaaatgaatacctgttgcaagtcggccaatactttcaaatatttcctgaattttatgtaaattattttctaatttttgtgtttttttcatacccaggaacgcgttcccaagtgtgcaacaatctccgaacggcctatttgtaaatttgattcaattaaattgatgcttttttgttaattataagtgtaccggcttttcgagtccgctaatgattgcaaacattgagttgaggtttcggaacactaaaccagaaaagtgttgggaaattataaataaacaataaaaacattggcattgtttggcgattttgatgaattttttgaccaattttgaccgtctgtacacattcctttcacagcacacttccgttgccacccaccacatttcacggttgaatagtaacttaataattatgttaacgattttacaaattgctccgaccaaataattagggaaattttataaaataaaattgttaagctaaaatgcacttcgaactgctccaactttggccacccttttgatcgaagagagcaagggtcttcgttgtcgatgagttggaacaaattgttcacatattcagtcggttcaattgcggtaaaaacggcgaaatcctagcaacaagaaaagagtaaataataacaataaaacatggattttcgtcctccttaaatcccactcaatttgactgctcaaaggaatttcacctgaagtgtcagttgggccgcgatacattgggcgttcagagtgtacaaagtgagccgcgtttgtttgaccaattccgggatcagttcgtcgggcagcaaattgctctcatcgggccgtcgcatgtcacgcaggtaaagccgtgcgttcagtccgacacgttcggccaaattggcggccgagtcgggcagccgtccctgcttggtcacaccatcacgactgaccgaacattcgtacagcgcccaccaaccatcgttctcacccacggggagaccaaactccttaaaatgggaaatgaataagtttttgtggtgaatttacctgcagtgccatgagcatcaactgtttggcgcttgtctcggccaacacggggaggtaacggaagttctggtccactcggtacactttgagcatttgcagtggctgaacaataccgccaaaagcggcgtttgttcctgcagcaccgccgccacagtttgtggagaaggaactgtgccgatgtgaggcgacagagggcacagccgacgaacaggaagcaaacggataatggacggagttggccgaaatgtccgggttcgaacggctggcacggagacttccgctggacgaaggcggcacggagaactgaaatacaaaatgaaacagtcttttggtattccaaaaaaaaatttatttgataattaaatttcgaaacgctggaagaaattttcaaagttaattcttttttttanatttcggacggcaatattccggctgcaattttggggtacacccgcctcagggggtcctatgtttncacattctctggggggatgtcagtgaaaatacaaaagatttttaaaaactcaa

SEQ ID NO: 17369 - DNA, 1992 bp, Heterodera glycines
tgaaaagtaacaaattaatcgttccataagcgatcacctttaccaaagcaatcaaaacccttccatcgatccattctttggtcgccgccacattaatcgcctgaggcggaggacgagcgactgctgggcggcgtgcgacgtttcctgctgttgtcgacctcggccgcgataggttgctgctcatgctcatctgctgcttctcggggctttgtgtcctttggatggggggaacatttagatttatgtaaatgatattaatattcggaagggggagggtttatccgaagtatctttgctattcagtctcaaattcccccccccccatttttacttacaataacatataaataatttctcattttattaccccacttcttctgcctttttgttcatttcccaattcaccttctcctccctgtctctgcgttctctcttcggcgacggcgagcgctggcgacgcgccgaacggcgaggcgaacgactgcggcgcggcggtgtgcgactgcgcgagcgactgggcgagcgcctacgacggggcgagcgagtacgcgaacgacgacggcgtcggtgactgtcctcctcgtcgtaataacgtcgcggaggaggcggcggtccgcgacgataagtcgcaccattcctggaaaatattgggctaaaaatgaaaaactggctctgaattttgtagaacattgaattggcatcaagtgaagatccttttcttaacacgaaaatgctattgcgcgacaataatcgtggagaaatgcttaccttggaagagccaccgtaacacgcgcacgacaccctttgatgtacgccgtgttgcccaagtctttcatgcaggcggacgcatctttgttgttttcgaacacgacaaaagcgtagaagggagggtaactgaatggggatttggagtagatagcagatttttggtaagttttctgagttatgtagtataatgtgtccgaaaagggtgaaaaatatatttattccatgcaattgtatctttttctgattatttttgaaaaatacaacttgcaacccgcatttcttttaaattgctaattgccaatttaaatatttcaacatcgaatcaaacctggccatccaacagtcgctgatccgtccatactttccaaaaacgtcttcaatgtcccgacgacggaccgactcgtccaaattgccttaacataaaacatcagcaaaccataaaggcgaaagtcaacccttgtccatttaattatttgcattcctattttccagtgagcaaaccgatgtgcagtcgtttttggccaggtgatggagaacgtgaaaaggtggaacgcgagcggcgccgacgctgctcgcgacggcgtggcgaacgactgcgactacgcgagcgagaacgggaggaagcgctcgaagaactgcgagaatcattagccatttgacgcagatcaaatctaaaaatttaagggaaagtgcgaatcggtgaaaaggaaaatcgttttagaaagagttgggagagaaattcgaagaatttgaaatgaaaaccattcatggtaaattatctaaagagatgacacgagaaaagcgaatgaaaattaagagaaaccagcagacgagtgcttcttttcaatcaatgaaaattggtgtttctcggcggaatagccaccaattccgtccgaaacgaccctaaaaatcttctcagaccatttttgtagagaattttaagctctatcttatgtgctttatttggtctttttatctttaatataaaaaaagttataaaacaaaaatgaatttttaaatgcaaaaccaaaggggggaccccatggatttgcatttcatgagaaatttttttgctcttaaaattgccaaaaaatacttttctagggtaatttgaggtgctgaacacgaatatgcactttatattgcgttttggattttttggagggtggtaaaaaaaatttgaaaaatccataatttttggcccttgaaaatgcaacctaaatt

SEQ ID NO: 17370 - DNA, 1170 bp, Heterodera glycines
  misc_feature (7)..(8): n is a, c, g, or t
  misc_feature (22)..(23): n is a, c, g, or t
gcatgcnnctgcaggtcaccanntttacttggattagaattaattttatgcatttttgttcaataattaccgctaatttgccccctttttatttttgcttaattattttttccccctctaattttgtgaaaaattattttcaaaaaattattttcggccctatgcctccccttattttcccccaatttttccacaggtggcatgccatcgacgaggaaggaagtgattcggcataaaatccgtgcaattggcaaaatggcacgcactttctccgttttaaggtagtcaaaaacaaatgggaaaaatatgactgacgactcattgacaaaaacaaaaccaacaataacaaacaattaatttattaattgcccctaattacccccaaagcccaattacctaactgctcactttgttgtgtatttactataataataccttagcaattaaactgtgtttataatgtgtgaaaatggcgaaaattattcttcgttacataggcttttcgtgatatttttacaaaaagaaaaatctaaattttaaaaataatgttttagctctgaaaatggcactaaatttttcattttctaaggcattattatatacctgaaatttgaatggttgggcgggctttatatttttgaattctgaattcattgggctgtgccatttttgttaatttaatctggtttaattggcacgcctaattagcccccccccctaattagcgatgcgtttgttgcgcttttgctaacaagatttgatcatttcccggatgtgcttcttcttcgctttcagagaggaaagtgaaactgtgctccagctcaagggcctgacacccaccggctcgttgccgctcggcacgctgcaggagggccgcaagggactgcacaacggtacggtagatttgtaatcatcgcgtaccgtccgtttaccgtacaccaacacgcattatcgtctctctttctctctctctctctctctctctctctgtgttcccctactgtatctttttccgtctttctttcactgctcctcattttaactgctattttctttttccattttcatgcttgttgctgattcctactaattgttcctcccatcgtacaagtgggtacggtatcaaaattacgggcttaaatctgtggatcttactgccactcccttact

SEQ ID NO: 17371 - DNA, 1409 bp, Heterodera glycines
ccatccattaaaatgccgaatttcattttgaaaatgccaaaaaattcgcatttctctttctctctctctctcacttttgtttctctcactttatttttcttaaataaaatgcccgggaggctgtgattttagcgagattcccgtcaataatttatacaatcccgaagtattattaaaaaaatttccagtctgactcggcatttaaatcgcgatatcacaaatcttccaaatgcactttgtctttcatttcattttggcatttggcattttgtctctgtcttttttatgcctttgttgctgcatctctctgttctgttctgtatgccaattcctccatgaacacatcagtgtgaatttgttcaacaatttcagcgctcaaaggcggcaacaacgacccgacccatccgatcaaatcgtttgaggaggccaaagcgttggacaaaatcaacgagcaacggtcggttggtccgtgattgattgatagcacagcactctgatcactgctgatcagaagtcgtcaaattgggggcccggcaaatttccattcctttcgggcgtccctaaaaagggagaatggtggaattgaatcacaatttgggatttccatgggcttttgccccctcccccgtccggaaggcatgattagggattaaattttccaattagggatttctatgggacaggcccgtggggtccccctcttttccgggatgcatgtcgggattgcaattttcaatttgggatttcgtcgatgagatttctctcccctaattaccctatttttttttgccatttgtaggcctccggccatggcctcgcacaacgcctcatcccaaggcagcagccgcgacgtgtcgccccaccagaggagaacaacggcgacttccgccgccgcatcgtcggccgccaactcacaaaattcggcgggtgccgaaaattcccatttcaaatcgtccggcagttagtcgatgggggagagaacccggcggcacacaaacaattaaaaaggtgccgacgaaatttcccaagaattttttggtttccaaattttttcaaaacatgttcggaatgccgaaaaaaatgaatgtcttcatcccggaatttgtgtctggcgaattaagtcgattccgtgttctcgaatgatggctttttcgcaattattcccgagtcgggacaacaagcaggtgttttcgatagcagggatcattttcgaccttgagttcaatcattaattgggtttaagcacagcttcgggatcaaatcctaatctcggagtctgagatcatcgccgattcaagacaataattggttttatagatcacgaactcacggagtcaggactgtaattagttttagggattgttaattagagggttcatttttaaatcgtctcgagtcgagacagtaat

SEQ ID NO: 17372 - DNA, 2181 bp, Heterodera glycines
ctttcaaaaattactctcgtcttctaccctccctctccttttgtgactgtttcgttttaaaaattggttccgaaattttttgactctaagaaattaaattgtaaaaattcaaaacttaaattctcctctgaagttttgaacttggcttttcaatgtttttaagtcccaccgtgaggcgggacagttccaaaatttgtaccacattttactgtggaaagtccaagtaccttaattggacaattacttgtcaacgaactcagtcgcctctggcctcttatggaacagaaaaggggaattatcagatggggtgcgtcccttcctaaaaatttctcttttcgtctaaccctccctctctttcgaacgcagcattgcctttgcgaatctaatgccaattaaacaaaaacagttaataacacagtcacaaagtgtaccaatgaccgcttcaatatttcccgacacaaattgaaagaatgccgctaaaaggcggttcaacaatccttctattattgtaaaaaaaattaattattgtttttttaaattaaattaaaaatggaccttgagcttctcttgcaacacccaaaaggtaaatgcccaaccatttctcgttattgtcagtgcttccgttttttgtttttatttgtgccattattttccatgatagtccatttatggtcattttttcgctgtaccgactgctctcaacgtcctctcgtgcaaattcggacacattttcaatgtccattaaaattgtgcccgttttgcgattagaaatccttctattagtcggaaattgcattgggaaaagtccatcggatatccaacgataatttggaagggaatggaactgataaacggcgatcacttcatcttttgataatacatctgatggtactataaaaataaaataaaaaagttttttttaattaataaaataaaatgaagattctattcatcacaaataaaagtttaaaatcggcagcttatcgaatgagttaaaattatgatttattttaccaattttcttcgtaaattcttctgttgagatgagtggaaaacgaatttcgtaaagcgcaggaccgagcatggcacgacgattctctgctgaacattttttggcattttcgaagcatttggcgtcagcccaacggagtgccaaaaaaaaaaatttaatgaaaataaataaaaggattcattaatatttattaatttctgttttctaaaattactgctttccaaattgaaatttctccatcgatttgcaattcgtcatgtcccaaaatttcacacaacaatttttggtcaatttgtaaaaattcctccgatttgaacaaatcatccgcatttctgtcaatgtaagccaaacaatcattggcaaaattctaaattcgaaatgtgaaaataaaaaatagttatataactggcccagccggttaaacaccaaaaatttttgattctttcggcctttttcaatttgttcttcccacctccaattcgaaaagaccggcctgggcataagccaagaaaacattgcgtagtgatgaaactggaacttgcaaagatgcgtcgaccaagccagggatgttgtactttttggctaattaaaaaaataattaataaatcaaatttaaaaataaattcaccggcgtaaagcactgccattgcattgtatccgttcaatttggccaaatcgcctgtataaatgaagctcaacatcactttgaacactgccacttcaacatcagtgacctccacggggcaattagcagaggctaattgagaaataattatggcaatgagcaaggttaattgaaaactaattaatataattagtagaatctaattgaatttttttattattgatttatgtgaccattttctcgttgttcttaggcctggatccagaaacattccaattttaccaattaattatttaatcttattataattaatattttttttaccgaattccgctttttcatttttagcatcaaaacggaacattgccgcaaatacttcagaagtgtgcttcaaaatcagtctatgtgctgacaaaagctgaagaggattaaagtaaaaatcaaacaaaaaaagaacaattcactaaaattaattttaaaaataataaaaaatttcaaatttgaagaagactcgcctcttttccgtctccgtcccccaccaaaa

SEQ ID NO: 17373 - DNA, 2837 bp, Heterodera glycines
tttaaagatttcgtatcggtgcgctctgttatgcctgcgaactgttgctttggattgttttactttgaaattaccgttcttcagatgaaatcgtgaattaaaaaaaaatgttttaaaataagtttgattatattaagggatgttggagttggacttgccccagcgcacatgaggatgcatgaattggtcgggcttgaggcaagcattgcgttgtggagcgacgggtctatccacatcaaattgccatacgtgccggatgtgcttgacggattcgcacagtttggtcctggtgatgttgtcggatgcggaatggacgcaaacaaccggggcatttttttcacattgaatggccacaaaatttgtaagtaaatgaatagattcaaaagacaaaacaaattcgaattgtttcattcttaagcaagccaatttttgcaagccgaatcgtttcacatgtatgcgtgctgtactctcgtggacatgaacgactccgtccaggcaaatttcgggcccgactttctgttcaacattgtcgacatgttgcccttctgatgggctgtttctcaatttgccagtggattatcgggtgggaattgcgatgttgataataattttcaacactgttaacaaataaaccaaaataattgaattaaacccgttacacattaaataaagtaaattattttattttatgctttccattggtatcttattgcttttaaaattgatagttattacagttttcaacaaaaaaaagttacctacccctttgtcccttccgatccatcctccgttcgtcaatctttgaccccaaacattttcttaaattctgtaatgcattaaatttatatgataatgatgatgatgattggattttatttaatttctatcgctgttggctaagtttattatgttacaatgattagcgattttttttattgcaaaaggccaactatttttgcgtaataaaaggcagtaatgcctattgcataagtcactttatttgcacattaaaaaaagaatccattttagcttttgtattttatttttttttcacaacgcactcaatgtcgaatccgagggcaagttgtcacagcaatgtttcctgtttaaaaatatatttagaacctcactgaaattagagcaccgtttgcagttaatggacaaacaaattttgtaatcttttcgttttaagaataaatgtacatttcttacccggtttcagcctgcgtggtatgatggtttgacatttccgttgccggtacacccccaaccatacctgccttttccaccaccaccacgaccaccattgctgttaccgtcgcaagtgccacaaatgccatttcttcttaacccattcatcaatccaatgtcaatgccgtcccaattcttgcctcttccattgatgaatcaatttgcgcatccgcttacagggccatttccacatccggtttttgctcaaacatcgtttcctgctgcttttccccttccgcaagggatatcactcactcatcgacaacactttgagcgcattgctacagatgtccatagccagggcgtcccacaacagcaacaaccaattataccaatgatcaatgagggaacgggtcggaatgcgggtgttcgaccatttctggagcaattttatcaggatggcactacaacaaatgattttttggtcttcgattggcaaattggatcatacatcccgtaaaccctttcattaaagtctgagtacaaagctttttttttgcttagtggattaacccttaaagtgcttgagtttgattacgcggagagagttccttttcgcaatggcacaaccgcgcccggcataaatattttgttggaaaatgaacaacatttgcgtgtacatatttgtgcaagagaggaaagggctacccttctttcaaacactctcttggttggaggcacttaccggttcatgcatttgaatgtgagaccaaagcgcgattttggacaatctgtgaactacactttatctttcgcatttggaagttcagttcacttgattcgggttatcctgttttatttatttgtcattttgaatttgatgagtttaagggaccgacagtagcatttaatccattaactcttcgaagtccgagcgaccgggttcctcaatttgtttgtccaaaaactaaataaaattaaatagtcgatggtcaaaaaaattccataccccctcaacatcagcagcacagtggaacgatttcgcacaatgatcgtccatataatcagcaaccaatgcaaggtagagacacaatgccgacacttcaagctgagcaacatccgccaccactgtcgccacaaacaaacaatgtacagcagcaacaaccaactgtaccgagtccgctgaacgagcgccaacagagtgtacaaccaacgcagggtgaacatccacaaatccgggcaaacgccaccttgcaaccaaacgtggttcaagcgcagcagcagcagcagcaaagtcatcagtttttgggacttgaccacgacaatgacgatcagcttttgaaccaaatttttttggtagcaaaatttaaaaaaacaagcaattgacatgccaattacaggatctcaccacttccgctgaaatgcaacctatcgccttggataacaacaacaacaacaacaacaacaacaacaatatggttgttaacgatttttggttttgtctatttgtttaatattgcattttgtttagaacccacaaatttcttcatctcggcgccgaaacaatgccaatgccaatgccggacgtggccgaggaagaggaggaggaaccagacgcaaagcggtgagacgcatgaatgaatgaa

SEQ ID NO: 17374 - DNA, 2002 bp, Heterodera glycines
gataaaacgcaaaattttcgaacaaaaaatatgtttttcgtgcatttctcgtcgaattaaagccgtaaaaaaataagtaaaacttataaatcccatccctatttataattattactttatttttgtttaacacagggttcccattcgtccttgaatggcaaggacgtccttgaaattgggccctctttcttgaaaataaaaaatgtccttggatgccaaggacgtccttgaaaatgaacatttagaaaagtttttaaaaaattcaaagaaatttgagaaatctttgtaattttcaacgatattttgattatattatggcattatgtaaataaaatgcaaatttaattgcccaaaatctcaaaatttggtcattttttggacaaaatctactaacaaacagcattaaaaatacaaaattcttccggcgccgccggaccctcccctatccttaaaattaaaaaaaaaagcgcgccgtaaaaaaaccttttttgtcaacaaaaaaaaaagtcgtcgcatggcttaaaatcgcaaaaaattaggcagtttttggtgaaaatctattaacaaattgcattcaaattttcaaaatttttccccggcggcgcctgtcggcaccgccagacccccccccccccccttttcccggaaatttttggaaaaagcgcgccgcaaaaaagcgtttttaaagcagaaaaaagtcgtcgcaaatgaggaaaatgatcagtgaaaacaaaaaatgttggaaaaaatccattccagtgaaaaatacaagtcatttgaataatattaaccatttttcattgcatataataaaattttaaatgtcattggatttcatgaattttccccactatgtccttgcaaatcggcatacccgtccttggaagccgactttggacgataccaaccctggttttaacatttaaattattaatttttaaacattttcagaaaagcgtggctacgattacatccgattcgggcgccgttcttccgctgtcgctgctatccccaaattggccaaacagcagaggaaaaagtcggcggacaccagcggcgcccgcaccgcttacgattacatccgatttggctgatcggactgactgatcggtgataagaatcattgccaagtcgagaatcattatcattgtccatctgctgatcattttatttgtctgatcatttgtggggcggggaattcatataaaaaagtttaaaaaatgccaaaaaccaatgcttaattgggtgttattactgcaaatgactgttgtcactctgatgagtcgtccaattcgggaatctaatttgttttaccgtacccacagccgttcaattttggctaccgtactcacaccatcgccgccctcccccccaattgtttacataatccaaaaaaaaatttgaaaattgcgaaaaatatgaaacattcgaaaatttgggttcgcaccaaattgtttgttcttctccttccacgtccctgatcacatttcttccgcgatttgatcaaacgcaaaataaacaataaagcgaatttccgtgtcgaacgaaacatttggcgattgaaaaaaaatggataaattttttgaaattaatttttggctgatcggacggggggagagaattttgggcatccgttcgtccgatgggccgtcacttcggattaatttgacgacagaatttcggcgaaagaacgcaacacactcagataaatgcgaagctcatccattactcagataaaacgatggatgcgaatttcgccgcttttttggggcttttcctttatttatgtatttatttttgattaccctttaaaaaaaggaacggtcacggggaattgaacagagattttggggagaaaagtgtgtatttccaaattaggatgatcgatttcatcattttccataaaatttctcttaattctttgattttggcaccgccggacacaaattcccataaattttgaatattgttacaaaaatcgccatctcttaaccaaattttg

SEQ ID NO: 17375 - DNA, 1309 bp, Heterodera glycines
  misc_feature (1293)..(1293): n is a, c, g, or t
tcataatgccaaaccaaaacgaattcgttttaagatattcttttactggactttgacttggtttctcaatatcgaagcttttttctccgcaatttctaaaacgcttataccaaaccctagatttttggttccgatcggtttcagaaaaaatcccttgtggtgcaaacatatttcacatttcacttcataattttttgagttctgcacggatcgagaccgggataagaccattggaaagagcagctcgagctctacaagaagctatagaaagaaaaaatcgacatttcagggactttcagaaatcatgtttaattccccaatggggccccattttgggtcctcagctacagccccatgcttctcccaattttaagtcttggatttgtccaataaattaaagatttcgaattaataataaaaaattctattataaattttttttttgtagagggaaaaattctgaaccaaactactattttgaaacccaatcaaaactgggaaaaaatttgaagtcaaaaaattattcgaattctccaattttgtttccataatttccgaatgttattcggtatcataatgccaaaccaaacgaattcgttttaagatattcttttctggacttgacttggtttctcaatatcgaagcttttttctccgcaatttctaaaacgcttataccaaaccctagatttttggttccgatgggtttcagaaaaaatcccttgtggtgaaaacatatttcacatttcacttcataactttttgagttctgcacggatcgagaccgggataagaccattggaaagagcagctcgagctctgcaagaagctatggaaagaaaaaatcgacatttcatggactttttcagaaatcatatttaattccccaatggggccccattttgggtccccagctacagccccatgcttctcccaattgtggcgaaaacaatatttcacatttcacttcataactttttgagttcggcagggatcgagaccgggataagaccattggaaagaacagctcgagctttacaagaagatatggaaagaaaaaatagacattccagggactttttcagaaatcatgtttaattccccaatggggccccattttgggtcctcagccacagccccatgcttctcccaattttaagtcttggatttgtcaaataaattaacgatttcgaattaataataaaaaattctattataaattttttttgtagaggggaaaattctgaaccaaactactatttgaaaacccaatcaaaactgggaaaaatttgnaagtctaaaaaattat

SEQ ID NO: 17376 - DNA, 1094 bp, Heterodera glycines
gcgccatttgcgccgcactgcaaaagtggacacttgcgccgctcagcaaagtcgacacttgcgccgcgccatttgcgccgcccagcaaaaatggacttttgcgccgcgctgtcaaaaatattatattcataaaaattccactattatcaataagttttactaaaactataagccatcgacaaaaataactaattgaaaattcgaaaaaattactagtcacaaagattggcattcaattttctaaccattaaaatcttaacattgaataggttcatcaaagatatgaaaaaatgattaagaatacaaactaacaaaaaactgaaaaaaagaattttctgtagaaaccccaattatttttttgcttcgaaaaagaatgaaattcaattcctttgtaattaattttctcaataagttattttcatcgattttaatttaatttcattgaaaaaacgcactgattttcaaattttcgctcctattttaccatttttcgcactatttcgcaatttttatgccctcatttatttaccttttttttcgcttaaaatccgccgcttaatgatcaggcaatacgaaggcttgttatcgcatatggtctcaatgaaaaccaaaataatcaagatttgatcaatcattacgtgcacttcaatatggaattgacatgaaaggcttcgaaaaaggaattaataatgaatatctatcaattcttattctataaagcacataaatttattttaatcagagcgcaaatatctttttttgctgtacggcgcaaatgtcgcggcgcaaatgtcgtttttgttaggcggcgcaagtgtcgcggcgcaaaagtcggctaaccgcatgagtgggttcgattcccacctgagagttaacattttgcccatttcttattatatttaaaaaactaattataagaaaatcaattggaatgccattgcatgaagccaaaattcctgctggttgggccagggcgactccaaatgagctcagcaatgccactgatcaaagcaaataaaaagggacctgttcaattatggcactggaaagcacttcgaaataaatgtaaaatttatttttgtaaaattaaaaaa

SEQ ID NO: 17377 - DNA, 946 bp, Heterodera glycines
actagggttaagccccggccccgaagcccccctgcccccgccccccggacattttgggacttatcccccgacccgaccccccgacatgtcccccccgaggttcccggcccccgactttttgcccccggacccccccgacataattcgggggattggggactccgagcgttttaaaaatttaaaagttatgcaaccaaaacatttaaattttacctatcactaagccaaaataaaagtttctcactcttttagaaaaattaataatatataatttgcaaaattaaactttgcacagatttacaattttccaggaaatttaatagattttcacccaattgattacttttaatggcttcaaaagcatctgatatttggaattttttcacgaaaatttcttcagaggttgctaagtgccggctttgtgaaaaccaattagcgtgtaagaaatcgtgcacaaaaggattatgggggcattttaaagcgaaacacgctaaagaatttgaaaactatttgcaaaaatccgacccgtcaacggtaatacaagcttcctttttattgaatataaaaaattcagaaaaaccaaggcattacaaaattttttggcaatgaagacccacaaaaaggcggatgaacaaattgcaaggctgatgataagaacgaattgcgcttttttatttgttgaggcaccggaattacagaatttgttctctttggcctacccgaaactccaagtaatatttttcacccatttttactattgtcatattttttaagcttctccgcaaagattattttcggaggaatgtaattcccaaaatggccaatgaaattcaacaaaaaattgttcagggaattggtcaggattttttttctgtgacctctgatggatggtcgcaaattacaaaatcaccagcgctcttaaggttctataatccatttcatggaa

SEQ ID NO: 17378 - DNA, 2117 bp, Heterodera glycines
ttgaaaaacgaattatattttgatctgatcaaatgtttcaataccataaaaactcattagaaaacatagttttttacagcaaaactaaacatttattgtaatgtgagggcaaattatttattaaatataaaaaattgagaaaactgcttagaataacaacaaaaacataacaaacttataaaaaaactacaaaagattgatcagagttcatttgaatcaaaaatggcgtttcgaatggcagattctctagcacagaacatcaaaatatcgtggagatctttgtgtttgctttgcgcgcgagatcgtcattgatgctcactgagaaggccccaaaatccatggttttcagcaaattcaggggcatggtggaccaaatgatgaaattttgaagtcgaacaatggcggcgaaagtgctccaacatttgaacacggaattgatcagcagtggcgcggaaatcagcgatttgatcagcagaaagcaaatcggcgacggcaaatgattggagttttgccaagagttcaagagccatcaaaatgttgtcgcggcgtggtgattgtggcaaaaactcggtgacatgcataggcccgcctaaaaatttcaaaaaattccgtttgtttttaaaaatttatgaccagaaaatttcaaaaagttggttttctaaacatttttggccattaattttttgaaacccaacggaattttttttaattttgcaggctaatagaggattcttagggctgtcgaatgatactaagaatatttaatttggatgcttcttgaaaaagttatggtgcactaatcttgcaaaaaagtttatggtcgtgtcttttttttatggtcgtgtcttttatctcattttagctttaatctcttccgatttcctacttcaaattgcctcatcatccttcattattaatgtcttctcccccatcgccaaatgctccccaaattttggaggcgcaggccgattttgcactgaatttgctgcgcgaggtgtccacggacgaccgttcgtgcattgtttcgccgttttctgtccccgtctctctgtccatggtttacgcgggcgccaaggaaagacgggcgaagaaattggcaaactgctcgcaaagggtgggcatttttgaaattttccacaaactgaaacattattgaaaccatttttagagaaaaatgagaaattcgaaaaatttgcaatttcggttttttgttcgaattcgggcccggaagcggacttggccgtaataaatgccaaattttttatcagcaaaagtctaaaaaacatgttcttagggggttttcattttcagacacgctgaacacaaatctgacacccaatccgatcgatttcaaacccctcgacccgaaaatcacaactcaccgtggatgcgaaatttcacgtggacgagaaaaccaccaaagaggtgattttgaaaaagacaaccacacattttaaatcgatagtttaaaatcaaaaatgccagttattagtttggccactgctactgacgaatcgggcacgcatttcgatcaaattaaagggagtgcaccccaaaatttagccgccgaaattttttgaaacgaattttcaaagcgaaatatttaaaaaaattatattttcgaaaaaacaaaacttactaattcaacataaaatttcgacaaaaaaatgctgaaatttttttataaccttttaaaattttttcataggattttcttggtttggaagtgtcattttgtccttcaacgtccaaattttttagctggaaatgatgcatttgaaggcctctttgatctattctgaagacactcaggtcgttcacacattttcatgcattttttccttttcatttgccaatttttcgattgcttatacagctccaacttctcggcatgccctacaaaggtgaaaaggagttcatgtttgtgctgttgcccaagcaacgctttggactggccaaattgttggctcaattggacggcaaaaagcttgtggaaccgtgactggacaatccgacagtggacaattcgacagtggacaatccgacagttggacaattcgacagtgaggacaattcgacagaaatggacaatccgacagttggacaatccgacagtg

SEQ ID NO: 17379 - DNA, 1089 bp, Heterodera glycines
tcatatttatgtccatattttggcatttttcaaaaaaacctctattagaacggcccccagcagctaaattagcctttttgagcccaaaacccgaaaaatttttcaaaaaatcattttttcgccaaaatttctcgagaatattgaataaatttaaattttcttaaaaattaataaatttatgtcaaaaataagcaaaaaagcgaacatttcgcttttgttgttgattttgcgctaaaaaaattaataaattttagcttttatgttttttttcttttaaaatgattgcacataattgccgaaaaaattcgagaccaatttccgaatgttgaccgactaattgccaaaacgaaagccgtctttgtcaaagcgccttaccgagtcaaaaaatttggaaatgtatctcatatgcaatttcaaccaataaatttgaagaaattttacattcaattttgaaaaatttatgtccatattttgacatttttgccatttatgtccatattttgcgatttttggtccatattttatggccatatttcgcgattttatatccatatttttggactccctattgataaccaatctctaatcagatttccattaggacatcgctatggcctgaatccctgcgtatctgagactctgaagccggctggggtgaggtcaggttcggatcacccgcggagtaaaaaattatttggttttttaggtatttttaaacttaatagactattagtaaattttctaagtattttttaaaagtatatttgcaattctagtgctaaaaaagcgcgggcgtgaaaacgaacctggcgcgaaaacggcggcgcgaaaacggcggcgcgaaaacgacctggcccgcatttttttgtttgtttttttgaaactaaaatgtaaaaaaattactaaaattatttttattttaaataatgcttctgtttcgaatcttttggcttaaagaaattaagctgtaaaaattgtgaacaaataattctctgaaatttttaacttcgctttaccattcttttaagtcccgccgtgaggcgggacagttccaaaattttgtaccacattttaatgtggaaagtccaa

SEQ ID NO: 17380 - DNA, 1640 bp, Heterodera glycines
catcacattcagcaaggcataaaatacgatgatatataatatgtatataaactaaaccctctgatactggccatttcgtttatattttaatgcatttaaaattcttggtgttgatggggggggggagtcgtacatgggtttagttttttgttgggtttaccattcaaaattttctcattttcccaatgctggatgctgcaattgttttccacaagtcatcgaggaggacgaaaggataaaggccaatttgatttctcgctttagtgttggacagatggcaaaatgaacaaaaggtggataggatatgttacaaatggcccaacattctccgcaacagattgactttcttaccacaacgatcttttgcctaaaaaattcggtgcaagtagtttcatcaaaagtgtcattttggcgttttttgcaatagtgccaatctcgtcatgacttttcttaaatacaaaaaaatcagataataatgttatctatacgataattattgggttgctacaaattgtgacgagttttctcaaataaaatttaaggtattttttcatgcatgctgaattattagggctgccaaaaatatgcacgaaaagtggccaaaatatgcgcataaatatgcaaataaagtcgtgaaatatgcaccaaatatgcacaaaaatcgcaaaatatgcaccaaatatgcacaaaaaaacttgaaaattaggggtgcaaatccaataaaaaatttttattcctcataaattttatcggttttttttttgcaattgaaaatcaataatttctcaagattttcggcactaaagctcatcctattgtctgccaaaatttacttaagggatattcaaaacggaaaatatttgaagaaaaatggcaaaatatgcaaaaaatcggaaaatatttgaagaaaaatggcaaaatatgcaaaaaatcggaaaatatttgaagaaaaatggcaacatatgcaaaaaatcggaaaatatgcacaaaaaatggcaaaatatgcatgaaaatgtaaaacaagccaaaatatgcaaataaaagtcccgatttttatacgcaaacacaaaaaagaaagtgtttttcgtactatttagagcatggagaagccaggaaaaaaatatgcatttgcatacttttggcagccctatgaattataccaagactaaaattggtatttggactgtagctcttccttggcaatacggcggatgtttagaatgagatgctagtttaatttaaaattagaaatgaaacaggaacatttatcataaatgctaaatttcaaatttttcataatactttctaaaaatttcagtatcgaatttacttaatgtcaaaaatatagtgacggaattacttagtgtcgaaaacacaaagcgcctccaaaaatgataacttttgcttcaaactttatcaggacatttctaataatcaggacaggttgccccctggattagaatgcaattcataagaattaatcatcttattgaagagtaattttaaataaaaccataaataataaattgattgtttttggacggagaatgttgaagaaatgagccaatttaatgatttttttcgttaaattcgttaataaattttcattttatcagggacatattggttttgaaagggtc

SEQ ID NO: 17381 - DNA, 1201 bp, Heterodera glycines
attttaaatgtacgatttataaaaaactggcatacttttttgaaagttgcaaaaccatattacaggggctagcaagcaagagtctaatagagaagtgccgcaataagtaccacaatatttctttgcaacttacaaaagggaaaaaaattatttagaaaggttatcacacaataatttaacaaaaaatttaatttatcttcattggctgtttaatcagttcaaaatgtccatcattaaaatacaaaaagattgatgctgttgattctttttgactcaggttcgaaagctaaagtttcaaaatgaatttacacaatcaaaacgttctaaccgatgtttccaaatctggtgaataaagttgccaacggaaaatcctttcctgtaaacgttcgcaaacaattatattaattcgaaacaatttgctggctgatgctatgtctaaattgttcatccatttctcagtttcatgtgctcctgttgctggcgcaacagcaatttcaatgtgttttctaatattttcaatactgttctaaatagtttaataatattaaaattaaaaaataattcatggtttatataaattttggattgttttagcaatttagggaaacatttttatataatgatagaaaatattttgatgagccttttatattcacttataatagcagacaaacagctcggatagagtacaggctgacacgattgtacagacaaataaaaaattctcgctaacatctatgtataagtctcggatgacacgtatttgcacagacaaaaaataaaaattgccattgataaattatatattttatatattcattttatatgttatcaaaatcgaataaaatagttagcacttttacgaaacgaccacagtgtcacctttacgaaacattcccaagttggcacttttacgaaacgacctggcacttttacgaaacgaccacagtggcacttttacgaaacattcccaagttggcacttttacgaaacgacctggcacttttacgaaacgaccacagtggcacctttacgaaacattcccaagttggcacttttacgaaacgacctggcacttttacgaaacgaccacagtggcacttttacgaaacattcccaaggtggcacttttacgaaacgcccatagtggcacttttacgaaacgcccatagtggcactttttacgaaacgacccagcacg

SEQ ID NO: 17382 - DNA, 936 bp, Heterodera glycines
gagcctcgcccacagcgccagcacaccttaatgccgctcgtcgaaatcgaccacgtgcttcaaagccttctcgtttttcggaacaaaattttcgctccgacagccaaaatttcgcttcgacggggctcggctcgttcgatgcatttagcttcagcaattgtggacaaatacatttgcaggtcctccgcgaccttatcgtattttgccctatcgccatctgccgccaatttgcccaaaattctctttcgaagttcgccatcctttggagattttaaagctgttaacagcattaagcaatagaattgctcttcgttgagtttcttgaactcaaaatcccttaggaggcgcttgtgccggttgacaaaagagaggaagttctcatcctcgctcttggaagcccgaaggcactcatacctgtcgatctacaccgactgtggtttggcgaacaatgccttgagttgctgctccgttttggcaaaattggagtcggtcacatctttcggcaagcacgacttcttgtactcgctgaatgccgctttgctcaatttcgtcatcagtagcttgactttttgctcatctttcagattgggcgccgaacaatccaacgcaaagcagaattgttgcagccaatcttcgatgttggtggtttcgtcgcacaattcaaatacgtcaatgcctgaaagcgacgggttttgattttgctgcgaaatttcctgcaaaagttgctcgatggtcaaagccatttgtcgaaattgaagaaaagttgttgattaaaatcacacaacaaaaaacaggagttgaatttgacgaaaatttgttgttgaataaatcaaacaacaaaaaaaattgagtggcgaatgttgttgaacaatcacacaacaaaaacagcggaaaagccgcacaatttgaaaacaaaacaatttaagtcgtcgacgg

SEQ ID NO: 17383 - DNA, 1334 bp, Heterodera glycines
gttatgccgatgagtccgaagagaataaataataaatatttattccaaattaaaaaggacaaggcacacaaatatattgattggggtcaagcgaagggaaatgacaaataaatgaatgaatggtggtgaacaacaagggggaggaaaatgggaggatatttaaggacaaaaggaatggggtcaaaatgatgacgtggcaaaaggggacagaatgccaaatacaatttaaatatgacccgtcctaacaatagacaacaaacaccacactaattcaaacacggacatatacaaacacaaaactttaatatgtgatgacaaaaataaaattcaattgttattttatcaattttatcagagtttgattcttttctataaaatttgacttatgcagcttatttttaattttaaatttgtgttttttctattttattattttaaactattcctttttatttttttaattcttatgctaaatattttatatagaatcacataattctttaaaacttgtttacccatgttttctagcttccataatcggtggatgtaattgtgtacgcagattattatttttaaatttgttaagttaatctttgaacttaattaacttcagataataaacaattaattgttttctatttcaccaaattccaaattctattaggatttatataagttctgagagaattttaatagatttttacaaagggtgtgtttctggcatttagcatatttccaattgtcttaatattttttataatttaacccaattaatttaccaaatttaatctgaacttttagaatttcttaaaatttttttgtaatttgcattttggtctcaattaaaatatttaaatgaaaatgttgcgttttattatttttgatcaaataaggcgaaattattgttcagcatatttcttcatttttatatctttatatcttatattatttttgacctaacattgaggattatttttattcattttaaaacaaaaatatatatgtgacgataaaaattgaattcgtaaatgttttttttatttaacattatgagacggtccaatcctcttttattaactaaaaaaaattttttttatgcatattgaaaaatttatattattcgcaaaattgtcaaaaaacttctagaggaattacaaggtttcatgaaagattactgatcctcaaaataaataaagctaaggaaacaataaagaaaataatgcaagtggctgggatgcaatatccaataaaggccgacttgggagaaggtaagtgacccttgtggacgacacaagttgcctcttaggtaggctatgagacttgtgtgggggggg

SEQ ID NO: 17384 - DNA, 1553 bp, Heterodera glycines
gatcattttgtccaaattgtttattctgatctctccttggttcataaattattggaccaattcgataaatattttcttcagttctttcgtcccatctttggccaaatatttaatcaaaacttttttcttcctttattttgccagcgtcccgcataataataaaatttttcttataacagttccatggttttttgtaaagataaaatgaaaagatttaatttattgaaatattttcgcaaataaatttggtaattattcattttttaacatggataaattgtacaatcaattattaaccacatttattcattatatcataatatcatgcatcaattagaataaaaattatattatatctaatagctatcaataatttgtttaggaaaaagtgaacggattaactggttaaattttttaaatggtattttctggtatttatttgtaaattatagttaatatagttaagccgtgccgggtttcgggattcggcctgcttagttccaacccctgagatcgatctcctccgtccaccgacggattgttggactgggccgtagcccccgcggaaaggctccgtcccatcggtcggcttagggggagggccagtagtgggagtgatgactggggaattgactgactgacctcgatggctgggagagccatcgcttaaaaggggaatcccggtgggcgttccaatggggaggagcctctccccttcaatcccaatcggtagccgagacccgagtcccggcttacacctccaccccagggcaggaaccgtccctggttcctcaacttactcgaaattttgcgcgataattctgctgcgccgccaaacctctcacccaaagaccattttcacgcattctcacaaattaattgcccttcagtcattctcttctctcgctctcttctttgctactgcccttcagtctccattcaccctcgcctcttccccgtcaattcccttctcttcctctcctcatcttcctcttcttctccccattcgccctctttccatcaccaccgccccttctttcctcctcaaagctccaaccacaggggaaagacttcccctccgttcgactgccattccatcccagtgccaagaagcgcattcggagggaggatgtaatttcgagcacaccaccagcctgccggcacctccatcacatgcagttgcacattttggccctcttccaaaagttcaattacgccttcgttcatgtttcgcttcgttagagtatggatgcgaccgtgtaccaggacattcaccgagcaaacaatgcgatggccctgatgtctgccgttgttgatggccctgatcactcctggcatgacgaaagatggcaccaagacgacattctgcaccgactgcgcctccgcttgacgcacaatttggccttgatggagccagcctggcaacgtatctgcgctacttgttcgaaagctgctctccagtagtagccaaccagaaccagcgtgtctccaacggcgagattgcgctgcaaacacgggtcctgcagcatatcgtttccaacgcgaacaaagaa

SEQ ID NO: 17385 - DNA, 1822 bp, Heterodera glycines
tttttttgctgacttaaaatgaccttaaaatgacttaaaaaagtgttctacactttgtttgaagcttctaactttcattttttgtgatttttttatactttttgggatttttatgacttttttgcgtttttatgacattttcgtgacattttggcgatttttcatgactttttaagtcgactttttgtagatttttcgttacttaaattcccatccttagccataattaaatttttttttacatcaatatgggattttgaccaatgattttttatttttaaggttttcatcggcggctctaggaaaatccgacactggaaaatccgacaccggaaaatccgacactggaaaatccgacacaagcggaaaatccgacaccgctggaaaatccgacactagcggaaaatccgacactggaaaatccgacaccgactttaaattttaaaaataattttcgattatttgagttaatatctgtataagttagccaagttttcgaatttaatttaagaaaattaaattggttccgccattctatgggatattgcccgcaaatattgaaggggttgtcgattgttgcgagtcgcataaatctctgtgagattcatgtcttgctccacgtacacttgcttacgcttcatgccctttcctctgattccatgtgccggattatttacaaattcctccaattgttgctgccaatgattttcttcctgtgcaactttacgaaggaaaatgcttaggcgaggcgagtgtgaacgaaacaaagcattcagatttcgatgccacgactcgacgctattgtttgtgaggcaaagatcagcctccaatcttcaatacaaactgatcattttctttgtttgtttgtaattaccgctcgcacatgttccacaatggcatcggaaataaagcaggccggttaaattatttttaaaaattaaagtcggtgtcggattttcgagtgtcggattttccagcggtgtcggattttccgctagtgtcggattttccgctagtgtcggattttccagcggtgtcggattttccgcttgtgtcggattttccagtgtcggattttccggtgtcggattttccagtgtcggattttccggctcccttcatcggatttactgctgaaaatgaaaagctgcccaaaaataaatgtgttatcatcaaattttaccaaaaaggatttggaaatatataccgtgaaagcgtagaggtatcggataaattaagagaagattcgaagaacgaagaattctttgtcacctttatggaccagtaaattaaaataaaaacacattaatttatttattgttttaattaatttacaaaaaataaaaaataaattaattgattttttgatgcttttagtggtacgatggatgaatcagaacactttgcaaaaatatttgaaccggtggtggccataatggaacttggcgaaagagatttagaagaggagttagcacttgtgaaaggcaattttcccacagacaaattcaacaaaatggtgatggatgtgattggcacattggtccaactgcataaaggtaactatctctccattaagtttatgctaaatcaaggattagggagtatgtgtaccgtattatctctaattacccccccccccccccccagattgattaaccttgcgatatcctcagaaagagggggatcataccgaaagcaaaactttggattttctaggtagtttgaagactaatgcagccagaaaatccaaaatttttggttctggtatgatctccctccctctttctgaggagatcgcaatgtagtcatcttgggggggggg

SEQ ID NO: 17386 - DNA, 709 bp, Heterodera glycines
ttgcgcaagtcgccacccctccccgcagcacaggtccaacaccgtggcaccgccgtcacagagtccctcggtgcctatgcgttccaaaaactcggctaaaaaatgacgaaaatgcttttgaatgaatctgtgtgttatgagaggtaaggaagggaatgtttgaccatgttgaactgaaaacttggtgtacctttcactcccataaatttttaaaaatggcgcgggaaaaaattatattaagtgcttaatataagaatttcaaacaaaatccctcctttgtgcgatttctttgtctttttaaatgaagttgcgtgcacacagtagagtccagactagagcctggttttgtgagaattctggtacggcattttttgggggaaaaagtccggtaaaactggtttttttttctcgttgatttcctgtccattctccatttttcaaatgcaattcctgtccctgcattttgcatataacaataactcaccaaaaactattccaattaatttacaaagaaattcaagaggacacaactcaaatgaaagaattagattcaacacaaacacgacccgcactttgctataatttgagtctgaaaatcattttaaagttttttgccatctgcacaccgcaaaataactctcattgtgtgccaccaacaccgaccgatgagcatgctcttcatccaattgttgaagttgcgcaggtgcaa

SEQ ID NO: 17387 - DNA, 915 bp, Heterodera glycines
ccataaaaaatactcaaaggcggggaccattttggttttaaaatagttttaagggtttttgggatcggggattatgaatatggccattagttttgaccaatccgtaatccaaactggaaaagagtaagaaagataggtaaatttcatgatttattatggactaaaattaatgtagtttttttattcgaatacgcataaattctgcgtctctatcgctcataacaagggacagtgaaagtagagaagtgaattaagaaaatagtgtgtaaaagactttttctctaaagttttttcgcggtttccaagtgtaaaagtgccaatcttttatttgtatctcacaatcagcatttggcatttacgtaatatattctgccagtggtagcccccttttttttataaaaaatcaaaactttttaaacgagaaaaagatgtttttgtggttttcagggtcggagaacccgattctgatatccatttctaaccccgaactcaaatttgaacaaaatttttgtcaggcattttcttttcatggttttttgccttttgtaataaaatagtgataaatgattggcattatgtttctttattttgcacttttaatttcttctccataatcataattagggctaggatttttatgttttaacatattttttttgcggcttagttatggcgagagaagcccaaaaatagcattttctccgaacaatttttggtttagagcgacttataaaaacataaaaacacatattttggcgttttggcacataaaatatgttagcacatattttggggtttggcacatattttgcacatattttggcatttttgagaaaaattgcaataaaaatacaagaaaattgaaaaatacacccctaaaaatcgaagaggttcctaattattaacataattttc

SEQ ID NO: 17388 - DNA, 2357 bp, Heterodera glycines
agattcttgattagcgcctaaaacttccccagaaaagcgctttccttcgttgggattatgatattttaaggatgcaaaactaaaagtgccttctatggctttgttctgcccttgttgttttgccttcttcagcttgtccgtgatgatgccctgctctgtccgaatctgatcagtctcgactccctcgagtatttggtcggttatttggtcatccgttcctcgtttcacttctctacccttttttttggtgctaacactttcggtcgcttttccggtgccggagggctttctctccgatcccgactcaattgttgcggaggatttggagctgttcaccggcttttcgcaagtgctttcattcattttttgtcctgggccatcatttggttgcccaaattgtcctcttttacgactgatcgttaagtctgagactttcttttaggccagcgttctctttctccgcaaggtctcatttctgtcaaattatttggcactaattgccacaactcgcttaaatgcttccctccccccccccaattaaagggctgttcctctgaccatcgttcgtacattttccaatttgccattctccgccactccgttaatccgccgtttaatgacactgatttgcgcctaatttatccacgaatgttcaaaagcaaaaggttctttatgcgccaagaggggctcataatagcgcgtgttaaacaggtgaacgaacgaagttaggagaaaacgggggaaaaaaccgccaattacgaagaatccgataccgtgagaaaagtttaaaaaatgaaaaaatgagacaccggaaaaataggacactaatatgctttttataaatagggttgggaatttaagtcactaaaaatcttcaaaaagtttctaaaaaagtcataaaaacgcaaaaatcacgaaatggaaaaaagtcctgaaaaaatagtcataaaaatccaaaaaagcaagaaaaaatgcaaaaaaaatctgaaaaaattaggcaaaagttaaaaaaatcccattttaaacaatttttatagaataacatttaataaatagagtaggatttttaagcacttaattttataaaaggtacctaaaataggaatgaataagtgattctttcaacaattacgaaaatttcatccaggtttcattaaattatttttaattaaaaatttatagatttaaattaaaagttttaatattatttaaaaattccgccagtgtcggattactggggagccattacggtggagtcagattatcagtgctttttctttaatggctcgatcaattcttttcagttttatcatcgttactgtaacttccacagtaaactcagtttcggtttcagtcaaaattccttctcccactgatcggcttctcatcgcccgaaaagagaaatccgaaaagtgttggcttttgtccactcccaaatgtcaaccaatgctacgggggcgaaatggcacttctgttctttgtcagtctctacgccagtgccgagatttgttgtgcgatttgttgccacatttttgaaagacggcgacagacaaatttagcataagcggaaaaagcaaaatttgttgaaattgaattgttggactttatttgaatttgttttatttggatttatctttaatagaaattttagattaaaaatataatgcgagaataatatacaccagggcctatttcaattcgggtcatatctgcgatatgactctatgacacggtgtcatatcatacgcaaaatttctgtttcaattaaacaccccaaaaatcatatgcggcgtatgattgacgtgtcatagtgtcataggcgcgtttcaattgtgtcatggtatcatatctccgatatgatatcgtatctgcgacgccgtcatacgcggcgtacgacttttcctatgattaatcatatgcgcgttcaattaactcccttttctacttatgatgccgtcatatatgacaccccttcccttgggcaaatcatatgcgggtgtatccgctccgaagcggagacatgcccaatcgtatgtaggataaaaattcataaacaattttaaacttaatcgaaaattttcaataaaagcattttatagaatgaaacctctattattgaatgataaataaattaaattatttttcccagtttataaatttgaagcgtaaatcgaaaatgcttaaataattttatttatttttgggcacttcaaaattaaaattttttttataaatgagatttagctatgttaattttttttacaaagttgtgatgttttctaaatataagtaaatttttgcattttattttccaaaaaaaatttgttcagacattttgaatatatccataaattttc

SEQ ID NO: 17389 - DNA, 2675 bp, Heterodera glycines
  misc_feature (24)..(24): n is a, c, g, or t
  misc_feature (69)..(69): n is a, c, g, or t
  misc_feature (96)..(96): n is a, c, g, or t
  misc_feature (105)..(105): n is a, c, g, or t
  misc_feature (124)..(124): n is a, c, g, or t
  misc_feature (143)..(143): n is a, c, g, or t
tttcaggatttttttcacttttanataatatttctgtaaaattaatttcaatattcatttatgtttatntaataatacaaaaacatttttatcttncatttattntaattatcgattatttgtntaggaacaaaaatctgttntaatgaacatattacaaattatttctaattattcctgttgcgcatttttcaatcatttttattataaaaatattttgcaaactattttttctttataatagaattcttttatatatttcaaattgttaattgattttcaatctttatcaaattaaattttaatattttgtttaataagaaatatttcatgtgcagaaactacgactacgcaataagttgatcaagtttctcgaaagctaaatgagccattttgttaaattaattttatatttattttttaatatgtaagattaatatatttctttttaacatcaatgttatgttaatttattcgtctttttatgggaaataggattataatttttaagaatatttatttatttttcgaatggtttatattctacttttcataataactgttattttgactgaaacagtataaaaaacatatttttattttatgattattacatttatataagatagaaaggtgcaaattataacgaatgaagaaattttcatattattaatgttatttaggcattaaaaagttcggaaaacgcatttttttttctttgcatgaaaatcattctaatttacttatgatttaactaagttttattggataatttcataaacttagtccttttcattatttttattggatttcacttcaatgtagaataaataatgcctttactaaaaatttattgttttgaaaatcttattgtatttggatgaatgtattgttctgagtttataatttgctgattatttttaaagaaaacttgttgttcgctttcatgtatgatatagttttttcgtaataataattattatttaatttgatgtacatatgaaataataaaaaattaatttagaattttattgactgttcatttatttgtgcattttttccggtcttcaattttcttttataagaaatttgcatttcccttcatagtgaaataattaattttttattttgaatttttaatacttttttaaaatatatttatttcgtgttaaatctcgatgcatatgtagcttcaatctcatttcattatttttgaaaaatttaaattttttcgggctaaagctgaattttttaattttaatacataaaatttttttgaatttattaaagctttttcgtaagaataatgtttttgataaaattctgggtaactccgccaattttgcattataaatggctccaacatgattttttaattattgtttttaatattaattaaaattaataatattttattttcttattatatattaaatttatcaatctttttaatgattaattatttattatcattttctgcagatcatcttcaggatatttattgtgttttttagataagctaaaatacttaaccattatcggctatctttaaaattttgaaaattcaccaaagatttaatgttaaggtttatcatttatgtctttattttattttaaaacacggaaaatcttaaagtttataaaattattgtttccaatataactctttatcatttaatattttagtaattttttacgtgtgaatacgcttagttcgttgaagttttatagtgcaaaaggttcatctttatcgttataataatttaatactactttattgttgcctttattttatatatatgttatataggttttgagtttcgttgctaaaaccattttctcccggccgaaggccgggagcgccctgaaagtagtggaagggtcttacaactttttgaggcgcatccgggaaaactatagagaaaaattcagcgcggccaactgagtcccagcggctgatttctcattttttcgtgcatttgagggcccctaactttttttctaaaaccctgaccaaaaaattcccgctgtgagggcaatccgcagaagtgtcctctataatccggtattttttattttttgatcagaccaaatcccggacctgtacagacacggagactcagttaatttttttttcccacttcagtaccaggcgaataactcattaggctttgacctgagcgcagggtggccagcagacttattgtagagctttaaaagcccgatttttccaaattttaaaatttcgaaaattttcaaaatttttcgagctaggcctaaaaaacggttttcgggtttttgaattttaagaatttttaacgaattttcccagaaaaacgaagaccacttccaaaacatagtttttcgagctctatcgactggtatttttttcggattattaatatatacgttatattgacaaggagtttcgtttcaaaaactaatttgagcttaacggctaatgggacgggtctgaaagtggtggaagggtcttacaactttttgaggagaatccgggaaaactatagaaaaaaattcagcgcggacgactgagtcccagcggctgatttctcattttttcgtgcatttgagggcccctaactttttttctgaaactcggatcaaaaaattcccgctgtgagggcactccgcagaagtgtcctctataatccagt

SEQ ID NO: 17390 - DNA, 948 bp, Heterodera glycines
  misc_feature (926)..(926): n is a, c, g, or t
  misc_feature (933)..(933): n is a, c, g, or t
taaaatggaaatgatcagcagtatgggatatggttcctgattgaccaaagcaaagtttgaaggattagtcaaagaaaagataaataatattcatcgaaatgatcaagccaggaagaatccccaaaattggaccatttggcatactcaaaatattggacgattggcctacacagacaaaataggacaattgggccattcaggcaaaatttgatacatagatgaaattggacgactggcctactcataaaattgctggattgtcccaccctgaaaaaattggacaattggcctaacagacaaaataggaggacaattgggccactcaggccaaatttgatataatattatataatttatgaaattggacgattggcttacttagaaaaattggacaattagtctactcagacaaaatgggagggttgacctattcatacaatttgagattggtctactcataaaaactgagacgataagcctttttgaaaaattggacgattggctttctcagtaaaaatcccatcgtccggtagcggaaaaatcgcaaatgatgctaatggaacgaacatttctttcatttccattgctttcccagtcagtcgtttctcactttttcataaaatgcggccaaatccgtcctgtcctcctcccccttggccattccttccccgcccaacgttcgttttccaatccaacaacagtttccacttttcccttttagccaatcggccacttttctttttttacacaaaaatatttatgcaacagtttaagcaaaagcaaatggaaaaggggagaataaatattttttcatagattttatctgtgcacatatttcgcaatatccttgacattgaagaaaaaaacgcaaaaattgcctcgactttgactacaaaaaggatgtgtacagtctgcaaaaaaggaanagcattngaaatgagtcattat

SEQ ID NO: 17391 - DNA, 1419 bp, Heterodera glycines
taaggtacaaaaaaaatatacttagggctatcgaatgatgcacgtactcagtcggatttggttagcaatgaaaaaaagcggtataattcaaaaactcggctggcccaaaaacgatctggccctgtcattgtcaattttttaagtgcgcaaaaatgttaggcatttcttttttgctgagctctcaggaaaaaatgggcgaatgaaagagaatgggagaggaaagaaagagcttttaaaagcaatgcgtcaataaacgaccgtttaataaaatcgcacaaattaaaaaaaaattagtataaaagtggggctcttccatcgccacattcattaatattatctatatttatttgcttcgtctctctctccgactttttctccctgaaaataccttcaaaatattaatgaacggccatgagtttttctattcatttctgtctatttgaaccgttttttggcaataaagatggattttggttaaaattgaatcttgggctttgttcgaattagggtccgggtttgaaattggtagaaatggatgtcatattcgtgattagcgatccctaataccccttgaaaaacttttaagacaaaatacatttattttgaaatattaaaaaaaaaaaattttttttgctcggattcatttgctgagatattccaaacttatttttgttcccaactgctgaggatttgttaatccaaaaatgccgttgtgtgagaaaagaaaatgccgactccattcacttgcatgagggtatttaacatttaacaggctaaattaatccaaatgaattcaaatggatcaataatcatcggcatttttaatctgcgagaagggcacaaaatggatcaaaaagttttcaaagaatttaagcttaaatagttggcaattggtaaaaaccccaaagaactgcctacacacaaaaattagtttaaaaattaaattgcgttcactgctaataatcattaattaattaggtaattcattaatgatgaaatgaaaatgcgctggtatgaactggtggaatggcaaattgtgtaattaacatgttcgttagcttggcaaaagtccaattagtggatggacatttaattgcagattgaattttgaattttttggttgtttttttaatttccatcaaattcgtttggcaattaattagttttacttttttcgctcggtttaatgagcgtgtttcttactgtgaaagttaaaatgatcaaattaattcacacgattgtaatgagctaataatttgaccgattaaatgtttcaccctttggatataatagaaatcaacagaattttttcgttgtaaagaacgcaaaactaggagattttgtactgatgattggaaaggcaaacaattttaatggaaaaatagaaatattaattaatcattattatcattttattag

SEQ ID NO: 17392 - DNA, 1439 bp, Heterodera glycines
  misc_feature (8)..(8): n is a, c, g, or t
ttaagcanttgagatataaaaaaatcgtctagaataattatctcaacaatttgtcgggaaagctgaataaatttctgttgcaataggcatattggcacaagacataaatgtagagcaggcacaaaatagaggaaataccaaagattaaaaaattcttgtttatgccccactctgctttggctggccataccttgccagagagtggagatagaccctttgttgatacatttggaaatgtcgagcccgcctagcgcattcgaataacacaaaatttgtttgcatttgccaccaaacaatccgcttatgacgcgccgaatgaaaattcacaaaaatttggcaccggaaaaactgcattttttcatgggccagcataataaagtaaacccaaaatgtaaggaaatttaaattggtcatgagagatttttagttttttatttgtcccatcctttttctgggaaaaaacttttcgagaaaagctgaaaaattttccacttgcatcagaagcagactcaaattcttcaacacacaatataaaaatattacgcaagaacttatttttacatcctttttagaaatgctacataaatttttattgtaaatagttacaaacaaactttttttcactgccaatttctaccagttgccaaacaaaaaggcgatagttaagcattgagatataaaaaaatcgtctagaataattatctcaacaatttgtcgggaaagctgaataaatttctgttgcaataggcatattggcacaagacataaatgtagagcaggcacaaaatagaggaaataccaaagattaaaaaattcttgtttatgccccactctgctttggctggccataccttgccagagagtggagatagaccctttgttgatacatttggaaatgtcgagcccgcctagcgcattcgaataacacaaaatttgtttgcatttgccaccaaacaatccgcttatgacgcgccgaatgaaaattcacaaaaatttggcaccggaaaaactgcattttttcatgggccagcataataaagtaaacccaaaatgtaaggaaatttaaattggtcatgagagatgtttagttttttatttgtcccatcctttttctgggaaaaaacttttcgagaaaagctgaaaaattttccacttgcatcagaagcagactcaaattcttcaacacacaatataaaaatattacgcaagaacttatttttacatcctttttagaaatgctacataaatttttattgtaaatagttacaaacaaactttttttcactgccaatttctaccagttgccaaacaaaaaggcgatagttaagcattgagatataaaaaaatcgtctagaataattatctcaacaatttgtcgggaaagctgaataaatttctgttgcaataggaatattggcacaagacataaatgtagagca

SEQ ID NO: 17393 - DNA, 2672 bp, Heterodera glycines
aaaattgataagtttggaatttgaaaaaaaattgggtgaaattttgcccggcgaaattttggggtacaccccgaataagctacctaatttcttcccttttcacagcttggctccctggtgttcacattaccgcatttttttgccgaaccgtacacaacttcgtaccaaattgaaaatgctggactttcccgttgcatgaaaggtttgttttgggttttttttcttaccaaacttattttttattttaaggtgcgcaatcactgcggtgcgcggggccacggcaaatcacggccattggttttgacttgggcgcggtcggctgcaatttggccatcatcatttttgtgccgaatttcatgtgcggaaaatgtttgcacactgttgtgtttgggttgagcggctttgacgccaacgggtaccaagtaagttgttttattctcttttttaagaattcaaagtttgaaattttttaaagttttggcagcaaaattttgggtacatccgttttccgtctgtccaaatcagtaattgtttttttaaattcttacttttccaggtccatctctttcatatgcccaaattttgcggcttcctcaaaagtgcgctgcccgaacggaccaacgaaattgtgtggctgcagcacatgaaattcatcgtattcgacgacactgttctcataaggttctttttcccccattttttccccgattttaatgggtccgtatgtcataaatattgtccgaccgaccaaacccttttaaatttaaatagttaaaggttaaaaaaatttaagggtaagaaaaagaagaaagatttgacataatcattgattttgaaatttctggcaaaattctgactggaaattcgggaatagttcctccggtttcctaatattttgtttttggtttaaaaaaacgaatatagtaaatcttcctgatccattagactttcgaatatttgtttttttttatttcatttttttaaaatgttgccaccggttttttttctaaaatctctcacaattttccagtgccaatttgtccgaccaaaactttgtcaaccatcaagaatcgctatttgctgatcgagactgtccactgttgaccgacttcttcgtcgacctgttccgcctcgttgataatccttccggcggatgaacgcgtcgcgtcggaacagttttttggaaaaaactcagactcttggtaatttttttttaattttctattcaaaattggataacttttaaaggaattattccgccaaaaaaccaccgggctgtcgtccatttgtccctccccaccaaaaaactgggaatgtgttggcaccgaattttttttataaagctgtaaattatgcttaattggtataccatgggagcaaaaaaaaattttcaaaacgtttattaaattttgattttttgagtgaaagaattggtgttcccggtgataatttttttgccgtcgtaatttttccctatcacattttttaaaaaatattgaaaaatctatgtctaatgaaattggtatcatgcgcaggcccatagccgaaaaaaagaaattcaggaggcgaaaagccgacgttgtttttttttggtccctaagaattttttctctggtataatttttcagaattaggccttatggcattttttaaagttttgtccaaaaaagcgctgaaaatttttaaaattttttttacttgtgataggtatcttataaaaacttttctcagattctttttcttgaaagaattcaaagtttgaaaattttttaaagttttcggcggcgaaattttgggtgcatccgttttccatctgtccaaattagtaaattgtattttttttcaggtccgtctctttcgtatgcccaaattctgcggcctcctcaaaagtgcgctgcgctgaccgaaccaacgaattgtgtgactgcaccacatgaaattcttcgtcttcgatgaacactgtcgtcatcacaaggtttttttctcgcatttttgccctattaatgggtccgtatgccataaatattgtctttggccaaaatactcttttaaattaatttaaaaataattattgattttgaatttttgacatcgggaatcgtacctctgatttcctactattttgtttttaatttaaaaaaaactaatttagtgaatcttttgtcaaccatcaagaatcgctatttgctgatcgaagacggtccactgttgaccgactttttcgtcgacctgttccgcactgttggcgacaatccttcccggagacaggtaaaaaaattttttcatattgtttgatacaaaacattttttttttggaaaaaaactcagattttcgatacacttttttcaaaaaaatttcttttactccttgattgttgtccgaattgaatgagtataatatcattcaatggtcctaattgtgattacctgttggcttcaaaattggataaattaaaggaattattccaccaaaaaaccaccgggctgtcgtccatttgtccctccccaccaaaaaactgggaatgtgttggcaccgaattttttttttaaataataaagctgtaaattatgcttacttggtctagcatgggagcaaaaaattttttttcaaaaaaaagttaaattttgaatttttgagtgaaagaattggtgttcccggtgataattttttt

SEQ ID NO: 17394 - DNA, 2168 bp, Heterodera glycines
tctttgattttttgttgaagattttcagccattcttggaatcacaatttttcgaaaatgccattcactgcgagtctgaataatatctcattctaaatagtggctgactgtcaaacctcaaaattagggtatgcacgttgcgttaattttagaattgaattttcaaaaactgaaaaggcgcagttttgctggaccataaaattagtcaacatttcctcaacttccttttgctcgtcatgttttttaagtaaaaaggaatcaattgtctgaatttgttaaataaataaaatagccttaaattattaccttattttttgaccttttcggctcctgtaattgcaattctttgtattcctttaaatgcatcgacttcaaatggctccacattcctttggtcgatgtatcgcttcggttcaaaaccttttgacataaattgcattgtacattcgttgattgtgaaattttttcgaaacaattccaaactttagaagcacaaaagtccatttttgcctgatttcaagaaaaatatataaaaaaagttgtgatttgaaatatttgttaaataaaaaattggaaagtaaatttatttattttgtatcatcagctaattaacaatgcatcacacatttttattttcacccccgttcccccgcgggggtgaaggtcgcgggggcgggggttgcgggggtcagagtcacgggggcgggggtgagcccaaaaaacctgtcccgcccccgggggcgggggcggggctcgaaccctaatttagaccggtaccttttaaattataaaccggttgaagcacctgcaaaacaaacacaatccgtcggtacactgaggaatatacaattaattgtaaaataaaattacaaaaacacaaccgtttagcgacttaaacggtttaaacggtgaataaccgaatttaaatgggttgtaaaaactgcgtaagaaaatacattggtaaaatatgaaattacaaaattgcaaaaacacaaccatttaacggcttaaacggtgaacaaccagtttaaacgtgttgtaaaaactgcgtaagaaaatccagtggtaaaacatgaatttacaaaattacaaaaacacaaccgtttaacagtttagaccggtaccatttaaattataaaccggttgaagcacctgcaaaacataaacacaatccgtcggtacactgaggaatatacaattaattgtaaaataaaattactaaaactcaaccgtttaaccttaaaaaaaacagtttaatccggaaccttttaaattataatccggctgaaacacctgcaaaacacaaactcaatccgtcggaccacaaaagaatagacaattgtaaaaactgcgtaagaaatacaatggtaaaattatgaaattacaaaattacaaaaacacaaccgtttaatgacttaaacggtttaaacggtgaacaaccggtttaaaacgggttgtaaaaactgcataagaaatataatagtcaattttcataaaaattggattaaaattcccgaaaaaattttcctggcggcgcctaacgacactggacttccagaaaattgactgaaaattggattaatgaggacaaaaaaatactaacaaagaccagcaaatttaaacaaattaaattatttacggactgaaatagattattaatcgactatttctatttgtatttatttttcataatttatatttcttatatttctaaaataaaaaaaatttcgacaaattcttcttttttcttcccttcgacgaaaattttatacactggcaaaaaatttgtggcgcgctctaagtttctcatttttgatcaacatttaattttttagcattttttattaaatatttttaaaaaatttcatgctttttttttgtaaatataaatcccagtcccagtaatgaatattttaatggtgagagctataataaaacatttttattgaattggaaaatcaataaataagcaagcatttgtaaagtacaaattttctcattttttattcttttttttaattatatatttattattaatatcttttttttcatttccaacgaaagaaaaatgtatttattatacttaatcctattttgtatacaattatttgacctatttgacgcaatgaataatggacacaaaagattgccgtcaagcagtgaaaaaat

SEQ ID NO: 17395 - DNA, 3270 bp, Heterodera glycines
  misc_feature (780)..(780): n is a, c, g, or t
  misc_feature (792)..(792): n is a, c, g, or t
  misc_feature (823)..(823): n is a, c, g, or t
  misc_feature (857)..(857): n is a, c, g, or t
  misc_feature (3243)..(3243): n is a, c, g, or t
cttgtgtgcttcaagggtgggaaaggaaaaaaagaaaggttgagcgaactcccttcggacgaactcttcttagcccacggacgggctcgcgcatcgatcggtcacacgggactccctcacttggagtgcccagctcgccttagccctcgcacgggctcagcacgttaaaacgggactcctgcctccggagtgcccagccgtcccatttttctctcccttcccctccccaacgtcctctctccccctccgagagtcggaccatcggacatcttcagcgcaagacgggagaagcacgctcccggcagttcaacttgtgggattagcctaggagtcccggcttctccaaattctaagtcggtggtgccgttattcacatcactcggcgccctcgcctgcgccttttgctgacagtactcaagcccaagggagccacctctccctttgccggccactgccagcttcactcgttcggcgcctctgcctgtgccgacgatcgcagcactcaagcccaagggagtcacccctccctctgccggccgctgcctttccttagggagtccaatttctcccgcgcaaatctttgtttgcctccccgacccctccgcctcactccccttgggaaagggacccggacggcatcgcgaatcggaacggcaatttgaggagtgaggcggtgccagtggaacgggagaaactcccgaccgaacagaggaaaggagttttcgccacactttgtatgtaatggaattttgaatggacattttcccattatagatacangttgatgagggntccgcttgtaatcgaatggatttgtgctgangtcgccaacaaaaataaaattataaaacattatntctatgctttatcctattctatcatttttgttttatcatcacaaatacgtacaattattaattatgcaataaataattaattatgtattcattcaccttttacgccaaattgtccgatgaaaaagtggtggaaatttgtcgacgaattaatttgtgatgattttgtcaaaatgtaaaaaagtaaataaattaataaattacttttgtcatttatcggtgtccacaatctctgctatggtcgtttgtccgctttttcttctgttggtggcttttcccccatttttttacacgtcgacacaaaaaattcagtgattggtccaacggattcaccccacatcaacaaattccatcccaccactttcattcatttcattttatttaatcatttgggaaataatatttattcataaaataaatcaaataattttttaattttcattaattaaatagtattaatattcattaattaattaatcaattagacaatgaactccttttctctattgaccgtctttctgagcttggtcattaattgctcaccgatacggtaatttcttaattgaaaataaattattatctttgtaaatttttcaaattttcaatttttcagccctttgtcatccgacgttggcatttggaaaacgtgcaatggcaaaaatgggataattatggtggaaaatggatgtacaaagtaaaataattgaaaaaatatattttatttatttttaatcattttaggctccttctctgctaccaaagcgaaatggccaaaaacaaaaaaattggaaaacgttttggggtgggcaaaggaaacattggcaaactgaaatttgtggaatgtgccgaagagattgccgaagaccaatggcacggtctgatcattgccaagcaccaagacggagtgatcagctacgaatcgaggcaaatttcaaatgaaaaatattttaaaatttggatttaattaattaagccatggattcgacgacattttcggcaccgaacaaataaaacaaacggaaaaatatttggaaattaatttgaccaaaagtaaagccaaattaataataatattttaatagtaattaccattttacagatgctgaaccacttggaaacgaacttcaagaagcgctttcttctgctgcatttttggacgattttatgccatttgttttggcatttgaatttggcgcaacattttgcgcagaaaacggcggcaccaacaaattgtgcaaagagaaagtcatcttttcatatttaaaattcatattttaaaataattttattttttagtgccttacattggcaccgtttgttggcacaaccaaatcccatggcaaaacaacagtaacaacaacttcaatcccaacgaccaccgaacggcaaacatttgcatttgccgaatttgtgccccattttggcacgaattgttcgaaaatcgttttccccgtggaagtggccaaattcattttgaacatcaccgcagtgccctaccgaattgcatgcaatgtgtatgaacaacattacgagatcggacaatcggtggaggattatttggtaaattcaaacaaaagttttttcatgcttgcatggaagtgccgacaaccaaatgcgcaaagtgattgaaattccggcaaaaaattaggtgcaaaattctcacaaattgtttttaggcatgtggaactgagcgcatgctataaaagcatgaaaacagtggggccaaacgacaatgtcgtcgccaaattatgccaagaccatcttaatgaatcgaatgttgccggattttctgtacaaatttgcatccatcgggatgaaaaggaacagaagcttgtctttgaaacattcttgaacctttccaccaccaacgaattgtatggccaaataatgagagattagatgatgtaattacttaattgggttaattaagcatcaaaatgacgcgcaatttcccaatttccgttgaacaaattatggagataaaagaaactgttcccattttctttctcgaatttggcaccgatgagcagcaaagcgcaatccgagaaaaagccaatgggaaagtgatcagcggaccattgaatgaaaatgtgaaaacaaatggatttttataattaatttaaaataaagccaatggcatttgccaattattttttaatgaattaatattaaattgagccaatggcatttgccaatattttaattggaatttagtccaatggaattggcaccgttctcaatgacatcaaagcagaaaaattaaatgaaaatttggccaaaatgattcatttggtgccgccttatgctgatcaaatgctggcattcttccagattccaatgcctcggttcaacaaacggatcagttatcggacggatttgaagccgtacngaaatgatccgaaaaaagaagtaagaa

SEQ ID NO: 17396 - DNA, 1478 bp, Heterodera glycines
  misc_feature (19)..(19): n is a, c, g, or t
  misc_feature (44)..(44): n is a, c, g, or t
  misc_feature (60)..(60): n is a, c, g, or t
tttaagtctgcttttgacnttccaaatgggtcgatgttccgccncctgcgataccgtacntaagtccaacggtaacattggtgtgctacggtgatttgttttgtaacaaggaaatgctgcaggaagactatgaccgagcacgcaaaagtgggtttgggaaagaagcataggcttactgtagttgattgtttacggtacaaaagtgggtttgataagtgtagtataaacctactgtcgttggcctttacattacaaaaggttattttgttcttttgattggaatgaatggaggggattacttactgtaatctttacagtcagtagaaaatgggtccgtttttcactgggggaggggcggttttggataaaattcgggattagtcccgacgcgatatccctcccgtccaacataatcttcaaaaaacggggtgttagcaaatggcgggacctaaataattatgtgatcaatcaatcaatcatcatcaatcacaaaggatgcgggctcgagcctgaaaatctgatcagccgtcggcggaaaaggcaatttcgtccgtttcatggcacacaaaagggcaaatggacttcgtttccgatcgtgatcagttttttggaagataaacgtaagtcgcctttaaaattgaaagccaaaatttatacattttaaaatggtttcagtgccaaaagattaccgagcatgggaagcggcgataaaagtcggtgccgacatgataatgtaggtgatcaaaatggaaaaatatttaatttggtgaataattttttaaattttaagaaagtttaaattttacaagaaatttcataaaaatttttatatgaaaaaatattttttgaaatttacaaaatcaaactatatcggaaaaatattcaatcttttcttaaaatctttgcttgaagacccagagtaagattctcgagagttttttctttcaaaattttaattttctctaaaaagatttttcgtcaaaaaagtctcataaaaatttataatattttgaaagcttcaatcaatgggttgcttttataaaacattttttgccgtgattaaggagcattttgtgctaaaaataataatttttggcgtcaaatttgttgtgtaaaaattttcagggcattttgtttcgcttaataatttgtgccgttttttgaatttctaatttaaaatttgtttatcctttttaattttcaaaacaggcaacacacatgcgttcaattcaaaattgttaatgttgaagcaaaggacaattacagtgaaggcattttaattagagaaattgagtttgccgaagctcacaaacttttaaagatttgccgtaagttttaagaaatgatttttaaataaatcagaataaaaaaattgaaaattttggaaaaaattcttaaactcttgaaaaatagcgattttttttttcgaaaatccgcgcgaattacagagtttttttaattcaaatatcttttgagat

SEQ ID NO: 17397 - DNA, 3244 bp, Heterodera glycines
  misc_feature (23)..(23): n is a, c, g, or t
  misc_feature (29)..(29): n is a, c, g, or t
  misc_feature (3231)..(3231): n is a, c, g, or t
cgcctatcggcaacgatggaacncaaaancactttttctgcccaaaattttattcctattaacttgatttagaattttttaaatttagccattaaaacatttaaaaatttttaattgattttatacagtttcagaaattccgatcttccgaaatttttgaggctaggaattccgatttccaatttccgaaaatctttgggcctcggaatgccatccctggtatatgacataggcattatataattgcgaacattttgggcacaagattgttattgatagcgttataacgggtggatgagatgaagaatcccagcgtcggcattgcgatattccttttcctttggtgaccatcagcagtttcgtagcccataatttttttcttacttgatcaatgcttcattttggtatcaatcgaaagattaaagtctacagtatttttatataactaattatcggctatttaattagatagttgtttataaaatacgcgaaaaagttaaatttaggatctttggttgtaatttttttttcctcgtgatgtttcattttgtagttattatagttggttcttaagttagcaagatttcatccaaaaatttgttatttgctatgacacttttttcaaaaaaaagaagaatactcgtagaaaattgagtcaatcaacctttaaaaaagttcgttttgatccaaatctgttaactcattgaaattttaaaaaattttcggggatgtttgacaccgtatagccataaaatgttctgattttataaaagtaaaatatttatttattttatttagcatttttcaaatttgtctaatcggttctgtcgtccgttggtcacattccgtgccgtggcattttcctcctcttccctccctctcatcattctttttggttcttcgaaatggtgcacactttgagcagtttgatgtggaagcacggctgttcctgttggttctgctgcagttgttgctgtccctgcttgttctgcccctgttgcagcccaattcctcctcctcctccctggccaacattgccaatgtttccgcccccaatttcttctgacggtgtgcactgttctttgaagggacatcgcgtgatcgaattgatcaccatcagcacgggttcacattccgtctacaaatatattaagtggataaatttaattggttaacaattaaaataaatgatttactcggatttcttcgggcaattcttgaacaagttcgacggacttcttcactttgtcaatgaatgggagggagccgtccaaaaagaggtcttcgagctaaattcgatttaggacaatatttcactgtaaattatggtaattacttcgttaattttgtttttaattttgcccacctgatcagcggtctccttagccttagacgaactcagcttctgcttcgcctcctcaatgttctgcttgaactggtcgtccgacacattcactttcatcagcacgttgtcaatgtttgcctaaaagttcttcattatttaaaataaataggatggccttgttcatgaaaattgtgatcggaaatgatcgaaatggtgtgattaaatttctttaaaccaatagggaaaagttggtttgggcgagcctcaattgaaaaactaagttttctgtaagagcaatcagttttaaaaaacttagtcataggccacttgcttattatttggcaaatttagccccgaaatgattaaaatttgatcaatccgtgccttcaaatcgccaccctgctcctctgccaacacttggaaggcggccacttgctggtcgtccgacagattcttgcaattttgtgccgtgtccatcagcagttcaatctctttggggttcaagctcagcgtaacgctgggcgtgaaaagacggcatttgcaaaaggcgcaacgaacgcggcgagaacaattggcaaaatggagagcagagaaagcattttttgaaagggaattcggaatttctaataacaaaaatagaaaaaaaatgtaaaatggcaaattttttgggtgtgctgcttaaatagtaacacaaattgttttgccccgattgatcagtgatcggaatgaatcaacgaatgaatgaatgattggtgcgcgcagttgtaacaatcatcaatcagtggcaacggaagggcaaagagtcaacaaaaacaatttgaagcgcttaattaacttttacagagttaaagcaataagatttaattttttacttctattagcatttaaattcgattttttttttatctaaaatgaatatttttatgataaaacttaaatcaatttgggtaataattataattatcgtattaaaaaagaattttgcttttcctaattagtgcaaaacatcaacatattgcaatgttgtttcggtcaacaattccacaaccaatcttctcgagaatgcaacaggtttttgtcttttccttttatttattttcacttcacacggcaatttttgaaaaacaaattttgttgttgactttaaaatgacagaggtgagggcaatggaaaataataattaatttgcaaatgttcaatttaattaccattagcctttttggaatttctgttgagacattttagcaaaaatgccgtaccgttagcttccatattgctcattttacagagttctgatgaaatttcaactcattcaaaaacaattcaacaaatttgtttgaagtgataaagtttaatggtttatattttttatcaaataaagcttataaatcaaatgtttttagcaatgtttttatttttgacatcaaatctatttcgttcgctgtttcttcagatattttgatttttcgatcggaactctgatccaataaaaattattcaactattttttatgcttctctctccattgtacttttgtatcataaaaatctggaagcacctagttttgaaatttcagacttaaatacaaagcgatattaattaaacgccaaattcattaaacgcaattgagcttgtccttaaattattcaaagtacaaaattttttatttttggtaactctctccaaaattgtaacgcaaagcggtggttcgttcatcctgcggcgaagataaagcgcgaatttgtcaatttggtcagcaaaataggatgccgccgcctctctcgagagtattaggacaaggtcaaacgagctcaatttgataataatttttataaatttttgaaaaatcaaagcaaactggcaaatttcaagctggcaaaacctgncgctgctgactga

SEQ ID NO: 17398 - DNA, 3478 bp, Heterodera glycines
  misc_feature (11)..(11): n is a, c, g, or t
  misc_feature (2711)..(2711): n is a, c, g, or t
  misc_feature (2863)..(2863): n is a, c, g, or t
acaaaattttnttgcgtcatctatacaaacactacattactatattgaatgcttacgctcacatgaaattaaaattttcttttgttgataaccctccccctcaacggaaaacggaaattgacctctgtctgcatagccatggccttgatctgcatttatcacgatcatcacccaacgccaatgatttgaaaatttccaagtttttgtttgggagggactcagcaaaaagttgagagaccgaccgaccgattgatagactatttttgttttccgatcggtcgcaatttctgtccgtttcaattttatctttgccgggcgatctttgtttgaatgccaattttgtcatactgccgccccccccccccccaaaaaaaaaaccaaggccgatgaatttgaaccatttcgaggccataggttgactgtgtggtgcttggtgggtgtttttaatgcagtaatttttacccattctaaacgattttttgtgtgtgatttacacaatttttgatcattatcacccccggggggatcttcgcctttttcatggggtggagaaggaaggaatttgtccatccctcgcgccgagtgcgccccggcgcggattgactcggtcggctgagcgtcggacaatttggaacattcatttttttgcttcatgttttgttatagagcctagcttattaaaagcattcatatgatatcaatatgtaaaatttacgtcttaaatgggtctggcgcgttggcgctcaaccggcgccctgtccacgcctcgggcgaatttttcgtggaaagtttcactttacgtgttacgctttcccaccccaccggctcgcggggtgtgacagttttgggctaacataaacaaacacaatggataattaattatctctaattatcactaattaataaaataatttttcattatttgaagaaataaataagtgaggaaataattttgagttgttttctggccccagaaaattataaatttcgcaataataagcctttattttgtgcgtttaactcagggttacccttgaaaatttcccgaaataaagagcatcgctggtcaaaaataaggacatttttttaaaacacgcttccaaaactttgaatcgcttttttattcaacaaaatcaagcattactttggtaaatttcagtgcatttagaatcaaaaaaacagatttttaacaattttttcggcgcatttttccgaaaaatttttgggtatgggtgagggaagagagttcggcggtgccgataggcgccgccgagggaaattttttaaaaatttaatgcaatttgttaacaagttctgtccaaaaaatgaccaaaatttgcgatcttgggctaatttttaagaaaaaataggagttttggggggccggcggtgccgataggcgcccctgggggaaaattttaagaatttttaatgaattttgttaggaattagccaaatttttcagaaatttcctcttttaaatgaaaataagacactaccccaaatcagaacatttcttagaaataagaacagatatgcccctgctctaataggcgccgccggaaaattttgtaattttcaatgcgatttcttaatgattttgttcaaaaaatgacaaaattagattttgagctaattttttttaagagaataagaaaccgccgagagaaaaatttgaatatttaactgaatcttgttaagattttgcatattaattcgcttcaaaaaacatttctttcaaaaattatcatttaaaaatctaaatttctccctgaatccaaaaaataagatgaaaataaggacaaagagcttaaataaggacaaatcttacaaataaggacaaagggtaaccctggtttaactagagaattcttgcttttatcatttgcccgcttatttttatcgtctgagttagattttcaagttttttagcctttgactaagattttgttttgttttctcgagtttctgagtttgaatttgcggtctcgaaagccccaattttagaaaaatagttttcagtgctgaacataaaaagcgcatcgataaataagcaaatgtacaaatgtttattttgttaatgttttgttttgggaaataataatagagagaggcataaattgtgacaaaaatagatgaatgataaattcaattagagtccattgatttcttactgtatcctacagaatcaaaaattagaaaaatgttggtttttttatactgtaacttattttatgaattctttttgcaggaatcatagttgcttgccttttaatgcgcttttattcgccaataggaaccatagagaaattttttaatttatataaaatattgttaaaattttttagaaggctttatccatcaccgaaatttcgtcaattaaatggaataggatatgcgggaaatataatctatatgaattggagttgctaccgaccgtcgggaagagaatgtcggggatcatttgtcgggggatacatagctagagaaatgcttctcagtgacagtagaatcggtgattacctacaattaaccctggtttttggggtttttagaattttgccatgccaatgccgtgcaatcttgaaaaatccccgaagcttatttctcaaaaggcgatactttttggtagggtatatttttaaatccaaatttttaataattgtaaaataagactaaaaatgaattttttggtccgctttttgttcacnaatttttgcacttttttggccgtccccacccgccggccatggtttgcttttttgataatttcattgctggtgtaaatttaatgccccccatggcattatccggagagaaagggatattcttcaatttcgttccatccccttgcttgctgtangccggcctaattaactccattatattcaaataccgggggggaataaattgttggcattttctatgaaaaaggggaccaaaaaaaatgaaaagtaaccttgaaattaacaaaaaaaaaggcaatttttttcttttgttaaaaaaaaataaggtttgtggaaatgaaaaaggggggaccttaaaaaaaaggggaaaagaaaaagggggaaaaaaaagaaaaaaaaaaaaaaaaaaaaaaaaaaaaaaggggggggggggggggggggaaaaaaaaaaaaaaaaaaacaccccccccccccccccgcgcggggggggggggggtgtgttaaaaaaagaaaaaaaaagaaaaggccccccccccccctctttaaaaaaaaaaaaaaaaaaaaaaaaaaaaaaaaatatttttttttttttttttttatttttataagaggggggggggggggggggggggggaggttttttttttttttttcttttttttcttctctccccactacaatatatttaaatatttataataaaatataaataaaaaaaaaaaaaaaggagggggggggggggggggggggggggggggcggggggcgcccccccccccccacccccccccc

SEQ ID NO: 17399 - DNA, 4294 bp, Heterodera glycines
cgctgatccgctgaaaataaagggcggccaaacggaatggacattgtgcaaaccttgaaaaattttttaatttcaaaaaaaaatttaaaatattttgaaattttacaaaactggccaccgtgcaaatgcaaacgccaaaaattgcaacatttctgatggattcggcctccgccttcaaatcgtgcatttctttgcccatttttagctttttaactgaaattataatataaatataatttatattttaaagttataaaaatagacaaactatggcaatttgaaaaacaatgaatttttaaaataaaaaataatatttttattgcaaatttatttacatatagtgtcaaattctttcattttaattaaggaaacaaacactagcaatggcaatgaaaaaataaatacaaaacttaagactaattttagattggcaaatcttaaacaaaatgagcttttcaactttatatgttggaaataaaaatttttcttgtaaaatttgtaaaaaaaattttttttgttattatttgaaaaagaaaaaaagaaaaattcaatggttcatagcatagataagtgaaacttcttttttggacatgtgtatttatacggggttacacataagaacataagtgggcagagcaacacggggtcaattaccgaaatgattaattgctggcgctgagaaaaggcatcaaattaatttttggacagaatgctttgtcaagaggtaaatagcagcagcactaattgaggcacttcttaatgatggaacaatgaacaattagtgcacctaattaactaatgaagtgacaaaatgggcggaaaattaagaaaatgaacacacaatgaaatgtacagagaacagcacataaaattaaaataaaatcagaaaaaccacatttttgagtggaactacttattttatttttctattttttattgttttatttctcaatcacaaaacattcgccgcggggggtaattaggcggtgcggcggacacggaagacaagcaaaagacaataattaatgataatttatttggttgcatttaattattactcaatcatgtttttttggtcgatgttttgtcaaatcgaaatttatatggtggcgggtcaattaagaaacaaacatataaaagagcgaaaaaattttaaaaaacaacaattagaataaaaagcatcatttgaaaccaatacaaataagaaaaacgaaaaattacgaattattttcctttttccatctctttagggtggcagttccaattttcaaaatgtcagcaatttctttgtcacttaaagaaggatttgcttttttcatttcataataatcattcattttgctcattttttgttcttcggtgaatcgaattggacctaagaatataataaaatttaatattaataattaaattgaaaattaatttcaaatttacttttgctcatttcaatgccaaattcctttttccattttcttaatgtttctttgctaatgcccaactctttcgcaaattgcttctgtcttccattttttggcattcttttaatttcatcaatttggtcaataaattcctgttttttctttttataataataaattccaatttcttttttccatttgtaaatttttggtcgattaattcccaatttttccgctattttttgctcagttttattcctaacttttgccgaatattttccccgtttcttaattccttcttttattgcatgaaatttgtgaataatttcgtttttttgttgaaaatccaactgatcgttctgatcagttgattcattttgatcattttgatgaaaatttgcattttgatcagtctcattttcattttctccaattattatttcattttgccattcttcgccaaatatttcagcaaaagttggtcgacattttttacacagattaactgacaatgttttgtcagttgaattgtttatgattaagaacacaaatataaaaaggagaaaaagcatcactaaaaaaatataataaataattaataagtttttaatatttttaatatatatatttgtattaaaattaagctaatttcttcggaaaataattttttatttcattttaatgaatgtggagaagcattgccaaaaaggcgatcaataagtgaaactgatcatcaatagattttcttaataataaaatattaataaataatattaaaataattaaaagccatgaatttcatcataatttcaaatgccatttcgtaattacgtcccattggatgttttcacacttcatcactagggcttcaatttttatttgctgagctccctatggtctgaaatacacgaaaaacaagttgttgttgttttttggtggttgttaaggtacttttcgagttattagggcctattttctaggtttttctttttagagcctaaagcctaaaaaatttaaatttatataaatcataaaatttttacaattatttgtcggtcacaaaacaatcgccggggggggagggtaattagggtaattaggcgcgacagacacgaagacaaaaaaacgcatcactaaaaaatttacaaaattaattaataattaattaataattttattaaatatatttgtattaaaataaatttaatttcatcagaaaataattttttaatttcaaacgaaaaattaaaaaaccgatatagaagtcgaccctcctctatccaatggtatatcatttatatgcattttccgactgacagctcggaatgttcccttgttaataaaattaattaattgtgccatgaatttcataaaagaatcataattttaataattgaaaatttatttaaattagaaaatttattgactattaattatcttttcaaattcatttaatttattggtaagactttaagaaatgggtttttcgagttgaaatccaaaaaattaaggactttaaaatacttactcttaaaaacaattaaaaaaccacaaaaacaaatttaaagtcgtttttattaaaattattccatccttcaaaacaaatttttaaatcgtggcggaaaataaacgatgtgctttatttgaatgcttagttaaaaataatagtgatggaatgaattcaatgatgagtcgggggcgtttgggccccagtttttgggcccccgcgtttgggcccccgtttttgggcccccgcgtttgggcccccgtttttgggcccccgcgtttgggcccccgtttttgggcccccgtttttgggcccccgcgtttgggcccccgtttttgggcccccgtttttgggcccttgtttttgggcccccgtttttgggcccccgtttttgggcccttgtttttgggcccccgtttttgggccctcgtttttgggccccagtgtcgtttgggccccaagtacagaaaaatgaaaaatcacagtaaaaacaactttttaaatttcagcataaaaatgtaaaataaacattttaaaaataaattcaacaataattttaacaataaaaaatgtaaaaattaacagaaattcacgggttcataaggtaatttggacaataaaacaaaaaatcacggttcattcgatagttgcgagaaattcccaggagaaactccaaaataatgtgaaattgattttttgaactcgcatctccaaaattttgtcatcccatcagaactcattttagcgaaggtgtgaaggtggccttcgtaagacaattttactttttgttttttggttgcaattgggttagccatttctgaaaaatgtccaaatcagaatgtacatcaaattggttaactattaaaaaataataggatttggaataagtaaaatggtaaaaaatgagcgaatgttaattaaacctaacttatgccaagtggcgagggatccctcaggcttagtttatagaatcttaatttttttaaaaagcacatttttctatttttgggctggggcccaaacgactccggggcccaaaaacgggggcccaaacgaccccggggcccaaaaacgggggcccaaacgcgggggcccaaaaacgggggcccaaacgctctggtcccgatcatttcgtcactgatcgtttcgtcactgttcagttcgtcattgagaaataatttttaaaaatgttgcaaaatgtcataatgtaaattattttcgctaataaaatatttttatttcggaaatggttattaacagggctgccaaaaatatgcacgaaaagtgaccaaaatatgcatataaatatgcaaataaaattgccaaatatgcattaaatatgcacaaaaatcgcaaaatatacacgaaa

SEQ ID NO: 17400 - DNA, 2000 bp, Heterodera glycines
aacggaaaagtaaaaaaatcacccaggccgataaaatcatttgcatttttgccatgtcccctaacgacgttccatcggcaacgggtgcagtcaaatccacttgctcctcctcaaattcgggttttggaatggtgttaaagaattcgagcagttcaacgaggcgatcgtccgaaattgtcagcacaaggtcaggcagttcaccaatgagacggaacctgattatgagaaaaggaaataaaatgcataataacatatggaatttcttcagaaatttaaaataaatttcgttgtattggaaaaataattgtcaaaaataagtaaaaaataatcacatcggaatttggacgtcatcgatggtggctctgagcatgtcgatgcacatccccgtgggtttcagcaaatggtcatccgacgatttgtccccccgggccttcatgcaattggcaaaagagtcggaaaagatcagtcggagattggagaggcgcagttggaaattgtcgtatgccttggccaccaatgaacgcaatcgctgatcggttatctgcaaatattattattttcttaaatttaatgatgcccttagcaattccctcacatgttcgtatgcctttgtggacggctcgtccaaagtgttcagtttcaattgaccaagttcggcgattaatgtcgtttttgttgggtcaaaagcaccgccggaacaaacgacaaaaatggcagggtcaattttgaccttcaacttcagcttcttgcgcacgtcaaccatgtgctgaagggctgtcgcagaacgggcctaaaaataacattagttaatgagttatgattaggtaaatttgctaattgtaagccaattgccttgacgtcctcgtaacgcgcaatggccagcgtagtcagttggtgaagacggacagattttggcggtctaaagacgtcgagtgctttgttcaccgccggggcatggtatttgaacatcacctaaaaattagctaggttatattttttaaattaaaaaaacgaatgttccaaccggagcaatgtttagggaaacgcgttgatcaaagtcgccctctagcggatttgtttcaaattccaaggtcaaccaagcccgatcagtctctgtcatgtgcagcatggactcggtgccagcatgcatttcaagtgacttgacggcggaagtgaagctaaataggcgaataaccagaaaacttagaaggattaacaataagaagtatttaaaaggtaattaattagctttggaacctaaaaaactcataaaagtggcaaaatgttgttttaccgcattgcgctcgcagccgatctctgctccaatttagcggacagttgagaaaaacgcagttccatcacatcatccaacttcagcatgagtgtttttaggttcaatttgaacagattttccacaaaatgcttcggatagtccgtcggtggcatattttcctgacataattttgccaaatttaacatttaaattgccattttcactctcacttggtagtcaatggcatcaaagaggcgctccttctcctgaggggtcaattccttctccaatttttcgaaaatttgtgcgtcttccggagcagccgcctctttgccctttggcgaaccgccgaaccaccaatttttggcccaaccaacccatccctcctgcggttggtcctcgacacggacgaggtcagtctgtttgtcgatttcgaactcggcttgttgtcgcgcgatgttcaagttgaacacgtccagcgcatcctcagcctcctgtgaacagagtaagtgcttttcagagtaaaaaggcaataataatatgcgattaaattttaattgaacaatttgaaggggaatcagctgcactgtctacctcaattgtgtccatcaccgcttttctgggcgttttgtgagttctgaagtgaatccacgcctctcggtagtccctcaccatttgccgatgctttatgattctgtcccacgaccaattgtttcggcgccgcaag

SEQ ID NO: 17401 - DNA, 1113 bp, Heterodera glycines
  misc_feature (27)..(27): n is a, c, g, or t
  misc_feature (30)..(30): n is a, c, g, or t
  misc_feature (35)..(35): n is a, c, g, or t
  misc_feature (37)..(37): n is a, c, g, or t
  misc_feature (41)..(41): n is a, c, g, or t
  misc_feature (53)..(53): n is a, c, g, or t
  misc_feature (58)..(58): n is a, c, g, or t
  misc_feature (65)..(65): n is a, c, g, or t
agaatgcaattgtatgcaaaatgccanccngaaantngcanaaataataaatntagtntaaaatntaaatacacatgacagaagtgcttaccattctttgtagtgctggcgatagtgtgtcagattgggtcgatatttgaggaatttctcggccaaagtgaagcgctcttgggcctccagaaacagaagccatgtcctggtactggtacttgccgatggacagtcccaatttgtccaattgcatgacaaatcaattttgggagtggtccaatttgagccgtcactctccggcttctgattcagcttaagctgtgcagcaatggtcaacggttccaaccactgtggaaaaaagggcaacaatttcttgtttttggaaatgccaattcagtacccaccgtatctgtacccctcgggcttctcctcattaactgcgattgtccgttgcaaagagttgattatcttctctttgcctttgttgtcggagatgaaattggagttggcgtttgaataaatgcttaaactgctcatggacaccaatctaaaacaaaactgatgatacaaatgaacacataactaacaaataatgataatagtaaaacgatgtactcacttgtaaaagattttgacagtttctttctgcactatcagtttgaaattctcatccgtagtctaaaaagttgctgtagtaaattatttatccatcgtttcgcaacacctgaaaattcaacgagtccaaagtaattcctgtggcaaatgggcgctcgcgattcgagaatttgtcctcgtaacgaatatggacccgtttaatatgcacttggagatttttgataatttgtgctattaatttctcggtaaaagtgtcgtccgatggcatatttggctctgaaattttaaattggttaacaattgaccctttttgtcgactttggcggcttcgtctgttctcctccaatcgtaacaattttttctgcttggcttcacgctcatttttgtgcgctttttctgcgctgtaaacaatgccctgattcggcataatgataagatgaatgccacttaaattttaaaaatttaatggttcattggtttatttacgtactgcaacgcacctaatct

SEQ ID NO: 17402 - DNA, 2952 bp, Heterodera glycines
  misc_feature (1674)..(1674): n is a, c, g, or t
tgctaacaacctatcttcattatcaaccaaattaaatatttttgttatcattcgatagcttttgagatactttattagcctgcaaaatttcaaaaaatttagtcagtttataaaaagagcgcacccagagctttcgaatgatgccagattagctaaagttaatgacaaataaaaaagttatagcgtttcaaaatttgcggcgccgaaatggtctgcgccgaagtgaccccgaccccataagcctcgccctaaactaaccttcaaaaattgtcgcaccccaagaagccaaatgataacgctatggccgacctcatgggaggcggtgccggctttgtttgagcggcgcgtcttccgggaagtttcggcaaggcgcgcgaatttgttttcccattgcctgcgcatgtggcgctggatttttctatttttttaaaaataaacaactttttttgccattttctgttgtgctaaatgctttaaaatgtaattaattattaacaaaatgaaattgttgcttcaaatgccataaacaattaatccctgcttaaatgaattaagcattttagtaataatataaacttttttggcgttttgtttattgtttttcaaattcaggtgctgctacgatgggtgcaaatccgcgagttgtcaactgcgtgccgccgacagcgtgccagccaattcaagaagccgtgacggaatgattggatcggcgtggtgggcgtaagtttgcatttgagtaaatcccattgatcacttgtaaattactttctaattaagtgccaaatttcacttattttttccccatttttaggtttgatcacatttggatcacatttatttatttttgtttttatttgattgtgtctacagaaagggccgaaacacattttctttagcattctgacagggtctgtactgatgaggcccgccctgtcacaatgcaattgcttttcattcttggtattattcgaaagcattcgaaaaatgctattagcctgcaaatttttaaaaatttttatttatgcacaaaaaaatcagagcaaaaaaaagttcgaattaatgggtttttgagttccttctggccataacttttttgaaacttaaccaaaatttttgagattttgcaaattaataataaacacatagagctatcgaacaacaccaacaattcttaatttgattgacagtgaacaaagttatggttcaaaaagtcttccgacaaattggcaataaggtgaaaattggagttgcaaatgttcggcaacgattcaaattgtctcacaaaagggcggggcggagaatttaattgggcaattcaatggccgtattttcaacaataaattgaacaatttgggattccccactttcatcacttttgcggtgagctttttccattcgtaaaccctcatttaataaatgagcataattaagcaattaatggacccaagcagaggattttatgacaaagacggggacaaagtgacattggccgttgacatcactgtggaagaggagaaaaaagggacgaagcgcaaattgtcggatcagtaaaattcattcatatttttaattcccgacccctttctttttcccactaattcatgtcaactgtatgatgtcatgtgtagcaattctttttattttggcattctctcattcatacatgaacaaggngtgcgtcggcgcacccccccctgcgccaaacgtccgacgtatgggggtctgactggcgcaccccttgtacatgtatgctctcatttttaaaattaattcctcaacactttactctctcaggttcccttactgcctctgaaggtaacagattatccaacattttttttttttgcttttaaatataaaaagataaaatttcattttttcaatacatatttccgttgaagaaaaataatccgcagatttatgaccaataaatccaatagatttgcccttaccgatgccgaaacgtatggtcttggcaaaaacttttttgataaggtcatttgcctgaaaaattttcaaaaactactttgctttgggtacagtatatgtatgatatactgaaaaaaaaaaagttaattttaaactttcgatcccgtcgccgaaatgttcaggggaaaaatgcgtaaatttttcttgcacattaaataatgttgatgtgcaataaaattgtcaaaaatcaaatttaaatcgcaaaaaatgccaaaaaaagttcgatctttcattgttgttaatttcaaaagtcaaaacttaaagcgacaaaagaaagaaaagatataaatttaatgaattttttggttaaaaatcagaacaatttgcaaaatagctttatcgactaatcaatttttcgttgaaaaaagcgctgagcagagtgcgatggtgggtgggaaattggttggggtacaactcggagttggcacgacggtccgcgtgggcgtgggtcagaaaaatgccgaccaactcgtcactggtcaacacgccggaaggcactaacaaaaataggaattttaaaataaatattatttaaaatattgtattgacggacgacctaccaacatggtcagagaaatccgaaagagagatgagcggaaaacgaattttggacagtgccaggccgaggacaacacgacgattctctgccgaacattcggtgccattttgaaggcattgcgcgtcagcccaacggagtgcctgaaaaaaattaacaaaattagtatttttaatagaatttaaatgttaattagtacagcattccaaatggtgagttcgccgctgatgattttcaactggtcacgttcgagaatttcatacagcaaattttgttccacttccaaaaaggcatccgattggatcagcgattccgcattttggtcaatgtaatccaagcagcgacgagagaaatcctcaaaaaaagaaaaaataagagatcgatttgatctgattttttgtaccaaa

SEQ ID NO: 17403 - DNA, 1838 bp, Heterodera glycines
  misc_feature (1787)..(1787): n is a, c, g, or t
agaaaagaggaggaagagagagagagagaaaaacccccccctgagaaagaaagataggtgagagagagatagaaagcccctaggagggagagaagaggagagagatagaaaagaggagggagagaaagaaagagaggagagaagggagagaaaagaggagggagtgaagaggagagagagagaaaaagaggagaggaagaaagaaagagaggtgagagagagagagaaaaaaaagaggagggagagaagaggagagagatagaaaagaggagggagagaaagaaagagaggagagaagggagagaaaagaggagggagagaagaggagagagatagaaaagaggagagagagagagagaaagaaagaggagggagagaagaggagagagatagaaaagaggagagagagagagagaaagaaagaggagggagagaagaggagagagatagaaaagaggaggaagagagagagagagaaaaagaggagagggagaaagaaagagagatgagagagagagagaagataataaatttttcaaagctcggctagcgcgaggtgcgcgagcgaagcgagcgcgcctgcgctagttaatattatttttcctaaaaattgaatttgcggaaaataaattgagcatcaagcgttgatatcccgacgaaaaaaatgttaaaaatttggcaggattttttctaggcttaaaaaatgcgctaaccacgaatatgaactcgtttttgaaaattattttgtctataaaattttatcatgtacttggttttttcaaaattttttattttctgtaaagcttttattttcaatgaatttgggataaaaaatgctcaggtcatgaataggatgaggattcttaggtttttatttattttttctgcggctttaactcgacgagaaattcacgaaaaaaaaacttttttttcgaaaattttgcgttcgcccttaaaataagtttttgcccttattttggcgttttgaccaaaatttattaacaaacatgcaataaaaacgaaaaatatatataccactgagaatcgaccctaaaattttcataatttgtaactgcaatcattgaataaaattgtttgccttaatctgaaattattttcatataaaaaagagcaatttagaattatacacctaaatttggaactttttcgtccttatttacggccttattttggctttttcgcccttaaaacctcgccctaatcatgaataggatgaggattcttaggtttttacttattttttctgcggctttaactcgacgagaaatgcatgaaaaacattttttgttcggaaattcttcgttttaacgcccctatccgaccctaggaatccctatttcagatgtacggccctaaaaatcctcaccctagtcatgaatctgtgttctcattttgcaagaaatttcaatatttttaagttttcccagaggtcgaataaccttagttaaaatattgccaaatttgctcaaaaataatttatttcgatggtaaaatatggcgctagtaagttttgacttattcccgaaaagagctgacattcaattggcaatcatggaaatggaacaagatggatatgcgaattttggaagaaaaggaaaatcatgggtgatcaatagggatgccaaaaaatatgaacataaaatcgtaaaatatgtgcataaaatatgcaccaaaaatcgtgaaatatgcgcataaaaagtgaaaaatatgcacataaaattttccaattgagggtgtaatttctcaaaatttcttttcaattgtanacataaagtaaaatcttcaaaatggctaaatgtggtattaaaatcatttta

SEQ ID NO: 17404 - DNA, 1568 bp, Heterodera glycines
gatttgatcacagattcgatacgacggggcatggagttaatcaaattgataattaggtcaagaggaattgaattccatgcctccaaaattgcattccaaagtaggggttttgactgaaagtgccttccggcgattttcctcttaacacagtgccataaattttcaataggggacaaatcgggactcaatggaggggtacgaagcaggggaactccattcagtcgaaaccagcccggcaaacgcagacgccgaccgccaggaagtcgccgaacgggacccatcaaaagttggctggtatggatggccgccccatcctgctgaaaagtccatccgggcgcgagatgatcacgcgcaaatggcagcatttggtcctcgagaatgttgcggtagccctccgatgtcaaattgccttctatccgcaccaatggacccaatgtgtcgccggtaaagcaccctgaacattctctccaaaaatggccaaatttgtccgacctaccccacaccattacaccgtctccccctccgaatttcatggtccctctggtgtatttagggtcgaatcgctttccgggtggtcgccgaacgtgaattgccccgtccgaattgaacaaatttaattttgactcatctgaccagatcaccttccgccagtcttcaactgtccaatgtgcatgtgcccttgcaaacgccagacgtgccattcggtggcactctttcagcagtggtttgcgcgccggacgtctggcattcagattgtggcggcggagaatgcgttgggccgtgctgtgcgaaatttggacgccgagaacatcagctgagtgccgtcgaacatcaccagccgtcttcttcgggtcggttttgacgagtcggacgagctgacgctgctgccgttcggttgttttcggactgcggccgacctttgggcgcctatgcatgtcctggttttcatgatgaagcttaaacaaaaaaaaaacaaaatgatttttgcattttttttttacctttagtatgcgagacactgtccgcctactaattttgaagtcttttgccactttacagacgccatttccatttaaacatgcttgcaaaactgcctcctttattggagtaggaataatattattttttcccatgctaaatattgatatttgtgccaaaaaatgaaatgggacaacacttttgacccggagtaggacaaaacgtcgtcagccgaaacgtcgtcgaacgaatttttcgaccataacttttttctttctcaaccaaattaaacattcttggtattattcgaaagcattcgaaaaatgctattagcctgcaaattttcaaaaatttttatttatgcacaaaaaaatcagagcaaaaaaaagttcgaattactgggtttttgagttccttctggccataattttttgaaacttaaccaaaatttttgagattttgcaaattaataataaacacatagagctatcgaacaacaccaacaattcttaatttgattgacagtgaacaaagttatggttcaaaaagtcttccgacgacgtttcggacgacgacgtcgtggggggcac

SEQ ID NO: 17405 - DNA, 2276 bp, Heterodera glycines
ttatccttttttcgccatttttaaattatacattttaatcagggagattttgtaggtgtctcacttcgttttcattattcgccgcactttcgctcgccgttctcatgacaaaatggcaatcattcgccccccccccccccctccagcgcccctcactttgtgccgatcatatttttgaagttggctttcttaatggaattttccactttttccctttcggaattcgtttcccctcttccatcagttcgtccgttattttctcaatgaattcatctctcatgacctccccgtgtccctgccatggccatggctatttttcatcatccgctcatgactacccctccccccccccccccctcaattagtccgatcggtcccccttttttgtcccatttcccctcctccttattctgtatttgccttccctcattatgcaccgaatgcctttgtcccttttattgcccttaaaaggatttcgctttccacacatttatcccccacccatccatcgtcatctgtcatcattcattcattttgctgctggtgctgatcattccctgcttcttctccactccccccaactcattttccctaaaatgtctttttttctctgccccctctcgttgtcgcgctctctttttgtgctgctgtctctccttctttcgctaccctctccactctcttcacaaacttattacgtgaaagcgccgttcgaaggcagatttaaacaggggcatgaaacgtggatttgccaattggacggctacgacctgagcacggagcacatggatcggacttgcgatgaaaatgacattggacagattttttgttacggaaaaattcttgaggtatgcctgcgcgagacgtaatagggagggcgcgagagggttcggccctaccttaggtggatggggggggggggtgttcggcccagatctccgagcagtggcatccctccccgcacattggcccctctcgccacatcttttgccaatttaatttattcccattgtcttacgcataataggccatcaactactttggagaacacacaatgttcaacaaagattacaaacacattgtcgaccgtcctctgaagaaaagtgccgcagatacagtcgcagactttaagacaatttttaacgtaacaaaatggagggatttcaaagtgagctcaatggactccaaaaatgtcgacaaactaaaaacatttgtgcgagaacactttggtagcgcggacaaatttcttgataggtaaaatgagtgaaattgtttaaaaaagaactgaatgtacatatttattcaatattattttaagcccacaaccggtcgattggaaggaaaatccaccgaaattgcaaaacattgctgacccagaattgaagacctttgcaaatcaactgcatgagctttggaagaaattggggaaaaaaatgccagaatcggtaaaacggaaagaaacgaaaagcattgtttggcaatttcaggcgaaagaaaataagtcgacgctgatttacgttccgaacccttttgtggttccggggggccgtttccgcgagttttattattgggacgcttattggatcgtccggggactgctcgcttcaggtcaaaataatgggctattggggtgggtgaattagggagtgattaggagtgaatgccaaagctaaagtgatcggagaaaggcaggaaagtgatcggaaaactgatagtgccttttgagctgccgtattcatttgtcagctggtcaaatgtccgtccttaaatggtaaagcattggaattcaattcacaggaatgaccgaatcggtgaagcacatgtgtaacaattatgccgagatggtcaataagtttggctttgtgcccaacggcggtcgcatttactacaacaaacgttcgcagccgccctttctcactttgtccgttcgtttcgcatagttttaagagtgcactttagttttattagtaagacaatgcttttggccaattttcagaataccgtatttactgaattagtacccccccccccccgggggttctatttttcaaccccgctcgaaagtggggtactaatgcagtaagtacggtatttgttaattttgaataataatgttttatttgctctctcatcagcatggtcaacgattattttgcggagaccggtgacacggaatacctcaagaccattttgccagttcttgaaaaggtccatttggaggggtgtcatggcagttcgtacaatggcgtttcgtgtacagacccatttggaggggg

SEQ ID NO: 17406 - DNA, 1299 bp, Heterodera glycines
  misc_feature (983)..(983): n is a, c, g, or t
tagcccccccctgcctacgcccttgcttcaaagtgcattctgacaaagttttttcttttaagagacaattaattttttataaaaataacaacaaaaaaaaactaaaaacaataatcaattttgcttatttttgaaccaatttgaacatattacagaaatttttggtacgggcggcccaggggttgctcctcccctccctccaccgccccatttggccccctctctttttagatcggttttgggtggtccaatggcggcattttggatctgttggtgacgtacggaaaggagatgaaaattaaggaattaccagaagtgaagtgcacagtcaaagaagtggtagaggaaccaaacgaatttccttgaccttgagtgaaatttgtattctattcgaatgtcaaagagaaaaaaaaatgataaatgctttaatttccatttcttaaacttttataccaacttgggttatattagaaaatgcaaaaaagtaccaaaatatattaattggagtgtaaaaaagtagagtgccacgggaccgggaccgggttttgaaaagctcaggtcccggtagggcaaccgggaaccgggaaaaacaagcactggtaagaatggggtctgagtgaaaaattagtgaagaaaattggagtcaaagggaaaaataaaaaataataattaatatattctttaaaagtaacactgccccaagtgtgcaaatggcctaacggctagtctcctcgactcttcccttcttctttcccccggttcaatccctctacagaaattaaattattttcgaatttttttttcgtatactcgtgggtttcctataaagaaaatatcgattcctcatagttttttctaaattcgatacatattttatcattttttaaatcgaaaatcctaccaattcgagcttaataatcgcaaaaccaacctttttttcgttgaaaatctgttaacaaattcgcacccaaatttttaatttnccccccgggcggcgcctatcggcaccgccggaccccttctttcccaaaagttttttgaaaaagcgctccgaaaaaaagtgatgtgaaaatcaaatctgaatttctattaatattcgatgatttagtccaaaaatgattaattgtttgaaataattgaagaaaatttgtttgaaaattttcattaatttaatttattataaaaaaccaaataattttgtattattttcacttgatataaattagaatttgaatttttttttaaatttttaaaatttttttgaatttttaagatttcccggttgatcccggttcccgg

SEQ ID NO: 17407 - DNA, 1317 bp, Heterodera glycines
  misc_feature (1080)..(1080): n is a, c, g, or t
ttaaactcgctgtggggccggttcgcacttcggtaaaattttggttaagaattatgaaaaaatacaaatcatacagaaaccggcttaccaaaaccgatcgtcgagtgccatgccgagctggccaaactgctcaacgactcgaagattgaggtcagcagcattgatcagctgacggaaaagttctggatggtctactacaaggccaaagatgagcatgtggtggagcacagcacaagcaatgtaagaaaagttttaaaatatttaaaaaagacaattggtgtatggccctgcaccaggtgtagagcgctacgacacccgcattctctacatggtaaaattcagaaaataaaatgaaaatgtgaagtaattttttaaaatcaggacacggacagcatcttttacgactacctgacgcggctgggggacccacttccgggtggtgagcagctcggggaactcgcggacgagtacccgaatcatacgatcatggagtttatttgtggtaagattagttaaaatttgaccaaaataaatggaaactttttgtttagctgggcccaaggcgtacggcctgtggttgcgcaacaacgcgacgggggaggacgagtacaagctgaaggtgcgcggcatcacgctggattcggatgcctgcgaaagaatgaccttcgagaagatgaaagatatggttttgaacaagctgggccaagcagacaacaacgtccgcttcaactacccttcgaagaacttcaagataacgaagaaaggagaaatttttaccgtgccgctggtaaaacagttcaacccgaccgtcaataagggagtggtcagggacaaagggttgagggtggtgccctttgggttcagcaaccaagagtggtgtaagtggaattgcccaggcgcttgtacctgtctgttcaacccagacctcaatgtgaacatgttcacagaagaggagttaaatgaccccgatattatgccataactgtttttattgtttcaattgattttcttcatttagtaatatttttattcatttatttcttcatttgtcacccctatatttttccggaaagccaatanatttcaccaatatttcactttttccatctctcactcgttctttgtatttcttttcaatccgatacattgtgttttccttcacttgtactttttgtaattctggtaaataaaatttttctcttcacttttgtgccattatagtctttgaagcaatagtgctggcggggttggttgagcgggccccttccactgggtaaaccgggtcaaaagaattgggtatttaaccaaaaataaaaa

SEQ ID NO: 17408 - DNA, 1385 bp, Heterodera glycines
tgtgtaaacgtgatcagagtaattggggtatataacctcattttaaaataaattgatcggaaaatgtgtgaattacagtacccttctcgaaaatgtgcttaggctcgggaattctgaccgtttccccggctctgatctttggtgacttgtccaattgtgcgagcccttcgccgtacaccctcttccacacctccctcgcattggtgtcgctgatttcgttcggtctaagaccggtcgcgcggcacaccgagttgttgatggcactcaaaaactttggcagcacatccacccacaccgacgtattgttggcggaaaaatatttgtacagccgagtctttacggtgcggatggcacgctccgccacggcggcctttttctttgaactggtctcaaacttttgaatgcccttctccgcgtaaaactccttcaacggttttgccacaaactccagccctcgatcggtgtacattgtgtctggcacccttggcatttgctcaaatagctcttcaaaagctcttttcatgtccactgggcgcttactctttacgggcgcgccgaacattcgcctcgatagaacatccaccgccaacagcaggtaccggtagccgctgttcttgcgcgaaagtgcctggaaatctgccaagtccgcctgaacatctgaaccctgaattgtgcgcaataagccccagtacaacttaccggtcatgaaacccgtaggcacagtgcgtaggcgtcggaacttctccctctttggcttgaacagcgtgtaggtggtgttcctctgcaaaagtcttcaaactcgatacgcttcaactttgggtgcttcttcttcaccgccgcgtacagggcactcgcacccgcatacccgcccggattggccgggtcggtgtatattttgtttattttcttgtccattttgagagaacaaatcctctcgtttgtttgacttgtccgacgaacccagacccaacaaacagtcgattgagtaggctactggcaagcggattctgtgcgagtttcctcttcaactctttggttccgcgtggcgaaggggcattctccgggcgagggtccaccaggcgttcaattgaccaggccaggtccgagtcgataaactctcggcccgtctttgggttaatgattttcccacggtcagttgcgccgaatctctgcggatcagacataatgatggccaacaggtggtccttcttctcgatcaatttttgctgttttgctgctttcttattggtcctgggtgatcgattgcttccctgcgtctggcttgttggggttaaaaactttgacacttcaatttcttcatcttcatcttcgtcggtaaccatcaacggacttgtccttcggttcgtccggaccaggccgtacct

SEQ ID NO: 17409 - DNA, 3197 bp, Heterodera glycines
  misc_feature (3138)..(3138): n is a, c, g, or t
aaccttatattttcttgataaaatagtgacattctgccataaaatttcaaaattttgaatatatttaagaaataagaacaaaataagaacaatagcccgaaataaggacaaatcttacaaataaggacatttttattttgtaagatttggaccctccaaataaggacaaatcttataaataaggacagatccgagccctggtttaaatagtaaaattagattaaataattaacagggttgtcaaaaatatgcacgaaaaattgctaaaatatgcaaataaagtcgtgaaatatgcaccaaatatgcacaaaaaagttgaagattaggggtgcaaattaattaaaaatttcatttctcgtaaattctatcggttgtttttttcaaattgttggcacagttgacaaaacactgtgtttccatcagtggtgtacgtatttgacgaaaaaatggcaaaatatgcaaaaaatcttaaaatatgtacaaaaaatggcaaaatatgcaaaaaatcttaaaatatgtacaaaaaatggcaaaatatgcaaaaaatcttaaaatatgtacaaaaaatggcaaaatatgcatgaaaacccaaaataagcaaataaaaatcccgacttttaaactcaaatacataaaagaagattttttccctactaattagactacgtagaatccaggaaaaaaatgcatttgcatatttttgacagccctgataattaattgtggtacagattagctagctcatcaatgaaatttaggtaaaattttctacatatctatattaacattttcatttcgctaaattctctaaaatattttagtgacaccaaaaggcccaacggcgggtgtcttacttttatgcaaatttcataatactttcatcatttaattaaaatataatttaaattaattaccgattcatagctaaggatggcattaaaattgaatttggacactcaaattttgacacgccttctgtcattatgtgactgaagctgactacatccgtcaattggtcaaaatgcaacaattgcagtcgaattcgtctgtcaacaaagtcacaaaattgttccaaatgaatggaattggcgacaatgcaacacacagcgaagaagtggtcgtacttaattaattagtgagttaattaattattactaagaattaattaattaaaaagtttctttattatttaattcattcccaaattaccttctctgtaaagttagcagtcggaaataattggccccaattttcggagggatttgaattttgaatctttcggactttaattaggcctaaaaaggggaagtgttgttttctaaggcataaaatcattaacgaaatgactttctctcattgatttttgcactattttaaatgttgagctgttcatgttgaacatcgcattctgttccaaacatccttaaaatatttttactttaacaaactaacaattttaatttttatttgctaaaattcacaaattaatttattaattatccaaatttatttgtcccctttgcctggcgttatgattggcatcaacagcggtgaattccttttttgctcctcatcttttggagtccatgaaaaggtttggagttcgtccggcacatactcttccaaacgtaaaggaattggccaatcccttggggggcaggtaattagtacatttaagcgattattgagataccataatgcgaaagtaagaaagaatttgtccaacaaaaagggaatcgaagcattcggataaagcaacatcactttggtggccattgttgccaacgaaattccgttaaaaaatccgagttttggttcataaataaaattagctaaatgtgttatttaaaatcggtttaatcttcaaaaaatatacctaccttttgaccaaaactttaaaattgtaagaaattttctgaatttttgcatgttttttcttcccaataacgccattattttctcatttgaaatgaatgcttaaagccgaataattaaaacagaatgaacaaattttttgatatgtcttatcatcaattaattaatggattatttccatgttatttttattgaagatttattcaccaatgcttattcttaaaaaaattctcagggaaatgaaaaacaaagacaaaatggtaaagtataaaaacactttacctgccaatgatttgatcattttttcgtccgcttccttttgccctgccaattttctgatcaatgccatcacttcttttcggctcaacggcccattcttcggaagagaatcactggtcggaatggaaacgaataaaacatcgaattgaatgccatcgaattccaagccaaccaacggcagataggcaaatggcattttcttcaaagaccccactttttcattctgaaagacaaaaaaatttaagggattcatgtgaaaaacataatcataatccacctgacacaaatgacaataaaatgacccatcggcgcacattcgcggctgtgccaaatcgcattttgtcgtgccaaaaaatttgccaatttcctctttttttgtcgccttttcgggcactaagaaaatgacgtcgacgtccgaattggcagtatttgcgccgagcataaacgagccgatctccaaaagtacggcctcaccccgagactaaaagtgccatgcgattaatataattaataaattaatattataatgacccatttggaaacaattgattttagcgcagccaatgcttcgtttggcttctcagtgggcttatattcattttcgagcagaattttatccaactgaaatatgtttaaacattattaaattataaaccacctaattgcctcttttaagtgatttttctcatcaatttcatcaaaaaatatttgctgattaatttctgacaaaattaatgaatttgtctcatcgttttgttctgtcgcattttctttgctaatgaattgactttttaatatatattttctgtgttgaattgttgaaatcttatctaaataataacaattaatcaggctcgtgtttttagttttattctttttattttttgactttctcatataccacattaatgcttttataataattaaataccccattaatcaattaattaattaatttaccaattcgcttttgctccaacattntgcgccacttttccaaattctccgccaattgactctccaatgaatgttttgtctttttc

SEQ ID NO: 17410 - DNA, 1610 bp, Heterodera glycines
ttttttggtgcatgacttccgccagaagggaaaacgaagcgcatagagtcccggaaagattgaaatttgattgacaggtgagagggaaaacggtgcgctagagtcaaattttgaatttggtcggcgacgaaatggaaaaggaagccgtcacattatatcactgctgcgtattttcttggctggcaccaatttttttggttggcacaaatttttttgagtgggactgagtttatgatatgattatactcttaaatctaattcgaagaaataattcatcatctcccgaaatccccattcaaaagacccctttcccccccccccccccggcaaccttacactgtatataaaattcaaaagtgaccaaatacctgtggccaaaaatgtgaataggtataaaaaaccataatggaataagaacacaaaaaagcgttttggaattcgacgcatttctgctggttgttttaaaaaaccgctgttgaaagtaaatcgaagactgttggcgaaatgtcttaatgaaaggcaaaagcaaagtcaaaggtcgactagcaacaaataaaaacatcccaaattcaccccaccctcagttgtcgccacgcaataaaatttttttttttacctaccaatttcccattgtttatgaatggctttaaaattctatagcttaaatttttatttgcttaaaattaatccattcgtcgggtattatttttttaacttacatacctacctaacaaataagttagaaaattatgctaaatgaaagaaagttgaaaagaaacgtatgttttacatacgctgtcatttctcatttgtataattttctcgcgttccgctgaatagacccatagtgaatctctcacaagtcactgtttatagtttattccgtcaattgtataattcttttttcttccgtcgttattggagcggatttctcgtttccattcacagtagtgaaaattaattgatctgttctctcgtaatgagtcattttcaaaataatacattgaatacaattgttttcattttactttgaaccaactttaattgaacttcacgtccaattaattgaccaactctcggtttttagacctttttttcttgattgaaaaatttatttggacccgtaaagctatagagacaatttcatgaaatagctgatttttatcttaatcttttttaaatttagcttttgacagacgacaatgacctctctcgttccaattcgccttcaagagcttttttctgtaatttttaaatggctaaatatcaaatgcattcttaaattcagcttcaaaaagtgggcatcaacccgagcagtatcagtttcggaaatgttacaatggagtctgacaagtacattgttgttcgtgaaactgttggggacacggctcaggtggtgatagtggatgtggcgaaccccaccgatgtgacccggcgcccagtcagtgcagaaacggcattgatgaaccccgtttcgaaaattctcgcactgaaatgtatgtatagcattactggacttgtatatgatagaatcacgtttttaagccgggaagaccttacaaatattcgatctcgaactgaaggccaaagtcaagactcatgttgcaaat

SEQ ID NO: 17411 - DNA, 1960 bp, Heterodera glycines
tcaaatgttcgaaagacatacgacgttggcaaatgtcaccatccttaattatcggtcgatcatgagggcaaattcctcctcctgctcggaatttctgcaaaggttaattttcttcattttaatggcatttacgctaaacaaaatcctgtgttaattctgtttttgtgcatttactgcttctgaatcacttgtttcctagggctcaaagacggattttttatgagtcgcgagtgattggctcaatgcaactgtacaggaccgaacgcaaagtgtcccagccaatcgaaggacatgctgcttgctttacacaattcaaaatggaagcaaatccgcacccaagcaatcttttctgcttttcactccgaaatcaaacgggcggaaaggttcatttttatcagtgttataagcattgagaggttgactgttaccttttcagttgcacattgtcgaggtttcggctactcccagcggcaatcagccctatcagaagaaagcaattgacattcactacccagccgatgcagtttccgactttccagtctccattttggtttgcaccatgtctggaacttgtttttaaaatattttctaggcatcttccgagttcggtcttttatacatgatcaccaaatatggatacgttcatttgttcgacctcgaaactggcatttccatctatactgtgcgtgtgtcgactgaaactgtttttgcgtcgactgaatacaaagtgaacaacggagtgctcggcatcaaccgttctgggcaggtatcaattggttttacatttggtgaaggctaaattcccagattatcgctctatgtttcatttgatttgtaggtcatcagtgttggtcttgatgagaccacaatcattccatacgtcacacaacagcttcaaaatccggatttggcactcaaattggcctctcgttgcaaccttcctggtgccgaggaattgtttgtgcgcaaatttaacttgctcatgggaaatggaaattacgccgatgctgccaaagttgctgcgactgcaccacagaaaattctgagaacaccgcaaacactgcaaaagtttcaaagtgctgtccaaccgcaggggaaaggcgctgcaccgattctgatttacttcaccacccttcttgagcaaggctcattgaacaaatacgagtcgttggaattgtgtcggccagtgcttgcgcaggtttgcgtttttatcgctgcgtttcaaagattatgttttgaaccgttgtaaaaatttgcagggaaagaagcaggtcgtggagaagtggatttcggaaggcagtttggactgcagtgaagaattgggagatttggtcaagcaatacgacatcaacttggcgttaagcatttacttgcgtggcaatgttcctcacaaagtcgtccaatgctttgctgagttgggacagttcgaaaaaattatcctctacgcaaagaaagtgaatttcgagccggattatcttttccaaatgcgccaagttcttcgcacacatcccgaaaattcctcaaaattcgctctgatgttgctgaatgaaggtccaagtggcgaaccattggcggacattaatcaggtgatagggttttccatttaaattccggtcgatttgcatacaaaaattgttgtttagattgttgattgttttgccgaggctggaaacatccaacaatgcaccgcttttttgcttgaagcgctcaaaagtgacgacgagtcccaagggcattttcagactcgtctgctggaaatgaatctgatgtcaaatcctcaagtgtccgatgctattctgggcaaccgaatgtttaatcactacgacagagcctcgattggtcaattgtgtgaaaaagctggtcttccgcaaagggcgttggaacatttctccgatttgtatgacatcaagcggtcacgttgtgcacacacaacatttcaattcagaggttattaacctat

SEQ ID NO: 17412 - DNA, 1613 bp, Heterodera glycines
aaggatgccgaggctaacttcaagaaagacgcaaaatacaaggctctcaatgatgccgaggctaaagcccataaagacgcagaagacaacgttataatggatgctgaggctaacgccaataaagacgccgaatagaatgttaaaaaggatgccgaggctaatgccaagaaagacgcagaatagaaggctaagaaaggatgcccaggctaaagccaccaaagacccagaagagaacgctataaaggatgcccaggctacagccccgaaagacgcaaaagcaaagaacaaggaggaagaaattaggaaggaaaaggctaagcctcgaagaaaaacctgaggcacctgccgaaggcgtatccgtaatgcctgaatctattaatgcggaagagacactggataagctgaagcaggaatagagaccagtggaagtgcctccatctacttctttaatcacaggataaagaaagctgcacaggagaaggctcaaaaggatgccgaggctaaagccaagaaagacgcagaagagaaggctaaaaaggatgccgaggctaaagccaagaaagacgcagaagagaaggctaaaaaggatgccgaggctaaagccaagaaagacgcagaagagaaggctaaaaaggatgccgaggctaaagccaagaaagacgcagaagagaaggctaaaaaggatgccgaggctaaagccaagaaagacgcagaagagaaggctaaaacggatgccgagactaaagccaagaaagacgcagaagagaaggctaaaaaggatgccgaggctaaagccaagaaagacgcagaagagaaggctaaaaaggatgccgaggctaaagccaagaaagacgcagaagagaaggctaaaaaggatgccgaggctaaagccaagaaagacgcagaagcaaagaaaaaggaggaagaaggaagaagcaaagaaagacccgaagagaaggctgaggcacctgccgaaggctaaagccaagaatgccggaagaaaagaaggcggaagagacaaaggaaaggctgaagcaggaagagacgcagaagagaaggctaaaaaggatctccagcagaaaagaagagaaaagaggctgaggagaagaaggctcagaaggatgccgaggctaaagccaagaaagacgcagaagagaaggctaaaaaggatgccgaggctaaagccaagaaagacgcagaagagaaggctaaaaaggatgccgaggctaaagccaagaaagacgcagaagagaaggctaaaacggatgccgaggctaaagccaagaaagacgcagaagagaaggctaaaaaggatgccgaggctaaagccaagaaagacgcagaagagaaggctaaaaaggatgccgaggctaaagccaagaaagacgcagaagagaaggctaaaaaggatgccgaggctaaagccaagaaagacgcggaagagaaggctaaaaaggatgccgagactaaagccaagaaagacgcagaagagaaggctaagacggatgccgaggctaaagccaagaaagacgcagaagagtaggataaaaaagatgccgaggaatctgccaagaccgactcataccagaaggctccaacggatgccgagacta

SEQ ID NO: 17413 - DNA, 2901 bp, Heterodera glycines
aaaaattcctcgtaaagagtgaaataggcacaaaatgccataaaaatgatctaaatatgcttagaaatcaccttttagtagtttaaaaattaatttttggtatctcacttttggaaaaaaccgattttttggggtacattttcaaaaaaaatattaaatttttcacaaaaaatttctaaaattctcaaaaacactctaaatatttttttctattattcgcagcatgggtaatccaggaaaaaacatttatttactagagatcggaccggtcggttttttcggtatttttcgattttcggtttttgactgaaaaaaaccgaccgagaaatttttgagtttttcggtttttttcggtttcggtttttttcggtttttaaccgaaaccgaccgaacgagaaattttgaagttttttgatttttttcggtttcggtttttttcggtttttaaccgaaaccgaccgaccaaccctcttgtccggtcaatagtatttacataaaaaagaagccctgattttttccaaaaatgcaagaaaccatttttataaacagaaaaagcgaaagatcacctctgagtaaattgtagaactattgaagctctattgagtggtgtattaaaggttgggaaaataattgaaaaaagcagccgaaaaacgtttgtttgcgccctgattctaaaaaccccccaaaataggtgctcaaaatggaaatgagataaataattttaaaaatcaaaattcttgtcaagaaaataaataaataaattttggagatgaatttttgataaaattgtccatttcttagggtaatagccttttttgcagaatgttctacttaatgatttgaaaaaatcctactcattgacgtaatgcttagctgttaatcattgcttggcaaatataattttatatatttatttccataaaaatatgaattaggtattactatttttctatgaattattactatttctattgctagaaataaaagcagaaaaatcttgtgaatttcgaaatttttctattaaaagggcattttcatggcaatgatgtaggctcccggtaaattggacactatcgtataaaaaaaaataaataaaaaataaataaaacaaaattttggtttggctaaatgattttattttattctgcacatacttatgtttttataagcgtaataaaacggaaataaataatgtttttattacataaaacttcagcaaaagtaaacaaccatatcatccataaagaaaaaagttttcttttggataggattccccatcttttatgcaattttagcacattgaccaatcattgccctttttcttgcattttttttggcacattgatcaatcatcttgcatgttgaatgcttgattctaagtgccttaattattaatccatttaccctacccaaatttatttttcaactcaattcctgggtttattttaggatggtgtccagttttccggtgtccagttttccgcttggtgtccaaaattccgacggtgtccagttttccgcttggtgtccaatttaccggtcctcatgatgtaaaggtaatgttaaagtcagcagaatgcgaccaccacgctcgaataagagggttatatgaaaaatcatcaaatgaaaattttgaacaaaaacttcccatgacttttgtcagagtcaaccaaattaaacattcttgacattgaaagaaatgataaatgtttaaaaaatagtacaacaaaaatcttagcgaacaaatcacaaaattttgaagacgaatcatttttctgaaaatcaataaattcagtaaaattaagcttgggttaaattttgtccaaaaattgtgtgcccaaaaagatcattttcgctcattcgaaaccaccacaatttggcgtggacgaaaaagcggtccaaccgtagaagaattgccttttcttcgcataatcgcctttttgtacgcagtccgataatcgctgctaaattaaatataaataaaattattaataatatttttttaattgaatttttgtcctttttacacctgttcagcaaaaggatgggcgccccactggcggatgccaaaattggcacgcaagtgataatgccgatcagtacacttttgatgttggtacacataaccgaatgagccacaggttcagcgatgaacaaatttacaataagcggtgtgataaaactgataaaatcggtgatttggttgcgtgcagccgatgcgatcagccagccgatcagaaggaccaaaagcagcagaaacacagagcgcaacatcctgcgcactgactgatcagcagctaaatgaccaaaatgagagtaaaattgaaatttaaaaaattgccaaactttgtgaattcgtttgattctttcttttcgtttgaaaattgcgccacaaaattaggccaaaaattgccgcgtaatttaaggagcacagtgaaaggacgacaaaagcggggacggagttcagaacatccgaataaagcccactgttacagtaaacccatctgaatatcgtaataaaattgaaaaatttcaaaactaattttaatttatttcaaatgttaatcgcctatcgtaagagatgttgataattgtccaaacattgaacacttccaaattcatgaccaagcaaaaaagagtacatagaatggcagaagcaaacgaacattggcaaactgtcgtttttttgatcgaattcattctacaataatacgataaaatttatatattccaactatacgatatataaagagtcacctgatcgggtacgagaatgatcgagcaatcgctccacggaaatcagaaacattgccgattattgaggcgtacgaggctatggtagcgcccgtgagagtggccagacagatacggtagtcaatggtactgtactggaaaatgacg

SEQ ID NO: 17414 - DNA, 2169 bp, Heterodera glycines
aatctaaaaatggttggatagagctcgtcaagctgtacaaaaaagccgcttacaccgacctcctatcatcaatatctggcgagttattcggccggcgctgaaatggcccaaaaaagtgacccatttttgcgcagttttccagaaaaactggtaaggcctaggggttcggtcaagaaacaaaaaatgtgccaaacatccatacgaagctcctttacggagccgatttttcatttaggcctttaaaaaatttttgaatttcaaaaagtgcaaaaaaaattttgaaaaagccgtttcagcgccgttggcgctcagttggccctcggagcgaaaaacctatagttttaccagatgcgcctcaaaaagttgtccccaaggtcgaaatttcaaacccctcccggcaaaccgtaaggagattttgtttttggaaatgagttgccttgtttctttagtagtatataactagcgggtgcgtgaaccgtcggctctgggctgggaaaaagcgcttcgcgctttgggagcttcgctacctaggctgtaaagcgattcaaatttatcgaattggttggagaggtttttttgaatttttaaaaaattattaggggtttttagtccacatcgaggctcaagacgggcgcttcgcgcccgttttttagcttattaggccgcttcgcggcctcagtcgggcgcttcgcgaggtacaaaagtgattagaagaggtacaaatttgatgaagaggtacaaaagtgattagaagagtgattagaagtagtacaacagtgattagaagaggtacaaactgtgattagaagaggtacaacggtgattagaagaggtacaaaagtgattaaaagaggtacaaaaatgattagaagaggtacaactgtgattagaagaggtacaacagcgattagaagattgattagaagaggttcaacagtgattagaagtagtacaacagtgattagaagtagtacaacaatgattagaagaggtacaaatgtgattagaagaggtagaaaagtgataaaagaggtacaaatctgattaaaagaggtacaaaagtgattagaagagtgattagaagaggttcaacagtgattagaagtagtacaacagtgattagatttgaaattaaattattttttttacaaattcaaaaaataaataatgaaattctttaattaaaaaaaataaataaatttaaatattttataaaaaatatttgaaattaataaaacatgtaaaagtaatcaaaaatgcacagaaaaataatgtacaccgatcggatccgaacttcgccccccccccctcaaaatgatgcctcagaatccccaatcacacagggattctgagggcttaacgatgtcaaaagtaaaaactgattatgtattcatgatcagcggcccaaattacccataatgacatgtttttagaagatttttgttgaaaaaaatttttcactcaaaaatcctgtccaccccctttggtcccgaatgccaaaatcacttttatttttgtatctttattttaaaagatgataaaaatgtcaaataaaatttatattatagagaaaaaaattgcggatttttgtagtattttacttttccctaatgacttttcagaaccgagatataaatttttttctgaaaaatcgaaaatttccagaatttctggaataactttttttgtttttgaggtataaatttcaaataaatctcataaaattctcccgattttttgctattttttatgctttaaatgagctgaattggaccattttgaggcgagttatgaatttttataatttaggttgaattttcaagggccaaaaattattgatttttcaaaatttttttacctccctccaaaaaatccaaaacgcaatataaagtgcatattcgtgttcagcacctcaaactaccccataaaagtattttttggcaattttaggagcaaaaaaatttctcacgaaatgcaaatccatggggtcccccctatggttttgagtttcaaaatcacaattaattttataactttttttaaactcatggtaaaaacataagataaagcacattagatagagcttaaaattctctacaaaaatgctctaagacaaattttcgctaaaatcaacgcctgacgagttataagccttgaacggaaatgggg

SEQ ID NO: 17415 - DNA, 802 bp, Heterodera glycines
attcgtaatcaggctcctaaaataccccttaggacatgtttttgaaagatttttggtgaaaaaatttttccactcaaaaaccatgtactccccccctttggtcgcaaattccgaaatcacttttaattttataacttttttcgaaaaagtgataaaaatatgaaataatatttataaaatagagaaaaaaatcgcggattttttcattattttaatttgtgaaaataggttttcagaaccgagttatgaatttttttctgaaaattcgaatttttccagaaattctggaataactttttttcttttagagatttaaattcaaaataattcccataaaattttcctgatttttctctatttttaaagctttaaaacaattaaattgagcaactcagtcataagttatgatttttcaaaaattacctcaaattctcgaggcccaaaaaaatgaaaaatatttttgaatttttaaaaaattccaaaaattccgaaacaaaaaacaaaggtcatattcgtgctcagcacctcaaaataccccagaaaaatatttttcactccattcttcaacccaaaaaaaattttcaaaaatttctagggggcctagctcgaaaatttttgaaaatttttcgacgtatagtacaccgttcgatagcgttttgaaagctctacgattttgctctaaggcgatttttcgctaaaaccaacccccgacgagttatgggcccgggactcaaatgtcccgctcggcacgaaaattttttcttttccggaaaaaaatcgaaaattttctgcctgccaggcc

SEQ ID NO: 17416 - DNA, 1488 bp, Heterodera glycines
cttgaattcagatacatgccgattgaacagtaaaaaatattgttgtgtaaaagaaattggagcttttcttttctaatacattattattaaaataattttcaaatttctacataattataagaaattggtgcctaaggcatccttttattatccgtccgtccgttctttctactcatcatttttctttgggcgcttaggcggcatctgagaacattcagcatcatcaattgtgtagatgtcgtcatcgtcatcctcagccccatcttcactttcaacgacttttttgtttgccagattaccgccagcctcttcttcctgctcaggcacgtggattgaagcaataacccagtcaagtgtctcgccctttgccttaacaacatagcatggatttgtgaaatggaaagagtgctaaaatcaaccttaatgaccaatttagcagcaactgtctgttcaatttttgattggagaattgaggcaagttttttgggacggtgctgcgctaagcgtgaaaattcatctatttttacattcaaaaatttaacagcagttgccgaaaaggcagttatttgcttgctcgtctcaatgtcatgacagtcgcgcaagtcgatgcgtaagtagaggttgctcagtggtttggtagcgtggtgatcacatgattcacagtacagctcgtcgttgagttttttttacaaacgaggccaccggtcttaattggacacgcctaggttttggttgaaatgagagagagagaaagagagagagggagagataatcacttggtaaagacagtattgaatgttgtcaacgaccgcgcgtacaaagaaggtaccgggagaattgaactttagaatttcacttaattccttaagctgtgcgggaaatcatccgctttttgatttgatgaaggcacaaattgaaaacgcctaagtttgtcgctcattttgtcagtgttttggcgggaaaacggctccaaaagcaaaatagaattaaaaaaggctaaaaaagtttaaagtactgagtcgggattaaaacatatattgaattatcaaaatttaggcccacttgatctattttcctgcctaaaattgtctcctgatattttggacaaattctaaaaatgttcgacttttagaccttttgttcgaactcgctattttggtctgagaatggctcgaaatcattttgaatttgttgcgaagaatttttttggtcttctggctactctagggccccgaaatgatggccgaaaatttttcgaactgtgaaaagtgggctgagcgtcatttttggacaaagatacaagcattttacccctctggggtaaactcctgtctgaaatggtctcctgaacattatgggagcagttcgaacaaagttcgacttttagaccttttgttcgaactcgctatttcggtctgagaatagctctaaatcattttgcagattgttgcgaagaatttttttggtcttctgactgctctaaagccc

SEQ ID NO: 17417 - DNA, 841 bp, Heterodera glycines
taatggagtccggtctggctaatggacagacagaccggtatgtccattagtctggtctaattaattgacctgtccattagtctccggtctggctaatggggaggcccgttaaacgtcggcactttgtgccagttaataaccctctcaattagcagctcaatttttaatttcttccataattttcccttaattgaactgatggtatttcataaaagcaccccccctccccctgacccagacagagtcaattagctggcttttttaggtgatggatgaggggctttataagcgtcagtttttatgaccataagtaatgatgatgaagcatcgctcgaaatcctttcccccacactctcgtaaggcacgctcgaaacggagcttgtcggaaagcggtaggccgggtaccactaccagcatttgtatgtggcaggacccggcctaccgcttttttgccagattacacgatttgaaaggcggacggcgtttagttagcacgccaaacccggccatctttcaaagagcgcctcccctaagtatgtttgtttgtttttttgaaagtgtactgtcgaatttttttgttatttaaacttttttgacttttcccaaactttttccattttgccatttttttagcgataaacatgtccgcaaaccaacagcagctgactgaaaatttaaaaaaaatcatcgcactccacaaactccagcaagacatgaagctcatccgcgactccatcctctcggggaactttgccgtgaacgaaatgggaaacaacaatatgatagtgtggacggtgccggtgccacgaaacgcggttaaattttgcgaaacaaaaaaata

SEQ ID NO: 17418 - DNA, 3252 bp, Heterodera glycines
ctgaaggatgagccggccttaaataacgacgggtccgagtggacgatgggcgttacagcaaaaatgcaatttatttgttttaaatgttacaacagcggcgagctaatgggaaaaaaaggcaaaaaacgtttttctcccgagcgacaggggagattcatcgccgcaaaaagctaatgtcgcgacggggaagagcaaaaaacgggagaggggacgggagatgaattgctttccgtcggctgccatgtttggcacgaagcaaaaaaatgggggggcactgcaaaactttggtcatatggaattaattaaaaacgcagtcaaaagcggggaaattgcaaattttgaaaagaaatttcaaacattaatttcaattgaatcgggttcaattgaccacaaatatgcgcgaattacacaaaaggaaatgccggcaatagtaaaaatgatgccgccaattgtccaagcatttttcgagaaaaatgaggaccaactttgagggacagtttttggctttaggtgtacacaagtccaacccaaagttgcatttctctcttcggttggaaaaattaaattagtcggctggcatggatgggcacaaaaatggtcacaaatttctttatccactgaaattcctttaatttgcttttcttgaggggactctacaatttgggcgttcgaactcaatatcagcaaaattataagcaatcttttgcaagaaattcttttgtccggcccgcaggcatggggaatgagtaaagaaagatttttggtttttggcattttaatctgaattttgcggttggtctaaaaaaagaaatatttcaggaattattcggaatgaattttggtctctggagacgatgattgccaaaactaaggggcggtgcaaaatgtgacattagcaaacaccggcacattgataatttgtgcaaagggagaaaaagtcagggaaaatggtgcaagagaaaaaaaaggaattctttggccttgaaggggggaaaaaaggaattggatgtgcaaaaagaacggcgccttccaccaaaatcccatgggagatgaatggcaacaaaaagaaaattgccttaaaaaccgaaaaaggaaacaaatgggccaaagaatgccaattcgaaccgaaaagggaagtaatggagtttttttttgtgttaaatcaattcatctgcgttttggtgattgttgcaagtccatggcggcacataggtaacggtatgatagtcgaaattgttcattttggagccattgatgaatgtcttcatgttcatcagcgccaaatatttttaagttcgttcctacataaatctgctcaatccaccaatcgcgaactccatcactcgaagttggccattccatagcagaagttttggcccaaaatcccgtagtttgaacccgtgtgccttcttctaactccgtcaggttaacgcttgaatcgagttggtgggggaaaaaacgctgattagtttcttccccatacaaaaagacatcaatggccataatttctgaggtgattttattttggatcacttccctaattattccgcagcagctcgaagggacaatttgacttactgatggtcccagttttggaggagaagtcatttgcttcagatcaattgttttgagccgagttcctaacagagattgtttgttccaattcaacgaaatttgtgtgaaatgtggccagttattgttagggtcaagtgtaattgtcgtcacataacttggtgtactttggaagactaattgatccgattctaagcttagatttttttggtccaatagctcattttgttcgcccaaaatgtccggttgtaccagtgcccacaatatggggtgtgagatgaacacaaacccaagaactgagctttcaattggtggcagatcagctggcggtggtgtggtgtcagaaaatattttctcaatttccatatgactaggcaatttttcagaatccgtcagttccaaattcgcaaacaagttcatgaaattaacagaattttcgtcatcttctgtttccactaattcatttccatttccgaccatattttctgtttcttgcccgcgggcgaaggagttaaaagaattgttggaattaatttttgttaaatcttaagagagaaggaagacaagaatattcgtaaaatgagcaaggtgaaaaacagaaaatgaatggctatggagagaaggatttattgaccgatgggtgcgagaaggcggggcaatgtacaagcgcctactttaaactaaggggctgatgttagcataaataagtatgagaagccatgttaggagacaagcagtgagagtgagaaaggaaaaaaaaatttaattattcaatgtttgacaagatttattgttcgattaaatgtatttcctgacaaaatatatatatatatatataaagaaggcaaattgaaatgccaaaaaaactattaaaaaaagagggtattcggaaaatgagagattttgtaagttttccctaaattagaaaaattttgtatgaaatgtaaaaattagtcaaatattaaagtaatttgttaaaataacaatgatcgtttggcttaaaatagtctgaaatacgaaacttaaaaaatgaggtttttagaagggcaattatagttagacacttgctttaaattttggcagaaaaaatagaatgttttggcgtaatgttatatatttcttttcaagaaaaataataaataaataaactcaaaaaaaaaaataaataaataaaattagttttgccaaatccgctattgtttgagcttttcacttattatttatattattattttttattctcatttcagataattaaaattggcaataaaccacaaatgctgtttgcgggtgtaattgttctaccaatattcgttttgcaacattgtgtgtggaagtgtcgccctgtgtgcataatgatgcagggaacgaaggaagtcctctagttatgaaggttttttttttttttaattagtcgggaggcaaagaaataacaagaagaaaaaaaatctcgagagaaaaaaacaataaaaaaaagaatggcaacaactatttcagcctttagtagtgtaaagcaaaaaaaaaaaaaatagaacaaaacaacaaaattgacccaaaccagtgttagatgtataagaaaaaaacaatattaaagaaaatgaattttgaataaagcattttttgaaatagattcttacttttagagatgtattttaaatcgtttttagttttttttatgat

SEQ ID NO: 17419 - DNA, 1532 bp, Heterodera glycines
aaagtaaagaaattcattggagccccgacatttcttggcaccgacgacatcgcctttactctcataccgatattttcacccacaaaattccttggatgaatcgcggattttttttttttgttaaaatttttggaatttttttattgctgaaatgccacttttcattttccatggtgctgctcgcaaaccttgcaaatgcactgcaatgtttggatgacgagacggaagaagccgacatggaacaccgggtactcgaggtcgatgaagccgaaatggccgacgcacgtgtccaacttctcaccgcacgtgttgcacagcaccgcttgttggaaggtgccctggagggaatcgaaatgagcaaaacaaattgaaatattgctggtaatcagtgccaaaccttgttggcaccccttacaagaccttcctcaacagcgaaatttttccgaaaatccacaaaattaccactttttgatgaaacagattacaaatcgaaagaaaatttagaaaatttcgccgccccctcctccaagttggaatcctggaacggtccctggttgaaccctcggaaaacacaatttttcggtttcattacgatttttgggaagaaaattttgcaataataggagagaaaacatggggctgtccaataagtcggaaaacaaatgctttaaaacaggatttaccagtcgcgtgtccagcggaccgtacggggcgggcagccagcgattgccctgcacatcctggtacagtcggttgctgaaaatttgcaggtgcgccgcctgacggatcagctccgagctgccggccgtgaatttgacgcccacactaaaaaaaagttttatgtcgccatttttaaggacagccatgaggaggagtgactgggggggttgtgcccggaatgtttatgcttggaaaacccggcatttgccgacttttggggagtccctgccggtttttttttgtatttccggaattttaggcatatgtgccgcgcttcagagtttacaccataacaattgggtcccataaaaaggcacacaaccaggctctagttcagtttatgcgtccattcaattttatacatctaattaattgaattgcattgacagtatttctaaatatacgggataattcagccgtatctactccaatatatggtaaatatttctgttttccatggtatctctgaacatgcatatatttactgaaacaaatatatatgcagcatttcctcaaattgtactctgacgtggttttaccaaaaaattgtaacaattctattcctgtacgggttttttactttctttttgccaacaaacggaaaaaaaatcggttttcacttagctgataatattgattggacgcataaaaattgatgggacgcacaaaagtcgattggacgcataaactggacttgagcccaaaaccaagcaactactcacactttgcgcgtcgtgtccgcctcgcgaaactgttctttgcccatcctagaatattcaattgttattgtaaattgtacgtacttaaatgaa

SEQ ID NO: 17420 - DNA, 1866 bp, Heterodera glycines
ttttgagtagattagagtacaaataatagaaaattttcgattcatgtttcccactcccttctaccaggggtattattttgttaaagtttttttccccaataaactttttataccccatttttcgcaccgtgaatgttatttttattgaattctgaaccgttttgagtagattagagtacaaataatagaaaattttgaacatgtttcccactcccttctaccaggggtattattttgaaaaagtttttttttccccaataaactttttataccccatttttcgcaccgtgcgtgttatttttattgaattctgaaccgttttgagtagattagagtacaaataattgaaattttgaaatcatgtttcccactcccttctcccaggggtattattttgaaaaagtcttttttcccccaataaacttttcataccccattttcgcaccgtgaatgttatttttattgaattctgaaccgttttgagtagattagagtacaaataattgaaaattttgaaatcatgtttcccactcccttctcccaggggtattattttgaaaaagtctttttttccccaataaacttttcataccccatttttcgcaccgtgcgtgttatttttattgaattctgaaccgttttgagtagattagagtacaaataattgaaattttgaaatcatgttgttggctcggacggcaaaggggggcaaaatggaaaggcgcgagggagagagggcggggtggaataagggggaaaatattccaaaggcagaaaagaagtttatttaatttaaaatataaataagataagatgaataagatgtctggataagatgtgaggagtgagaaatgtgcgtgtttaaatagaaagaaaaagcgtaggtggagcaattttggacagagcgatcaacaacaaaaagagtgactaatgctaaaaatgtacaaaatgttcaatggagggacaaaatcacaatttcaaagatcaccaattaaataataaaattaatcacaatatttaaaattatccaatttaaatcaattaaatttctcttcctcaattttcttcatttcttctttttctccactttcttagtcgctttggtgacataacatgctttattagccttacaaaagcaacaaaattttcaagcctggaaaaaatttattaagaaaaaacttcaaaatttttgttaagctttcgaatgatatcaactagagcccggcgggatcgggactcccgcgggattttacgggattcccgctcccgactcccgcttttttcggtgaacgggattttttacgggatcgggatttttacgggattcccgttcgggactcccgtcccggaaaattttgaactcccgatcccgctcccggaaatttttacccaaaaacgggagtaaaaatgcactggtaagaattggaattttttgaatttttggcaaaacattttgccaaaattaaatagtcagattaatatttgcttgtcaactttctcatgaggaataatatttttgatattctttcttccaatttagttaagattttaataattcataattaatggcgccatttcaccctatttggaaaattgggttgtttgagaagagcaaggaaaacgacaaactggcagaatgcgttgaatgcaaagccaaaaaacagccaaaataccaattcaagctttccgacgggagcatatcatcattaatttgtcatctgaaaagtgaaaagcataaagattcggagtacaaaaccaaatttgatgaaaagatgaagactctaacgaaaacagacaaaaggactgaagtgaaagccgaaaagattgacaattttattctgcgtagtagtggtaaacgaataaaat

SEQ ID NO: 17421 - DNA, 2681 bp, Heterodera glycines
aataacagaaaataaaatatcccagtataaatattagccatataagaaaactaaaattctccctattgtaacagttacaaaaatggattgatcttaccatttccaagccgtcgtacggtatccctaatggcgccgctaccgtccgaaatgtttgcacactaaataaaacgaacaaaaaaaagaacaccaacagatcaacaaattctgctgttggtagtgcttcacgcaaaaaagcaatgttcaaaatttcgctggttacggtagaggacgatgacgacagaatgggctactgtaacagtagcaaaggtcggcctaaacgttcttggcttccgctaccagagcaacagcatgaaaatcacaaaaaatttggctcatcggttggtgaaaatttcaaacaaaaaatgtggtgacaaaaactcaaacaaaaaaaaacgacaaaatttttcaaaaatctggcaaaaagccggcaactttttaaaaaaaaacaaaaaatcattaaaacagtaaaattttcgaaatttttcaaattttatgctaaattttaaggagatcaagtgcaaaatagtaaacttggcaaaacccggcatggcctcaaatgacggtttttccaggcaaaatcgcatcccctgagaaaaatatttaataaacaaattacttagaagaaataagaaaaaaaaattcaaaattatttttgaaaaaaaagaaaatagggtaacttctcattttttaacaaaatgaaatgagttagaaaagaaaattcaaaaaattgaaaaatttgtgttttttgaccgacagaggcataaaaaagcatcagtgatgagtcagcgacatcattttttggcattggcacagcccaaaaaaacgacgacaaaaatggtcaaacattggtcatgcccatacgaaatttggtgtgacaaatttttacgggagcacaactgtcggcgggaagagctgtgcaaagaggtgggatgcccagaggggatgacgacaaaatcgaaaatttgtatttttaaaaatttcttgaattttaaaccctaagtcccgggctgagtatttttagtcacaaaatgaaaatcttgcttataagaaacaattttcatcagtaaaaattagaagcctccataaaaccaaatttcatggtttctcaccaaaaataaataaaatattgccaaaatgaaaaatctaaaatttttgttactttaaaagcatttactctcctatagctgggtctaacccagaaaatagacaaattttcaataaatttaaattttcttgtccgggaattattggttcgcctcactccgaggctgggacctgtctgagaaaattgacaaattttcaataaatttaaattttcaggtgtttctgtccgccctgccccattttggcgtgttttttgttgtttccgcttacatttttcttggctctttggcgttccgtcaacttgacactcaaatggccaagcttccattccacgatgtgctgctgttcgcattcaccacaatcacaacaattggtgggtgaaaaataatgaaattaaataaaaagaaaaaatatatttttcaagcatattttcgaatttcaccacaaaaccccctttattagaacagcccttgtagttttcaaaaagtttcttaagtaattgaaaattcatataaaaaggataattaattagaaaataattctaaattttactattttttggttttttaaaattggtactgaattccattaaatcttcaatccttaaagttgttctaaaattatgcctccacaaatttaataaaacaataaaccggtttttggagtacaaaaactgactacgaccccccccccccccccaaggttacggtaacattgtgccacgaacaccgttcgcacgagtcgcctgtgtggtgtactgtcttgccggcattccgctggtgttcctgccgttgtccaaccttggcgaactgttagccgaattctattgggttggaatcgcctcattgaaaggtcagaaggtcagaaaaaataaatttaatacatattatcagctgttttaagaaattttaaatttctaaaattttgagattttatttttaggcagaatttttgcgaatgaaaactttaaaaaatgcgtgtcaaacaaacactttcataagaaaatccatttctcggctctcaaaaagtcctatctgttaatcatttgtccccaaatccctcttctccactgcccgagttgatcatttgtccctacccatttgaacattgtccaatttttggcattttgtcatattttcccaatattaacgagttattcacatgacagaatttaccaatactgttcaggagaatgctggtgccgatgaccagctccatccggacggtccatgtcgtttgccgttgaaagtggttgtgttgctgatactgttccattccctgttgggtggactaattttccatttttggatacaaaaaatgccaatctttcctgcaatatatttcaggtgccaaataatgctttatgaacattttaaaattttaccagggcttttttctggatttgaattttttaatagctaacgcgatcatatcgatgtttaaaattcttgagagctaacctaatcaaaatgacagcatttttataatcgacccaattaaggaattgcgatgtctgagtttttaagatttttttgttt

SEQ ID NO: 17422 - DNA, 815 bp, Heterodera glycines
ccccccccccccccccaaggttacggtaacattgtgccacgaacaccgttcgcacgagtcgcctgtgtggtgtactgtcttgccggcattccgctggtgttcctgccgttgtccaaccttggcgaactgttagccgaattctattgggttggaatcgcctcattgaaaggtcagaaggtcagaaaaaataaatttaatacatattatcagctgttttaagaaattttaaatttctaaaattttgagattttatttttaggcagaatttttgcgaatgaaaactttaaaaaatgcgtgtcaaacactttcataagaaaatccatttctcggctctcaaaaagtcctatctgttaatcatttgtccccaaatccctcttctccactgcccgagttgatcatttgtccctacccatttgaacattgttcaatttttggtattttgtcatattttcccaatattaacgagttattcacatgacagaatttaccactactgttcaggagaatgctggtgccgatgaccagctccatccggacggtccatgtcgtttgccgttgaaagtggttgtgttgctgatactgttccattccctgttgggtggactaattttccatttttggatacaaaaaatgccaatctttcctgcaatatatttcaggtgccaaataatgttttatcaaacattttataattttaccagggcttttttctggatttgaattttttaatagctaacgcgatcatatcgatgtttaaaattcatgagagctaacctaatcaaaatgacagcatttttataatcgaccccaattaa

SEQ ID NO: 17423 - DNA, 943 bp, Heterodera glycines
tttttctgtcattgtcacgtttaccgtgagtttcttggtttttcggtcacggtcacggttaccattgagttccacgattttttctgtcatggtcacgtttaccgtgagtttcttggttttttcggtcacggtcacgcttattcttcatttttttcggtcatggtcacggttaccgtgagttccacggtctttttcggtcacggtcatatttacgggtttttctgtcacggtccgtttgccgtgagtttcttggtttttcggtcacggtcacggttaccattgagttccacgattttttctgtcacggtcacgtttaccgtgagtttcttggttttttcggtcacggtcacggttaccattgagttccacgattttttctgtcattgtcacgtttgccgtgagtttcttggtttttttggtcacgagtacgtttattcttcatttttttcggttattgtcacgagaaccgcgtgttccattgttattttttgtaagggttcaaattaacggcctatactgtcaggagccataactcgagaagtttcttaacatcaccccaaaaacacctgtttttcgtgccttccaggacacgtcgagctcagtaaaaaatagccttttgccaaaaaatcccatccctaattatgacacctaaaatcggtgttctaaaaaataacctaaaagtcaggggggggcgtacacgtctgtggaggttgcgacaggctcgtaagcaagggggccgcttcaaccaaataaaaattatgaaaaaatctatacattttcttgaccaattttttacatttgctaacaataaccccaatacagtgcttattgaaacgggcagaatgaatgactgtccggtgaagcattccgaaaagctttacatttttttgtacatcaataaattacttatacataaaacaggccgtccggagtcaaacaattt

SEQ ID NO: 17424 - DNA, 1349 bp, Heterodera glycines
gatggggaggaggagaaatcgaagctagcgcatggggaggaggagaaatcgcagttaacggatgcggaggacgagaacttgcagttagcggatggggaggaggagaaaccgaagttagcggatggggaggcggagaacttgaagttacaggatggggaggaggagacattgaccctaaaggatggggaggagcagaaactgaagtcaacggatgcggaggagcagaaactgaacttagaggctggggaggaggagaaaacgaagttagaggatggggaggaggagcaattgacagttagaggatggggaggaggagaaattgaagttagaggatggggaggaggagaaattgaagttaaaggatggggaggaggagaaattgaagttagaggatggggaggaggagaaattgaagttagaggatggggaggaggagaaattgaagttagaggatggggaggaggagaaattgaagttagaggatggggaggaggagaaattgaagttagaggatggggaggaggagaaattgaagttaaaggatggggaggaggagaaattgaagttagaggatggggaggaggagaaattgaagttaaaggatggggaggaggagaaattgaagttagaggatggggaggaggagaaattgaagttagaggatggggaggatgaggaggaaaaatgaaaatgagaatggtcacattcaattaaattccaaaatttattcattaactcattcatttgtcttatcatagtttcaattttggagaacaacacttcgtttgcttctccactccctgcaaacaaaaacattcaatcacttactccatactccaattaacatttaatcattagagtgctcatttttaagcacaaaaaatcaccgattaagcactgttaaaagcagcaccaaatttcccaaaataagcatgaaaaaagcacaaaaaagccaaaatcagcacaaaaaaagggaaaaaagcacaaaaactaagagattaaaggcacaaaaaattgaaaaaggtattaaaaaaacatttaggtatttgctcccttattataaaaaaccctaaaaataggtgctaaaaacgatgatgataacataattttaaaaatcaaaaaattcttgtcaagaaaataaataaaataaattttggagattaatttttgataaaattttccatttcttaggggtgtatttttctgaaatttttcgggtcgattctcaagggtgtatttttcatttttttattgcatttttgtttaataatttttttttaaatgctgaaaatattttagaaaattcctcaaaatgacaaaacagcacaaaaaagcaccaaatgccaaat

SEQ ID NO: 17425 - DNA, 2840 bp, Heterodera glycines
atataatttaaattattaaaaagaaacattattaatttattgaaattataaaaaaaaatatttcgaggaataatttcaatattaaattataaatttaaaattgaaagtaattaattgttttattaaataaaaaacaataaaatttaaaatattaaaaaattgcttgaataaccgaaatttatatgagaacaaaaacaaatccaatgtttttccttagtaaaatgagtaataatcttgtggctttgctttacgcatttaattgaagtgagaataccggccaagaaaataaatgaatgttaagtaaaaggaacatcgtaaataataataaataacaaaataaagaccaatgaatgtggagacaaacatatcaattgtcagaaaacaagaaaaaaaaagggaaactaacagcaagattaaataaaaatataagtaaagcttgaattatttatagcggaataattaatgaaaatagaacagaaaagaacaaactaaatgtaaaaaaatgaaaaaaggatttgcaaatcattgaattttgctttataaacaaaaaaaaactgaatgacattataaaaagtaaaaccaaattacaattttacattacgggataaatgaaaaaatagaatataataataaataagagtaaatatcctttttggaaatatcctttttggaaacggaatttaataagttagtaaaaatgaaatattattattattttaaataagtaattcaaataaaaaattaaaaaaaaaacataaattatttatataataatccatagaaaagcttctaaacagataatgaaagtcccaattttgtcccaacgttaaagcaacaactgaaatggctttcactcggttttctgcaggctgaacgatattcataaaaaaatatctatgaaaagaaacattagacttacattatattataaaaaacaatttattaaataattttaaaaaacatttgtacaaacttagtcgagaagaaataattaatgtcaatagattatttcattaaaacaagcaaaagaattaaaattcaaaaaattgaaaggcaataaaatcaaaaaataatataattaaaattaaatttaaagacaaaaaaagacttgtttttttagtatttaagagcacttagaatccaggaaataaaagtatgtatttgccaataatttctagtcctaattataagttatcaataatttaaagatgccaattagtattatgcatacaataaaattataatataggaaaattttttcgtgtttcacacctactagaaatagccaatgaattaatctgatttatcaaagagactataaaattattaagctgaatgcataagtaattttgatcactccttgatgatgaaatcaaaacgaaaatttcaatttttttgaaaaaaagtaaacaatatttcccgaaatgacaaacattaattatattaacaatataaattatgaattcatttaaatataaaaaatagattaagaaaaaataaatcgactaattaataatatatgaaatttatttaaaatattataaagaatattaaaaattccatttaattaataagaaatattaaatttaattaatagaaataaggaaaatgattgttggaaagacacgaaagaaaaattctaattggcatggtaaaaacgaataaaataaatattaaagctaaacttgtttaagctaattagcaaaaaaaaaatattagaaacttataaaaaaataaagtttaatgaattttttttctattaataaatataatcatgcaatagcttctttatatttaaataaaataaaaattggatcgatcgagaatcaaattataaaataatagtcaaaagtttaaaatggtataatgttgagggatatacaaactaaatatatttagatttaaaaaataacaattttaaagataaaacggaagtctttcaagaattttttaagcggataattaattgttttagtataataatagaatacatttttgatcgaataaatgtaaaaatatttgtagcaattttgcaaaatgttcttatttttgaccctaaaatcttattttttggcctttattcttattttgaaaattttgaaatagaaaccctggatttagataaaaacacccataaaaattgactattctgacataatttataatccttaaatttggtcatttttagacaatatctatgaaattataccaaaaaagaattgaatcgaggcgatacatcgaataaaggaatgtggagccaaacacatcattcaaaaaaaaaaattttttgtgagattttttggagctaattaaaaacaaacccccgcccccgtccccgggggcgagaaacttttcatataccgtatattggctaattatcgccccgtctccattaatccccccgtcaccaattatccccccgtatctaattatcgctccctttctggggaggttgaaaaataataccagtgggtgataattgggcatcaagggcgtagccagaaccttggcttcggggggtggaagtcaaaaattcgatttttaggggtgtatttttcttttcccagtcgatttttaagggtgtatttttgcttttttgaaatcccgaattaggggtgtattttacaaaaatttttgccgtttttcgccaaaaaattgctattttttgccattttagcctccatttttcaaaaatatggtaaaaagggggggtccggcggtgccgataggcgccgccggaaaaattttagagtattttaatgcaaatttatgaagaaaattgcttaaaattttcaaaaaatgtactgtaaatttttatttttttgggtttcggggggggg

SEQ ID NO: 17426 - DNA, 3517 bp, Heterodera glycines
  misc_feature (76)..(76): n is a, c, g, or t
  misc_feature (105)..(105): n is a, c, g, or t
ggatttggattcttgtcgtccgactgcgttgtatcaaacactgaagccagccattcaagcaaagtgttcgcctatnttgtacaaactcgcagatggaccaaattntttggggttattcatactcttttattatattgagatggtcgtattgaagagaacctattgttattttagactttcccatcgtctcattttcgctgtgttatgtcgcgactccgtcctcctgtacagctcccaaaatgagtttccactcgcttacattgaaaatctccagtacgacaagttgacttcaatggcttggacacccgacggccgtgtgttggccgtttcctcgatggaagggttcaactcgttcatcacagtcgattcgtccaaatttggcaccacaattgaactacagaatgcggtaacacctttcggagacgaagtagcaatgtcccctctaaacaaagcaaagaaaaacattcgtaagcgatgccctgaaaaatagtgataaaaaagcttaatttctttcctttatttattattatattgtccagataaaatgttttatcttgcaaagaaaccggacacattctgagtttttaacacagtatttatttatgattttaaaattatatttactaataaaattctaaaaatatactgtatagacaataagaaaagtcaaaatatctccaatccatctgttttggtttttgtcatctatgaatttgaatgaattatgtccgaaggcggaccaattttcgccaagttttggagtgccttgtccaaccactaaacaaatttaggtttaaagtacttttgtttcaattattacgataagtggggcgtgtaaatgcacttctatccaacatggcgttgaagttatgctttttataaaattaaaatattaaagaatgatttccccttccaatactcttgtcgttggtagtccttcccccaacccttcacaaaagccattcgtatggttgtcattttggtcagctcaaaactgctgttgtaacccaaatttacgcaatgattgagcaactaacaaatgaaaaatataataaaatatagggaaaatgtaaaatcactttccaacctctccaaattttgctgtgtcgaatattttcaacgaatatccatgagagagtttgcctacactttttgtttttaaatggaatgaatttgcactctcacaaacggtggtcggatggaagtcgttggtcctgtggtgggattgattatgagtcggaactcgattaatgatgagaaagtcaaaccaattgctgttcctcgactgaatgaaaatggggcagtcactcaaacattcggcatagagtgttcctttgggattcaaaatcaacaatttctgttctccccccccccgtccaattttattgccttggtaaggaacataagtgagtttcacgcctctgccaatttgcctccgcgtgttttccaccgtcgaatttctattaacctaaaatttaatgtccaaatgaatttaccctaaaagagtaaattcacatttgaaaataaaccgagtgaaattttgtgctggtcgttggcttctccgctgctcggatctgtgaacccatcgaccgaaagtcaaaagaattttggaaaaagcattataaaccaaccacacattcaattgcactgactcttgcctttcaatgataaaattttaaggaacataattttgagtggaaagaaatgcggtgacaccaaaacagtcccaagggaattaagtgatattatccatttgcttatggactatatttaatttgaatatgtccatgaagtaagtggatttttccctttcgtggattatttttctttttgacaaaaaaatagaatatacctgttcaccaacccgggtgctcaattcgtaatagctaatggtggcccagtgctggcatggcacaaacggaatagggtcgtggccgagaagaacgcgatgttcgccgcccggctgacgtttcggtggcgaatcgctgaagcggggcacaagaacaggcggcaacaagttggagctgtccacgcgttcgtaatgataaggattgatgcacacatcctcaagaaaaataaatgaaaattgacagaaagtgaggaaacgcgcactttttgaccggattcgaaacaaaaacggcagcattgggacgctttaagctaaagcaaaagtttgtgccttctgatcgggcattatttgtctgatcacttcgtgatgcgattgcaaatcgggccatcggtagacgcggcagtaaatgacgtgcggaagtgcttttcgatgtgaaatttgcagacgcccgtccaatgagcgcggaatggtgacgcattcgctcggctctttgccctccgtacgcaaagcattttccaacagagttaaaccctctttgttgtgctgcttttgcaactttttcagcaaactgtcaaccgcctttttggaccatccctcgtcctcatcccctgagaaagcattctttgattatcataggcattactataataacctaattaaccttgcttccatcccaaccgtcgcatgaaaccattgccaaaattctccaaactcattttaaagctaacgaaataaacaaatgataatgagactaccttttaaactgattccaatacgggagcaaagttctttatctatttacccgatcaatgtttgaatttacgtttaaaaaaacatattttttgtttttgcagcaatttatcgcaaaattcattgacaaacaataaaatatttttaattggatcgcaattcacacaaaggcatagaatcaacgcaaaaatcaggcaattggcaggtcactgtacaagaacaaaagagctactgcggcacaacttcggcacgcctgccactttttgcagtcatcgcattcggattttcatgccgcgcaatcagacgttcaaccatcacctgaatttgcaaaaaatatggacctaaattgtgattattcaatagttttcatcaagcgaattaattaccttagtgtatttgagtctctgacacaaatctttagggcatccgtatttctccaaatattggaatttgcaggtgaagacattcttctgctggtctatgtatgtggcggcactcatcagcggacacacaatcaatttggagtgatcctgaaaagacaaaatcccataataaatgtgcagaaatcaccaatattaggccattcatgtgtttattcaatgcggacctggaagaagttgatctgcagagtgccgttgctcagatgcaagacaatcgccgactttgtccggaaccacgtgttcaggcagggcagccgcgccaactcgtcgccgtcccgcatcttaatgttggcgcccgccttcatcagatgctcgttcatgtacgaccggaagaacttgagcagagtgatcttcttctccagcgcctgcgggtatttgttggccccgtaaaagtgagcggtgttgttccgctcggtgtattgcaactgactcaagtggggggggaattggcatttctaattcaacggagccaaactca

SEQ ID NO: 17427 - DNA, 2537 bp, Heterodera glycines
aaaatttaacctattaaaatatttagaaaattttattatattttatgttttttgaaaaatttccgagttccgacgtttttggggtcggaattccgatttccgaaaatttttggggcctcggaatgccatcccattatctgtggtcgattttttgaaaacttttttgagataaacttgttttagggatttttagggtcggaaaagccgattctgacatacattccgaccaaattcgaatcccgaacccggattcgagcaaaactcgaaaaatcgttttacaacaaaattcacatttattgcacaaaaaggttttttaggggaattttagggtcggaaaaacggttctttcatctattttgtcccaatacgaactccgaactcagactcgaacaaaattcaaaaataggaaattcatttttcaacaaaagtacagccggaatttgaacaaaaattttaaatctgaaatttgtatttcccacttttgcttcgaattcgggtccgggattcgaaattggtcgaaatggatgccagattcgtgctcagcgactctgaaaacccctaaaaacatcgtttttgggacttacagatttttttaaattttttttctaaaaaggggggctaccatcggcactattaccgtcactaaaagtcgcggccctaataattacacgccctattcattatcattgatcttccatttattttctaaatactgtaaggcgaaaatttatcgcatccatttaatctctttctcaatctgtgatctgaaaatttaagaaaaatttgtcaaaaaatggcacgaatgcacaaaattccgctggaccctgactcggcaaatgtgccaatgtttgttgctaaatgcgagcaatggttggccaatttgccaacacactttgaacaggtcgaaatgcagcaaaacttcgatcaaaattttaatggtaaagaatttaaaaaataaaaaattctttttttaaattaaatttttaaggctcttctttgtctgagcagttaactgagctaattaaagcattggaaacttctgaatcaccgttggtggtgtttgcgcacaacgatttgctgctctttaacagtaagacaaaaacaaattctcatttatgttaatttaataatataattttggcacttaattttgctagaactatgattgatcaatttttgggctaatcaagacataaaaaatgtgtgattggctttttgggaacagttgatcacaagctcaattaggtgattacggtctgatcaaagggacaattcaaattttgaaatattatttttctattattttttggtgatcaattgggcaatccttggattatcaatttgattagattactcctaataaataacaaatggacagtttattatggcgatcaaggacaattttgatcagtagacttcttgagctgtcaaagattcgaatttttcatgcttcgagaacgggactgaaatttgatcacaaatgagttatataaatctcgacccattaattaatctactaattgccaaaaaagctaacaataaggatcgatttcccgagttttagagataaaaacaaattaattaattgcctaatttagtcctttttgacgaggaaggcactggcgatgtccatttcattgactacgaatatgcgggccaaaactaccaactgttcgacattgcaaatcacttttgcgagtacgcaggttgtgcacacagaatcggttgcacttcatttatgactacgtattggttttcaggtgttgatgagtgtcccgattatggaatgaattcggccagtgaagacgaacgtcggcactttctgcgccgttatttcgtctattttggccaaccaattgaggaagagtgtgaaatggacaaaatgttgtgcaaaattcggcactttgaagcggtacattcataatcacaataaaatagtgttaacttttcatttacaggcagcccatttttctggactctgtgggccatccatcaggcagcaaaatccgcgattcaatttgattacatgcgttacgcgatcacccgccatcgttactgcactcggcttatgacctcatcaggcattgctaaaaataattagccacaaaagcacaacattattgatttttggttttcgttatctgtactttatcaactctcttaataaaaggtgacgatcaacgcgatactattcggtttatcttcagcgacgaataaatcttaaaatggtcggcaatcgtgaagattattggtcccacaaaaaaaaaaagaaataaaaattaaaaaaacacttttttagttttatttaaattccttaaattgatttccaaatgttttgcgatttacaggagatcactaaaaatggcttgaaatggagtactagtaaattgggaaattcattacatacctaattaacttttcgcagaaaagagaaaattaattttcatcatatcatgaaatggccagcaattgggtcgagaaataaaattatataatggcttaggtgggatgtcaattcaaaatcgcatgacgccgct

SEQ ID NO: 17428 - DNA, 857 bp, Heterodera glycines
  misc_feature (27)..(27): n is a, c, g, or t
acgtgcttcgctttgctgccccagcancggagtggcggaaagatgagctggggaattggttggagcgcttaaatgatggaagagcagcagcagaagaagaagagtgaaagacgagcacagtcatcaggcaaaagcagcaccactcgcactatttaatgcatttcaacaacaaacgaacatttggcagaaggaaattatgtccaaaaaaaagtcaattagaaatataaaaatatatagacaagtaattgatgaagatgtttgagaaattgactcgagaaaaggcagtcaaaaaagagtggaaaaagtaggcattctgacaaacacaaaaaccatatgaatgcagcaaaaattcttgttcaaatacagataaattgaatatgtaggtatcagaaatttaatgtgttatgtttatggtctaattggccaaatcttcgtaacgtattcgctcgctgaatttttttgacgcacttatggagatccgttcgttatctttgaactcaattagaatttttcattttgttttttccacatcaaatttctttatttttaaggttttacattttttgtcttgtttttatcaacaacacatgcaggaaaaggctttttctgttcgagtaattcacctattctttttttgttttgtttattttagtcgcaggaaggcgtccttcagcagcagggaacagctcaaaatgggaataaagaggaggaagccaagagacaagcggaacggcaggaaatggcaaagaactccattttgacacaggcaaaggctgagaattaaactgtctgagtgccgcggtttctgtgattattcatttactttttaatatttttgcattcagattatcgacaag

SEQ ID NO: 17429 - DNA, 849 bp, Heterodera glycines
catttttttcactaattgttaaatgcatcaaattcattgcttttatgaaataatacattccaaatggaaaatatctatttcttacttgatggcatgataaaaaaagaaaaaatggtggaaaatgttaaaaagaaaaatcaaaaggagcagacattttttgacttttgtgaaaaacagtcgaagagaagcagcggaaagacaaacggtgaaagagcggagagaaaggggagaaaggacgatgagtaagcgatagagaaaagtgatcaatggacgagaagataagagagattaattaagcaaaggcggacagtgatcagcgcgaagtcatttctgttgataagccgatgaatgcttctgctgatgaaaagcatttgatcagtaaaaactaaaaaaaaagaaattgttcaaaaatggtaatacaaaagcattgatcagttaacaaattgaattgatcaatgctttgatcagcaatgatttgaataagcgaatcaatcaatcattaaaaggccattcccacgttggatttagtagcaacattctcttcaccatctgctgccaattgacctcttcgagaccgaaccggtcggccgcggctgccctcgggcgacgcgaaagaaaaataataaaaaaatgttccatccgagaaattcttttcacgcttatcgcttctgagaatgagcgagttccgtggcacgggcaaagggaagaagaaaggagaagaagcccgtttttggggaggaaagggggggaagagcggatgtgatgaaaagaaaaggaatggaagacacaaattaagaggagggcaaggcttagggtgggagggagggggcgaggggggatgaagcggga

SEQ ID NO: 17430 - DNA, 1981 bp, Heterodera glycines
ttattccatcatttgtgggtttagtctgtacgcccaaaatcaaaaaacctaagaaaaataaagaaatattcccctatattattaatatgttgtcgaaccgaggaaaacgaggtagatacacagtcgagtgattgggggggttggggcgggaaagctaaaaaatataaaattaatcaaattatagttttaagaggatggccaacttcttcctaatcatccagcttgtatttggaacatgctaatgaaaaaaatcaacaaaaaaaaatcttaaaaattaaaatattttaatagaattttttttctgaggatttgctagccccgggatacgatatcggcgacttccccctgcgctttcccactgttcgctttattcctgaattcatttgtcactcagtcagtcgttgtttcattttttgccatccttcaatatttcccattttttcttctcacaatcccaatttctctttttaagccgccttagccgctaaataagattctctctcagcatgaattgcttctcccccctcccccattttcctctttaccaaaatcggtcgctggtcttttaatatttctgaaaatcatttctccgggcaatttgcaattttcagttttttttgtatgtatcaatcaaccttatccatgtcatactcatccaaatagcgggccaattgacatgggatcagattggttttgatcagttggggggggggcactccaaaattggccactttaattaaactaagcaaagcattgcacaaaataacaaagtttccagtcatttaaccatataattcggcgttgcatctgaaataaaatagtcaatgaaaagtgacgggcggggggagacggaaattgggcgggggcaagctgatcgacgaaggaagctaatcaagacgaagccaaaaatgccaatggacggaaaacggcaaaagaatgtcaattgaaattgcaaaaaaaagcgaaaaaaacatgaaaatgaaaatggtaacaccaattaagaaatgggggatgatccaatggcttgcgcatgtaattagcctcacttcgcttccctttcactttttccccccttttaccttacatttcgtcagacctttgcccaccccacaaattgttgcttcgcaatttgcactgtcattcgtcgcttcattcattcgtccccctaaactggataaagtctttccattcagcaggctttcattcccacaaattccccctttttttccctttttttcccttttttttccgctgcgttcggttgggcctttgttccccataatagcaaaatcaaattcacccatagaagaagcagcagtttttcgtgcatttggtcttccttaaactcgtccatttgaattaagcggaaaaacactcacaaatcagcgataaaatcgccctccccccccccacggattggtcactctctccccccccccctttaatagcgaagttttttacaaactttcacttatttgcatccctccaaaattctcagtttgataagcaaatggttccctcaaaaactttgaaatggcttttccttctttcgctaatttgccacttttccacttcggtcgccgtgggcgacgccgtggaacagcaaaaccaagcagtagcagcaccaccagacacagcatctgttgcggatcaaccatcaacagagaacagcaaacaattggcagaacagccgaacaatcagcaaaatgccaatggaaacgaaagcgccacggggggcggaggagcgggacgcgcactcgcggcaccgcttctccgagggccggagaacgcgatcgaattgaacggggagcaaaagccgtttttcagtgagcgaagggtgggagagagagaaagagagagatagagagagagagagagagagaaggaaggtggaagaaagcaaaaagaaatgagagacaggaagaaaaaggggagagagagaaaaagaggggagagaaagggaaaagggaaaagaaaggag

SEQ ID NO: 17431 - DNA, 1309 bp, Heterodera glycines
  misc_feature (1273)..(1273): n is a, c, g, or t
aaaaaaggagtggaaatgtgacaaaatagaaaggggcgacccaattattcacccaatcgaccactttttgcgattccgtgctgttcggctgaatgtccgtcgacgcatttgtcacatggacggcctattcccgtaaaagatgtacatgtgaatttgtttgtcatttttgaagtccatttggcctagtgttaatgagctgttgataacgattgcaaagtcacagacgagcgaaagttaaccaattaaaagttgagttgagaaaaacgtggtaagaacgaggcaaagggagccctaagaagcaaaaaattacattgaaactgatgagtgagctgggtaaagggaataactcacaccgaataaatggttatatcttatggagatacgcacctgaaaactctgtcttccgataaaatttggttgtataaaatcggatggccattttggtaaggaaaaaggtgcaaaatgacgtggaacgagtgcactttgtacatccgtttgtattgtccgcgataataatgacaatttacgcaacaaatttgacctaaacaacttaattttgggttttcggtattaatttggcgaaattttttcttaaaattagtgctgtttctctgttccttttctgcaaaattacgacttgcttctcttacggtagagtcaattaattcttgcacaatttgtcattgttgaatcactctccgcgtcctcctctcccgtcgctgaagaacaatttgagttttcggaaacgaaattggtcgatggacaagactcaaccgactcagtcataagatggtttggaaggcgatgtctgtggtgtccaaaaagctttgtttacatttacagttagcacaaaccaaaaatgaacgtttaattgttaaaagtgtaagcagtgctgggctctacttaagtttacgtgtccaaccgacttttacgcgtccaatcaaagactatcccccctgtttcttaggttatatcttttttttcatacttggtcaatccatacatctgtggcatcattgaaagctttaagtctcaggaattcaaagataaagaaaagctgcaaatacttgtattaagataaaattgcaatcaaaaaaaactgattaatcattttgcgtatattcaagaaaatttagtcttgctttatcccagaatttttcaacacaagaaaacttcttttagcttaaagctttcaattgatcccaaagatgtatggattgaccaagcagaaaaaagctgttcggttctatgcattccatgacatattttatgntccatatttttttttttgcgtcccgtcaatgaccat

SEQ ID NO: 17432 - DNA, 1916 bp, Heterodera glycines
tcatcgtgttggtcctgatcttcgccactctggtcgttcagtatctctactggatgaaaacatgtaatgggtgaggggacaagttttttgacggttcaatttctttgttattttacttgtttatgttcggatataaaaaaaaacaaatacttttttgtttttgttaaaaatatctcataggcacagagtaacaggtccaccaaaggtttttttgggaaaggattacccccctcatcttataaatacggtatgattaaggaccaaaatagggatagaaatctgtctactcttttttaatgggttttaaaaaattaaattatggtgtctttatatttaggtttttgaaaactttatatttcagccattattttttaacaattaatttaattttttatcagcagcgaaaaaaaggggaaaatacccttagaccacccctctgacagagaattctggattcgtaattaaaacaattttataaaaaaaatgccgtaaggtttatgttaaaaaatccactaaaaggctttgagtcatttaccccacccctcctccctctgaataggggtagaaatatacctactttcttaatggtcttttaaatcacacaacttttatttaaaaatgattcacactttatttaaaaaatggttcatatttttttattttattgcaaaaaaatggtggttcactttttttatttttaaaaattgtaagaaaatatggttcatacctttggattttttaaaaattgcaaaaaaaatatggttctcacctttggatttttttaaaaattgcaaaaaatatatagttcacacctttggattttttaaaaaatgcaaaaaatatatagttcacacctttggatagatgaattttaattctaaaaaataattcgcagccaagggggctcgaactttaggggccaaaatctggtggactaactactgtttttcggttctaaaaaacctcctaaatagttgctaaagatgggtaaataaaagttgctaaaaatttcaaatttaggggtgtaaaatcgtaaaattttatccaaaaactaacaaaattaagccaaatcattaatgatttttaaaatcacaaattttttgtctaaataattaaattttggagatgaatttttgagataattttcaatgcatttttcctttttttttttgtatttttgttaacaaattatgggaaaaagccaaaagaggtgaatataagtttttttaaaaattcttagttttataggtaaataaatacttattaaaatatttaatttttttttcattgtacgcattttatcaatcatccaaattaacaatccatggtatcattcgatagccctaagtgtcctctattagcctgtaaatttcaaaaaatttcgttgagtttcaaggtagtttttggcttgttaatttcaaaaattggttccttaaataattttggctacaacttctttgaagctcatttgtcaacgaaatctttttaaaattttacaggctaatcacttattgctatcaaaacataccaagattgtttggatgcttgtagaaaaagttatgttgcattaaatttgtcaaattatttgatggtcttaatttttgaagggtcgtgtatactaaaatagagccaaatatatttattataaatagattgttattcaattatcaattgattatttaatttaattatttaaataaattttccgtactgaaataacccgcctcttccgatcatccctcatcaatacttttgacacttcgccacatcgatacttttgacacttcgactcaccacgaactcaaggcttcagaatctgggctggacgtaattacggattacggaaattacggactttttggagttacggattacgggttacggatttttgggattattccgtaattttgatccgt

SEQ ID NO: 17433 - DNA, 2049 bp, Heterodera glycines
  misc_feature (97)..(97): n is a, c, g, or t
gagtttgcctcgcgacccagcgtgtttcagtcgtgggtgtttgagcgtggacgcgagctggatgcgctgcgtgcggcgtccggtgacccgacgcganctggatgacagtcgcaagcagttcaaggagctcaccgaacacattttggtcagttttatcacttcacggtttttaaattattttttggctttttaaaaaatttaaattgttaaaataattttgatttaatatttatttatttattttattttttatttaatatttttaaatatgcaaaattttatttacatatttttttaaataaaatatttattttagatatttcatttaaaacatataacctaacttatttattttatattttgtttctatttttaatttataggccttataaatttttattttaaaaaatatttaaaatacatttttttaaattatgaataataatttaagagttttttcgcctaaataatttattttttatattattgttcattattggcacgaattgcttaaataattaatgttaaaatttaagtcaaagcgaggcgaactgagtgccatcgctcagctggcgcagcgcattgaaggcgagatcagcgcttatttggcggagctcagtcggcgcaatgagtcaccggcgccgggattgcaacggcatcactgtgtggaggcggcgcagcgggcacaggacgattatgaggtaaatttaaaagaaaaaacactaaattctttttcaaaaaataaaaatcttgttttcataaaggatctttgctgaaacgaaacttgcaattttgttagattagtatgaaaaattctctatgttttcaaagacctaaaaaattttgtctaaaattaaggcatagcaaatttaagccgaaataagcaattttaggagtcttaatcaaaatttaaaaaattatcttaagtttgagtcttacgattccggaaaatgaaaattgttgaaattttcaaatatttccagtttaaatgtttacaaattaaggcacttttgggcgccaaacaggagctgtctcaactgttgcgccgagtggcgaactgttcaatgcaatatgagcaaaaggtggaggaagtgaacggatggatggccgaactggagcgagcaatttcgcatgccaatgtcggcacatcgggcgcaacaggtggaaacttggaaaaaaattttgcattttattttaaaacgaaattttaaattcagttttcaatcatattttgatcagttatgtgaatattttcaactttttgttcggctaactttttgggctttgtcattttttggctaatcgcaattctttcaaattctcattaggtagggtcgcgatttttaggttttaactaaattttttgctcaattgatttgaaaatgaaaaatttttctcaaaaatgtattttttggcaagaattttttaaaattatttttttagttattattttggttttttgctcttaaaaatcccagtcctactcatttgcaactgcaaatagtgaataaaaattatttttgctcaatttttggctgaaaattatgtcactatttgtcactaattcgtactttttgccactattatgtcactattttggcatttttactcactattttagttaactattttgggatttttcgtcactaaaagtcgcgaccctactcattagtctaaatttagcggttatgtttaattttgtaataaggttaattttctttttattttctgaccaatttttgataaatttttatttaaaatttatttttggccaatataattgaaaactttggcccaattcaaatatttccaatttcattttttgctcactttttctatacataaaatgattgctaaatttattattttggcatttaagccgatcgtcttgacctgttgagccgtctgaaccaaaaagcggttgaagggcagccgagaattgaagcggtcgaagccactgggcaacagttggacgaagcgacggcacagaccgatgcccatcagcgattacaggtgggtccccaaaagtgtgcccgcagaggcattttt

SEQ ID NO: 17434 - DNA, 1113 bp, Heterodera glycines
cttgagcgacgtttcatcaccaccgccagcgccatctaatttgatcaattttgatcaacaacgccatgagtgcaaagcgcttggccaacgactaatcactgcagggcgcgagttgaaagagttggaggagttggggtcgatgttgatccaaagcggaggcgttggggcgagcaagcggcgatcaaccgaaatggacgaatcggcagggggaggagcgggactgatcggaatgactcggcaactttttgaattgcaccggaaaaaggtgcgcagaaatttcacatattgttgggggagggataattatgaacaaaaatcaactagaaaattttgagttccatttctcgagaccctaacctgatattctaattctcgagagttgaaattatgaagcatattactggtattctcgagagcagtgaccagtgagagtgacccaagactgaaataacgacggcggccccgtgattttgtcttggatttggttaagtagaaaattatttcgggcactattaaatgaacgagcaattgatatttaattagaattttaaatttttgagtccaaaaaggtttttaaacgtgctacaacattcgagattagctattaaaaatcctgctaaaggaatcgcgaccaatgagattattgcaccaccagtcccgagattttgagtttttgtgccaattaaaaaaaactaaggaaaaaaatttattcgacatttatttagaataaattaggcttattagccaactaactaaatttaaggacgaactggaccgagcactgatggaaattgagagccgaattgagcgacggaatgacgaacgccaaaaatgggagacggaccgagacgcactgaacgcatggctggaacaggaacgggcacgtttggccagtgcatggagggcacttgcatgggaggtaaggacataaattttgtgggaaaactcgagactgaatccataaaaccgagactctgactctcgagttttacaagcccgcgattaaataattattctggacacttgaaattaccttgattaaactgttactttgaccagtaagcgacgcctaatttgccgtgagcaaagattaaacgatttaaacaaatgata

SEQ ID NO: 17435 - DNA, 3038 bp, Heterodera glycines
tcagaaagtctttggtttatcggttttggtctcagtctctggataagtctcggtctcgagactcttggaaaattttcggtctcaataaacagcatatgcttgatttttaaggacacctgtgttgaaaaggtgagcggtgtcgctaattaaaaaccaccaaatctatttgctttgaaaatttcaaaaaaatctcgatgtcttacaaaaaattaaggccaaaaaaaaacaaatcctgggttttcaaatatttttgccataatttggagcaagattatgaataattttttattaaaaattttaattttggtgtttttgaataaaaatgctgtcatcaccattgaatgtactgtttcaaaacgccaaaactaatgctcctttcaaaacagatataaattttggacccacgatcgaaataatatttgtaatattgtcaattattaatattattaattgtattattttgcacttcattaacccaccttttgttgtaaacaggcaaataattaaggtcaattagtggaaaatattcttttaatttcgctgtgtccatgaagccaagtttggcagaacagagtttataaaactgtaaattaatttaaaataatatttaaatattattttataatagtatttaaaaaaacaatttttattttaaatacctcgccaaatcccggctcaacgtttatgtaagtgttgtgatggtttgggttaccatcaagtaataaactggctgtatgaacagttcgtttgaacggtgaagcaaaaactttgtcaattttttcagttttgaaacttaatttacggggaaatttaaaatgaatcatttttaatacctagagaaatttaaaaaatgtttatgaaaaagtacagaaattgtacaaattttaatttagaaaaaaaaatcgctcacaaagatgcaaaagattatgaaattcactaaactaatctgttatataaaacccactctaaagttaaaaaaaaaattaaaatttatttttgtcacataaaatccgcaaaaaaaattagataaattaaattttttaccgttttccaagttctttcgcttgttcaatgcctcttttggacaaaggtgtgtcttgttggtccaattcatttaaattattgcccctaattagatatgttgtcaagccgttcagcatgacgaacaagccacaatgtttggcgaacaatcgggcgttggtctgggggttttttttatgaaaatttaataaaattgcaaaaaatttgttaatttaggaagaaagattaagatttgtgctcgcataagattgatgggaaaaatggggggtccgagatattcgaggcgatttggaggtgtaagttctcagggattatcaaaaattttccgaaaggattggtctaaaattttcggttttagagtccacaagtattaaagattagggtgaaatgaaaagtcggggtcactttgatggggaactgttgggagcccgaaataacgggaggcattggtataaataaaaaatttggaggtgtcacttttcagggatttgtccaaaactttccagatttccggggtccacaattaatattattttcttttttatttattttttattattttaatttgcctattgtccaatattgctgcacattatttgtgtcttcatctgtcattgtaatttgaatgttgcgcaactcatgttcaattaagtccaatgattgcaaaaaatcctcatatttgtacgatataccgtaatccttaaaaaaaatatataaattaattcaaaaaatttgaattttaaatgtttactaatttaaatttaattaattttacagtttcggtgcatttgtcgcagaattcctccttttccttcagctgatatcggatattcttcagcacagcatcataaattcccattttttcttcatatcgaaccaaatcgagcagttttttgcgtacttctaactctcgtaaaatctaaaaaaaatttgatttaaaaaattttaggctaatgaaaggggggagggagggagtttgatcagtattttattgttttgttggcaaaatcgtcataaaattccagattcgaaaatgctataatcaaccatcaaatacaaaaatttgtatagttgttgaaaatttttagcaggcattatcagctgtcaaacggtatcaaaaggattaaattttgttaattttgagcaaaagttatggtaattatttggtaaacaccctaattagtgattttttacgaaaccacttagcaacataaatttcgactacattttcaaaaagaaaaattcgacggcgcctagcggcaccatgcaaaagcaattaatggactttgctaatattgtgccaatgctccgcttcggtggagagaaatttggccagaaaataacgtgcaattatgacattttgtgcttggtgaatttgtgaaattgcactcattttcattttcggttgataggctttgtatgagctgatttttttatgctaaatttgaataagtgaaatcggaccaaaaattcttaaaattggatatatttaaattgacattaaaaatcgaggaaaatttttgaatttaatgcttttttatagcaaataataatattattaaaaagatatgtttaaaaaactatttttttttatttaaataaattaaaaattttgattttttataattttccatatttttcactaggaaatttcagaaaaaattcaaattggccaactattaaaaacaaacaaattttttacataaaaggcagcttgaacttggccgctctcttcaactgcaatttccttttctttgttcaatttctcattccattcatttatttttgcttggaattctttgaaaaattgtaaaaactttcctagagaaaaatttaaatttattttaatatatataatatttttttaattaccattaatgcactgtttttggtccaaaatccatgaaatcagattttgttcatcaattttgatgttttcacgataataagcatcatggcattgaacaaattttgccgcatccagaactccgaaactc

SEQ ID NO: 17436 - DNA, 1900 bp, Heterodera glycines
catacataaaattcgatgaaaacattttgctcattttgttgtaccatcatctgtgaactgagaatcccattcttgtcgatgcgaaatgaaagtttgttgcacaagcgaatgctgtctttgagccgtttaaataggctcattcgataccggtgttgaacgcgatcagtggtcacattcaaaagctccaattggtcacaatttgtgggtaattccacctaaaaatattatcaataaagaaaatgggtctgatgaaatttgatgattaaatgcttcatgcctatttttgtgataatgcatttcaaaactcgaagagagtgccttcattcgtcccattccgccggccacataaaattgcagataaccgggagtgaaagtgagcaccaccgtttcggcggagtcgtccaagtcgcgcataatctcccgaattggtagagagttcagaattgccttggccgtcacattttcattgtcgaaatcgaattcgagaatctgaagcggcagaatactcatactaaatggaaaatattttttacacctcgggcgctatcaaagttcgaatttcggtgtggacaacaactccttaaaagacaaaatggaagaggatgattgctaattgtaagcacctgccttcgtcttccaaaatgacgagcaatggaaagccttcgccattccacgaaatttgcaccattgtcatcgtaccggaaaacatattcagtgcttcctattaatgttcaaaatttggccaagaatccaaaagtgtacattttttgataaatttaccataagaggcctcatcggtattttaatgctgcatgtttgggtacgaaagttgaagtcttggaagtgctcggatctgaagtaggcactgccttgctgattgtgttggtcgtccactgccaagcgaatgccctcattgcttacatttaatgtgcaatgctaaaacggaatgttttctgccatggttttgccattgcttctcacgtctcggaatgccattgctttgaccacttggcttatttctttaacgtcatgcttagaaatgcaaaacaatgcttcttcactttcctcagacatttgttgttgggagtaaaatttttcctgctgttgttcttgtcgatgagcccggtccatttgcctctcatttgacctagtcccaataatttcaacttcctcgtcatggacatccattaatacaggtaaaaacataaataagcgaagtacttttttaaatttaattaaaatttgtaaaatgacttttgtcaaagtgatctttggcgaataatttttatttaaattttttaaattacctaatttttttattcattaaaattatttatttttttaaacaattaattattagattaacgcatataattgcctatttatgatgtgcctaatcagctgaattcgttttcccttcctttgcttttacctttttccattagttcatatacaaaaacacaaaactaaatttatcagcattaactaaaataattttcttattatgaatctcggacggtgtagcatttgcactttaagctttgacttaaacgatgtttcagctctcaaatgtggtcatacgtatcattaccaatgcatcgacaaatggattgcggtgatttggctttttataacttccaattagtcaacatttagaattccaaaacttgtccaaattgccggacatcgaatctcaagcgcgacatattgaagcttttctttgatgagggcgaaaagtcttttagtcaattggtgcaagaaccggccaatgctcgtttttttctaatttcatccatttatattattggttttttaatgtgattgtttttaggcagaacttcttgctcaactgaaagagacgcaagacgtgaaatgctttttggagaaaaccattaaagag

SEQ ID NO: 17437 - DNA, 1206 bp, Heterodera glycines
cgggaaatttgtcgggagatcgagcccctgcaacaggccacagccgggaaggggcacgaggcggacggtgcaacaaggagacaaagtggggccgaattttgaccaaatttactcggccgacaaaagagacccgtgccgctcatttacactaaaatgccagctaattaattgagtcgcctccataaagcatgaataattatagcaaatggcgaagacgacctcaaaatatttgatgccgttcactgaaccattgtttttgccgtccggagtgtccagaatgagcccaacccattctcccggctgaaattgagttcttccgacaaaagcaacacgacctgtaaagtagtgtccgcgtgtttccaaggtcaaaattaaaaaccaattcgctcgccgactttcaccgtttcgccaaccgcaaaagtttcggaactttgcgcttctgagcaagtggagaacaccgaatctttacctaaacttatttgtatgaggatcctttaaatctaaacaccgcatgattggccaatgtgggcccaaaagtcccacttcggaaaattactgatatttaaaattgttacttactcggcgttttcttcattaactacagcaaaatcaatcagtctccttctttaacacaataaatctgggcaaaaaattttgttttttcataaacagaaactctatggtataaaagaataaactcataaaagaaacagcaaatattttgagagcaacaaatttttatcatctaaaccaatttgtgcaaaagagaatgtccatttaataacatctctattgaataacttcttccaaataaaatcacgttgaatttcctaaattgtaaaatcatgcgatcagtgaagcgttgcaccctctcgaggacgactctgaacaattttttttactaatcaaaaaatgatcatgatatatgatgattcgtttgaaaaagcaaacctggaagtccttgaaacgctcgcgccaattggtgtcattaacaccaatgccccatgggtcatctgccaatggaagaaatatttatagcctttgtagtatttttttaattgtaatgagaacttacaatactcgttgagatagcgaaggtcctgatacttatgtgggaaatactggacgagttggtcacgccaactgaaaatgaaaagagcggaactaaattttttaaagattatgaaactcacagctgctcgactg

SEQ ID NO: 17438 - DNA, 1566 bp, Heterodera glycines
tcatcaataactcccattcaaagttacagaaccaaactaaaaaaactgtggagaccaagatcatatccaaatgtgtaagcggcttttgtccttcttttggattctttatttgaataaatttgatttgacttataaaaaaacttaaaaatacgtaactaatttcttttaaagaattctctaaataaattctcaaaaattttgaaatctacatatgtcgaaaacttattagtttttcaaaatttaacgaagaaatttaattttttccaatattacactgaatttatgcgtaattttcttaagcacaataaaatcacaatcaatttttttttaaaaacgccttactttaacttatttaaatctgagaaatgccgtcgcgaaatttgtcagcaaagaaaaaacaacagaattcgttagttcgggatgagtcgacctcttcacccagcagaacgcccaaatcggtgtcgaaagcgagtaacagcaacagtagccaacagaaacttcagaagaagcataattcatcagaactgtccacgattagcagtgaaagtgtcgagtacgacttcttttgttttttgagaaaatacagctaatgtttagaaaggatctcagctcttcaatgtctaccaatccgcacggacatccgacggacaaaaaatggaccattggggagaaagtgttatgccgttatctgaactcggagcacatttattatgaggctaaagtgatgtttctgaaagacttgtctggcggagatgtcggctatggcattcattatccggtcattttaatttaatccattttatcgcattgaagattttagggttggagcaaccgtcacgacgaagttgtaccacaacatgaagcactaattcgcttcaagaattactccgatgaagaggcaaccaaggcaaaggttatttttcgagtattttacgatgagtgttaagaaaaacaaattttaggaagacgtgaaaagggctcagcagatgctaaatgccaaaaaaagaaagcaatcggaactgaagaaccgctcgcaagcgcatgatgaaagtagtcgctccagcacaccaggaagcgccgacaacgcatgtaagtcatttatttgtcagtgcaattaccggtgcgttgtacgtttaaaagggactctaacaaattggatatgaccattgcgtttaaattaagttaggattaagttgtcatttaatatgcacaagtaggaatttagcaaaacgtaagatcgcccgtcggacgacaattgaaacaagcgcagtggccaaaaaggacatgccccaagtcacattgaccgaccctttgcgacgcattctgatagacgacgaaaacctggtcaacaaacagttcatgttgccgaaattgcctgcacggatcaccgtcttcgaaatagttcaaaaggtctttctaataatgttttcgaataacttttgctgttcagtaccgtgagtcggtggtcggtgtgggcgaaagcggaaatggcggactgtcgccgcgtgagttttacattgagtacgcggatcgcgacaacgtgctgctgaaccctacttcagagaa

SEQ ID NO: 17439 - DNA, 1896 bp, Heterodera glycines
tgcgatttatctgtccagaaaccatttttccaaattcttagaagaaaaaaaagaaacctcgggaaattcgttgcaaatgccttccacacggaacacccatttcgcctcatttgtcgggtccgaaggatgtggaaaacgtttccacattggttttttctgtaaacaaaaaagcagttagtctaattaaaaattacaaaattgaaaaaaacatatttgatgcctcattttctccaaccaaattttggtgcgcttcatttcgattaagtttctcgtccaaaatttgtgtcaatacattaaaaacaaaagttattaatataaaaaagataatactcaaaatcagagcccatgttttaaaaaaaaaccggttatcggattcgtgaaatccaatgaccatcctcaggttcttaagtcatgtctcttttttggctctattgcagttcacacgaccacaaaataaattggcaactttaatacaacataatttttgctaggagcacccaaattaaatattcttggtatcattcgatagcattaagagtcctctattaatatgtgaaattgcaaaaaatttcgttttgttgcaaaaaagttatgatcaaaaatgtttagaaaaccaattttttgaagtcttcggccattactttcttgaaacacaacgaagttcttttaaattattacagaccaatatagaacttttagggctatcgaatgataccaagaaagtttaatttgggtgtttttagaaaaagttatgatgaattaaagtaaactgaactataggtcgcccttgggctctgaacaaaatccatgtaattttcggggactttaaacagcaaaagtggccaaaaataccaaaaagtgtgaagatgaaataattttggttctccgacatcccaaaagccccggcgaattccatcaacattcggcgacagccaaaaaataaataaacctgggactcggcgcaatttgtctgtgatggatgatgctggtgatgatgctttccgttttggtgcttttgatgcggccggtgggccggcggatttgtggaagtcgaaggcattgcagaatgcttgaaaaaggggagaacttttgaatgggccgaatttcgaacaaaaaaggataattttttttttcatttttgttcgagttcgggtttttttctgttaggcagcctgcgtcccctttggcatgtcatggtctcaacaaaactaacttttatggcgttttggccactagccacgatcaggcataaaaaaagtaataaaactaaggatttgtctcatggatataggccgaaatcgcattataggattcaaatttatttatgtgaatgtatcattttgatgctcagctaaccgaaaaccacaaggaaaaaatggggcttaagcattttcacttatagcacttatttatagcagttaaaaaaaatcgtgaaaaaaaaaattgttttgtgcttgtgtcatccagcttaaattaaaaattcttggtatcattcgatagccctaaaattcctctgttagcctgcaaaatttcagaaaatttcgtgaggtttcaaaaaagttaggtatgtctagaaaagtgcaaaaaattgattttctgtgtatttttgaccatgtgtttttgaaatcatttgtgagtttttctttaagccttcatagattaataaatttctttggggtgttttgaggcgctgagtacgaatccggcatcctttttggcgaattccagaccccgaacccgaacgtttttcgaaaattaatttttaattttttttttaaatttgaaagtgattgcctcgaatgataccaagaatatttaatttggatgcttttacaaaaagtaaaaatagcgagataccagtccgaaattccgcatttttttttttggaaattatgg

SEQ ID NO: 17440 - DNA, 1332 bp, Heterodera glycines
tttgtgtctttatccagaaaaaataaggtaaaaataagttttgagaacccaaaaaaaatttgaaacacagaaaacagactccgttaaagtatcggtaaaaaaattattccctcaaacaaaaacctgtaaaatctcggtttcggatttgaataactctaatttggctgcttttggaaaaattacgactcagaaaaacagtaacaaatcgtcccgtatcctaacacactgtcactttactttcgtccctaacctgaaacgggcaaccccgatcatttggtccgtttatatttaaattgcgttcatcagttgtcgaaattttggtaagcatttaattaaatcgaatccttaaagtgattaagaatgttagggttaatgtgtgtgtcatttgtctgggaaaccttttttaatcgggatttgttggaccgggattctgattggcaaaaatttggcatatattttgaagaattagaaccgggttacaatttctgttccaactcatcaatttttaattttatggatgaattgagattgggtgaaaatttggtgggtttagttgatcaattgggctggatgattggtgatttggtgagccttggcatttttgtcaaaaaccccaaaaaaaatttgtgccaaaaaatcaaaacgctgtgaaaatgccgaaaacacaaaaatatgttttgttgcttgtttttaaattaaagaacatcttgaaccgccgctggctgctgattggggaagaatggagttcactccaacctaacgcccccattttttttcatgcaaactcgacgaataaattcgatttttcaatttctctgccgccaaacaatgggcgaagcagcatagagaagaagcatttagcaaaacagtgtgtggcagactaatggaaagcgacagacaaaagagcgaaaacggggcgaggaagaaggtgaggatgacagagagagggaagaagcgcagttaatgtggaaaaggaacagagcatgtaggcagagaaaataagaaagaaaaatataataagagaatgataaataagaaaagcagagagtgtttattgtgaaaagaatgagtgtttaacgaacgagaaacgagacaaaaaagaaaagagatgaaagaaaggcaatgatgaaaatgaatgtgttaaagataaagaacatttaagaaaatgtagaggtagagaaaaaagcaaaatacctatgtggagagagagagaaatggaaaagagagagagtgagagagagagagagggagacaaaaagaaagaaagagagaaatgtaatgagagagaagagaaaatagagagagagagagagagaaatggagaaagaaaat

SEQ ID NO: 17441 - DNA, 988 bp, Heterodera glycines
  misc_feature (904)..(904): n is a, c, g, or t
  misc_feature (931)..(931): n is a, c, g, or t
  misc_feature (955)..(955): n is a, c, g, or t
ttcccctcggcactgccggacccccccccccccaccccccccgtctattcctcaaaaattttttttttgaaaaaagcgcgccgcaaaaaagcggtttgaaaaaccggcacgtttttctttttgttcagctcttgcgtcaacatcagcaacagttgctgcagcaacaattgcagcagcagcaacaacaacagcagcaacaaattgccaattcaaatgccgcaagcaatgccaacaccaacggcacgtcaatgtctggcacgccgaccacaaactcaaccccgaaccatgttgtacaaaacgggggaaatggcggggctgggtgccatcaacggaacaacttcaaacactggcggaaatgggggaagcaacaataacattaacggcaatggcacagcaagtaataatgcacaaggttggcacgaagatgccaaaagagggggaaaagcatggcattccatccctaagaaatttgttttttccatgttttttaggttaagggtttcagagcagaataattgcaatactgtatcctggctactggtaatggtgttgactgcaattctccccccccccagcccaaaaatcccagggacacatttatgttaattcttttaattaattagtaataaaatttgaaatttattttattaggattcacttctataggagggtactggtatttgcgaattttttgtagatgagcgttttcgtggctccgccaacagtacgccgcagtccaacgggggcacaaatgggaggccgtggcagggtcaacgagcatcagttgccaaattcggcatccccgaaatcatcaactggcgtggcggtggaccccgcaccacggaaacagtccccggcttccatcgtgaatcctatgaatgtaaaagaaaaaattattccttanattaattttttaattacccattcctanattttcaattatttttttaagtanactgatattagtacatcattatctttttatgac

SEQ ID NO: 17442 - DNA, 2322 bp, Heterodera glycines
tcacaaccgtaaacggtggggagtgcaatggcaatgtcaacggggccgaaacggtgccaacattgttgactgccactgaaatgcactacacggagacattcagccggaacaacagcaacagcagcattgccgagctgaaccaacaacagcaacaacaacagcagcagcaacggttgcaattacagcagcaacaacaacagcagcaacgtgcgagaagtgcagcgcaacagcaacaacaactgcagctgcagcagcaggcaacagagtttgaagttggcattggactgaaccagcggcgcaagagcggcgtgtacatgctaggaagtgagttgtgctgctgtttcttatattgatataatattttggaccactgatcgtacccccccccaagacccctccatacctgaattttgaatggaaaaatcgtttttttgttgaaatttccgaatttcttattggcaccttctcgaaagttctcattcacccaaatttccataaaaattgataaattattttctaaaaaacttaattagctttaaaaaaacgccgcaaaaaatggcgtacattcaccttcaatatgctaatttgtcaataagcaaatcaatcacaaatcactaagatgatcatattgattattttttattgctttttaaatcgctattgatctgtagtgatcattgtttttcctctttgttcagacatgaacggcaaggagcatcaggacatcaaacccacactgaacggcggtgttttagttggtggtgctggttcagctgctggtggtagtggtggtggcggtggtgctgctattgcgggtactgcttgccctcttcccgttgctgctgctgcaccaaatgcggcggcactctccgcctcaaacaatgctaccgcgaccgttgccgcaaccagcacaccgatgtcgaccagtgtgatgatgaacttcatgaacaacatgttgacaacggccaagtccacattgcagggccaaggcgtatctgtgttctacgaccaaaacggacttccggtagaagaaaaaaatatatgttttttataaatcgaccaattgattagaaaattaataataagttacttaaaaggaggtttatattcttggtattacggtagctctaagtgttctcaaaacgtaagaatttttaaaagtcagaaaattttaagtttgtattattaggtactgcaaaatgttctccagttgcttaatttaaaaaactgtaaacattctttgatccagaaaatattttacattaattcttctaattataacttttttttaattgacggatttataaaacaaagacaatagcatctctttgttttatgggcaaagtcctggcctcgtcctttttttcaactttccaagtccaaccttgtttggcactcgacatatggacaacatcgaagcccatcaattaaaaaatcactcagaattttttttaaattgattaattataatttgtaattcaattggttcagattgattattcttcacgcccaatcgatccgattttccgtaaggcgcgcagtgaggttacatcggtcagcagcattaacagcagtcatttgcccagtggcacactcacattggcacaaagtgtgttgttacaatatttaaaaagaaccttattttggcataagtttttatgcttcggcacaatatttttcataatgagcggccagaatactctcggtgtctgactctctttttaatgcattagcctttatccccttagccaaaacttaagcttttgaaatgtcttatactagtaagatttctaactaagctgtatatttaacatccgccttaaatgtcttgcccaattaacttttgtcacatagcgtttaaattggtgaaaatggagaggctttattatgcttttaagccataaaaatttaagttttaaattcataatctcagaattggcattcaaatttataaagtataatttctttttttttatccttgaattagcaagtatctgtacaaatgtattatccttagctctttttcggtttttagaatttagttttaggcatggcatattcctatactccctatcaaaagttcatctttctaatttaaaaattttattttatttcccccgaaacatttttaaaaattatttttaatttcctttttctttagccaatagttcgtccgcagacggcacacatccaccgttggtgtccaccagtgccagcggagacttaggcttcctcagtcgcacctgtctcatcggcatttcaaatgctagcgccggcggtgggggtggtgcagatgcccgtcgcggatcaatcagcggcaac

SEQ ID NO: 17443 - DNA, 1705 bp, Heterodera glycines
aaaaaatcagatttttaacaattttttgcggcgcatttttccaaaaaacttttgggaagtgcgaggggagggggtacggcggtgccgataggcgccgccggaaaaattttttgtaatctaattctgatttgttcacagattttcaccaaaaaaggccaattttttgcgattttgaggacattctgccataaaatttcaaaattttgaatatatttaagaaataagaacaaaataagaacaatagcccgaaataaggacaaatcttataaataaggacagatccgagccctgttttaaaccaaaaaacaactctctcatttttatgtatgtccatgaaaattatagcgatagagaacaaccgatggttttgtcattacgattttgctttccctttttgcccattgggaattttcacccaaaaattcatctggcaaaattttcgaagtcatcgattaaggctaaaagaaaggtcagcggtgtatttttcaaagaggtgcccgccattatggcctttccagctaacaaattgcttgtgtggcaacagaatgacatagcccagacttcttgttcaagcaaaccaaagtcagtttggactcatcaaaattttaattgccgttcattttgatttctttttgcaatttagcactgatcactttctccaatttgcactcgaagtgtcgccaatcaatgggaataaaaccaaaagagttttctatctgaagaggtgcgtttgctctttctgttctcgctttgttcatttttcttcttttggccaggccttacgatgaccctttctccgggtttaaaagtcggctgaggcataagatcagtgagtttctcggagtgcaggacgaattggcagtgcaaccgatttattcgggggaccaatcgccggcggaagcgattgaagacgtacggacaaacgaatgacaattccaaaaactaaacatttcattttacccgttttctttttttaaggtcagtctgttcgatttgtttttcaatgccactgaaccgtgctcgttgtcagcacttcgaattggcacgacagattacgaaattgtgcgcgattcggcttggctggataagtgagtgagcagattattacatcaatttgggtggcagcacaacccggcatttatcggtttaacatctctcagacttttaaaaatctggttacccactaccttttgaactcgacgaatacgctcacaaatagagttagtttagatttttgatcccaatccgtgattaatggctaaaattaaaccaggtaaatatttaaaaaaataattagggcgggggtaggggtagcaaaactacaaatacctataaccgttcgttggatttgggcatgccgtgggaggggttagggttggcggattgcctcactcaaattaaagccaaattaagtgtcgaaatttccctccttccactggtcggctgtccagttttaccgagctgtaattggaagtacgcgacgaccaaagtgcaattccattggtttgttgcgagtgaccatctcccgctgagaataagccgaggcaagcggcgcttggggggggggggggggagtgccgcagaaaaagccgagacttcccattgaaaatgattttcatgatcagagatggtccgtagatacctagaaacacgtcatagtcgtctataaatattgacatttctaaataatgcaaaacaattttat

SEQ ID NO: 17444 - DNA, 725 bp, Heterodera glycines
acctcagaaatgtgagtttttgattcattttccaatacccatagagcattttgtctcgctatttaccaattctttctttcccaggcggtggccattctttgacggacagagtccgtttggagccagcggactggacgcacgtacacacggggccttactattccccgacgatggacgatgccggaaaatttttggctgtcgttgttgactttgacgacgatggaattttggtgggcaccgtttgtcaaaagccaatcgaaaaattgggcagtggcaagccgaagagtgaccaggggcaggaggaggaggaggaaacgctctttgagagacgacaaaaggagtgttgtgcgaagcaaacattggggcaaaggcggccaaaccgcacggaaaaggcacccgtgggcggaatccattccagaaatgaaaaaacccaatacaaataggatatttttgtctttggcaatgatttgatatttttttcactaaatagcgcatggaatgcaaaaactagtcgttaaattatttaggaggtatacagtaaatgcctcaattagagccaaaacctaagcgtatgctcctttcttaaattttagtattcggaacatttttaaactcgttgtcagtgccttaaatagaaacgtatcaaaaccgaaatgaacgacggggcggggaaagcacccaaagtcattaattaattaatgaatatttcactatcacaatcgggc

SEQ ID NO: 17445 - DNA, 2575 bp, Heterodera glycines
caattaattattatgggagcgaaaaaagtggtaaataaaataaataaataatgacacgggtgtaaacacatttaaatcggcagcggttcaaattttccggcaaaagtaaatacaatggaacaaaaaatgtaaattatttaaaccagtttaaacaaataaaatcatcggcgtctgtaaagtaaatgaattaaaccaatggtacgaatgtttaaaatcagtggcggttcaaagtaaaatctttaaaccagtagcggctcaatacttttccggcaaataacaagttaaaccattagtgtgagtaccttcaaaccagtgacggctcaatccttttcctgcaaaagcgtaatgttttccggaaagtaaatacatttaaacaggtaatggattcaacccgttttccggcaaagtaaatacatttacaccggttatgttgtcatccttttccggcaacagtaagtacagttcaacttacaaattagtgtaaatacatttaaccagcggacgttcggaataatttaaatttaaacttacgtcaatctttggcgttttatttcatttgccgctttttgattttttgattttaaaaaaacaaagatttaaaaaatgaaatcttttttactaaaatgcattaaaattcatttaggcatctatcaattcttctccaggagtctatttctttttttgatggctgaagacgacaaagttgaagcgctcttcagacgggcagaaaagtgtgtgttgtgttttacgaaaacaatggggacgaattcctccgacgagggcttttttaaatttttttgggccctaattagcaaaagtgccactaacccttccttaaatttaatggttttttaaaagcaccgaaatttttctaaacctaaattaatatccaaataaaacaaagtttaggaccctccatctaattagcctggatattgttgtgccatgcttaaattcttcgatttctacattaactaacccccccccattttttaaatatatttttaccatttctaaccaaacattgaaacccaaatgtattttagttctaccaaagagcaacggctggaggccattcgacagcgcaatttcatcgacgccaaatttgggtaccagccgtacactgagtcgacggcacgggatgcgtggctgatcaacgtccaacaggcactattactgattggaaaatgaaattttcaacaaatttaaatgccatggcatttttggaaaatccggtttaaacgcgacaaaaatttgccgattttacatcacatgacagaggcgacgaagaatttcacaatttttgaccatttttgtttgaatgcgggttccgtaatagtcaaaatgaatgtccctttttcaaattattagcaaaaaaaaaccctaacaaaaatttcatgacaaaaaaattccatttaaaaataaatttctttaaaaaaaatttttttttccgtctaggccgagctgttcgatgagcagacaaagtccattctggcggcggttgagctgtactttttggaggaggacgggagccggtttaaggtgcttttcaaatatcatatttacaaattgagtgtggttttttaaagaaattttatgctgccaaaaattcaaaatttttaaattgggcgactaaagggcgccagctcggtttttgcagtagaacttctttcattgttgaccgaactgaatgaatttgatttcattggatagccctaagtgttctctatttgcttgcaaaatttcgaaaaatttttgttaactttcataaatgttaaaataaaaaaattacgaaaaagtctgtttttttatgttttttggccctatcttgaaagttaacgaatttttttgaaattttgcaggcaaatagagaacattaggactattgaataatattaaatgcattcaattcggtcaactatgaaaggagttataccccaaaaaccgagctggcgcccatttggtcgacgcccattcgtgcccttattacccacttggaagctgaatattattactgttaacacttacgtaccttgttcaacatttccggttctgcacgcgttcaacaaacggtagtttaattgttgcataatgaaaatatttaatctataaaaaattattttattaattattagtcttattaattaattattagtcgccaaatgaaaaataattcgtgcttaagagctgccaataagatataaatgggacatttgaagaacaaaaattacatattttctgaattatgcgtggagtaagaaacaaatattaggaaagatggtacttttccgttttgtgcctacactttaaaacttaaaaaaggaaacaaaaggacggcaaaaaatgaaaattgtgccacgttcccatatgcatcaattagcgcagcaataagtaccgccttacattttttttaattttaaaccacaaatattcctcaatttatttccttatcccaaaatccaaaatgaaatggaagcagcagcattcaaactttggcgtcgcttatgtcatttatgcctccaaaatagtgagaggtgcattttcgaacgcctttgttgcctttttaaattttgag

SEQ ID NO: 17446 - DNA, 3527 bp, Heterodera glycines
  misc_feature (11)..(11): n is a, c, g, or t
  misc_feature (1340)..(1340): n is a, c, g, or t
  misc_feature (1475)..(1475): n is a, c, g, or t
aaataatatanttagctaaaaattgaaattattatttttttaaaagcgccattttttggtcgaaaactacttgaaaattttgcatgaatttgtgccaatgaaatttaaatgaatggaaaaaaccattaataaatcagaattaattattaattaatctgctcgggtttttcgtttcatgcttagtcaagtgctcaattattaacatataaatattaccgaagaaaatggcgaagtgctaattttaattttcaaaacatttcacaaaaactctatcgacatttttttaaatttctccagccattttcgacaaataatttcaatttatcaatttatttaataaattctttaattactttttttgaataattgaaaacattgcaataaatatggaattaaagctgagaattcacacataaattatcagacgagagataaaacagagaaagacagagaaatgttgcagaatgcgcgtatcaaataaatttaaattggaaaattaaaaattgttatgtccttataacgtcatccgaaccgtggctttactactgagtccatttgccgaaggatttcgtccaaatttagccgatggattttcacatgtctaaatggtaaaattggatgaatatttacatacaatttaaaattttaaattttggaatgccgtacctccgatgtttgtgcccgattttctggtgcactcttcgccattcgtgaagacttctccgatggtgccggtaaagtcggcttccttttctgagggaatagctaaaaagtcattttcatttcatttcatattccttttttggcacctttttctccgatgcggcgctgccaaagtgaattggtcaggtgctatgagagtcagcagaagcaaagttatgacggcgaatttgaagagcaatttcaaattgaagttgccaaatgttgggccaattttcatttttaaaatctatttaatttttaaagaaaattttgccaaggctttaatgaaatagacaataatttcatggaggaatactactgactatataattttattttgaaaattgttaaattggtttacaaatgttttaaaaatgcgcgactaattagaccaattaatttgcttttttctctcttcttccaaaaattgaacatgttttatttgaaaatcatgaccagtttattgttcatttttagcctccattttgccatatttgttcggcgttaaaccgcaataaatttcacttaaaagtgaatgccgcccaccataaaaagtgtcattgtaaattggaacaaggaagggaatgaatgaatgagtgagtgactaatgataatgaatgaacgatcgaacgttttgngaaagtgtgggggtccttttttgggttttgcttctgcttgcttgcatggtgatgacaaatgataatggtcgacgaacaaatgaaagagcgaacgcaaaatgggcggacgcgcgaactttgcgcagccgtcgcccncggcggcgcttcggcttttctgctgatcagcgcgggcattcgctgatcagcagcagagaagcactcactcgccacaatgaaaaagcggcagagagctaagctaattgtgatcgcgctcctaataagtttcttctgctgcccgcctctgtcgatgtagagccgaagcgagtgaaaacagcgagacacattctcaaatcggaattatgtcaatagtttttacaaggggggggttttggggggggggggggggggagtgtcaattaaactcaattctatccgagaagaggaagagaggttttatatgatcgggttggttgggttggaggttgagaattggtgattggatgggataagatgggatatcagtgaccagtcatttggttttcattgatctgatcgggagccagacaatctgatttgatgcgggattagctttaatttactgattggattggtatatgagggaaggttcagcagatttagattggttgataataaattaaaaagagaagggacccacgagggacacgaagagaaccggcgattgtttttgttttcattccgtccacaaaagtgtcacaagttgcaggaagtgtgactgatcaaaaagcaaccggcacgttggttgtggacgaagggtgtgattagggggaaatgcttttttattgcttaagcaattattttattatttttgttattccgtttgtgtgcggtgagaagctattattgtacggatcacagatttgatggaattgcgtgccaaacggaggggggggggggagagcaaatcaagttttatctgccaatgggtgggctgaaagtgtgctgcagccagcaacagcagcacagaaaccaatccgatccgcctcctcttccgccgatggaagcgatcatccagaaaattttacgcctcggggacaatcaaggacggacgacggggagggggaggggctgatcagtttctttctcatcattagcaaatggggcggtgggaaagaagcacttaaaagcggaaaaggggcgcaatcggtgataaaatcgagaatgtgatgccagcagaagcaaaggctaagaggcaacagaaagacaaaacaaaaagcataaacaaaggaaatgctaaagtgttgcacaatttgcggaaaattaaattaatttaattaaagaaaaaaaagttattaatacttttttgaacaaatgaaaaacgtgttttgttttataattttccattttagaatgaagaaaataaagaaagtgattcatttgtgaagtgaacgtgatcggaagttggagaagggcgacggatcagtgtgattgataggtgaatttatcagtcggatttacagtaagcaattggggaacccgagcaaaaaatttgaaataaatttgcaaattttagggattgctattactcaattggcttaaatagtacaatgcatgaaaggaatttgacatttcccaatttttaacatttgtaaaatttcaaaatccaaatggagacaaacgttcagctgattaatgtccaattgaaatgtcaacagcgggcggaacattaaaaggaacgaaatgaatcacagaagaatgaatgaaataaaattataacattttattgaccaaccgaaaaagaaaaagcagttaataatcggacaaaaaaaattacttcccttacggtgccctgaattgatcacgtgtgatctgatcagtcgccggggggggggggggagaaacatgtaaaaattgaacttctattatgatcaattgaaatttcctatcagcttcgggtttgctttaaacacgctggcctatgaaaaaatggagttttatggatgtcaaattttgggacttttcttcgacgtggccatcaccgggttgtttcgtgacaaaaacaaaccagtttgatgctattcgaatgagctagacgcgctctacattttcaaatgtatcaacaaagggtctaccgccactccctggcgagacatggcctgtcaaagcagaacggagccaataaatttgaattcttgttaatcttcggcagttgcctttatattcgagcct

SEQ ID NO: 17447 - DNA, 777 bp, Heterodera glycines
  misc_feature (678)..(678): n is a, c, g, or t
  misc_feature (700)..(700): n is a, c, g, or t
  misc_feature (763)..(763): n is a, c, g, or t
tactttaatcacttaaaataccagcattgtactttgaccggtgaaattaattttttagaagtgtaaaaatcagatattatgctttaaaccccaaaaacaaactttttatttgttttgaagcctccattccttattttcagaaaatttttaacgaaatttttttaatttttggccgaaattgtccgcaaatgtccgtaaggcagtgtaatacatatgatggttattggctgactgcaaatttttaaattctttaaaagtttaaacaatttttgtgtattataattaatgaaaagtttttcggattttgtacgattttagaaaattttttgcttatatagaaaaaacttgaaattaattgatcagtatattttgagttcattaaatttaaattatttcataagaaagcaatattttacagtgttagattccccaaatatcactaaggagatcaatttttgataagtagttctattctcatttttattcccaacaaaacttttgattttgagcaagttaatttttatgactcggtttagcccattcaaaagtgttgaaattttgcagaaaaaaagaatacaaagtctctgtataataaatatttttataagtagcagttttgattaaaactgtttttgaattaattaattaggtttgattgccttctttgataatcactgngaaggtcaaagccattttttcnaatggacaaaatgcataaatttgcaaaatgaaacaatcatacgcactgcttttagcagcgaanagacacaaatttcc

SEQ ID NO: 17448 - DNA, 1528 bp, Heterodera glycines
  misc_feature (586)..(586): n is a, c, g, or t
  misc_feature (609)..(609): n is a, c, g, or t
tcaaaactagttaaaaaaccagtttaaaggacttgccatatgaatttttaagattttcctttcattttaagttgggttgggcccccgaaatgtcggggttttatgaaagccgtcaattgcacctgaaattagagatcggaccggtcgattatttttttaattactcgccgtttgatatgagcaacaagttgatggtcctcttgacccaaattcttcatccaatgctcaacgttttttattcacctgctgcgccaagcgttggcgccttagctgggcgcctggcgtgcccttcagcggccgcagctcctccggcaaacagcaaatagcggcgcgccaaacgccaatcaccggtcggcgctcacacgtcacgctcggcgtgccgatgctggtcgtcaacatgcagagatatcagagaaaaaaaaattaaaaattattttagcaaaaattttttaggtgaatcttgcgacgaagacgacgagttataggttgataatgaagaaacggaggatgagcctaattgcttttgttgtaatctatcgaacaatttctgaaaaagatttattttgaattttattaatatttttancaaaaataaaatgtattaattanttttgggtaaataatataccgtacttcttcgattatagcccccgggggctctattgttcaacccccctcaaaaggggggctttattcgagaggggggatataatcgagtggggtctattgttcaaccctttttttcaaaaatttgataaaaatgtcttctttttttttgaaaaattttacaaaaataccgaaatttttcagtgattttaatttaattcaaaacactgaaatttgttaaccgatatgcaaaagttggttaaaaagaggttttatgggttcaaatccacttgcctttaaaattttttaaaatagtttttcgtttcgagtcatggttcgaaattgggtgaaatgatgtcaaatttttgatcaacgatctaaaaagcctaaaaataattttaaaaattttttacaggcaagtggatttgaacctcggaccataaactcatttttaaccaaccgtgaaactcagtaccgttcatttaggtaatcaggcaaaggtgtagaattgaggtcccgacggaaaaaaatagtaaaatttcaaaaaacattttttctatggtaaaaaaatgtgttgatcacgaatctgaactttgattttgaaaaatcattgattttatctatgacttttcaccaatcacttggttttttcaaaattttaattttctttaagtattttttccaatgagtttagggttaaaaaatatgctgatcattaatctgaagtcagattttgcaaaatccatcattttgtctatgatttttcaccaatcagcataaaaaaataaacctcagccaagcgggctcgaacccacacccatctcatataatccttaaagggatgaataattaaatttaaaaaatcgtaaaaaaattaaaaaattatttctctttacattcaatagcgcattcgaaagctcta

SEQ ID NO: 17449 - DNA, 1012 bp, Heterodera glycines
ttgcccactgcattgcgactagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatatttacgtgtcaaagggtgtgcatttaagcgactcgctgtgcttgccactgcatt

SEQ ID NO: 17450 - DNA, 3373 bp, Heterodera glycines
tctctctccttgtctctctccttgtctctctctctctctttctctccttgtctctctccttgtctctctccttgtctctctccgtgtctctctccttgtctctctccttgtctctctccttgtctctctccttgtctctctccttgtctctctccttgtctctctccttgtctctctccttgtctctctctctctctctctctctccttgtctctctccttgtctctctccttgtctctctccttgtctctctccttgtctctctccttgtctctctctctctccttgtctctctctctccttgtctctctccttgtctctctccttgtctctctccttgtctctctccttgtctctctccttgtctctctccttgtctctctctctctctctccttgtctctctccttgtctctctccttgtctctctccttgtctctctccgtgtctctctccttgtctctctccttgtctctctccttgtctctctccttgtctctctccttgtctctctccttgtctctctccttgtctctctccttgtctctctccttgtctctctccttgtctctctatttttctctctatctctctttttctctttctcttttctccctcgccgagatttttccaaaaatttttgggaggcttggaagagtaagtcggtgtcattggtccattctgaaaattgagttttaacgaaccccccgtaattatttttgcaaaattcagtgatgatgaggaagacggtgacgaatcggaagaggatgaggaggaaggaggtgacgaattggaagaggaggagcaggaaggaggtgacgaatcggaagaggatgaggaggaaggaggtgacaaatcggaagggtccgacatggacatcgatgaattgtccgagggaatggaaatgtaattttctcaatttgtaattatttggtcctgttttcttgaagatgaagacgtatattgtggaacaaccttttcatgtaacattgtcaacaaatttttattaaagaaaaaacaaaatcaacaaaattcccaaagggctgatcaatgagtgatcgatcacttctcattcaatgagtgatcacttctcattctcatcaattcattcatttttgctgaccaattgagcagcgaattgcgaaaggaaagctgaaaaggaaaaatattttctcaaaattagttaaaaggctgttcgagagtctcgcttttggaggtggtcaattccaacaggtgttggttctcgaaactctgccaaatttcgctcactctcgaacagtttgaacaattacgactcccacaatttcactgacccttttcggcgttatcatcgttttcccaaatggtaattagatttcgtggaagaacatattgcccttcaatcgccgccgaaatccatttgatccatttcttctcgtcgcgcgcaattggagaacggacaagcaaaaattgactgaaactcttttggggttttaacaactctgctgatttatcaaattttttgctttttgaagtgtcaaaactggatttaattttttgtttttgtaaatctcaaaatggccaattttatgtaaaattgctacacaaaactcccaagttttcaaatttatggcgatttgttgatttttctatgtcattttctcttacaaaatgaatggggggggggagagggcggggctcgacttccctcacccctcaattcgcccgcactttcgtcttggcatcgccggccccaaaaattgtttaaattttcaaattttgaaatgttgattttgaaattttcagttggctaccctggttttaatgttctaaatcttagtcgttccgccgttaaatgatttgtcaaagcgaagtccgccattgagcgattgcggtaagaaatgagaggccggcgtttgaaaaggacgatgaaattggcacgaggagaagtgccattcacaaatgcctaaacaaaggggccaatcaatcgatggttagcaaacggtacattttttgagcctaccgtacactcgcctaaatattcaaaaggtgccaatgtggtaacaacctttttgccgatctatcgtaccgcctaactctaccatatccccattactagaaaatgtttttgagtctttggatctaccgtacccatccccagaaatgttaaactacaaacagcacaaatttaaaaccaaaattgaccatcaccgttttgtattgttcaattctcgcaatccaactctcaatatcagagttatagacacggcatcgcaacactttgggcggcaaatcattctccggacgagaggagaacaaccatttggtcaaagcttcgcttccgttccacggcacattggcattggcattataattaccattatcattggcactttcaaaggctggcggcaattttggcaattcgcccatataaaaggccactgattggagtggcattttccgcgaacttttgtcatcgtcgacgctgagaatgtggcggagaatggacggggcatatttttccagacggcgaaaaccttctgtttggcaaaaaataatgccacaaatgttttgtcggatcattggccaaatgaaacgttcaatggattttaaattgcggccaatttttgttctaatgctcagatttattgcgcaagaggcgaaaaggcgtcgaaaacgttggagaaaagtgatcacatcattgtcaatgtaactaaaattgaggggagggaaaatttggttgaattttcgatttttatctttttatcccaactaaaatcattggcattttttaaattgagaaatgtttgggcttatttctaaatttataaaaaaccttaacctattaattatttgaaaatcgttaagctaaaaatcatttggttatcatttaacttttagtgagtttttgtttcattttttaatttttaaaagatgattgagggacatacattttagcaatcgcataattcatttggttataaaacattaaatatttattataattatttaactctttctgccctttcgaaataattttattttggtcctcggattttattagcatttctcatttctggtaaagaccggcggacaggatcgaaatctcgagggattgtaatattattctcattaatttatcctattttaccgtattgatattctggagaagtcaacgactttgtccggcaacggaatgcgcggaattggcacaatcggtgccacttttcgattgtgatttttaattcgcatttccttcgtgccattctcgccaattttgcttttaatgcgaaaaaatttcaatgcccaacgacgcgttttgaagtgttcgtccaccatgcggtcaaagcgcgggcagagcagtgcgatttcaaggccaagtgacgcggcggcag

SEQ ID NO: 17451 - DNA, 1279 bp, Heterodera glycines
atttcggcaccctcaaaagggcacggagaaatggaggggcggcaagccgctgccttctttttgtccacctttgctgtgcagcgtcagttcgtccaattcctgcgacgccattggcatgccatcttctgcgatggcaatgcgcggactcagcgccagccaatccatgcgctgcagcgggtcataacggcgcgcgtgccgctcgcgtcgctttcgcttcagaatgggtgctgctgcggtcagtgctagtgcagcggaagacgaagcagtgtcgccgcgcaagcgctgctgaaggtgcgagtcggcgccggggacagccgctgccgcatgcgcttcggccatcaacaggctgcgccgacggcgatagtaccagatgggttggcaccgaaagcggtgaatgaacgaaggagcttttggggcctgaaaagcctatggcataagagggagtgccgagttagaaagtgatacgaaaagcattaaaaaatgagaaaagactttgagcaggaccatttgaggaaaaaaaagacgaagagtaagaccaagttacagtattctcatttaaaaattagagaagggagaaagcacagtatcccatccgatcagaatggggatgagagttacggtaggcatttaaaatatttctgcaatttacgacctgcttaacagcatctgctgccggccgcagaagcttgtaccgaagctgttgctgctcaaccggttccgcctcgtggatcagttcgagcgcgtggtgccgtcgttggtgctgtgccgcttccgcgtcggcgctgttccgcctgctgttttcgcacttctgcggaccctttggccgccgcgccccaccgtgcggacatttgcctaattgggccgggccccgtggggagggtgaggaggaggacgaaatcttgcgggacaacgactcaagcaaaggcacaatcacaaaacgcgggcgcgcgaagcgcaacagttcggcaagcgcatgggacggacacgcgagcgtacgccacttgcgacgcggcggcggcgacgccaatgcgcttactgaggcgaacgggagaagcggacagctggccaagcggcggtccaaacgcgccgcctccgctgaaaggggacaaagtgaggaagcgggacagaagcggacaattgaattttattaagataattttatatttttaacaattagactactaaaatgacaaatttggaaactaattaaaaatcatttaaaaaaatttttggatttttattttaaattttgaaaataaaaatgaatattttaaatgaa

SEQ ID NO: 17452 - DNA, 943 bp, Heterodera glycines
ctgttggcaccatttcctgctgctccgatctgagcgatattttctcattctccgtttgctcccgcgcgtgcgcctggttggccaaatggaacgcgggttgcgccaacccgcggggctgatgcgaggggaacaacgctctgtggcagagcgtcaatttagaaaatatatttggacagattcaaatagaaatccttcctctccgatcactcagaaaagatcactccctcagtgatcggggtcctgctgactcattcaattttcgtgaaatttgctaattgccaaattgatcgttaatttacctaaaaatcgcattttatgccctcctcccccgcccattcgttcaattaatgaccctcccccccccccaactcactccctctcctgtttgatcacatattcgatcagctctttgccctcgcccatcgcaaatcgccgttccaacattcgctttcggcgcaaaatttgcaaaatgtcagtgcctttgaatttgcgcccaaagtaatggattctgatcagagagacaggcaaaacatagtgattaaaattgggaggaggagagaattgtcacttttggatgtattggatgccgacgagatcaatgcacattgtggtgacggcgaggccaacgcccaaataaatgagcatcagagcaatgtatctgacaatgagcagaaaagggggaaaataatagcggagaaacacgaaaaaacaaaaataaaataaaattgtaaatttaaataaaaataaataaaaaataaaattaattgtaaattaaacatttcaagagatgaaatgccgataaagtacgacgagcaaaatagaacaataaaaacagtggccatattttaaataatcatttgtcatgaaaaaaagaaacaaaattatatataaaagagttgcaataaactgtaagaaatttcacctaattatacaaaatacaatt

SEQ ID NO: 17453 - DNA, 1720 bp, Heterodera glycines
aaaaatgagatattaaaaataatttttaaaataatacttactgattttaagccaatttagataattttaaggcattttgtgcctgtttctccctttattaggaatttttttccaaaaaaaaccattaaaaaaaaatttatttacatattttgggttttttgtacatttttcttacatattttaacattttttatacatattttatttacatacatatttcgcgatttatcttacataaaaaaacaatccctaattattactttaactcgtcggggatcataccatagaattttacctaccgatgttttcggttgagaatttatccttaggttatttataggacccggatttatattggcaaaaaaaaaaacacacaccaaaaatatagattataatatagcgaaaaaacgaaaaatatagacaaaaagctgaaatgccaggtcccggtcgcgtatggacaataaatttatgaaaattgtcttgaatttttgaaaaactcgaacacccgtaaattttttgtcattttgtcagcaatgaagaataatttttgatacatgaattataggacattagagtttattatttgcaaaattagatatttttactcgaatttcggtcataaatttttgtttttcacaattatggtatttttccaattttttcggttttaatggcatgttttcaaaaattttttctttctttaggggtatatttttcgaatcaaatttttcataagaatctgtgggtctctgtacttgattctttcctgtccgggctcttattattaatcacatttttttgttttctcaccccaaactttcaagtcccattaattagtgttaatgagattaataattaaaattctttcttcacctccatcttcagcaacaaagcctgttcaaaagccacaaaaacatttggcaacttttgaattgaaacattggcacattcttttaccaggccagtgatgttatatttgtctgctataattaaaattccaatttatttaaaattcaattaataaattttcaccagcttttaaaacttccaacaaattattggcattcaatccgttaaaacgcttcgtgtaagcaaatgttagcatcactttgaacgcaccaatttcaatgtcggggacctcaatttgaccttcatcgtaatggaacattgcttcaaatacatcggaagcactggagagaattgctctatgagctgttacaatcttaaaaaaggtcaaaaaattcaatttaaaaggctgacggaaaaatttagagaattaaagtaatttttcctacaaataaataatgataatatgttaggactcgggtgggaatcgaacccaccctaaatcccaatccgtgggcatccgaccattgagctaccgaggcatatttattggtcttatcaacattgaaattttgatcttatattgatcattaaactatattcaaaatttatatgcattcgcttatagattttgcagaaaatttttcgagaatttacaagatttccataaaaatatgttctaaaaatgtaattgtttatccttgggcattaagatatggtttttgctttttttgactcgcctcctttttgtcatccttcccaaccaaaaaatgaacatccgaatattctcctttcttcaacactttctccatttgatctgccaaagaattgaaaaggttccattactggtgccttaaatttgaaatttattaag

SEQ ID NO: 17454 - DNA, 1857 bp, Heterodera glycines
atcagttctgaagaactttaacacaccttatttatttaaatataaaagctaattcttttcaattttttttgaaacaaaacatattactcacatacttctgtctaagccctgcggagctaattaatgaataataaaaactggagaaattgataactcaaaggcgaatgttcaaaaattatgaatttaaaaaaaaattaattaaataaatgaaggaatatatgaatcccgtggaatttaagtttttggatcagggacgatccgctgatatgaaggggaggtataatcatacggtcacgcttggtcatttgctgtggtctggaacttggattcaacaccccgaaatatactaaaaatctaatttcatcgattggaagcgaaacaaataattgtttaatttatatattttttttaacttcatcgcaaactttcttgggcccatatctctaaaatcaataatcaattaattcaaatccaatcgactcagaatttcaaaggggcgtggtcaaacgaaaaataaatgttttattagacaaaaataggcggttgtgcctcggtaatctcaatgttagaggttccacggattggttggaggaatgagccgtttacaccagagacctaacattttccaattcttattttaattaattaaatttaaaaaaatatagtcttttgtttaggctcaactcaaaaaaagtagtcttctcaaaataaaatgaaaaaaaagtctgagtacttcgtgaaatcttgaaattaagggacggtcttttggagggtcggaggtgtaaggcattgaccggaaatggcattttcccacgcccatttattactccgataaactcctcccattccgaagggcgcttaaaaggcaatggagagccagccaacgggatcagtcgagtcagtcgggagccacctaagagacttggccaatcgatccccgcctgggagacgtccccaggcatctatcatcatccattcccttccaagccctaaggggtctaattacggacgcgtaagaaggtctcctggaattaattcccctattagcactgggtaatgggaccaaaggtatatttcattctgtaaccttaaattagaaatttaaaaaaaatgtttgttggtcatagagcccggaattttgaaaaaaatcgggatttgggattggcagaaggccgtaataggattccgtgatgaataccccggttttgctcggattccaatcccgattttgccatggtcccgatccgggagtcttttagtgctgggattccagcgggatatctcactattttttcgaatttagcctgagtatttttttggtcaattaggtttttgtgtataaaaacagaatcattaatttaaaaagcgacggacttaactcatcaatgttagattgggttttacataaaatttacctagcaaatttatttaatttaaaaattgaaaaaaaattaatgttaactgtaaagaatttaatgaacttttttgtttaaccatcaaatgaattaaatgaaaagtattcaatggaaatggccaaaatgagtgaagtttgctttttttattagccaaagaatttaaaacgccataattattgtcaccccccccccaaattagaagcccctgaaaaggagcccctttggagaggaactaaaaaacagcagaagcccagggggtattttaggaaataccgtatatgtaaattttaattaaaataatttattaattaaggcttcttcacgtcgcctccaattgttattttcaatctggaaattgagtgaatgatagtcagcataaacaaatgcgcttataaaggctgaactgggggagtgtattttgtattttatgcataaaaatgat

SEQ ID NO: 17455 - DNA, 1932 bp, Heterodera glycines
ctcaacaggaatggaaaatgtaacgaaacacaacccaccgccaccgcaccactcccaacacagccgaggaatgagtggggggggggggggtgacgcgagtgggctcggggggaaaatgaacacaaaatcaaacgaaacgaccaaacaaatcgtggccattggttcacaaaaaacaaaaccaaaaatcacttcattatcattgtcatcttcaccatattcatttaaatgttgtttgtttgctccgcttttcattcattcattataatttccaattgcatttttcactaaattttgtcaaaacgtttgagtgcaaaacgaaccttttcccctccttccaattaaattgcttttgttttacatgtaattatcaacataatcatcagaatcatcagcacattccccgcgggggaggggcggcagaagaacagaggccaatgagcaaaaagtccctccgcccactctcgtcacttttcgctatgcactcacgatttcattctccgcccccctccctccaaacgttttccatttttaaacgcttcataatttttggattgaatttaaatttattaaaaagcaatttaaaaatttcagtgagcttttccatccctacaaattaaattatataaattttattcctcgcgaaacatttggcaaagtctttcaacgcgaaaaccgacaaaaaaacgacctcagaggccatcaaaaacgacaacaataacagggtgaagcttatccatttaaacgcatcgccataagcagaaaatgttctctttgggcgaaccgcccgcggcaactgtctcctcttcgccagcgacagcggtgcggcatcaccaccaccatcaccagccgcatcagcagcaacacaaccactcgcaacagcagcagcaccaattcggctccccgtcgccggcaatgcctccggcatcgttggccgatttggcgtccacggccagctcgctgctgtacgcgttgcagtcgtcccagtccagcgcggtgatggcggccaacacaattttggtaagaatggccgaataaattgcaatgatatggtggttccttaaccatggcttggcatatcgccattttgattaatgtttaatgattattgttgatgcttttagcaaaatttcgtcagcggtgtgcagccttcgctggtgtcggcgctgaacaacagctcccccgccctaaacgttcatcaccacaaagttgaacccgctgaacaccaatcacagcaacaacaacaacagcagcaccagtccgtttttgttacaactgccgctaccgtaccacccccggctacagtcaacaccgtgtcgccaacggtttccaccgcggtgccgcctttcccgatggccagcaagtcgctgtccccgtcctcctcttcgcgttccgtcacaccgacggtctcgggcccaacgagcgcgggaccgttgcatcaccaccatctgatgagcagcaacagatccgaaagctgtttggaacagtttgggcaacagcacagcaaacacttccaagcaatgcacggcggacaatcgcagggaaaaggggaaacgattggccaattggagagcaatatttggtgagtggggagccaatcaatgagaagggccaatccaacggcacaatcaggccgagtttgccaaacattccaattgatccaaagcttccaaattttactgggaatgcgattgatcaacagagtcatgtgactgattacaaattttgcaaattcttctctcttttgtcctccattccatcattcgttcgccccctccccgctaattaatatttaatgtgtttatcaaatgtaatttttgccctctggcacatccttttttggaatgtatgcaccgaccgaccgaccgaccgacccattcattccttttcccctctcccctctttctcctgcgactgatcactcccgatcgcgtc

SEQ ID NO: 17456 - DNA, 817 bp, Heterodera glycines
ttggccctcccctcccccccccccaccctatcattattcctcagatttattttgataatccccgtgcggatttgccacattgactggatggctatatgtgaccttagcttgcacatctcttcagcgttacatctctcgataggtcatctctatgaaaaccgaacttgtatattgaatggaaaacaatcacgaaaaacatcattgaccattgaaagaggaaggaatggtgaacacatatcaacaatactgctgtactggctatttgttgggcttaatgcccgggtaaacaccgaacgccaaaaacaaaatgtaaacatttggtaaacattttttccaatttctcgtaggctttgaccttgaacattgaatttcattcacgtcatttatgctcatcggtcaaacaaaaccaatttttcttccttttgccctgcggcgctttttgcgtcaatcgccgcggggggcggggtatcagcagctgtggcgaagcaattgggccaaattttgacgaatgtcccccgggggcatagggcaaagggagcgaagatggtcccgttttagaacgaagaacaaaacaattgttggccttgtgcccatcaaaaaaaatagagaggaggcacacaaacagcgacaaaagggtaaaaataaaaacacaccccggggggaaatgaaaaatgcggggaatgataaattgacacgacgaacggacgtgtgatgatgatgatgatgatgatgatatgatagggaggaagaagaagaccaaactaaaggggaattatgaaaggaaaaacaaagcagaggacagattatgaagggaaca

SEQ ID NO: 17457 - DNA, 852 bp, Heterodera glycines
ctccaagcaaacacaaaacacagcccaatgccgaagacactttatcgtttaattccaaattaaatagtcgacgacaatcaatagaactgacgaaagcaaaaactaacaacaatctaactattatcacccaaaatcacaaacaaaaatggcataaaattaaaacaacagaacgcaaacatattttaaatcactatattatcacagtattcaaataaaatttgggtgctaacattggacattttgaattttaaattttaattatttatgctttttcttgtttttctataatttttcattcattttattgaaataaaacaatattcaaaaaatttagagatcagatacaacgaaagatggaaagaatgaatttaaaagaaatgcaaaaaaggctaattaggcattttggcatacttaaaacaaaaattgggtgccagcattggcattttaattttaaaaatggtccttttctctctctctatctcttattgctttcatcaatttctctgctggcattggtcttcttcgctgcttctgtttggtgccgtggaattttgcgcaaattttgttggcattggcacggcatttggtactgaatcgtccgatggtggcgattgtgccaatgccggtgattgtgccgaaggctcgtgttgttgaaaatgggcgaacaaagcaatgaaacggtgcaaacagtaggccaccgacaaatgaatgttcaatagccataactgatcagaagtaaaaagtgatcagagaatttgcaaaaattaaaattaattgattttacaattaaaaaaattggcataaaatgggccaaaaatttaatctacgctatgttctgatcagaaaatgatc

SEQ ID NO: 17458 - DNA, 2100 bp, Heterodera glycines
  misc_feature (1939)..(1939): n is a, c, g, or t
aaaaataaaaggaatttttggtcggttttttttgcaattaaagaaaatcaattgattaattggggtaattaatgaattaaatgcccgtgaaattgttcgcttccctccgctcaaggtcaagcaagaaaattatttcactaattaataaacacattcagaatattttagtgtctgatcaatgaatggcacggaatttcttttaatgatttaagcacgaggccccaaaaagttcaaatttagaaaatttttgaacttcgatttcaacaagatttagtgatttcttgggcaaaaagtgtgccgtttgcccgattatttccttattttcggcacctgctcatcattttctgcccgttcaactgtttcaatgccatgcgttcgcacttcccacagttcgtcctccaattgaaagtgccgaattgtccgttccgttgttggcattgcaatggcacggcgccgaattcgatggattggcacatcaaattgatccggcaaagctcctcaaattattggaaaaggccatataattatcggtctttttgtcttgaatcacgggcagcaattttttggcctctattcttggtaccaatccagtaagtcttggcactaattgtctgcttaaattcagagtcttggtacaattattgacttttttttttacgatttttggcaccaattttcggcctaaatcccgagttttggtccaattattgaattttttacaaattttggcaccaattttcggcttgagtctcggtaccaattttcagcattggagtctgagtcttggatctatttttaaattctcgagtcttggtgccaatcctcattttgatcagctcttttctgcctcatggatgcaaaattggcaccgttttcgttttccgttggttttggcacattgttggcatcagcatttatggcttcttcatcttcctcttcggcacggtcataattaagcggctcttcatccgcttccatttctaccgcccgttgctgctgtccgccaatgtccgtgccaatgtaaaagtgccgattacagtctaagcgacaaccgaattggcaccgtttgacgacggcttggtacgcgacacggacctgtgccattttgaaaatcattaggcacgtgcactgtaccagatctgatcaaaaacaattgttcattcaaatcatgggattgatcagtgagtgatcgatcagagatttccctagtggatcaggtcttcagcagagtctatcaaattagagattgctgaacaaagtaatcattttgattgtctcgtcatcatcagtgatcatagataatgattttgatgccattgtatcagttggttagtgatcggtttattcgtttctgatcaatgatcaatgatctattatttatctgttttgatcagcaataatgatcaaaatgaagcttaaaccttgtcgccaaatgggacgaatcggatgccaatgcgaagccgattcgggcccatttgctggatggaagtcaccatggacaaatttgtgacacacctgcagagaaaccggataataattggtaaaacgtcaatcggagcaatgcgaaaaaggcacgaagaaatctcattaaaaaaaaattaaaaaccttaattgtgaaataatgaaaaattaaaaaaagaactaacgcaaaagctttaggtgttaatgtaaatttcgtttttacttttttacatcaattttttatgttttccgttgaaacttttgccgtccccttaattgttttttctaggcgtcacccctcctcattttttcttgtttctattgtaaaaaactaaaatttctttccttggaattttttgaaaataaattttaaaatatggaggatggcttatggaatatgtgcccttaccctcccgagtcccaggtttttcgataaaattgccccacccattggcatcgatcagtgccaccgaattgntcgcctcctcattttcggaattgatcgctttcaggtcgctgatcagcagtgatccgtcctcatcatcaccatcattagcataattgtgcgggaaagtgcggcggtggcggcgccgaatctccaaaagccgggcatgcccagctctacctttgcaccggcat

SEQ ID NO: 17459 - DNA, 2967 bp, Heterodera glycines
ggaccttggtactcagttgtccgtgtccaggtcccggtcccgacctaccctaatttatagcaatatgtaaataaaaaaaaatttcgataaaaattcttggaaaggaatgaataagaacaatcattaccaaaaaatgacctaattaggcttagaaaaacgttttttagttatttgaaaaaaaattaatatttagaaaatcattttagggtctcaaggaaaatcgaaaaattctcaaaaaatcttaaaaatatgtacaaataatagttccaatttttgttaaaaaaaattacacattaaaaaacaaatgtttttctattatttatgtagagcaagaaatcccccccccccccaaaaaaaaatgtttacaggaaatttccaacctaattaattaattaattaccttcccaggtccatcaacgttccgtgcacaatttgttgggtctgtccgcccgcccctggtggactgttgagcaaagcgaatgtgccaaacagctcaaaaccatggaacgtcaatggaccgcgatcagaggtgggaccaaactccggagattaattcaggatcagcagaggataagattggataattcggcacggatcggatctcaggattaaaatgcctgttttaggattcctgctgatccgagtcaattttacaaaataccgtatttactgaaatagaacccctctcccccctgtaataaagcccctccaccgaggggggttgaaaaacaaagttccccccctgaaataaagtcacttttttttgaaattttaaatttctaaaatttgaattttttaaaattttattttagaagaagcattgaaagtgtggagcaaaaggaaaagcctctttgttgaagaagccctaccaataggcagcagtggaatgatgggaggaggtgaattggcactcgttttgagaagcaatgccatcggcggattcagagaagaggtaaagagagaaaaatgtcaaaatttaaaattgctaaattaaattaatttaattaataaaggttaaaattatatttttaaatagaattttgaaaattatattttttttgtatggaaaattattttttaagtattaaatttattaaaaggtttacgactgaaaaaatgctattttatttaaattaaaaattgttaaattttttattaattttaaatatagttttcaaattaatgaaaaaaaaaattcattaaagatttgcgaccgattgatgcagtcaacatgtgaactgcttaagcaatttgaaacagcaagctgtgccaaggacaaggtgaaaaatttaaaaataataaatcagaatttaagaaaaggattcgaattaaaaagtttaaaataattttaaaaacgaaatttaaaagggaataaaattacaaagtttttttttaaaaatgaaattaattccaaagggtccgaattaaaatatgaaataatttattaaattgaaatttaaaaggggtccgaattaaaatttcaaaataatttaaaaaatgaacactctcagataaaattgtccgttttgttggccggcacgcgaacttggcccttttgtgggcccaccaattatgtgctggaggcacagcttggcctggtggcacattcggatgcacgaattcgggtgggcaacgagacaaggtccacccacaaaagttttttgaggaatttaaccaaaaatttttttttaattttttaggggttggcgcccgggccgattcctcgtgttcgacacgagttttgagcgggaaatcagcttcgaaggggtgggctgaaaaaaaaacgtttttttaaatttaaattttatggaattcccaggccccctccaacgcaatacgactcgcgctgaccatggaactgtggcacccgcaaatgccaatggaattgcgcggcaaaatccgtgccgccgatggcagtgatgaagagagaaaatgaaaaacaaaacaattttttttaaatattgttgttgggaagatctcatccggattagaggagagttggatgggcagacagaaatttcgttgattttttttttcaaaaataattaaaatgagtacaatttggtatttattcaaatatggatttttgaaaaatatgtatgtgttatttctattcaagatagatccaatccgatatgctcgtcctccgggtccgcaatgtattggtgattgggcagggtggacaaccattgcatcatgcttggaaaaaaaaattacaaaatttttggatagaaaaaccgcaaaaattggtacctttttggaaaaaaaaaatctatagcaatttttttttcttcaaaatttcataagtttaccaaaaaaattttccaaaaatttttgaaaagatttcattacaatttatttattgcaattaaatctgcggtttgttttttgcaattcgccttacgattgtgtttcgcattcctcgcgcaaaattcgctgtacaatcagccgatcacgagcatcgagcaccgccgcttcaatctaattaaaaacattttttttagaataaaaaacaaaaataattggcacaaaatcaaaaaaaaaaattaaaaattcacttcctccccccaatcgtttattgagccatgcgaacgcccaaacttcttttcataacgattaaaatgcactttctctgaaagaaataaggggttaattgacgtacgtgtataaattttttttgaaattttcaagaatttttttttttgaaaattttgttggaaaaatttttattttagaatttttctttttattataaaacttggttttcattcaaaaaacatcatcacctaacagaagaccgaggccaggagcgcgagggatatccaactgaaaaattaaattttttttttttttttagatttttgagattttttttcgataagctaattaccctgtttcgttgaaatgaacgggtgatgtcacttttgtacatgaaaccacggagcacacaaatgacagcacctgaac

SEQ ID NO: 17460 - DNA, 479 bp, Heterodera glycines
agagcgagagaaagagagagagagagaaagagagagagagagaaagagagagagagagaggagagagagagaaagatagagaggggagagagagagaggagagagagaaagagagagagagagaggagagagagagaggagagagaaaaaagagacaaaggtgggagagcaagagaaatacagggagagaatgctagacaaaatagagaggaatttagaaaaggaaaagggagagaaaaaagagtgggggggaggagaaagaggagaataatataatatgctagacaaagagaggagaatagaaaaagaaaagagataaggtggaaaaatgaaagaaaaagataaagaggacgagggaggaaagaaaaacaaaaaaagttaagtgagagaaaaaataaaaacgtttttcttactgtccgtctgacgccaaacacgcgaatacggccggcaacaaatcgttcaacaacgcgggaccgtcg

SEQ ID NO: 17461 - DNA, 2112 bp, Heterodera glycines
tttaatttttttaaaagagaaaatgagtcaacctttacgtttaatttcgttttttatttaaattattgttttgctgtccttttatgttttgcccgcctttttcctcgtaattggtcgactccccgtaattaggccctgctttcggcactttgttacaatgtagtaaatgttgtgaacattcagctgacgcgcaatgtccgcctgtgaaagtccgctctccatcagtttgacaacggtgtccaagtcaacttctggctaaaaaagtgccaaattaaaaaaggcaataaaaaaaatttttttttttttttgcctttttctcttttggaggaaccgattcggcacgtttttgctgttcagattccttttgtgtgctcaacaccaatgaaaaattgtgaggcggcacttctttttgatcaacagtttcttcatcgtcttgaaacttaaaaaaacctttttaattagttaaataattaattaataagtttaaattgtttattaccctcgtttttgtcatacgcattttgcgtttcggttgtttgacagatagaatttgaatagaatcatcggcattatcttcacccttaataagtttaataattaattgtaatacaaaaaataaggcaaaattataaatttgatttctaaataattaaataaaaagataaaataaattagaaaagcaaaaatttttctgttttaaccttgattatttttggttgagcagattcaactccgttgtgttcgatttcatcaatttgcgccttaaaaatatcaatttatttgaaaaaaggcacagttaaaattttaatatattaatgacaatgccaaaagtgattttcgtggtattagcaaatattatttgcaaaaagtataaatacctaaagtctaatctctatttatattttttttatacatactttttgacacaaaaatcaaaaaataaataaaacaatttaatttacctcaaaatcttcggctttttcaataatttgttttttgactggcaaaggcaactggtgcagcaccgtttctttctgttccatttcttcatttgagcacttaaattaaatgacactaagtaaatggccttttttcatttttttttcaatttttgatttaacagttgaggaggggcgggggatatataagtaatatactgtaatggaataattagtgtcaacaaattcgcgctaccttaataacggagttcatttttgattttgtcccaattgaagccgtcggtgaatttttccgctttttcttagtgctttttacaacaatagcaggcgcgaaaaagtgccaaacatttttggcattcatggccaataaaattgtaatgatgccgacaatgagaagcaccaaagaattgcgaacggtgtccaaaaatgccttttcgtcggccatttgtttcattttttgaatttgctcctaaaattgtgattttaaatgcaaaaaactaataaataacttacatttgtcaccacaacgtgcgaattcatttcagcattttcatcaaaaaggcattgcaaattgacggaggcgtctcgtaagaattttgccagttttgactgatcatccggctaaaatttttgttaattaattattcggtaactttagcaaattgttatatgatacaggcttccttaaaattctgaaaatgtggccagagatgttatcactaataaacattttgtctacattttcggctttgggtaaaaatgccattttgtttagaaaccggtaagatttttttgggagcgggagtatgggatttgtgggagcggagtacgggatttgcgggagctggatcaagaatcccgaaatctctgaaatttcaacgagggttggggtaacccaaaaattaatcttaaatatattattgctcaatttcaaagtcccttttatatctcaatctgttctctatacatttattttcaacatttggatcagctttgcaaattgatgagataaaaaatttgttgaaatttttgaaaaaataaaataaaattcttattcagaccctttcaaattcaacaaaataaggagaaaattcagatctgtgaactttaagaagatgaaaagatttcatgtttaccttatctgataccgatt

SEQ ID NO: 17462 - DNA, 1251 bp, Heterodera glycines
cttttcgagaccgggtcagtggtttcggccaggggtgggaaatcttttccatttttgtgcacttttggatttttctcccagcctcaatgattaatttattatatacaaaataagttcacctgcaaaagagcgccttcgcaaaataaaattgtgttcaaaataatggaaatgaggatcattttggagtttttggaggatatcattgggccgactaaattttaagaatcgtaaaatttaaatagattatattaaaaatatttgtttgatttagaagaaaataataataatattgtaaattcaattccaacgaaatgaccttttgactgagaatctttattttatgatagattattggaaaagacctttaattttattaattctttgtgagaaaaggcaaaattctgacctattttttcagatggtgattgcctttggatgagttatttgaaatttttattcaattatatgcatatgagcaattagtattcaaaaagatttataaaaatattaattaatagggcttccttttttaggcaaatgcctaaaatttttgcgcacttgatacgcatagataagcacgaaaaacgcgttttccgcttggtttgaggtgtctacgatgacttttataatgcctatttttgcctatttcggggtttttgtgcctaaagtgcctattttaggctttttgaaaaaagccataagaaaaatgcaataaaaacgaaaaacacacccctaagaaaaaaatttgttcatattcgaaaaaaactttaaaatattttatcagtgctgaaatttaatttaaatttcatgccgttcgttttttctttttttttgccttggttccacaactctcgacattagtcccaaaccgacctcattacaaaagtcggtaaattggcgtttttctgcgaacgtctcgcactcgcccacgccgacgatggtcttttcctgaagtaacaattaaaaatcccaaaaatttaaatttttttctaaattttgctggacgggatcccgcgggattatccctaaaagtcctgcgcagggctttacccagcataagcttcctcccgtgactgtctcgggttggctggccgacccctcccaaagcatggaaacattaagcacctgctgctactgattgcgttgcggcaaacagttgcgtcgcgccgccacttggttgcccgcctcttccggcggcggatggttgtgcgactgaaaggctaacatcactcgcctcttcgccacatacac

SEQ ID NO: 17463 - DNA, 3239 bp, Heterodera glycines
  misc_feature (108)..(108): n is a, c, g, or t
  misc_feature (301)..(301): n is a, c, g, or t
  misc_feature (306)..(306): n is a, c, g, or t
gtgcccacaggggtcgccttggaaattttggtttatgtgcgttttattaacagattttgagtattttaaagttgtactagcttcaattaagcaaagatatattatganagccaatatgttccatatttattagacaaaattaaaatgtttcaaccttttttaaaaaagttaagcggcgccaaaactgcaatttaaaaaaatcatttttttgatttttggcaataacatgtttgtacccgaactaaaagttttgaaattttaaaataatagagctatcaagagtacatcatatcaatttatntaatntaagcattcagagttaatttggcaaaaacaaagtttatttgataaaaaaataaagttttgtccaagtttctgaaaagtaaaatttataataataattattatttttattttctgcatttttttggctgaaaaaagaatttgcttaaaattgctgtcaggaaatttggataatgattttgttttaattagtgcttactcaccatactttgttaattagtgcgtgtaatcatcaaatataattcacatgaaaaacacattaattaacaaaaaaatgaatatgcttaagtaattcaacgaaattttattcgcctattaaatcattttttataattttttcttcaacaaacgtaaatataatcacacaacggaaccagtccatcaattaattacgatgtaaaacataaaaatagaagaagaaaatgcagtaattagcatttaattcatatgaaaggcatgcccattaattaacggaaaatgactatttaaattaggcgtaaaaattcaatttcttataattaatgacgaaatgtaaccatcaattagtcttttttcctgtttggaagcattacagaataatatcaaaaaaaattccattggctttaattttgttttgtcttagtgccaaagtcagccaaggtctttatttatgtaaagaattttcaaaaaaacgaatactttttgtcacgattctcgaaaacaaagtcccaaatctcgagaccgaattagtccaattacaggataaatttaatattttaaattatttgattcatttagaaagaaaaaagttatcatctataaaactgataatggtactaattattattctcatatttttcgccacttttaatggaatttttggggttggagaaggtggtgaagaaaacgatttgttcagtgatttgtggaagaattatttcaacgcaaaaaacgtgcagaaggcaaatgttggccgaaacggaggacaaaaagtgaccaatcgcgtaaagatggaagaaagggacggtggtgtagaaatgggtgcggtcggcattcgcatgccacccaaattggcacaaatggtgatcaagagtgaaccaaccgcagcagcagcagtttttgatcagctattgaaaaatgtaaagcatgagccaaaagaggaggagtttgagcaattggacattggaaaaatgggtgtggttggcattcgcatgccacctaaattggcacactctgtgatcaaagatgaaccgccatttgatcagcagagagagcatcaacaaaagcaagcaaataaagagccaaatcatttggactatgggatagaaagaatggaagaaacagaaaattcattggaatcgaatgggaaaattagccaaaaaagtgccaaaaagttggcaaaaaagaaaagacaatggcaaaaggaagtggacagaacgccacaacaatttaaaaaggaggagaattccaaaagcgacataaaagtattgatagaacaatttgatcaaatgaagaagaaatttagaaaaaaaatccattttgttgacagaaaaattaatgtgaatttggaaagtaaaattgcaaaaagattgggcacttgcagaaccaaattatacaaaatgaaaagagaaaatggtaaataaacaaaaaaaaaaatttttaattttaaatatttttaaatgaaaaattcatattattgtttttttaataaaaaattatttttttttaatattttcacataactatttacttgaaaaaattcacccgttttaaaaacttaaaatttaataataaaaaataaaaaaattttttggtatttaaaaaagtttaaatttttcaaagagaaaatatataaaattttaagtcattagaaggattttatacttttaaaataattaagcaaaaataaataaacactttcaaaataaaatttactaaacttttttaatttttaggattattgaccagaaatttttcaaatgaacaaaagaaggaaataatccatcgatttgaaataataaaagaagaatttatgcgcaaattcaaaataaaaaccaatgccaaaattagcgataaaattgcgcgaaaagttggcgtcaatttggagacaattaatcgttggaagaggtcatttggctcaactggtaaaaaataataatcaaaataaaactaaatcttttgtttttaaaagatttttgcatagctttttggggataaatgtttaatttttacagcaaagccaatctatacgagcgcagaacaattggaattcatccgaaaatatgatgcactgaaaattcaaaacccactgatcagcgatcagaacaccgcccaaatgatcggaacaaacgcaataagcataaaaagatggaagaagaagtttggtatcgcgtatccttgcaaaagaagacggatcacgtgaattgattgggcagtgatcagcaatggcagttgcttgaacatcacagaagcggaagagtgatcggtggcttctgctcagaattggtctgctgacctggtctgagtgatctgcttaatttgtatgctcttaaataaactgatctgcctagtttggtttgattgatttgtgttccggtaaacactgatcagctgggttgaattcatccttctcagcacagtaattgatcatttttcccttgttcatccgggaattgttgtgccttgccatgaccaatctaatggtttaatctggcgatcttttgccgcttttttcacaattcgcttggcttgaactgcgcaaaacttgtcattttttgaattagagtacaaaaacactgatcagtttggcttaactaacactgaccagtacagaaattggtcattttttccattcttaatccgggaattattatgcacttgatttttataatttaaaaaaactggataaattatggtcaaaaaagttcgggaaaatgcctttgaatctttttatgctg

SEQ ID NO: 17464 - DNA, 2802 bp, Heterodera glycines
  misc_feature (1326)..(1326): n is a, c, g, or t
tagagtgcagcgggaccgagaaatttgggcaagaccgggactttttgggttgaaaaacagggactttttggttgggaaaaccgggaatttcccggtcaaaactgggtaaaaccgggacttcggtactcagttgtccgtgttcaggtcccgtcccgcagcactctagtaaacacagacttatgaattaattttggtcacattcaatcgtaaaaattaatttaacacatcaattttgttccaatttcttagcattgttcctgctgtttttgttgttggtgcttcagttcttctcgaccattggtgccaccgttcaattggtcaaccaaagacacttccttattggagagcagagtatggcacagaacgcacaccggcacggcacgccttacaattagtgtgtgttgaatgggaagaaaaaaataaaaaggatttgtgagtggtcatacataggttggaaattaaattttgcctttgtcggaatggaaattcagtccgtttgacagaaatgaaaattgtggaaatttctgaattcctttgaatccgaaatatgaaaattcaagaaaacccaaagcatataaaaatgctaaaaaaaattcaggggatgaggagacgaactgttctcttaaaatcgtgaccaaacatgacaaaaagatgatttgcctacttggcaggtccactacaaacactgtttgctgtgcaggaagaacagaaaatctaaataaaaaattagacatttaaaggacattaaggacattacccccccccccccccctaattacttttccacaatgacgacaattgatgcgatgctcaggccccggctgcaattccttcacgcaatcattgcaccggtcaacgtcctgttcgtcttgccatcgaaccttaaaatatactgacattcatacgtgtgcaaggggggggggggtcaggaaaagggtcgtgcgttcggcgatgaccccccctaaggggggtcagcgtcaaattttttgcggtcgaccatttttgcccccgttaaagaccttttttttgccaatttttgcgcgaccatcttgaattattcagcccctcctcttgcgttcgaacgcacgaggaaaggatgtcgaacgcagaaaaattggaaaattttggcaaaatttcttagggaaaagtcaatttttcaagtccccactctgcgttcgacaaatcaccctcatgtcagggttagtcgaacgcaatgcacgaccctttccttgatctcgccgctcccttttctcgattttcccctttttcttttctctctcttttctttcccttttttcctttctcccttttttctcgacccccccncccttgcacagctatgtccaccatagtccgggaaaaattaaaaataaattaaaatttgttttacgattgggagaagtcggagtctgaacagtgctggtcgggatggcctccaaaaattcaatgaactgctccatgtcgacgcccaattcgtccaaagtgagcgaccgctgctgtttttcgcgcatttccgtgcagagcatccgatggatcaccggcgaatgggccataagccgagcagcagacacagtgatctgcagtggataaatgccaaatttttaatgctttcattttttaatgatcagaaattgctgtgggtggtgagtcaccgttttgtcgcaaattttcactgtcaaatcgttgtccggtagattaatgtaaataccttttatatactaatttgccaccaaacaatattaagagccagaaaatattttgaataaatacgaaaaacaataatatttattccatgtcataataatgaaatagaaataccatattaaaaattaagtattcttttaaaaataaatgtaaaaaacgtaagttttactcataaaccaatccgggattttgaaaaaatgaaattttaatgaattcttattataagatattagtaatttgaaataaattattcctttattaataattaataattatatcttcttctaaatttacataacctgatcaaaaaaagtagttttttgatattcaggccgattctattaatatgcaaaaatacaaaatatatttatgcttaaacccaaaatgatcaatgaagctaaatttcatcaaattttatttgcgcttaaaaccacgattcaacataatttttacaagcatatattttttaattgttttacaagaacattaataaccaaatatttagtattaaatacgacaaaaattatattttatatttagacgatttaattcaaaaataaatagcttaaatgagattttcttaaagtgttccttacataaataaaattttaaaatttattaatttacactattcatcataaaaaggaatttcaaaaaatgaacgttgatttaagaacaatctattttatgctaattttaaaaataaaaattttataagcaatttacaattaatcgaattcgctgacccacaaaatgtccagcctacgaaatgtccaagtctcgaatttgagttttttattattcagatgggcctaaggttaggcaaggggtaatataaagggtatattcgtattcagcgaccccgaaaaccctaaaaatccgaaattagactcattttgtttttataaattttgaaaaattttggacatttcgtgggtttttactcttttggacatttcgtggcttggacactttgtggggatgccatcgaattgaaatatatcaacgttaacaataataatgttttttgatatgaaaggtttctgtttatgctaaaaaaaatgtgaaaaaaatatgagtagaatatagcgtcaaaag

SEQ ID NO: 17465 - DNA, 1837 bp, Heterodera glycines
cggtagggtgccaattttaaaaaattcaaaaaatgcgctgccagggcagaacgccaaatttgttgtcccgccaaagtgtttgctgcgcgttgctgttgtgcccgccgtctctttcatctccgtgctgttgctcatcaacaactcatgctccgccgccgcctctgcccatgcatttccgtccgcagcagcatttttggcacaacgacaacagcaacagcagcagcaaagtgagatcgatcgatcaattaattaattataaattaattggggaggggcaaagagtctcgcgcagatcaacaatcaattaattataaattaattgaggataggccgagagtctcggagcggatcaattaatattatttattaattggggatgggccgagaatctcggcgcggatcaattaattaggtaattggggataggccgagagtctcggcggatcaatctgtgctatgacggttttcaaaataaacattttttgccttttattctcgatataattcgcttgcactaagtgttttctattagccttcaaaattttaaaaaatttcgttaatgagcaacaattattcaatcaatcaattaactagttaattggtaatggtcgagagagtctcggcgggtcactcaatcaattaactagtcacacggctattaaaagtcattaatttttcaactcattaatagggcacaatgcaccgcttctcttccacctgttgatgaggcaacacacttcattctcccggcttccggccgccgacagcatttcccaacaaaaccaacaccaacaacagcaggacatcaacaacaacaatgccgtagtcgatgataatgatgttgaagccgaagatgaagcggcggcagcggaaatgccgggggcgccggcggcgacggcacagcagcgctgggaggactcaaccggcggcggcgacgatggcatggaggaacagcgacgggacggaaatggcggggacgaagaggaggtcgccggcgatgaacaacaacagttacaacaacgacgacaacagatgttcaagcggaagttgttgttggcgcaggacaacgacggcacggcggcggcgagcggtgccaacgacagcggcgaaacgtcgccgcgggcgttggcacgctcgcatgtggagctgttcacgcgaatgcgcagcatttgcggtcggatgaaccgcctgaagcgcaagcggacaccgcggcctggctcacccgagtcgttggtcgctttcctgtgcgacagtgccaaattccagtgaggggcacggcacaaaaaaaaacatgggggacagacggacggcacaatttgatcattgatctccaaaaaacggaaaaaaatatttgtttttttttttgcccggatgcaatttttgtgttctcctctttgtccaacaaatctcaaatatgtaatgaaaattgtgtgttcattttgcgttgtgtaaacattctctcctggcgaaaaaaatagccgaaggcacaaaactttaattttgccgatctctgttttgtactgactccccatgaaaaaaaatcaaatcctttcaatttggcacaacgattttggtacggtaattaattaattaatcagcctgttcctgcaccaataaacaacaacaacaacaaaaaatttgggctctagtgcactttatgagtccaatcgacttttatgagtccaattgagttttatgagtccaatcaattgacaatcccgtgtttttatacaataactttgttcatgttcgaacaaatcctatctttttggtatcattcgaaagcacaaagtctaacgaagctaaaatatataaaatcgcagcgttcaggcaatta

SEQ ID NO: 17466 - DNA, 1411 bp, Heterodera glycines
agcagcagcagcagcagcagcataatcatcaaatacacttagaaatgggctcaaaaaagggggaaaaagaggggaaaaagtaagtgggtgaaaaaggagactccaacaaatgggaaaagggatttatttaaattaattttaaatatttttattattttttttatattttaaaacattggcactttttcggagtggtatattactggtatgaacacaaaatcttatcaattttatttggaaagattttgaaaatccaactctcaaacaaattctgccacttaattttttgggcggcaaattggtggcgagcaaagtaaaaatggtggggacattttttgtcggttaataataatatgatacgtatctcgtggtattgtgattttccattatgttgtgtcagtggtgttgaatcatagcataaagataggatttgttcgaccatgaacataagttattgtataaaagcacgggaatgtcaattgattggactcataaaactcaattggactcataaaagtcgattggactcataaagtgcactagagccaaaaatttgtacgggaaaaaaagcaaataaattcttaaaaatgtacaaaagttgcacacttgtagtaaaacgctaaccagtagaatgtaaaaaacaaatacttgagaaattaggaaattttttagcaaaaaatctcaacttaaaatttttgtttttaccgaaaaatcgcatttgtcaaagcagcacaataaaaacaatgaaaaatgagttgaatgtgttatgttcaatgttcatcaatgtgatgggggagcacaaacaaagacactttgccatcggaggcacccgcaaaaagcatggacaaatgggcagagggagaggaggaggacaattgagcacaagggacaaaacggcgacgacggcggctctgatcatcatcatcattttggcatttctccgccgcattttcccaatggggcgacggcaccgctgcatcagcaacagcacagtcggaagaggatgaagatgatgataaaacgcggatggcggcaccagcagccgcgtgaaagtcgcatttggccaacaaaacggtggcccattggccgccgacgccgcccggcggggcgatcaccacagagcgtatctgacaaattagatataaaagaaatcttagaaaaaaattttctaagaaaattttaaaaaaacaaaaaaaaacgatttttatagttttttatttctaaaacagttgaaaatttctcaaaatttttttcatgattttttgaaaaattcacatttaaaatttttgtttttaaatttacgggagggggggggactcagaccgccgcacctcaatgagcccatccttaaatccgctggccaatcgcctcacagagtgccgttgttgttgttggccggcaccgccgctgc

SEQ ID NO: 17467 - DNA, 1527 bp, Heterodera glycines
tcattatgagcgggatacgtccaaccgagcgtgtacagtgatcgacgagtgccaattcccgcagctgaacgactgccatccgaggtgtgttaacggcaccgtgaaggtgctttatcccgagccatggcttgaaaattctcgaccactcatccatccattatggcattaattacattaattttggagccctttcctaaatgacatgagcaatggactaattatgtcccatttaagtgccgagtgcacggaccttgcccagggctacacctgcaagtgccgaagcggcttccgcgacgtgtccccgtccaaggaaaagccgggtcgtgtctgccgggcaagtaagtgccgcccactatcgttttgggcctttataccgtattcaatctcccccaaaataccgtaatgccattttcctcattttcagtggtcaatgagtgccaatttgcgcatctcaacgactgccatcagaatgcgcaatgtttggacttggaggtaaatttgtgaaaacacaatcacttgatataatcctttttagaaatttaaaaattaaatttacgcccggtaaatttggaaaaaaaactaaaaacccatttttgccaggacggctatcagtgtaagtgtgaaaacggcttcaaagacgttcgaccggaaaggccgggccgactgtgccaacagatggtcaatgaatgcgcacgtgcggacacaaattcatgcgacaaaaatgctaaatgcgtggacgaagaggcaagttcagaagagaggcacacaaaactggcatttgtcattaaaaaattgtgtgtgtctaaagttagggtattacagtaccatgaacttttgggatttactgttttttggatattacagtattcagaacaattccttgactttaccgtatttattttatttccggtgataaatttccatgctgtacttttcttttaaattcagccagccatggaaacggcctaacacagtaaaaccctggttataaccaatgcataccgtatctctcaaccgcatgacgattagttacagtcttcccgacttgaatatacagtatcaattatccatgaaaattcatagcgcataattaattgttcatggcacggttttcatttctcccccatctccctgcttcgtcccctctgtgtgttactgtattaaaatggcatactgtcctctacagaatggctaccgttgcgagtgcaagtcgggcttcgcggatgtgtcgccaactccgacgctgcccggccgcgcgtgccggcccatcgtcaacgaatgtgcggagtcgaagctgaacgactgcgaccggttggccaaatgtgtggacatggaggacggctaccggtgcgaatgtccggccaactcgcgcgatatttcgccatcgcccgccttcccgggccgcgtgtgccacatattcgagaacgagtgcctgaccgggaagcacgactgcgacccgcaggcacagtgccacgacaacgagcaggcattcacgtgcgagtgcccggagggcttcaccgacccgat

SEQ ID NO: 17468 - DNA, 1180 bp, Heterodera glycines
attaaatccaaagcaaatcatttagtgatcggtagaggtggttcttgaggcacaaaaaaagtcccagatctcataggccctttaaaatatcaaatttcctggtttttcggatcggaatcagaccctttgccctttcgctttaaccgatcagattgattagaaccggtacagagagagagagagagagattgcgctgctcctctctaaaaacctttaaatttttaagccgatctaattaatttccgtttttttagtcccccgatggattgcaaggccgaatttgtgtgcgcaactcattttgccgtgacccgaagctgaacaattgttcccggaaagctgtatgttatgaggaaggccaaggctaccgatgcgaatgtgcccgaggctatgtggacaagtcgccggacggcacgccaaaaggccgagtttgcgaattgccgccggcgccggcacagccccagcgacacccgtgccaagacgggagccacgactgtcacaccaaggtggataggacattttgtgtataactcagaaacaaaatgcaattgtgtacatatttggtgctattcgttgtagaataacgagatgaatccattgaagctattgtaattgtttgtcgaattttacagcacatcagttaggaaaagcagcggaagtcatttaaaaatatcctggaaaatcagagttctgctacccaaattgaaattgacttttctctaggcatcctgccgagctgtcggcgccactgggttcgtctgcgaatgtttgcccggctatgaggacaaatcgccggatccgaagaacaaaggcggaagagtgtaagtggataaggccaataaaaaaagctttggattaagccaattaattgatcagttttatagcgaaaatgataaaatttccttaatgaaattctgcacctaaaaagagcaaaagccaaaaaccaaaatcccagaatgatcgcttcactttcaactgatcagaaataactcgcgacttaaattgaccgaataccggagaatttgaatcttaaaaaatacttaaaattggctcaaaacaaatcttcttaaaatttcatcgctcttttcagctgtttgctccctgaacccgatctgcctggataacacccgaaatgattccgatgctttttttgatcgatcaatcacaattccttgattcactc

SEQ ID NO: 17469 - DNA, 2458 bp, Heterodera glycines
aaagcttcaatccatggtagtcccaataaattatgtccgacttcgccgctgacataggcgatcagagtttgcggtggtttgtcggcaatttggacggtgcattggaatttgccaagcaaagcgaatggctggtcattgcaatttttggcatcgatgtcggatggagtcagttccggttctcccaactctcgccatgtttgcaatgaaataattgtggcctgagcgccggtgtcgccattcatggaagtttgccttccattaatcaaaatgcataatttccaccatcgtccttgagtcgtgccgacatgcaggcaatttgcgtcgactttgacagtgtgaaatgccctgtggttgttcggtgccgcctttgctttcttttgccggcaaattgttgaaatgtgtccttttttgttgcacttgaggcaagtggcgtccctgaatgtgcagtcggagcgccaatggtcggatttgccacatgatccgcatggatgcgtcggttgaccacgcgttggctttccgcttgaattggcatttggagtttgcttttgattggagccgccgctttgtctttgcgctgggtcggcccattgccgtggccttgtgcgaatggcgtttgtggcaattggtgggttgaccagcgaaagggcgctctccttgacaagttgaattgcccttaattcctcctcaattttcttgagcgaaatgttggtgccatttttctgagagtcctccaacattttcaatgccttttgtcgcaaatcatggtgttcatcgttgagtgcgatgaccaaaataatgcacttgagctgctcctttgtcagactcaggtcggcattttcacatgatgcgttgatctgcgcaattagtgatgagatgtcttgcccttgttgctgtcgaattttaaaacattcgaagcgacggacgaatagcgaacgtgtctcggcaaaaagctgtttgagctgtgaaatggtgtcattccaattcacttggtccggctgggttgggctgatcgtgtcccgatatttgctgtactcctcctctccgagtttgccgagaaggagtcgcacttttgaggcctcaggcagtgtgcttccgtcgtcctcgatcaattttccgtaccgtttgaaccagcattcaaatgtggtaccgacctccggattgtaatgaaaggttgaaaggcgagcatcgatagagcttgccaaattggcattgctcaaatttgctggtgcggcgttttgcggtgcggcattggtgacctttgctggagtgcatttagcaattgttgaagctgttgcgcgtccatggtccaattgaagaaaaactgcacacggcagactttaatctcacacggagagaaaagtttttgatgatctgcgaaaattagaaatcaacacgagctttctaattttccactacgagcaatatcagcacgaaataaagctcggatttgttgctttgccggtgatgtgcagttaattgctgactgcgccaaaatttgttatgtccgaagataacaaattaaataagtttatttgccgaaaaaaataaaataataaaaatgcagagaattaaattgggaggtcaaaattggtgggcacaataacaactgaatgaggggaatcggagggggaagatgacgaagtggcgttgggtcatacacctaatcaataattacttccttctctaacaaaaatatttgaatattcgtaattttttcctttttatcttttattaagatgaaaaatttactaaaaaaaaaatttaaattttggccgcgtaaatctgtcactaaattgtaccaaaatttatgccctgcggcgccaacaaactacgcctgcctcacaatgctttcaatttttaattttgttctaaaaacctcctttttagcactatttacatgaaacctttaataataatttctgtaaaaaatcctcaaatgatcgaatttactatgaaaatcgtgagaagaaaaaaaatccaaacaaataaactttaaatttattaacttagaggcgaaaaaaatgaataaaaagcgaagttttcgctttttgcttatttttgacataaaattaaattttttaaattcaaattgcagttgaatttgaactaaaatcaaatatttggagaaaaatgggaagaaaagaacttattaaagtaataaagaagaggaaaaaagagaacactacacatttaaagataaaatcaagcaaaacgagagaaaattttctaaaaacaatggaataaaattgaaagaaaaattgtgttaaattggggaaaaatcgaaaatatatttataaatggatcaaagaattaggaattattcaaaaaataatttataaaactacaaatcaaaacggatgaacaaaaaagtgaaattgttcaaaaatttatagtgttgaaaaataattataagcaaagaaagaaaatattctgcaaaaaatggaatcaaatttatgga

SEQ ID NO: 17470 - DNA, 1484 bp, Heterodera glycines
gaaataatatttattaatttccataataatatttgtcttcctttgtatattttttatttattttatcagaaattttgtctataattattttttttttcttgaaattttaaaattttttattacttttttgttttccaaaacatcttttttcacgtcgctcttttctaaagacttaaggagaaagggtacggcgtccggcggtgccgataggcgccgccgggaaaattttgaaaatttggttagatctgttaacagattttgtccaaaatatgctaaatttttgcgattttgagccaatttttttaataaggtttatgactttttgggccctgtgatgccgataggcagcgctaaattttggaattaagctctattttctaagatttttcaccaaaaaaatttatgaatttcggtaaatttttgtttttcttcgatatgtattttgtcaaaatatgccaagattggtcgatttctatgagtatttaatttaaaaaaaaacaatttgtcacaaagaaaataattaaagaagaaaacgtcaaacggtatcgaaatcacgacagaaagtaatgtcatggcactaacctctacaccacattccaaatgtccaaaattgagcaaatcttctttatttaataaaaatttggcaaatggttaaaaaaattcaaatttcgtctaacttttttgcattttctcccacgaaaatgccattcttaggggtgtatatttaaccccgaccccgatcggggttaagggtcggggttgtcggggtatgaagcgtcggggttcggggtcggggttttccccgaaaatggccaaaaatgtcgggggtcggggtcggggcggggtcggggttgcaaccctatgaataacaacaagtcccaagtcttgtgcccattctttcgcttcttgaattagtttttcaatttcaacttttgccaaatgttttttaatgtccatcgcataatctcttattgtgtatgtgccttaatttgagtaatttataggtgtattaaaatgtttggtaatataaaatgattattttaataaaattcaatcagattttgttttgaatgggtgaattaccctttaaattataattgaaaagcacaaaacttagcttataattggtgagatttcggttaattaatttattaaagcttttttatttttattaaatattccttaaaattatcacctgctgaacctgatgaacttgcttctttttcagttgattcatttttgggaggtgctgtgtcaatagaatataaagacaaaatacaaatgaaaaaaatttgtgaaaatatctcagttctcattgtctctcaatgttatgaataagcctggaattttttaatttacaataatacattatatgtttttaaattatcctcttttataatttttaatgcgaaggaatgcaataaaaacatttccggagggagtaatggataaaattatatgtttacaattataaaatgaaaaaa

SEQ ID NO: 17471 - DNA, 913 bp, Heterodera glycines
acatttgaaacaaactttttgcacttaatgccaaacagttggccgtcatgaacatttatattttaaagtttttacacttattgccaaacattaacccaaacttttatcttttactttttacacttactgccaaacatttgcaccaatattcatcatcaattttctataaatgtttgggtaaaatgtttggcagtgagtttaaaaagttgaattgataaatgtttgggtcaaatgtttggcagtaagtttaaaaagttgaattgataaatgttttggtcaaatgtttgtttcaaatgttgggttataaaatgtaattgataaattgttttggtcaatttttgttcaataattgtaaaaggttttttgtaataagtaaatatttaaccaaatgtttggtagtgcatgtaaatgtttgggccaaatgtttggcagtaagtttaaaaagttgaattgataaatgtttgggtaaaatgcttggcaataagtgtaaaaagttgaattgataaatgtttgggtcaaatgtttggctgtaagtgcaaaaagtctaatgataaatgtttgggtaaaatgcttggcaataagtgtaaaaagttgaaaacataaatgtttaggtcaataaaatatttgggtcaaacaatttttcgtacttgcaaaatttttagtgttttgttcatttaccttcaataaacaagatttgatgattaaaacatttataatttactaaacttttcacacttaatgccaaacatttaacccaaacatttatcattttacacttactgccaaacatttgaccttatttaaagtttttacacttactgccaaacatttaactcaaacatttatattataaccagggaacgggtttatatgtttttacatatttttttgcgcatatgctatcgcatgaaag

SEQ ID NO: 17472 - DNA, 3493 bp, Heterodera glycines
  misc_feature (3447)..(3447): n is a, c, g, or t
atctaagaattttttcttgaaaaatttctgtttggaaaatttttcgaaaaaacagtatacccctcaagcctccataaaatttaaattttgttttcaaaatttaaactcacatcattgcctccccgaagccatttcagatctttctccgcctgatctttccttccttggacaatcaaactgtattttggcgactcagggcaaaatggaagtgcgcacaattggaacaacacgggcacctgaaatttaataggaatggaaaaataaaataatcatacatgaacaaggggtgcgccaagcccaatttttcgtacgaaggtccaaatttttctccggtgacgaccttttttttgctattcaaagcaccttttttgcgcggcgcgttttttcaaaaaacttttaggcgaggtggtggcgggcgggccgggaaatttttaaaaatatgcccaaaagccactaatgcattaaaatatggcataaatttggcacataatccctcaaaagacatattatataatctcaaccctggattagacataatttttctacatttaccagagtaaacgcaaaaatcagtggccaaagatttgcagagccaaaaatttgtggaagcccaataatttgtgaagcgagaattgcgatggtaataaacaattggtgaagcgagccgatggagccacgcaaattgtttggtgaaatttccatcaaatacattggagacagtccgctgttgaaccctacaaatttttaaaaatgggttttataatttaaaattttaatgaaaatttaaattacaaaaaaaaaaaattcgtggttaattttaaaaaatttaaattttattcaattttcaaaaagttatggcagtttttgcatcatttttagtcacaactttatgaaaactgaatgaaattttctgaaaatttttatgctagtagaaaaaaacaatgagctatttcgtttaatcccagattttatttattgtttttgattaaatttcatttattttttcaataaaaattcaaataattacgcttatattattaatttaacaaaatattttcgtcatacacatacatacccgtgttcagtccaataatgaatcgtccaatggtgatcaaataataaacattcacatattttgccagtgtcatcagtgccgcagcaatgatcgccaaaatattgttgtacagaagtgatttacggcgccctaatttgtccgcaacagtgccaaccataatgccaccaaacattccgccaacggcaataatgccgaccgcaagtgccctggacaattaattcataattaattgaattcatttctcgaataataatgacaatttttcaaagaattaattagtatattgttttagaaaactccgatagtcaatttttaccatgtcgagtccatctcttccactgttgtcgaaacccctgtcatgttcgtgtacgattcagagatccattctttgattatgtcccctggaaaatttaaaaaggaaatgttagagatttgaggtgaagaaaaattctagttttttaaatctaaaatttaaaaaaattaaaattttttgtttcaaaattttcaaaaaatgcaaaaactaagaatttcaaatgagtcttgttttgcaacaaatgcatcataaaaggcagtaaaatccgaacctggaatattgatgcagccaatgtgatagcccatttggaatgaactgccgaaagctaccacaaaaacagcaaatgccaaaatgccggtgagtcggccctgcgtatagcaagaaaatgaagagttcgaaattcaaatgaccaagaaacaaaatgatacgaccaaaaaattgaagacggttaaatttggtcaaattcatgtgttaattggtactgaaatgcccgacaaattcaaaacgggtccgttttgcgtatatttttaaaggacgaaatccgactcgtattgtttttcgacttttatcaaaagcgacaaaattaaaaaaaaaattgttaatccttttattttttttctaacataataaacttgaattgtgcttttagaaagagaagattaaggcttaatcgattgaataatgccaaaaatgtttaaaacaggcgatttttacaaaagttatggtcatttttgtcgaaaaacagtacgagtcgggacaggacgagttggatttttatcattttgaaatcatcccaaaacttcaacccactaccacgaatgaactcatccaaattttgcttgccaacacgtgccttgaccggtggcggcgctcgcttggacccatccggctcggtcgtggtctccacaaggccctcctttgctttgctgatcaacttctcacgctgctcctggtcccgagtggacaccactttgtccaagttcgtctcggccattgcaccgtaattgatgcttgtggtgttactgttttcgttggatggcaaaaaattggtcgtcagaatgaattggttgttttcaggtggtttttgctggaaaaaataaatcaaaaacaaattagcaaaatttgggggaggatggcgatatgaaaatgcaacaaatattattattggagtgcaacaaatataattgcttttaatgagtgcgggagggggagtgataaattattggacgatttgcgatcacaaagttaggtggggtgggtcaacaaatgctccccctttttgttgataggaagacacaaaaccgaaaactgttggggctggctgataagtgatgataacaaaaatcaaagtgcggaaaaattgctagcattttttttttggtttttttttttaattttttttggttggttacactttatgtacgctgatgcattattgagttctttctctctgtgtttgtcattgaaatgggacgagaatttctgtcactgaaaacgagctctccctcgtatgattctctttttcgctaaaccaaaaaagtggggggggggggagcaaaaaatggaacttcaattatcttcaagtaaaaaaggagaagatcgttttaaataagggaaggggctaagaaatttcagatcctgttcttaattcattgaaaaaatgaatggttagcaaagagggctaacaaaatggtcgtaaaatctattcaaaaaatgaaaacatagaaaatttccatgtatcacatatttagggacaagtgaattcacactgatgagctttcctcagcactagtgtaagccttaaaatgagaccagaaaagagcggacaaagttaagggaaacaacatcaaacccatcagtggatgaaatcaagggagcaaagtttgttgatcagaaaactgaaaaataaagaaaatccccaacacgtgactccaccatcttatgatgatgatgggggagagggataaggataaagcaatgtgagaggatgggaatggatgatgatggatgagaaaggacggcaatgtggcaggataaagtgaaattacatagggaatcngataaatagtgctttactgcagtttacgcgtccaaccatgatcatc

SEQ ID NO: 17473 - DNA, 2914 bp, Heterodera glycines
  misc_feature (43)..(43): n is a, c, g, or t
cctggttcacattgggttgccgtgtattgcgagcatcaaaatncgggtggaatactacgattcgacaggaatttggccaccgctaagccctttcatccaaaaatttttaaagagttttgctcaaattcagtttcatcaactttcgctccaagcaccatactcacactcatgtgggaagcatgtgattttctttatatttggacggtgtatggggatgcactttgaagcaattttgcaactgctaaaacgcgcaaaaatatcaccagatttttttgtaaacaaatttatgcaaaaaaatgtgtttaaacaaatataaataactagaaaactcaatttaaaaagcgcaaaaaaaaaaagaaagaaaaatgcacgttgatttcgatccttttaaagttgaatggtcagcattaactcaaatttctccagaagtagtcgtccaatacggtggttataatgtgttcagaggggttccatacccgcgcggtagtggtatcgggtctgtttttaggagtctattgcgttacctaataccaatcgggaaagaaatcgggacagccatcgggcgccaaggacttgaatctggaaatcgagttctatccaatgtattagagggtagggacctcaaagagtcacttgttagtgagggaaaaacggggctcaaaaatttgctagagaaagcagccaacaacataaatgcccaaaaaggtcaagggttcgacttcaaacgatacacaaagagaaatgatgcaagagaaggtggtgcaattggtaaagcgaaaaaaggtataaataaactacaatcaaggttgggaccacacgatttcctaccagcaaacaccccagcaggtcggaagaaaaaacacactaaacagaaatcggtcaaacgccttcgtaccgatatacttggaacctattaataaaacaaccccccagaagcacaatcatgagttgttcacaaaaaattagcgaaagtagtccccttgccacaaatagtgctttgaacattttttcagtacctccaacaaatgtgtcggttgtgcgctcatatttccgtgaagtcctccccctagtgacaataacgcaagaatctccgtatctttttcgcctgtacagtgacaatctttggaccgatctttcccggatttatctcttccttgacctttcaatagaaaaaccggatgtggacggcaactgggtgtcaatcgcagctaccgatgctcaagtcggcaccattcagggaattggttaaacatttgttcaacaactaaaagtctcagttggaaacactgaaatttacgacagcggaaatttgtacccatataaggtttacattacgaacacactttcgtttccgatgaacgtcaaaaaaagcttcctcgcttcaactggtcactatgcgacacgcacacacgacagcgtcgctgacgagggctttaaagctcggtgtaaaatttttgagggtgggaagcgagcccaatttctttcacgtctggactttgacctgggaaaccaataactttatttgttgaacaatttggatcttttatttacaatttacaaagctcgtgacactttcatcatgcagacattgaaagcaaacgatactaccaaataccgcgttagagtccatgacgtaaaactgtatgctaaaatgattgatgttcagtcatctttgaatttaagcatctacaaaacgcttgaaaaacaaccagccacatatgcagtgcgaaaaactgaaatcaaatcatgctttataagtgaaggtaggtttgaaattgactacaatgtattcagtgcaacaattcctcgacgtatgacaatcgcacttgtcgcaaacggggcatttaacggaaattatgctatctctccatttaattttaaaccgtttgacatacgagacattgcagtgtacgctggcggcatgatttacccaattgttccatacaagcttgactttgccaaagatatttttgtccgtccttttgttgacatgtatgagggaggcacttggcatggctaattcagagcgttctttcgacatcacaaaagagcaattcaaatctggttggaccttttttgtaattccactcacatcgacgctcgacgatagcacagggtatgaactcttaagaagcgggacaactagcattcgcgcaacatttaatagtgcaattcctgagggcggagttgaaatgatagtgctgggtgaatttgaccaaatgataatgatagactacaaccgtcacattgtttccgattcaaagcttagttaattaactgtataaataagatgcataatgcgaaaaaatgccaccataaaaatgaccttcttaaacactacagtcaacgccagtttaaagccagagatacaagtactaacatttgaaaacaaaagcgttcatcctaacctcctcgtgcaacttctattgcttgcccattatctcattgcttttcccgttttcattttatgctggtattctttgataaattttcttaagagaagaggacatatttctcagcgtgatgccaatgagatgatggatgatttgcgaaattaccaattaccaaaaaattcatcagttatttttccaacgccccccccccgattcccgcccttcaaaattttgaaaaataaataaaataataggagactcagaattttgaaaattttttataaaaactgatgacaagctaatgtgataaaacaggttaattcttttcctttcagtatccctgcaaagtttggggcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaagacct

SEQ ID NO: 17474 - DNA, 967 bp, Heterodera glycines
gtcaacgccagtttaagccagagatacaagtactaacatttgaacacaaaagcgttcattctaccctcctcgtgcaacttctattgcttgcccactatctcattgcttttcccgttttcattttatgctggtattctttgataaattttcttaagagaagaggacatatttctcagcgtgatgccaatgagatgatggatgatttgcgaaattatcaattaccaaaaaattcatcaattatttttccaagtttatcaataaagaaatgattaacgcacaaatattcaatttttttcacatgatcccctttcagccttgatgaagatcaaaactaaatttaggagtgcttttccttcttttgaaaaattagggttacgtgacaaacgcatatgggccaagcttttccaacaacgttaattgaggagagttgacgatccaccactcggatagagccaactgcaaatctctctgtgctcattacgaaaaattgtcaacgtgcaatcctgtctcatggtgaattcacgaagaaaaaacaaaattgcaatcacatcaagaccattttggagtttgtgtctcatcatcttcaacaataaaatgcatttttaatggatttttaaaaaagtaaaagacatgctcaatcttttttttaaaagctcacaacaaatgaatcatttttctctttcattctctatcaatttttcttggctttcttggttgcaatctcatcaacatcatttttttcttttggcacatcactgtcatcattccctgggcacttcttgaaaaggttgacaatccaatcaaatccagtgtacgtctgattgttcgcctagggcgtggtttgtcaaatacataataaatatcaacaaaaaaccttaatgttaacttttgcgatcagcttcacagcaatcaaatcgtccaagtgaaaggaaggctttccggctccttctccttggcgagcaattca

SEQ ID NO: 17475 - DNA, 3003 bp, Heterodera glycines
gaaatatgagacgagaaatcaacaaaatctcgagattctgttcattttttagtttttctttcgtgcattgctaaagacaaaattggtggaaagtcgcgagggttgcgaatggacgcgttgtggcaggacggaccgcggagtgtccgcttttcgacaggtggcggccgttactgtcaggtggggacggagcggcaaaggctttgtggatctattgcagtttattcgaccataaataacacgacacaaatgacagaacattcaaatttaaaataatgttgaattcgaaggctaactcttagatagctattttattctgtcaaaattaggtcgacggatgtgtcttcgtttgacagtttttggagtgagggaaatgcggagagaaaagacagaatcacttccaccgtcgaattgtcctacgtaaaaatgtgaggatctacaaatttcggacttctttcaaacttaaggctcaacggcgttcttccccattccgtccgtgttctcgcctttgccccggtccgcaggggtttcaggtaccgttttcgccctttttctattccttcgttcggtcttttcagtgctcggttcaattgcgttcagcgtgagtacacttacatttttccgcgtactgccattgccgacctttccgtctgtcctctccaaatgatttctcaatttgttgcctaattaagtggctaaacgatgcttgcgcgcgactctgtggcacccacgactttcggaacttttgtcacatcgatcggaatgagaagagattggccacttcatacgtcagaacaattaaggaggctcgagtggaccaattagggtgaaaagtgaatttattttaatgatttacattaattcgccattttaaagaaagggtaaaatgaatttcagcagttcgtctcacgtcgcttcccttgtcccctcaacgtctgctgaactgtccgattcgttccaattgttgagattgaccgtcaaggccaatggttttctttggcaccaaatccgttgcatcgtttccctcctttgggagatcgcttgcggcaatgaggagcccgaggcagattttcattttaagtcaaatcttagaaacaacaataatttaatttagctgatcgacgatttgtttgacattgagaaatttcctgctaggtattttccttttttttattaattaaaaacacaattaagaggaatgttccgatttgtttaggcctcagtacaaaatggccaacgaattgccattgtgtctgttcgactgtactttcgacgaaccgattgattggaagttcgatttcattgcgttgggttcagtcgtaaatacccttcagaaaaaatgggctgaacatcagataaagttagtttcggccggtttcatgcgcccatgacattttacgcgttccataaatggcacatgaaatgctgtaggacgtgtaaaatgtggcatgggatgcgtaaaactgaccagtgccttaatttctgacaaaagcgtgttcataaagttcctttattagagcggcaaacattaaagaaatgttggatggacttaattttcacatggcaaattcgcccaatggattggatgagtttgtgcgcaccgaacccaccccgaaggtgccccgccatattttgctcacattttataatttttcagaaattcattcccatacgaaaacgttcactttgcgagggattggaagaacgaagacgaaaagcacaaaagaaaaagctaaaaatgggaggaacggatggaaaaggggcaaacaacgaaggataacaattaatctatgccttttgaatgtgttcttgttaccgtaaatatttatagaactttgtccataagtataatacaattagttggaatgctcgtctatcttatttccttttatgcatcatcggcaacattttccgcgtcgtttccgttccgcatgtgtttcatcttcgtccgcaattctaaggctccgcctcgacccgtaatgccgttggaaaggagtcgtgccgattccatcggtgtcttccgtctcttcggaagatttatttaacatttctaaatgataatctttttaaatgaatgcaaaacacatcatccggaaaatgtgtttctgtaccgaaaagatttgcgtgtatggctgagtggtttttgtaagataaaaagagaaaaggctacgattcgaaccccctccacgaaatggatattttttaagcgattttctaaaattatttttgagggctattgccaaaaatttattcaactcgaaaccagtggctctgggaccccctgggggaagtgcaggggaaaagataccccactaaaaataaagtcaaattgctaccaattgccaacttcgagaacagttcgctgaccccttcgttggttttggctgagcactcacagaaattggctccgatggattgagaatacctcaaaaagtcagaataaaatttttgcctattattgggtgatagtttttgtaaaagacataatttttggtaaaaatatatacaaatccataaattttgaagaatttcctggctttgcctaatggcaccaccggacttcatttttcgctaaaaaaatggtaagaaaatttctgccatcgataaacaaaattttttttttttggtccactcactctttggcctcttcctttggcaccgttctgtgccgtgccaaatcgattttgttgccaattatgaaaatgacgactttatctgccaacatacttctcagttccttcacccaatttttgacacggtcgaacgatttttggtcggaaatgtcatagacgagaagggcacctgaaaagggagggacttgggtgaaataggcaagcaaagtttggcggcaatcattaagaattggtgtcccgacgaaaaaaaatgttaaaaatttgtcgggtattttttctaggcttaaaaaatgcgctgatcacgaatctgagctcagattttgaaaatcattgatttttatctaagattttttgtcaactacttgattttttt

SEQ ID NO: 17476 - DNA, 1719 bp, Heterodera glycines
  misc_feature (72)..(72): n is a, c, g, or t
gctttccctggtatttctattaaactcattaaaaaacacataaaaatgtgtgtggaagcatttggacatatnttatgtcaaaaagcgatgataccctgaagagcgcactagtcatgtttcgtttggcttatggtgcccttccccccgactgaccatattccacattgtccgcctgatgggcatgtgaaggccaaaaataagggagttgtattctgtagagggtattgtcttctctgacagcttgagaatggacgtcaattacgggaaaaaggtagccaaaatgaagcagaattgttgcaaaatgtagcctaaaaaagatattcgcagtgtaattagcgagttgaacagttatatgagtatcaaaccacaaaaacggaggggggggggtgaacaaataaccatggggggttaaaaaagccaagactttgagctgatgaccgaaaaagataaattaattacgcttcattggtgtcctccactgataagacttcttggatatgctgcaccaatgcctggccagtgatcgcttgaggtacagccacacggaaatatttgtgagtacgcaattgagccgattggacaattcgaacgaggacaaaatcaagctgaaagcaataaaaaggagttaagtaagtaacagtgaagcacactttttgaagaatgtgttgtcgggacgttgagacatacgtcacactgctcgacgacggcagtgaggtcatttgctgaagaaaagaaaggtaaactgtaataaagtcatgggagcaaaaataaataaaataaaaaactgcaatgaaagaataaatgatgaattaaaaaacactattcgagtgaattttttaaatattactgaaacgactttttggattgtagtgcactttaaacgtccaataatctcttaggcgtccagtgcttgtttgtgtttgctggatgtaatttttttcatattgtcagtttttggtttgataccaagaatgtaggtattgaccaagtaataaaaagttattgccaaagaaactgaacattggacccctaaaagttcattggacgcctaaagtgcactagagccacttttggttcggtttcagggaatttaaaatcaattaaaaaccggtcaaaaaaaaaaatatttttttataatttcgactttttatttgaattcgggttatggatccggaattgctgaaattaatgtctaattcgtgacaagcgaagaaaaatgtaaaccaaaagggtcctgcctgacccaaggagaatgtttggcattggaaagtgttatgtataaaggaagggatggggtaaaatgatgatagccggtgatgcaaaaggggaggggagatgaaagcgagtctggatgaaggctaaatgaatgccgtcaatggcagctattgaattgacgtgttgtacaccgtagctgagtaagtaaaaggataaggaaaaagggaaggggaaaagagccttcctttaccattcattacaagatcgatgatgtaaaagcggcgaaagcagcacaagcggcactcagtgactgctaacgcctagacatagcttccctttacacgtgccctttgcacacattttcttttcctcttcttggctttcatgaatgcttggatggacaaaaagaaatggaaagcatgctgaaacacacaagaagagtgaagggaaaggaaaagggaataagaagacgaagaaagtcctggaggaaatgaggaggaagaa

SEQ ID NO: 17477 - DNA, 2068 bp, Heterodera glycines
  misc_feature (145)..(145): n is a, c, g, or t
  misc_feature (192)..(193): n is a, c, g, or t
  misc_feature (195)..(195): n is a, c, g, or t
  misc_feature (202)..(202): n is a, c, g, or t
  misc_feature (215)..(215): n is a, c, g, or t
  misc_feature (246)..(246): n is a, c, g, or t
  misc_feature (256)..(256): n is a, c, g, or t
  misc_feature (273)..(275): n is a, c, g, or t
  misc_feature (299)..(299): n is a, c, g, or t
  misc_feature (309)..(310): n is a, c, g, or t
  misc_feature (321)..(321): n is a, c, g, or t
  misc_feature (326)..(326): n is a, c, g, or t
  misc_feature (369)..(370): n is a, c, g, or t
  misc_feature (407)..(407): n is a, c, g, or t
  misc_feature (413)..(413): n is a, c, g, or t
  misc_feature (429)..(429): n is a, c, g, or t
  misc_feature (443)..(443): n is a, c, g, or t
  misc_feature (449)..(449): n is a, c, g, or t
  misc_feature (454)..(454): n is a, c, g, or t
  misc_feature (489)..(489): n is a, c, g, or t
  misc_feature (502)..(502): n is a, c, g, or t
  misc_feature (514)..(514): n is a, c, g, or t
  misc_feature (524)..(524): n is a, c, g, or t
  misc_feature (529)..(529): n is a, c, g, or t
  misc_feature (539)..(539): n is a, c, g, or t
  misc_feature (546)..(548): n is a, c, g, or t
  misc_feature (556)..(556): n is a, c, g, or t
  misc_feature (566)..(566): n is a, c, g, or t
  misc_feature (570)..(570): n is a, c, g, or t
  misc_feature (572)..(573): n is a, c, g, or t
  misc_feature (576)..(576): n is a, c, g, or t
  misc_feature (591)..(591): n is a, c, g, or t
  misc_feature (606)..(606): n is a, c, g, or t
  misc_feature (609)..(610): n is a, c, g, or t
  misc_feature (644)..(644): n is a, c, g, or t
  misc_feature (652)..(654): n is a, c, g, or t
  misc_feature (659)..(659): n is a, c, g, or t
ggatagcagttaattgtataaaaaaggggtatttcatttagtttcagaaaaatccagaaaaattctaaaaagaactcttagagctgctatctaatgatcccaaaatgttggatgcttctagaaccggttgtggggcgttggtttnttttatgatgttgggcgccgcgccgttttctcttttggggcgtagcnngnccttcgnccaggggttcccngttccgctggtcgctggtccggttgtctcgngcctctctgntgttctcgcgcccgcgnnntttcccggtgttttggcgctggtncttggtccgnncccggccctcntggcnctcggtggtgttcccgcggccctttggggggtggtcttgtccnncgcttcgccttgcgtttcgtggttttccgcttggttnggggtngggctgctcgctcttncctgcctgctcggnctgcgntgccntcgggttgggtctcctccggggtgtggttgctcgntctggtcgtgcgngtgcgctgggtntttgcttccntcggntgggcgtgcntgtgctnnngctcccgncgcgtgctcntcgncnnttntttttttccctttcngtgccgacaatttgngcnncctgcggtggtcttccctgctttttcttctcttncctttttnnnttctncgtgtagcatggcgctaagctttgcttctcgtgaggatgccattaacttttgcgagaaaaatcgctggtcctatattgtcgaagaaccaccggttggctttttttattgactatcatcttgatctggcttgttttagagccgtgaaatcaagccgaaggcttatggttccaatttttcatggaacaaacgcacgagagtcagcactaaatgaaccgataagaaacaatgaaatttagtgacttaactaataaattcctgtacatttacgcatttttcttttgaaaaaaagttgtattacattcactatttgattactttttccgttttagacgacttaaaatctgattaaaaaaaataaaacaaattattgtgtaaagacactgtacaagcatcatcaattcgttcattaaactccgaacaattaagaaaaatgagagctcaaaaaaatatggaaaataatgataggtacttgtatttggcgttttcagcatttttctatttcaaataatttgggttatttttttctgaaaagttcgaaatttagtcatctaaacggcaaaaaaaaaatccaatatttttcgtttttttatttttaaaatattttaaatgtctgctattaatgttcttgaagcgatgaatttattgaagccggaacaagtaactgtgcagaatttgctgattgaaaatggacaactcattgaaactgtggcggaatatcagcggatgggcaaaatcgttgtaagcgaattctttcgcgggtaatactgcagaattgggtccctccgaaaaataataaatttcttcggattggttaaattccccggcgacgctcatcgacacgctggacaacaaaatttccttaaacttcagaatttaccaaattttcttgcggagtccagaacccatctctctcccgtccttacaattaatttctgccctggtattaaatgttgagccaattcattaaaggaagcgactaaataccaggagcgactgcacagaaatctcatttatttggcaaaactggctgattcgacatgttcttctcaccttttactggtgattaagttagacaaaactgtacttttcctttttgctcatacatccaaaacttaaaaaaggttgtcaattttggcgcgaggatttttgatgtaaaaaagggaaagtaccgaccaaacatagtcagtacctgttaaattggacattcagtaccattttttatcaataaaagggctacatgacatttcgcctactaacccaaaaacattcatttcgcctactaattagtaggcaaaatgaatgtttttggcttagtaggcgaaatgaatttttttgggttagtaggcgaaatgtcagtaggcgagatgtcggtagccgagatgtcgagtaggcgaaatgtccgtacacc

SEQ ID NO: 17478 - DNA, 3728 bp, Heterodera glycines
tggaaaatggtggcatcggtgggatttgttcagaattcgccctcggctttggtcaaagtgagagctacgctactgaattctattatgacgaaaagctcgaaattgctttggccagtgaatataagcaaaaattcttttgccaaaatgacaacgaatcgttgccaactgctgaagtgatcgaccaaattctgctgttgactttttcactcgcactgcgcttacaatttaatgcaatgtcagcattttgttttaaatttaaaaattaaatatttaaataaacattatttagatttgctatttatccaatgtttgacatttttcactccaatgaaattaagcattggcaagtccgaacccttttgactgcgtataaacaattatcaaatgctaaaggcatcactgaacatgggtaattaagcaaattaattaaatattaattacattaattttgggatatttagcgtttttccttttaaactttcccaactttcggatgacaaaaaatatgcttattggttgttaacatttattgaggaggaacaaccgacgaataaacaatacattggtatgaaaataagagaaattaatttccttgtaaatttcagaaaatttcaatttcatcataaaaatttccgaattttcattgtctcctttcgatgtttacaaagtgctcgaggcaattctatcgaatgttaatgaaaaggaaaatactgtgcataaaaatggatcagcagaagtgccaaaactgtacgaatttgtgagagaatatttcaatgccaaattaaacagtgaaaaagcatcaaattctcccaaaagtccttctttatccattgattgtgtgctcgtccatttgggctatcaattgcaaatgaatgcttaccaaaaattcagagaattaacggagaaacaccaaagaaatacaaatgggtgtgcaaaatggagcaaggacattttggaaattgttgatctctatgagtttggggaaggattgggatacaggtaaaatgaagaacaacgaaaagaacggaagaaattgagggggaaaagaaaagccattttataggacatttgttcgctgatgtgacgaagttacaaaagtatcaatgacagtaatatttaaattaatattatttaaattttatttgcagaaaatgatcatagtcataaaatagcaaaagctaatttaattaatcaatcatggtattgaaaggagctctacatcgcctctattatcttatttaatcttgcaaaaatttacaaaaagttgtaaccaaagaatttttttaaatttaacagaagaatagagaaacctgttctatctaatcacataaagaaattaaaattagttgtttctgaaaaagttactaaggaattaaatgtgttatatgtttatggtcatacaaaaatgtcaaatcgtttaaatgcgtgaaaattgttcaacaactcttaatatgattagatagaggaaagatttctccattattctgtaaatttcaaaattttattgaattttaaaaaggaaaaattatttagtctaatttttcgaatttttttcgttacaacttttgtaaaaaattttgctagctttttaaaaaatacatacgataggaggacatagagctaactatcttccaataccaagattattaattagattaagtttggctaggtatgtttattttctgaaataaaaaagtaataattaaacttagatattattatcattgatacttttgtaacttcggctcaccacgcattattcattcaacgataataaacccaattggaaaaattcatttttcagctttcacatataatgttcaccattttaggatgtgctcgactgaaaaaagataaatcttagagaaaaaaaattttaagattttcaatattagacatcctccagaaaatggcaatttattcatgtttggtttagaattgcaccagttgagttagaattgttcaacgagccaatacaaaattatgcgaatgcaattgaaattgacacacatcagtgcagaggttaaatacattcgaatttgtaatttgagacttaaaataagctcttctcgagaccaaagccccagcaccggaagagataactaattacccccttaatgactgacatttgtccaaatgagtggcagagaaaataaaaaaatagactgacttaattattttgagtgaggtgagtaaaatatttccttggttttatttagcattgactcaatttgccaacgacgcattggacaaaatggtcaaagaaaacatcgacaaaaatgagcattttgatcgattacaaattgtccttcaaattctatctgaaatgaaagacacggaaaattatgaaaaacttaaaaaattattggaaaattttgaacaaaaaattgcaaacgaaaagaataaatcgttgctaaaagagccaacgaaatttctaaggcagttaattggggaatacagctgcaagggttattgtacacagatcaacggaagagggaaacgtgacttcggttccggtcttatgatgttagtcaaaatcccataaaatgaaattttatgatataattttgctcaaaatcaccaaaattttaattctttatatcattgggtaaatagagagagaacactagggctatcgaattttacgaagattttaaaagttgattgcttttgagcgaatttatgaataaatttttgtgaaaatatttgcattcgaaggtttttgactaatgtcccatccaattactacagatcggtgaacaaaataatgccaatatttggacaaattttgatcgaagccctcaaaaaatcatatggtcaaacagtggaatataatgtgaaggaacaaaaactgtcatttccatcggaattgggcgaacatttgctgggacgactcgacgaaatgatcaaaatgttcgaaaagtaaatgataattaaatttatttgatttttgaattttcaacagggcttcctcaatttcgtcgtcagttggccaaattggccatgaattggactttttcaaaacaatccataacatcgcatcagcggacaacattttaggagcttaatataaagcgcagcaagtcaattccggccaaagtgaatggccaacttttcgaattgcttttgtccttggccattcgcctgacaatgcaaattgaaaatgatgagaaaaaattggcgaggaaatatttggaaacattccttcgtacttatcaaagtattgaaaaatcggagccacattttattgatgggtaattaattatttaattgcattttacgacgatttaacattttttgttttagtatatttcaattgcaaatgaattactcacataaaatgatagaaattcatacgacaaattggcatttgccatattatatgcaggagaaaaatatggagaaattaaaacaaaaaaatgcctatggtaacggattttttacttttatatttcgaaaataataaataaataaataatttaaatttggtgtttgtcagagaacttccaatttcttcttttgctgtccaattactctacaaatttttatgaacttttgatgattgcgaagaaacttagccaaatggagaaaaatcaaattttaattgataaaaaagacccaaaattttttgttgacattttaaatcatttgagaggtcaaaacaaatctgatcgaatttttaaagttgaaagcgaattttgccttttggcatttattgttagagattt

SEQ ID NO: 17479 - DNA, 3077 bp, Heterodera glycines
atgattttcattggcggcttcgcttctttgctcaattggttatatcttcgctttttgacctcctcttgtgatggaattcttcgctttggcatttttatggaaaaaaacaaaaggcattaaattacaaaaaaaagtgaatttgtcgaaagaaaaaggtgtcatttatttaattgataagattaattattagcgttatgttaaagtttgtttaatgataccaatcaaataaatgttcacactttcattttatttttttttcggattttctttggcatttttaaagatactaaaaaagagaaaaaaagcgcccgtgatagagcataacaattgtttagggggaacaaaagtcgtaatttgagccaaaatgtcatcgaaatgatcatcgttatgccctttgcagtcttcgcgcctaaggaattcgcacaaatatgaatcaaacactttttttaaatgtggaggtgtggccgcacaaccgaaaagtacctttttaaatgccattgtgcgtctcctaacaaataagcgatttcaaatgccaaaatttaagaattaattattagcaattttattcagttgtgttgcacaattaatttggtgtgtcatcattagaggacactgagcgaacggagaaggaaaagagtgcctaattgaggggaaagcgaaaagggacaacaaagggacaaagaaaagagatgaaatgggaagggaagggacaatcggagaaggacggacggaaaaaagaatcgaatgccaaaatcgaatcgatcccaaaatcggatggacatttctccgcctctcccatcgccgccacctccgccccattcgacccgccggatgtttctggggtcgtctgatcgttgatcggcccaccactgccatcttagcgccgggtgccgtcctcgaagaacactcctccgtcgatggcgcagtatttggggcagattcccttttctccggatgtgccggggggtccaggaggcccggcagggccaggctgtccgtctgcgccgggcgcaccgtcgggtccggccggtcccttcggtcccggggggccgggaggaccgtccgcgccgggggcgccagggggcccgggaggtccagggggacctgaaaagcgggttaattttgtgggcaagacatgcgttcaccttggtctccttgctctccagtctctccaggaactggtgcttctggggtcgccggcactcccggctcgccgggaggtccctgtggtcccgcttctccggggggtccaggagggccgcgtggtccaggctcgccattgggcgcatctgagccaggtcgtcctggagttccagcttctccgggctctcctggaggtccaggtggtccaggagggccgggcggtccctgggggcatggcttgcatgggggaggcgtcgtgggctcgcatggcgcgtttggcggtttgccgggcgtgccggggtttcctggtgctccaggcttcccgggtttgccgggtcttcccggtggtccctgcgggccgggctggccgggcagacagcagtcaccgcacgccggggccgcgttcaccacggggccgtagccaccgccagtttgacgagcagttcggttggacctcatgtccatgtcgggcgtcgacttcatatggttcacctccacgtaaatgtccttggctgagccctggagaataaaacgaaatgaacacagaatgccaatgtcaaaatgccaaatgccaattccaacggcaatccaattccaatgccattggaaatatgccagtgccaacccccaaaagcatttggcaccaattccctcttccctcccaaccttgcaaaagccgagctcgtgctgcatctgtcgccgaacgtgggctacgtaattgtacaccatgggcagagtgaccacaacagagagaacggccacgatggagaaagtgacggccgaataggcaacgaatttgtacgcccgaatgcgactgtccgactcggtcattttctctgctgatggctaaaccgaacaataaacacaaactaatcagcaatgatttgatcgcttttggaaataagaaacatttaatgggcggttttatcagatcaaatcagcggagggattcttccgccggtggtaattctgcgtgaatggacagcgaaaacgagaagcagtggctaataaccggggttaaatgggggggggggggcgtccgacgtggcggatccatcccgtttttttttgttggtctgacgaaagcacgcgaaagtgaagccaaaatgaatgccctcctcctcctctgtaccctcggacattgtcacctcgccgactgatcatcgccgatcagtcaccgatctttgaatcagtgattgatgcattgggggacatgcctttccgtccctttgccgtcctttcgctttgcttttcctttctttgcttttcgtttgttttgtctgattgatggactgctttgtcagctgaccttcagcagctttcgaaaaaagccgaacaatttgtctcggaattcatctcgcaaatcattccccgctggtcggaaaaggttttgcaggcaaaggacgaaaaaagtgacgggaaagagacgccccacccaaacagtgaaggaatgggcgcggaagagaagatccggcatggcagggcgaaagccaaaaagaaaaaggatggcatttttggaagggatggaaaaagaagagggaatggcatggcatgccaagggatgagggaacatcggcacatacaaaggcatgaaccatcagaacgccataaaaggcacggcactatatggcaccagaagcacgtatgaaaagcatggcaccttctccccgaagccctcccccttacgcctcgcaccctttgcttttgctgttctccgtttggactattaataaattattttgagagcaatgggaacggagagggggggggggggtgaatttgggggagtaataaacgcatttatgactaaatgaatgtgctgcttttaggcaaatcactaggttaagtacccgggcaacaagaagcattccctggaggggagcagaggcaaaaaacaccatacttacgaagggggcggggaggggagaagaagc

SEQ ID NO: 17480 - DNA, 1393 bp, Heterodera glycines
tttcccggcggcgcctatcggcaccgccggccccctgtttccaaaatttttttggaaaaaccgcgccgaaagaaaactgttttttgaaaagcaaagaaaaaaaagtcttcggcggccgaccccctttcgcaaaaattttggccgatccacccctcttttttatgtatgataccgaattcactcgcaggtgtacagcaagatcgctgttgcacttcaccatttgcgcatgccaactctcgcggcaattattggccaaatgcgtgccgacatttcaccccatctcgacatggttgagcatttgttgcgcaacacacccctaacggtggacgcggggcacgcctatttcccactgattgccgacattcacctcatggagaggatggccggtcaatttgccaaaaccaaactaattggtcatgccattacatttattttcagcagcctatgaaaagttcgaactgccactctatttgcaggctttggtaagtgtttccaccagccattgggccgtttgttgttcagtttggccttttacttgggaaattgccgttttagttggaactaatgccaacccgtgcggtgaatgtgaataattcaccggtgattttggaacgcgaaggtgttcgacgtcgtcagcgttttatcgaaattgtgtttagacaatttggggaacaatgttaactgtgtctttccaaattgttttaacaaaattcagagcttatcccggtgggggcggtgcaatttacggttttgaaaatttgtctattttccgagatttaaatgatacatccctgaaaactcatttgttcttgttttggtctctttttttttgttaattgccattttctcacatttgtctcgccttccttcgttttccgattcaaataaaatctttttttaattcaagtttttcataaaaatcgaaaatttgcatttttttttaattttcccacgggaaatgatgcgtggacggggatgaaagtagtgcacccactgtaattcctaaagggtgtcaatgtcatcttcgggttaagttgagttaatgagtgctttcattttaagcattgggcgtgaaaagccaataatgccctcccctctccgccgcttcggaatgcgagtgcctttctttcccctttcgtcctcttccattttctctcgtcgaaaaagactttaaaaaaactgttaattatcctccctgaaaggataatagcttcgacctttcaattctgaaagtaatttctgtccttttctctgccaattttgagttgggaatgactgagtaaataaacggagggtttgaaaggcttcttcgtatatataaaccaataatttctctcttcattcctttttgcggcctttttccaaacacttctttttacatgttaaattaatt

SEQ ID NO: 17481 - DNA, 555 bp, Heterodera glycines
agtgagggaggatgtatggtcatagagaggggtcgggagggttgggagagggacagccatcggaggggagaggcgacttgaggaaaaaaggagtgggggggggtttggttcggacgagtgataaattgactacggttgatgaccgggtgcctatttcacgccttgtcgggactgggaatgccttttgccgttctctgatgccgccccctcccggccaatttgcattccctaaggactttcccaaattgggcattcggcgcatcatttcattcatatccattgaatgacataatttttccatgaaaaatacagccattttcagttctttggaattctttattcaccaatggacgatggattcggtgaggaaagcaacgccaagggattggagcagtgcattggggaaacaccgaagaccatcgagccggagccggtcagttgtacttggcggaaagcgggaaaacccaaaacgggaggggggggaaaggaccgttcgaccccgaaagcacttccacaaagaggtgtctgatcacccttttaatttgaatcgatcaa

SEQ ID NO: 17482 - DNA, 1489 bp, Heterodera glycines
cgtcgtttattcatatttgcataatcctccacattttatcgattccctccctttttctgatccattcgttctgatcagcacatcactatcgttttcaattgactgtccatgcccaaaatgatcggcggaagcattttcgcggcgggcgtcggctgaaggtccatgcgcgagaggagggcacaattctgaaaattggcacagacccgtaaagcggtgcttttccattggctgacctcccctggcggagattcgccccagcaaatgtgacggatcagcaagtacggctccaactcgcccatttcccactcgtcctttgtttctttcagttcaaaaacgccgtcccctttcgaagatttcgtctcccccaaaaggtcgtctttgtcaatgaagccaaataaattggctaaagtgactgggcggttaagttttattaaagaattccattatatttgacaattataaattataagtaacatgaccatccgcttcccaaagttggatgaccgcctcgttgcgatacggcttctccattccctcgcggtaacggcacttcaaagtgccattgatgcgaaatttgacgccaaaagcgcaatgaatggaaaagaaaaggaagaagcagaagcaaaacagcgaatttgagcagaacatttattaagcgagaagatggaggaggaaaaggaggagaacaatttaagaaagaatgacattaaacgacaaaattttggcttatgaaaaagcgctgattcattcaaaaaatgtcattgttcgtgcagcttagccttttgtgttcttttttcaattaaattgtgcaagtatttaaatcgctgatttgggcattacggtgttgaagcaatcgatggccaaaatgccatttgatcaccaatgatccaatcactgttcattgtcagagccaaccttaatgtatcattagcagtgccatttcttcaaggtatttcattcctttgtttttttcttcttttcattgtcccattcaatgctttgtcagtataatttcgacttttgcccaacacattttcgaggatttgcttttttaaatctttaatttaaatatccacctttttttggattacgcccattgctcatttctttgttaaaatgccatggaaacgcttgtgccgtgccatttttgctgaggtcagttaaaatcgccttatctgtgctaagagaaacatttgcaagtatttcaaaaaataaccaaagaattgtccttttttggcgaaaataaaagctttgactctccacaattataaccttatgttgttatttcgctcaaataaatttatatgccaaagcataaaatattttattgcttttcccaaagtgtcaattccaaccgcataatgtaaatttccccgcccctttccccgtgtgccgttctgttcacgcatgaataattgatgcgattgacactttgtcgcttatacccttggtgaaccattgttgaacagccttaactgctttttatttg

SEQ ID NO: 17483 - DNA, 1363 bp, Heterodera glycines
  misc_feature (1267)..(1267): n is a, c, g, or t
  misc_feature (1306)..(1306): n is a, c, g, or t
cccccccaaatttaaaaataaataaatttcaaagaaaaatgggcaaattttttgaatttttcacaaatttttttatcatattcactaaatttccaaaaaaaatttgtaactccattgtaccattattttttgaaaatttgtcccccaaatgggaaaaatttatatattttttggcgcaaaaccgttacaaattttgcttttccctggggcgcttaaaatttgaaaaataaaatggagaaaaatttttcaatcaaagagcaaaaaaaaaagtttttgaatttcccctccgaaattttttttgggtattggcttggctttgcccccaatatttgccgtacttttgccccccccccccccgccatttccgtccaaagaattctcagaattaaaggcgcttttccggcttttccgccagctgtgacagtcttttcctttcagtttatgtgcctttgcttgtcattctttaaacaacaattacgaatttctctgttttattttgttgaaatacataatccctttaatgccaaaaacagtcaaaatgccaatggataatttttcaatggcctcacaaattgtgcctcggcttaaaatggactctttggccactgattcggccatcgacgacttttacaaagtataaaaagaagaagaccatttattattttgaaaataaatttcatttttgaagattgaccgaagaggcgccaatcgctttttaggagagtctctgctggcgatgttagcggataaaagcgacgaatgcaaagggaggggcgacgggaaagtaattaaagcgaaggcaaaggaaaagcggaaacattggccaatttagcacgtttatatggatgactcaatggccgaacgacgtatggccgaagagaatttgcaaaatgttcagtccgccagggcaattttgtccgcgcgcttttcctccgtttctgcgaatggaagcggtgacggagagaacgattccggcaaattgccaccaaaatctccgaggacaaattcggcagaacctcgattagacgcagacaaaattctgaacattttgctggtccgatcaaagctgatattaagagtgagtttattatgagaaggagtgatcgaagctgccaactctccgtgggaaatgagttttttgagcaaagagagggaaatgatttaaaatgggaaaacaaattggcaaagtgttacacgaatagtcagaacagttgatcagtggacataagcaagcaaagctaagtaatcacagatgagaagaaattgnggatggacgaagaataatccgtaaaatctgaacaactgnggaagagcgggggagaaacagaagacggagggatacacacacaacagaacgggggga

SEQ ID NO: 17484 - DNA, 2145 bp, Heterodera glycines
cggcaatttcataggcattcaggggactaaattgcaattgattagtgccaattagggtcattttgtgccaattcctttcgcttctctcaccgtaattggctttctcagcggtcgcatgtcgcacgcgtccagccattttgccaattgcatttcgtattcttgcccaattctgatgcttttcatttccgaaactttcgtttccatttctcgtccctcttcagaagcagcaaaaagctatgaaaaataataattaatctattatttaatggaatgttcatttaccttttcctcatccatccgacccaatctttttcgctctttcaaagcgtggaaatcatattgcgaatcctgcaaagaaaaaaaaatggtgggtattttggcgtgatgctaattggaaaaacccattttgatagttcaagttaaaaaattcacttcaattttttcagataaatgtccaaatcgccgatgggacgacgaaacattctgaaaaaaataaaaattaaaaaattaaattaaattaaaagtaaaattaatttatatgaaaaactcactgacaatgaaacgcaaaaaagaattatgggaaaaagaaaaacctggggaaacattggtaaatgatgaatggatggaaaatttgaatgcaatttaacaaattatttgtctatttaaataagcaaaattatcgctctaacaaatccaattagcaaaagggaggacccatttaaacatttgaaaacgaattaattttaattatgccttatttaaacgtaaacaataaaacgaagcattcaaatatatataaaataattaaaaattcaattcgttttcccgattgtcacgtcagtaaaaatagcacttctcatcaagcttaaaaagagatctttgaataaaggaacaattgatttatgctttaattcaattattattagataaaatttaaaattctttcgaattttcatttaaacaattagttttctgtcggaatcaacgcattcaactccattcatcactggattggcatacatttttttcctaattctctcgccatttccatcactctctctctctctttcttccgatcactctctcttccctctgatcacttttctcacctcgtccgatcactttagtccctctcacttttgctctgatcattccttccgcccatctgcccgtctgtttgttactcaatgatcatccagctttacctccgtattccttggtccggatggccaaaggcggatgattcgtttcttttggccacatcgactgactgaaaaatccccgggagaattccgaaatgcctccggaaaaatcggccaaatgccccggggctttcactttgcttattatttggtgggagagcatttgtccccggccatttttctcagcactttctcacaaatttcgcaaaaaatagcccatcattggggtgaggagcatgtgctcattaactaatgagtgtatttgttaaaaggaagggtaattaaattggttaaacaaatccaaccaccaattaattttttgatggccatttcattttaaaacaacttaaacatcgccgttatggctgaataaatttccaatatgcttttatatattttattaaaataaatgctaagattttataaacgataatgaaacgattcactgagaaaccgttctttcaaaaattaaaaaaagaacgacgccatgaaaggacgacaacaacacggacaaccacaacaacagaatacaaaaagtaatagaaagaatttagaaattaaataaattaaattattattgaattttgatttttgtcagattttcgagcagacaccgggaagagttcagcagcagcagtgagcagcatgaagaacaattttatggtgaaaatgaaaatggaaagccaaagtcattgcgtttcacacaatctttgcaggtgtttttttgggttaataaatgcccattccgctaattattgtcaattaattattaattaaaaatcaattttgtttggtttaggatgcttttcatcccaatttaatggatgaccatcagcagcaccttcttcagctttccaacgaatttaccccgctgcaacgcgagcctcggcaatatcagccgagaaaagccgagaggagcaaaaagtgttaagctttaaggaat

SEQ ID NO: 17485 - DNA, 2228 bp, Heterodera glycines
aaaatttaccaattgccaatggcaccaaaaatgtcacaattaaagacaattggccgacgcggagacgagcagcgaacgagtaccaagaagggtagtacttcgctggacagaaatgaaaaaataataattaaatttgctaattaattataaatttgggaggggattttatgggtttccacttccccccccccccttttcgacttaaaaatccattataaatcatttttcgttttgattccagaatcctctggacgtttttaaagacacagagaattctcaaagtttacattcatattcctattaaatttaagattagttgacaatttattttcccaatgaaaagaaaatccatttttcagacaccaaatatttaaatttatataatatttttgatatttcgagaatcaaatatatattttttcgttttaattaatggcttaagagttttgtgaaaatttgaaccaaatttctgaggaatttttatccatatattggcaaattttcagcgttttgtccacatttgcattttttttccatataaatccgctccctacttttttcgcataattttctttaatttaataaattttgcactaaaagcttacatggaaggccgagagcagacaaatctgaaaatgaaaagaatgacttttcaattgtaataaatttaatgtatagcattcataaatgtgatgcttttcacccatagaaaatgcccatttggaaatgttacataattagggaggctatttgtaagctttccataaataaccaaaatttacaaggaattcaaaaatctctttttttctaaacaaaagatatttttcgcaaaaaacgttaaatttagttggaaaaaaatttatggaattttttgtccggcgctgctaattgtgagatgcgccgctgggaaaaattttgaattttgcagcttttaacgattaatattttttaaataagcctctaagtagtactaattaggcgcctagcctaagcctatgtgcgagttgccttttgtacgattgtcatggcacctcttggttaggtacctgtgccctgctgctgaagtgccgtgccccggtcccaaacttgggcattatgtatatcaatgtgtgtcagagatggatggcattccgaggcccaaaaattttcggaaatcgtgaatccctgcccatcgtccctggtttgtataacaatgtgtcttaccaatgtccttcccttggttgaccttgctttttgcacatttgcacttccaatctcctttaccaaaagtctttattgcgccattttgcccatatccttggcaatctctctgggtattcgaattttcatttttgcaagtttgctgataaaagacgtgcttttccttttctgaatataacagattttcactctttatccaattttcccttttttggggcgaaggatttatttttatttttttctgtggggggcgcggcgtggtacttaccgtaacccttgtacgtctctcccgttgctgggactgtgtgacaccaaaatgtggaactgctgctggtacccaatttcggtaccttatccaattttcccttttatggggcgatggatttggggaggcgggggcagggcgtgtggtatctaccgtatcccttgtacgcctcgccctttgccctttgctgggactgtgttacacacaaaatgtggaactgctgctggtacccaattccagtacccaatttttggtacgcaattttcagtatcaagtttcagtacccaattttctgtacccattttcagtactcaatttacagtacccaattttcggtaccgaattttctgtacctaattttctgtacccaatttaaaatacccaattttcagtacccaatttacagtacccaattttcggttttcttaccgagcacacagacgagggcagcacagacaattggtccgtattcttttactttttcttctcgatgagaacagttactcactttttctttttcacttttgtcatcttctgtcccaccttccatgcattcgattgcttttgttggatgaatgaataataaattatttgaatttaatttaaaaatccgtaattaactttggcacgaacttttcctctggggttggttagtcccgtttttagaggaggacaattttctgttccttctcgcgggaatttttcccgctttgttctgacggtctgatcaccgtggagcagtaagtgttgtgacaagggcgta

SEQ ID NO: 17486 - DNA, 2730 bp, Heterodera glycines
attgaagtccgcgattaccaccatcagcaataaactcaaatatggaggagacaattcagctatgaaaaaatatatggatttaaaaaataatttaattaaaactttttaaaaatatatatttttaaaaaccttaaaataaaacataaacttttttcaactaagtaattcaaaaaaagttctctgcaaaagaatttttttattatttcgtaaattgctgaattgtccgtcccctcagttgactgttggtccattcacataagcttgaaaaaaattgagaaatttgcagtttcttacactgcgcggctggttagagctgttgtcgggcagcgaagagagtggtggtcaatcggtggccaacgatctcttcgacagagcgattgcgttggacaaaaatttggacgcctatttgggcaaggccaaactgatggagatgaagtatgatagattgatgagatgatggtgtttctttattcaaatttgcctcatggccgactcgagagtttcggaatcgagtcgagcatttaggtcccggtctcggcatactctatgggtcaaatccaagtgccaaaaatttttttataagaaaattctgagaataaaaaaatttgtatttttaatgatttttaaattatatgtgaaaagttttctgttaccattaccggtttgatttttggaaaagtcgtcatacaccaaattaccgactgttatcgttcctttaccgtaaccgaaatgtcgaataactcaattaactttcatctgatcactttgcccctccccgtaggcaaaatgctgtccaaatgcaggctgttctaagtgcccttcttaacgtaaatgcttccgttttgcccgcatatttggaaatggcaaagggtgcggcaatggcacgcagttgggaggcggcagcggaactgtgccaaagagcgtcactcattcaggcaattttgctttcacaaagattcacatgaattcaatttttttgggccctcaggctaggaaattttggtttactgtattttctatgaaaattttgactaaaaaattttttccaacagagtgactgtattcctgctcttcttcttgactttgttctaacgacattgattcatggcgaaatgtcaactggagaaacagttttgagagacttggtggaagcactgatcaaaatggagggctcaaaccagcgaaaactgatcgaaatcggcacaattttatgctccgttatgatcgatcgggaaacaattgcagaacaagcaaagtcgggcggagaatgggaacagctcagaaaactgatcagaaaaaccaaaccgttacagaaaattgactgatcgggcgattggattgggcaaaaaaagtcaagcgatgacattaaaaagccgcttattgttggccgaaggggacagaggccaggcaatgcaaatggcactgatggcagtgaaaatggtgtcggaggaaagtggggaggagggcgacgaaagtgccgttctcggtctgttggcaaagattggatgggagaaccagggcaaggacgtaattacggattacgaaaacgggaattcaggcatttctccgagtaaaaaaatgggattacggattaataaaaatatgtcccgcgtgaatgtcctgccctgtcgggaacatatgacaaaattgtgtgttgagggcataaaaatgggaattaatttgatcagatggaccatttggtaatttccaaatggatttatgaaacgtgggtcaaagatcaaaaatgcagtcattatgttaagcgctgatccgtgcccaactcgaagatgcaaatggccaaagctgcaaagaggcggcccaacaattaaattttttgcgtgaaacgcgcccgaaaataactgaaaatgcggtaaaaaaacaagcacaacatcatttgacattttaatttgttgccattattgaagcatttccattttttgtgcgcacttttggctttacgcgagcgaaagagcgactcggaggcgttcggccatttgcgcaattgcgtcgacattcacttcgatgcgcatcatcgtgtaggcaatttttagatttttttaaattacagtaacctgtattccaaaaaagccgtaacccgtataattttttccccaaaaatggcgtaatttcataatcccgtaccactatcaaaattttcattggccataatttttgccgcaaattttggcacaattaagacgggcaccaacactttctcagtgtgccaattggccaagctggacatcactttttgtgtggaagtctgtgaattgcttctcgaaatgagcagcacagtcagtgcggcgccaaaggaatgtgcgagggttttgacggcagtgcgcgagaattgtgccggtcggtgtgacccaaaaaaattcaaaaaaatatataatttttttccaaaatgaagggctcacaaaacctacatttttactcacaaaagccaaactcgcaatggacgacaatgcatcggctgaacagttgttgcgcatttgtgtggacaaaaacagtgacaactccgaggcgtatttgcttttggcacaggcattgattgatcaatgggggcgggaggggggggggattcgaataagtcagataatggatgagagattagctaattagggaaaattgataatggaggagggtgattgacggcggtttgaatgattaatcacccacccacacgcagattcacgtacaaaagaatgacctggacgaggcgtcaaagct

SEQ ID NO: 17487 - DNA, 1636 bp, Heterodera glycines
gttgggccttttttagtacttggaacgggagacgtcctgggaatcgaaggggttgtaaactttttttccctttttccacttttaaatttatttaattttcaatttttttaagcttttttcgaaaatttttttgtttttttttcggcaggccctgcctctgacaatgttttttatttaattagaaaaaaaaattgattttttttttttttgatttattttaaatatatttcatccttaaattttttaaaaaacattttcaaactttccccttattaatttaaggcgaattttgccttttttaataaattctcttgtgaaaaggcaaaaaaataggctcttttaaatatgcctatttaaattactttaattgctttcctttcgcttacgaccataccacgttgaaagcacgccatcccgtccgatctggcaagttaagcaacgttgggccttcttagtacttggaacggagacgtcctgggaatcgaaggtgttgtaagcttttttccttttttcacttgtaaatttatttaaattttcaatttttttagctttttttcgaaaatttttttgtctttttttcggcaggcactgcctctgacaatgttttttatttatttagaaaaataaattgattttttttctttttgatttattttaattatatttcatccttaaattttttaataaacattttcaaactttcaccttattaatttaaggcgaattttgccttttttaataaattctcttgtgaaaaggcaaaaaaataggctcttttaaatatgcctatttaaattactttaattgctgtcctttcgcttacgaccataccacgttgaaagcacgccatcccgtccgatctggcaagttaagcaacgttgggccttcttagtacttggaacggagacgtcctgggaatcgaaggtgttgtaagcttttttccttttttcacttttaaatttatttaaattttcaattttttttagcttttttcgaaaaattttttgtctattttttcggcaggcactgcctctgacaatgttttttatttatttagaaaaataaatttattttttttctttttgattattttaattgtatttcatcctgaaattttttaataaacattttcaaactttcaccttattaatttaaggcgaattttgccttttttaataaattctcttgtgaaaaggcaaaaaataggctcttttaaatatgcctatttaaatgactttaattgctgtcctttcgcttacgaccataccacgttgaaagcacgccatcccgtccgatctggcaagttaagcaacgttgggccttcttagtacttggaacggagacgtcctgggaatcgaaggtgttgtaagcttttttacttttttcacttttaaatttatttaaattttcaatttttttttagcttttttcaaaaaaattttgtcttttttttcggaaggcactgcctctgacaatgttttttatttatttagtaaaataaatttattttttttctttttgattatttaattgtatttcatcctgaaattttttaataaacattttcaaactttcaccttattaatttaaggcgaattttgccttttttaataaattctcttgtgaaaaggcaaaa

SEQ ID NO: 17488 - DNA, 1667 bp, Heterodera glycines
  misc_feature (1467)..(1467): n is a, c, g, or t
  misc_feature (1554)..(1554): n is a, c, g, or t
  misc_feature (1583)..(1583): n is a, c, g, or t
  misc_feature (1657)..(1657): n is a, c, g, or t
tccagcggtgccgataggcgccgctggggaaaattttgaaaatcttagtgtaatttgttaacagattatgtcgaaaaattgtccaaagttttttgatttttttctttttttaagaaaataaggagatgatgtggctctaggacaggggtgtgaccgaaaaattttcaaaataagagcataatgacaaaaaataagattagggtcaaaaaggcaatcttgcaaaattggttcgaatcagttaatatacaattttttataaagaatttattaaatattatgtttttcacatcccattatggattttaacaatttttggagaagaaattatcaaatcttacatttcggtgaaaccgtgctgaaaaaaacagattttcaaacaatttttttacggtgtatttttttaaagttggtgaatgggaggtgggtacggcggcgtcggaaattttttgaaaatttcagcgcaatttcatggcagattttctaactaaaatcgtaaaaacaattcaaaaatcgtaaggtgcgggcatgcggggccgaacattaatgcacagcacaacataaacctgctgttttcaccactaaactacaatacttaaataatataacttattatttcttaccaaaaaagtcattcttaagggtgtaagtattttcgtctttttcgtaaaatattgctctgacgaaaacgaaacgaaaatccaaaattttaaaaaccgaaaacgaaacacgaaaacgaaactcaaaaagtgccgaaaatgtatgacgaaacgaaaacgacacgaaatttcgtccagccctgactgggatcccgcaaaatccggcgcgggatcccgtcccgcgccgggctctattttttaccccccccccccccccccccttatggggcggggcggggcggtgaaggcttctcgaacccaaaaattttatcactaaatgcggtttttccctattcattcattaaagcgggacggtgagagccaagcggcgcatcagcagaagggctttagtcagaagcggctttcgtcgtacgttgacctttcggacagcgaagaaagcgacggagagagaaaggcgcgaagaaagagcgaattgaaagacgaatgctatttttacaatatgtgacaatggcaaaagggcggaaaaggaagcattggccattgtccacttggccaatgggcatcaatcattgtcattttaccatatcattgtcagcactaattaccattgttatttctatggcaaaaagcaattcgcgttgttttttgttgacaaaaaaatggtaaagagcacaaaaatggaaatttctctttacaagaatagatttaaacggtttaattttattttatgattgctagggcccgggtttgtatggatttacatattttttgcacactttcagcctaaaatcacgtaaatagtatttttagcttagtttgatgcttctggatgcctttttctttccatatnttcagggtttagtccatagtcggcattttcacaaaaattttaaaaacgcatcctaaagatggaaatttcttggaaaatacgcctctnaaatcgtaaaattttggaaaaaatactanaaagtgtgcataaatttctcataagcaagcctcgcgtaaaaatgaaatttttctgccattttttctaaattcantatttttcag

SEQ ID NO: 17489 - DNA, 1370 bp, Heterodera glycines
ttttcgactcgcccctttttgcggtcggccgcgactcggcccttcgccggtggtgcctccgcgtggtcgaggcaaaatacagcggaacggcggaggaaacgctgaatgggtcattccggggaaaagcgcaactcggcacagacggaggccaacaacaaccaggggagaagtacaatcgtaacggtaattagaatgaataaaaggcaaaccgaaggaaacggacaaaatcatttggggaaacaaaggaattccgagaatggcatttttgttaggcccacaagtacaagcagttgcgcgctctgttcggtctgctcacttacctcgactgggccatggtgctggtcaccgccttttcctgtgcttccatgctgttcgagtcttcgtggccaatcggtggcgacaatttggtgttgaacaacccttacttaaaggtgccctcttgggatgggcaattactgtaccggttaaagtacaccacaattcgcaaagccatcatagcatcatatttattattattgctaattttcaggcatgcgattttgtatttgtgcttgccatgaccattgagttggcactcaaagtcgtggcccatggccttttcttcaccccaaatgcggtggtgcgcgatgttggcggcgtaatgacactatttatctatgcgagttcattttggtttctgatttggatgccgaaccatgtcgagcaaaactcattggcacaactgctgatgatattcagggcaatggtcagtggtgaagcttaaaagtaatcgattgacagattgattattgttgctaattgattgtcggatgcaaacaaagggaaaagcgacgcttttccttttccgacaaattgcgattaatttgatttggagagaaggctgaatcaccgaatgggggtcatggcagttcgtacaattggcagttcgtacaatggagtttcgtacaattggatttcgtacaatgggactttcgtacaatgttccaattgcggatttcgtacaaaaaatatatataaagtcgattttttctttaaaaactcatttaacgacttgtttttattgccacttttgtgaatgtttgaaaaattaacacaataaattgtatttcctttcctaaaagcaagtatttaagttatgaaataattgtcgaaaactttcgttgaccaagttcatttgagtgagcaaatcctccaaaaaagttcccgaatgaattattattgtttgcgttattaatattattattttggatactcattagctcattacttatttataatttgcttataattgtcattttgatgaaaagtatgtgtcgctgtcactatcacttattttttaaaatttaatattgtacgaaacgtcaaattga

SEQ ID NO: 17490 - DNA, 2027 bp, Heterodera glycines
attgctctcttagggcgttttgttctcgagcgattgccttaagagaggcaattttctttaaaaaaaagactgattaaagctcaaaaaaacggtaacgggtgtgattaggtcacttcatcttcactaattggtctctaatgaatttcagtaattaaatccaatgattagccattgatctttccatacttcgccaaccaccgacacgtcgttggccaaatttgttgtcctctcaagcagatttccaactttgccttcttcttgctcaatctgtttagaagaatggcataaatgtaaggtttttagaaaaatatgcaattttaaatatttaaatttttggcccatgcctcggtcattcgctgtgccgccttcgttcgcagcttttttgccgattcggcaagttcgtcgctgatcgcctccaatttggctgcctctgctgagtccataagtggacgaaggcgatttaagtcagaatttagctggccaaatgccgtcgtccatcgcgcatcaaagtcggaaattgctaaacggcactttatggtaatgatctgggcatgtgggattttggaatggtaatgatctgactagaagataagccttaaattgcttgaaaaacaataagataaccaataatactcgagaataaggcattgagattcgagatattttcaatttgaatggaaactgacccaatttaagtgcatcttttccaatgagatcattgtgcagtttatgagctgtgtcctccaacagtgatcggagtgaatcagtgtccgcgtcaaaccgtgctttgagtgtttcctgaaaatttggtcaggtttaaggcattccacatctgacaaatatataattgttactcagatatcacatgttaaactatgacaaaaattattaatgatcagattcaatttcgaaagcataaaagtccagagtgatcgttcaataatgattttgatgatgattccgattttccatattcattacgttaataaaaatcggcgaatttgtaaaataaactcaatttttttgtgtccaacatttcattaaatgtcctattttcggtgccaactttttcaaataattaatttttggctcctattttttcatttgtgccaaacacaaatgttcaatttttggtgcccatttactcaaatattcaattttctatggccaattccataaattttcaattttcagtgcccaattttcctcccgttcggattttcctctcttatcattatcaactgctgctgattgtatgccacaccttgcttcgtgcctgatccaacgcgctgttgcactcgctgaccaacgcggaatagtcgcgtcgcagttgttccaatgccaaccgatgctttttggtctcggcacccgagtcgccgcccaatgccccttccagcttgtccatgacggtgaacacgttgtccacgccggggcccaacgcgtgcagtcgctgctgcagcgactccaacacgggcatcgacagggaatctggcgtggtctaaaagtcgaacagggaatgttccaatttgaaactgaagcccgtaaatttagggattttccctgctgggggaaggcttggagcttttatggacttttatttgttaaaacgccattaaaattgtatatagtattagaaaaaagtaaaagccccccggcaactaaaattaaaataaaatttgacaaaaaaatatttaaaattcaaaaaaatgaaaacatatgataagcttccatattaggggggtgggataggtaattagctgttttaattagggaataaacttggattccatctattggatataatagagaccattaagttaattaatctgtttatcctattattgttttaaggcttcttatgaattaagttggactttttcaatcgaccatagtcggcacttacactttcccggcaagggcacggcgacggatcgaaaatggcatttcccatttgtgccaaaaaaggggacggtacacaaaattttgaaaaattcactcgcgcagcaagcagaaccaattactactaa

SEQ ID NO: 17491 - DNA, 1104 bp, Heterodera glycines
tgactagagcaatcgaacgctaacggacgacctaatggaaaaaaatccccgaaggagagaatttaattaaatccattccttcgggggactgtgccgggcaccccggggtaagcaaaacgatataaccaaaatataaggaaaaattttttaaatcgttttttcacggcaccgttcctttttgatactacagcaatcagagtgctaaaattaagttgtaaataaaacttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgatttttttcagtgtccgtttggggtactcaaacaattatggggagcaaaaatccacgcagaattaagtacaggctatagggaagctatcccgaagggatcggtctccccataatctgggcgcatccggtcggggggactgccccgaaaacaaaaaatcgattttttcaa

SEQ ID NO: 17492 - DNA, 926 bp, Heterodera glycines
cccacctactggccgtcgtagtcgagtgtgcggcggttttttagcgcaatactcgatattcaaggctaaacgatttttgcgcttttaaattctttgtcagtttcccattatttcttgcccaagttgatgcaataatttttttttaatggacataaaacagttgagaaattgggcattgaaatgagtttacaagaatgataaaatgtgttttctcatcgtcgtcattttgtgccaatgcctccctttacggtgcctaaccgctcgtccaggtacagaatggcactgccgcccttcttggcactactcgccctgttcttcagccagtacttgcgccggtgacggcccatcagtgccgtcccatggcggcgccggcgtcgctccaggcaagcgagcagcagacacagcagcagaaatgcggccacaccgaaaaaggtgccatagaggccgagcagtacgagcagcacatccgagtgggtgctcggcaccggctcggctgtgatcacaattcgacgcggcgaatcgttggaagtctgcggtggtcgacgaccgccggtgccgtcgccgatgggagctgagaaggcgtgaaaatttatcgggaatccccacttggaaaagccgggacaggcgccggtgtttgatccggcattgttttgaaaacccgacttaaccggcaccgggccgagatatgtaaatgggcaaaaaaaggcagccaatttttctggctttgcggacccgtgccgtgtttctaccggctgaactaccgaccctaccctcttcagctacccaatttttttgatcacattagtttaataatctttgtctctgttgtccaagagggatgatcccttctctatccctggcataaatcattaatccatgccgtggtttcgtgtgcttagttcaccgccctctcgtgtttttcgaag

SEQ ID NO: 17493 - DNA, 2196 bp, Heterodera glycines
ctttgtctctgttgtccaagagggatgatcccttctctatccctggcataaatcattaatccatgccgtggttcgtgtgcttagttcaccgcacctcgtgttttcgagcttaggtcggctaatcctcggctcgcttcatttgtcgcaatgggccgtgccgaacccgggcttttgtttgagattcggtgccgaatgtcgtgctgtccctccgtcgattcgtctgtatgtaaatcgtcattttcgtcgtcatcctcaaaataatcatcatcttccgctgcggaagagtcgtccagcagctgtttgtccttcttcgcctcctcctcctccccaaaatgaggatgatcgacggcaccgttttgtggttgcatcggcttggcctgttcaccacgtggaatgtgttcaatgtaggcagtcactaaatgccgcagagatattctttttatttgtagcaaattctgccggaggagggtgaattaggtatactatcggcataaaaatgcctggcagggtgttttgttagataaaagcctaaaattttgtcctcagcccctcccccttggcactcacctcgcgcgccctgcggcgtcgttcttcccactgctcgtcccgtgctgtcctcctcctcctcgtcatcaaattccaagattttggcaaagtacacattgttggcatcggttcgcaactgttgaagctgttcagagtcgtcaatgccatgcggcggccaatttgttggcattctgtcgccgaccctttcatcggcatcattcggaaatttttgaattttgaactcagccggcgaatgctgcaataaaaaaaacttcagtagccaagttcgttttgtcgggccgataccgtatccaatgaccgtgtcggcgccgtcaccgtatgcgtcggtgttattccaacgccactgccaccggtggcactcgtcaacagttgttgcctgtcatcgcttaacaactgtatctctgtccgccttgacacagcagcagttgcctgttccgtcgccgtccactgtttgtgcggtaccgtagcttggccgttgatcagatacggtagcgagacggagtgatacagctccgcaggcccttccaccagcacagtttctggaaaatgcaagagatagacaggtcggtcgagaaagggaagaaaaagctcaagatttaattttttggcgtttcgttccctaaattccgtcgctaaatgcatggtcagcaactctgtttttctcacagctcgcttatttgatgcttcttaccacgtgcatcgggcaactgagttgtcgtaagcattgcgtctggccaagtcgcgcgcgtggcagtgactggtggtgcttctgttgttgttcgtgttttttggggttgtgtgtggccgtttcagcagatgctgatcaacttttgaagcagaaacacctttttgtgtcgcatcgggcagcaattggacacgcgtcggatgtgcagcgacggattgggcgcgactaaatggaattaggccgaaaattgttgaaaagtgccgccggtttctccggcgtaaaaaggggtgcaaaaattggccgattggaccaatttcgatggaatgatctcgcgtgatcagccgcgcaaaattcaattacggttctcgacaatttggcccttttggttttttacattatttctaatgcgttttttacctcctcccgccccaccaaatggcgtaacgtgtgtaaaagtcgggcggaagtcgagctgaggaatactgaaagtttggcggtatgtcgagcaggtcttcatccgacgagaacaggcgacgccttcctgccaaagtgccggacggcgcttaaaaaatttatttaaattttattttaaacatttttcggcacctgccccttccgccgatgtcgttgtcccatctgcttctgctgttggcattgtgccaacggcacgctttgtcgtcccccgtctaaattcgttgcctttcttttgctggtgatcgccctgcgctgaatgatgcggcgagttcgtcgacacgtcatccttttgttgctcctgccattgtgccatcattctgtaaaaaactgtgattaattatctcagtctaattattattcactcttaattagtctttgccactgttccgaagtgttagctaattaagcagttattcatttaaagaccttttcgctctcactgtccacttttgcaaattaggtaattaatt

SEQ ID NO: 17494 - DNA, 3672 bp, Heterodera glycines
  misc_feature (3603)..(3603): n is a, c, g, or t
  misc_feature (3636)..(3636): n is a, c, g, or t
  misc_feature (3654)..(3655): n is a, c, g, or t
ttaaagctatttttctttaagaatactttcgtttattttttgtcatcttttcttttctttcttttaatataaacatagatccaaaatccattactttttattttttacagcatcttaaaaatgattttttttatagcaataacgattgaaaatgttttattttattgtttatagcacattaaaaaacaaaaaaaaattgctttattacaaataatatttatacgacttttaaatgtaataatatgtaaagcaaaattcataagaaatgtcctaaaattcaaatttattgaatgttgttggcccatataaatccatattttgggtgttatggaataaatccatactacgccactggttcaagcaacttgtttttgcggcttagctatgcgagagaagccaaaaaatagcattttctctaaaaaatctttgttatatttggggttttggtacataaaaacatattgaacatattacggcatttttgagaaaaaaactgtaagaatatacaaaaaaaaaataagaaaaagtctcatttgttatctcaaaatcagacaaattttttcatattttttaatttttcaaaaaagttgtcaattttctgcagaattttaaaataattaacctcattttgaatttttgttttgaatgcaatcaatcaatcatcacaattaatttcaatatttttgagcaaataaagcgccaaaatgaacaaaaaacgttctctataaacaaaagcaataaaatttgtgaatatttgagcaattaccaattattcttgttcatttaaacgaacagctatgaaaacatttaaaattattaatttgcagaaaatagaaaaaaaaattcacaattacgtaattaaaataataactaattagttttttcactatattttaaggcgatataaaaggaatggcaaaataacagaaaggcatcagtcttacattcatttattaaatataattacagaatcaacattaaagcaaccttaattggcatttaacttataaaataataaataaatttaagtatagaaaaaaattaaaaaatgcactcgcttctgctgcttttcaatgtcacggtttacgtgattattttacttcatttcgtgcccaatgaaaatgggttggccagtgccattccggtataattttttagtctaattaaattctaattacataagaattattcaataaaaaatatatataaggcggctttcaacggaggcgacgcgttgctgttgagaaagaagcgccaagacgaagatggagaaggtgaaggtgaggagggggctggagatgatgccgagggtgccgaagaagacgccgaaggtggtgaggatgaagaaaaagccgacgaggaagatgaagcaaaagaggacgaagacggagacgagggagaagataaggaggataaagctgaagatgaggacggtgacggtaacggagacggcaaagacgacgaggaaggtgagtagtgtcaaatcggagacacatggacgggacggcacaacactgagtggtcttggtcaagaagcgatgttcaaaaattgcttttttaattggagcaaaaactaagcctcgtagtcgtagagaggcattttgatttcaatttgcccaaaatttaaacacaacgattgagttgagttgcagcaataagctgcagaagaactaagtttattttggtcgtatatattgaggaatgggatttcgattaacgcaattaggtaattagatgcatttatttcccattaatatcaataaaataatttaataaccaaaaaatagacgacgacaaagaaggagaagacaaagaaaaaggaggaaaaggaaagggaggagatgaaaatgaaaatggaaatggaggtggcggtgtgccgcaaccgccaagcgcaggaggaggtggcacttgcacggacaaaggcaccggatgtgagccaggcttttgtagcagcacagactttgctcgggcgcactgtgccggcacatgcaaacacgttttgcaagagtgcagtcatttggcttcggtgcccgacccaggtgggtgatgaactgttaaaatgttcatttattattatttttattaataatatattcgtgtttgttcagcaaaatcatgctccgacacgggaacgaactgcggcaccataccggacatttgcaccgtatgctttttatgtcattattaaattattggttcagtctcagctagagtgttgcgattcaaaaaactgttcccatacatgggaaaataaaggctttttgttaattctaaatttcagctacaaccatttttcaggatgacactttggccgtttgtggttgtgctcacacgtgcaatcgttgccatcaccaggcttcatatatggcacaaggaaggtgcaagaatgtgctgtaatgtgatgaattggcacacagattacagtaatgatgtaaaagcattttaaccaaccatttccaaccgtataattctgccgtacatacacaaaaaacgatttgtagtttatggcatacagtaaaccaataaaactattctcgttgattcattttaactttaaatcatttttgataaacaatagtggttataaacatatgaccatgactgtaaataaatgctgtcatcattcgataataaggctccaggaaaatgcgtcattaaaataaagtactgttgcattaaatcatgtattacaaggtcaagattgtataaaaatttcgttctgaattttttcaattaacttttttaaaggccaataataagcactcagggatcactttttaaaagtttttctttcaacaaaaacgacaattattcggtgtttaatttgccgatttttaacaaagatatattttttttcaatatagatgccaaagtggggaaatggcattttagcgcatttttgacccatgttacaattgttcaaaaatggcacttcaagaattcggctgggaaaatatcgcatgtcaacagaatttgtaaaaaaattgttaattttttgaaaaaaacgtaaaaaaaattccgactttttatataaaaatttcggaatcggaattctgaactcaaaaaatgtcagaaatcgtaagtcggaattccgtgccatccatggttaaactttactttttttttgacaaaacatttttgatttttaaatttttactcatttgaattttactttttatttacttcgtgaataaaaaacattgccttttctaagttattttgttaaaattgttcaacaatcgaaatttcgcatcaaattatgcagcgcttgcaaattttctcaactttcttttcattttaaaatattaggcatttgctttggaaatagctcacatcaacaattggtttctttgatttcttacaaattttcaatttcaaacttcaatttctttgctaatgtgctatgaagaaagtattaattttttgaatgcttttgtcccatataaattttgggtttatttgggaataaatccaaaaatttcgacatttccgcttcgtagtccattttttggatatttggccatccatcatcatctttgtctaccatatcaaaaacttattgtaatttttcagataatttttatttaaaaactttttaatganattttttcagtaaatcacagccatgatcatttntctctttgatttacttgnnaaatcatttttaattct

SEQ ID NO: 17495 - DNA, 2458 bp, Heterodera glycines
gatggactctttgcaagtgaatggcggagtgccatttggacgaaaaatgtatgcgcccgaggcctgaaaataatcaaaataatttatttatttattatacgtgaccttttggcacttattaatagttttctacaatattgtttgagtctttgtccaaatttttgcagttttttgatagaattttcaaattttttcgttttttaaattttatttttggccaactttgaaaattcaaaaaatgtgcagtgtttatttatgcaaatgccataaaaggacatgtaaacaagaaactctataaatttaaaaatgttaaatgaaattatttaaaataattgaaaccaaaataaaaagtcaaaatgcctgtcttggtgttgcattattggacatgccatgatagtacaagaattgttgccgaagttgaacagtttggttccggcgtaaatctgccacactttgaagcagcccatcggtgccaaaagtcagtcggaaaaacttaataaattatataaattaaaaaacaaaaacattttttttattcgtacaatcaatgcgtggcattattgctttcccaaaacagctatggaaatcggaagttagctaaatttaaaaatcttgtgaaagaattttattcactaaataaatcctgagtggtaattcatccctttttttattctattttatgtatgattactgtattaactatatcatatttaataataatgcccggagtcggagcctgaatctggacagatttttccgggttccggattttaaattacactaattacaaaatttattaattattaaatgcccttctgaatttaattggcaaaaggacgcaaaaacaatgtgattaaaaaggtcaaagaaaatgacaaattgaataattaattaattacttcatttgaaattgttgtcaattcgtcaccaccatcattttgctgctgctgctggttttgttgttgttcattgttgtttcgtttgcttgtcctcagattgtttttctcactgggacaaataattttttttttataataaataatttaaatgtaaaaaatttataaattttttttaaaattattttttaattaaattattttatatcttttaaattaataacaaaaatatagtttaaacaataggaaatagttaattattttatatacaattaaaataaataatttttctttagcataattaagaaaatcttgacatttaaatttaaaaatggcattattaaaataaaatttaccgtttttggccatctccaaacacaaaatatgtgcgaaagccaagtggaggtacaataacaggaaaaacaagttcatatggggccgcatcgtgatgcgaagaatggggaaaaggttgccaaaatgattttatcaactgaataaaaatggcaaaaaaataaataattaaaaaaataataaaaaatttatcaatgaaaatctgtcattaaataatacgtaatatatttgaatatatttaactatagaaattgtgaaaaaaaaacatttttttaatgcaaaagatacatttaaatattattataaatatttaagtttagtttttaaataaaaaataataattaattaaataaataattaaaaataatgaaaataataattaattataaaaacatgatcgagaaaaactgtccaaatataataagtaatattttttgattatatttaactattgaaattatgaaaaaaatttaaaaatgcgtatagataaaaataaaatattaatataaatatatttatgtttaattttttttttaaataattaattaattaaataaaagtaaggaatggtgaaaaaaataaaaaataaatttaataagcaatattttttttataacttttgaagacaaaaaatttaaaaataaaataaattgtttaaatttaaatattttaatattttttctccttacttcagcattaatttctttttcctgatcatcaaacactgtgacacgtctgcgataaaatggcactcgaattattgtgtcaaattgttgactcgttctcattgaacagagtcagtgtaaaattggcaaaatttctggggaaatttcaaaatttttttaaaacatttaaaactattaaatttaaattatttaataattttttcgtctcatcaatcaaaaaaaatgttttttcttacatttgaataaaattagatttaaatttaatttaattattctataatttgcactttgtggcctcgcaaacagtttcattgctaagccggcaaaaatggaatggacggatttgaattggcaggcccattttttgtggctaaatggccaaaaggatgcgttgaggacactctgacacatttttaatttaaatttcataaaaataaaaatagaattcaaagtttgtaagacttcagcatcttgccagccattgagcagttgtcgatggtaatcttgggtcacaaattctttgct

SEQ ID NO: 17496 - DNA, 1526 bp, Heterodera glycines
  misc_feature (1499)..(1499): n is a, c, g, or t
ctgacgtcacggcatcgtgatgtgtgcacaatgcttgagctgttccaaactttccaactgcttagaagcatttgacagaagggcaaatgatgcaaatttgcgtgaaagctgtcaaaaaaattataataaataaatagagaaatgaaaatttttttaaatttaattccattatgcttaaatacccattcttctaaaaatatttttgggtttcaaataaaaaataattaaatttacttaatattaaatagaatgtgagccagaaatagaaaacaataaaattgttataattcatggattttaaaattcaaattttgtgttcattttcgattttatcgtatttttcttattataaaaaaattatgaagcgcaaaatatgaaaaaaatatggacaaattaatctttttaaataattttatttaaaaaaaatcagaaatttgttatgacctgtaaaaatgcacttgaagctcgaatgagtcccttgatgcccggttttgaagttaaatagcctgtccaatctgaaaaatttattgaaagatatttttttagaaaatcgaaagatctaaaaatcacaagaatgattggcgcttgcatatgggaagaagtcatcagatttaatctgaaaattataattttaaatattttttaagtagtaagtttaaatgatcaaaaattatgaaaccttccaaaacactttaatttaaaaccaaaataattttatcaagaaatgaaagaaacatttgattaaaatttcgtttttcatggataatcaatccattattttatttcaaataattattattttttattttatagagcattattttactggtaattttggctgtgcttcattcaacgctttaacataacaagcaggggttgagtaaaaaacggtgatattatttgacagagtcttaaaaaataaagtttaaatattttatttcttaattaaaaattctggaaaagtttcggatttagtttaataaataaaatttttaaatatacatgtgtatattttaaggagtaaaataaattaatagatatttttaaatgaatatatttaattttttttttgaattttcatatttaattttttacctgtttatttgcggcagcaatcagtttgtccaattgtgtgaaccacatatttgaatttgtgtaatgaaaatcaccgcccattgttaacatcacatgcttaaattaatttttgtcaattttagaattaattttttcgcattttattaaatttaaatcattttttattcggaattaatgaaaactgagcaaagcacataattttcaatcaaataattaatttgttttactaatgcttttggttacaatagcgtagatgaaaaaataattcgttttcattgtggtgaaacccgggtaactgaagatatccaatttacacttacaaattattctgaaattttctacaattctaagcttaaaaatgacaaaaaaaatttgaaattaaatttcaatatttttggaccganttttttaaaggaattatagggagacaa

SEQ ID NO: 17497 - DNA, 2788 bp, Heterodera glycines
  misc_feature (7)..(8): n is a, c, g, or t
caaattnntgcgttcacttcttacaaaatcaagaaacatcggttgaatcagaccaaatagtgcaattttgaattttaatttccttttcaaattcgattttcacaaaatttaagtattttccgcatagcattgttgcatgtaattctaaatttggaatttttcttttgccttttggcatattagcaggcaccactagactttttgcaaaaattaaattacaataaatttgatggtcattttcaattcgaagataaatggctgcgccaaaggcttttgaacatgcatcagtaaaagcgtgtaattgaaatttggtatgttctgaaagattattttgaaataatttccgtggatatttgatctctttattttcccatgtaagcattagttctttccatttttgttcttctgaatcggataacttactgtcccattttaggttttttccattttcgatttcttgacgaaaaagtttagcagctaaaataattggagatgtcatcccacatgggtcaaatgttttagctatttgagatagtacttttcttcttgtttattatttggttcgaattttggcatttttataaaatattcgtcatttttgacattccaccaaattcccaacaatttgacagtttctttttcgattcggtcttcctttgggagtttttgaagctcacttaattcattcgacacaaactcacgcacattcattcctgctttagcaaacacctttttaattaattcataaaccatttgaaaatcctttttgtgattaattcccactagtaaattatcaacgtaaatattttgagccaattgcttaataatggggtggttatatttttctaaatgcaatttaatggttaatgccaattgggcagggctacaaatgacaccaaaagtcactcttttaaaccgataatgaattaatggactgtttgggtcgaatggatcctccacccacaaaaaacgtacacaatttcggtcttcaggtgctaattcaatttgatgaaatgctttagcaatatcagaaccaatcaaaatatttttttaaccgcgtgcgtaattgtatgccggttaaatcattgtattcattggtgcctttttctatgcattcatttaaggctgggtttttaccgcttttagcacttgcattgtaaacaatccttaatttagtgtgttcactagtttctttcactacgccatgatggggtaaataatgaattttttgtcctttttggtttgggtccaccaacggattagttatttccactgatccttggtcattaatctgttccaaaattgttttatgatataattggagtaattttgggtttgtgcgtaaccgttttaaatttgattttaattgactgtaagccattgcaaaattcgtgggcaatttttcggcctcttcttctatccaaagtaactttgattggtaccttttgccattgaatgaaatattttttatcattttttctctcatattttcttccttttctgataaatctccgaatcccacgctatttaaactgtcgtgttgtctaaccaatttaatcaattccttgtttttgtccaattccacttgatcagttatttcagtttcacattgtattgcacttgagtttatggctgatacgttatattcgtcctttgtattcacatttttgtcatttaaatttgtccaggtcacttttccatcaccactcaaaattttaccgattttagaattgctgatccaaaaaccagaatttaaatgtttaataggtctaatgtcaaaataattgtaaaaatcgctcccgatggtaatttttggttcatcgagtaaatatggaactgaaattttatttttctttaattcatgattatttatttcctgataatccaaaagggaatttcttttaaaacttttttaattgctcttccaatcattaacatattaaaatctcttgcttttaagccaaattcaactactgggctttcgaattttcccaaatttgctccacctaaaccagaaagttctaatttttgtcttccaatcactgttaatttaaggcttcttgctaattcttcttcaatataagtttttcgactgccatcgtcgaaaaatgctaaaaccctttttctaagtttttatttaatggattataaattgtgacatatcgacattttaacactgatattttatttggttgggtaattaagtatgatgctgcattaatactttcaattattttttcagccgtctgatatgttttgtaaaatactggtgagtgaatctgttcacaaaagtgacaaggaaatttaggagaacttttatttgaataatttgaaccattagagttatttgagctattcgaaaatttgtttttgggtatgttcttccctctttcccatctttcttgtggtcttgaaaatatttaattgttatgatccactgaatattctggagaggagctaaatctccgtctttgatcatttttgtttccaaaatttttgtgtttttgttcattttgaacttttttccattcctctctaaattttactgcaaaattcattgttgcctctgactcgtatttgttgtaatttacttttttgactcgtactgaccttttgtctcacttcttgtctgtttttaatttgctcaattgctctcgatagagcatttctaaatttggtagtattccaattttgattatcttcggcatcatttataacgaaatacttgtccaaaactaaaggtgataatttcccttcaagcgataaataatgaggggataaatccatg

SEQ ID NO: 17498 - DNA, 2160 bp, Heterodera glycines
  misc_feature (2097)..(2097): n is a, c, g, or t
ctctgtctccttaatctgccagtatctaattatctccccctttctaagggtgttgataaataatatacccgggcatataattagagaaaatacggtatgtacataagggatggcattccgccgaggctccaaaaatatgcgaaatgaatgtttttgggttagtaggcgaaatgtcaataggcgatatgtcggtaggcgagatgtcgagtaggcaaaatgtccgtacacacagcggcccaattttgtgctctcagtgcaaataggtttattatttatttagtaatcagaacgccaaaactttgcaaaacttaaaattttttggggattttcccttgtaaaaatagaagagccgatctcgagttaaaaactagacagctaaaacattaactgtttttacgacacttaaactgaaaaaaaaatttcattatgaaaaattgtaacacgccaccttttattcgaattcggaacccggattaaatagttgatccgtagcgattcgatggtcccaaaaactccaagaaacatgttttaacgactattttttccaaaaatgagggggaatatcaacagtagtacagggaaaatcttaattctttatttttgtttaaaatttttgttaaaaagatttcattttttatggccaaagctgagaatcgaaagctcaaaaatggcattgaaaaaatgcaggaaaaatttgataagaaagaggagcaattggagaagaatttggaggaattacagaaaaagttggtcgaaatggatcatcagcagaaagaacaacagaaaagcattgatcagatggaaaaggtgggaaaatgtgaaaaaaggaaaatgaagcaaattgatcagcacattttgaatgtgattttcttttttgctaaaatgccgtaaaagatgctacagacgaacgctgatgccgaaaaggagaatgatgacaacatgaaaaatgatcacaatgaaatggagaagaaaaatggacaaaatggagaaaaaattagacgcggtggggtcaaattataaatcacttacaaaaacacaaaaataaaaaatttttggcactaatattttaatgttttagaaaatagattgctttttgcaaaaagaaaaatctgttaatttcagcagatggcatttcaagaaaagcttgagaaaaatgtcatggcacaaattgatgtgaaagtgcagacgaaggaagttactgtcaaatagttaagggaaatgagcaatggttaattactgtacctaccgtaacattattattataattactgtcaaatattaataggatttgttccaatttaagttattactgaaaaggcaattttgattgaatcggtgaattgaagggacaacaaaaacaccaaaagcagcaaggggagaaggagacaaaaggcgagttgtaattacaaaattttattaagaaaaaacttcataatttcgaccttttcgcaattttcatgtataacttttttggtaattgtctaatcgcgaagtgatacatagaattagattcgaaacatgttaagctttcgaatgataccaacaatcttggatttggatgacaaagaaaaaagttatagcgaaaaacataaaaaattttgaaaatctgcccacagataacacacaagtacccaaaattgttacaccgccagatttttattttattttttatttttcagtttcgtcatttgagtcctaatgactaagaaatttcagttccgtctctaagattggcttatttttcggaattttcatcacaaaaagtcaaattttgccttaaaaagtgtaaaaagtcatgaaaaagtcacaaaaacgcaaaaaagtcataaaaatcccaaaaaagggtaaaaaagtcaaaaaaagtcacaaaaaatgtatgttagaagtagagtgccacgggaccgggaccgggccgggaattcccggtcatccgaggtcccggttcccggtcccgggttttgaaaagctcaggtcccggtcccggtagggcaaccgggaaccgggaaaaacagcactggtaagaatggggggtctgagtgaaaattagtgaagaaattggagtcaagggaaaataaaaaatataattatatattcttnaaagtaaactcctaagtgtgcaatggcctagtgctagtctcctgactgtcccttcttctttcc

SEQ ID NO: 17499 - DNA, 2812 bp, Heterodera glycines
  misc_feature (2731)..(2731): n is a, c, g, or t
agaaaccatcgccgccgtctcgccaactgaaagagaaaaaaagtaaaacgcgttcgacagccaagtccggttgaacttgccggtctcccattccgccttttgttcgtcggcaatgtccattctgccagaagtgtccccactttcgtctgcttcttcgccgtccccctcaaattaattggattatttgactctttccgccttctctcacttcctttttgctgaccacttcctcttccaaaatggaccttcttatctcctccagttctgccctttcttcgtgtcggtcctttgcgtccgcctccctttcgcgttcgtaatttcgttttctttggaacagtgctgagcccctgaacgattgtttgtcattttcctttcaattggtccgttttggcagtctcccacctgtaatacttcgggtcgtcccgttcgtccacgtaatcctccagaaactgtcgcagtttcttcgcctccttttgcagcgttttctgcctctgtttttcctcctctctctctttgtcgtataatttggccattctcttctccctctcctcccacttcttcagcctcgcctggtacgactcctccttctctttcacctctttcttcagctttcgcttctcttccgcttcatctgagtcctccgccgaactcaaacttttccttttggcgtttttcttccgtttgattctcctcgactctgtagaagatgtgctggaataagacgacgcatcggatgaactcgaagaatagtgacgggacctgcaatgggcgaattagaaatgcccacccattggccaactttttgcgatttggtgatttttgtgaacgttttttcttgtgtcgatgactggcgaccgaagaagaacgggactgacggccctccttgttcgaggcctgaaaacagaaaaataaaaatgcaggaaaatgccaaattcaaaggcgagtgaaattcaacttttctcaattgaaaaaggattttatgttaaaaagaaagacaacattggcatttgtttcactttcactcgcccttattttgttttggcttcccgaaaatgaatttcaattaatgaggaaaaggaaaaagaaagaataataaatgcaaattgagaagtaaaagaaaatagggcataagtaatgagatgtttggcatttttgcgcctacttacgaatcctcatcgtagcagcgcagcctcaacttttggtgaacctataatacttcggccaatagagaaattactgtgtggtaaattatacgaatgggtttggaatattcgtttaaatatgtcacatattcatgtgtcaaaaaataaattttaggagcgaggaatgaatgcaaaaaccctctaataaatccaaaattctgactattgaaagtatgtaaacaaaatataattctaaaaaaacgaaggaaatcaaaaaaaaagtttataaaggggagttgatgaccaaaatttaaacttaccaccaattgcccaaagaagacaaaaagatccaaaacacggtgcctaagaatgtttttatgcaaaagaatgagtgagaagggagggagagagtgatttaagaaggacggactcggaaagagcaaagtttaaataatgaaagaagctaaaaaccttagtgcttccttcggccgggcttttttctttggattcgcctgaattgtttggtcacaattcgccttccctcaccgaaaaccttcgtccgtcggcatgtccaccaggtcggccgcctcgtcctccaaaaactttcggatcgaagctctgacggcgtcgtcgctctcctcgttggcggcgatgagcttattcttggagaattcatccagcagtttctccgtttgttcgtccgcctgaaaatggccactatttcgctgactttgagcaccaaactcactttaacattcagacgtttgtcgccgatggggaagtccttgaggacactcagtgctttctttgctccgtctgggtacataaagtcgcaaaatccaaacgctttaaattttccgcctgagtcttggagacgtttccaattgcacacggaaccgcacttcttaagtaataaaggttttaagagaattaatttttacgaaaaacaagacctttagaacttcctgtatgattcggtccggacatttatcggaaatgttcccaataaaaactgttgtggtcgttggtggcccggtgggtcttgccaatggattgggtggccgcagttcctaaaatgaaaattacaaatgctatttatcatccttttagtatggtcttacactattttagcgagaataaatgaaccaaaagaaatttaggcggttttataataataatttatcgaattcaatccctatgtagacatataaaaagcacaaacccttggaataaaattcggacgaaaacgtggacggagcagcggaatcccgggcagaatactttgacgttgtggagaaaagaagccaaacttctgtccagggaattgaactaaaaaagaaacattctgacgaaatggaattttatttgcttttttacccgactgattcggaaggcgaggaagcaatggattcggaaaaggaggcggaaaagccatttccaatgttggattatacttcagtaacaagctgaacacaaagacttgtttgttaggtatttattgtttacaaacgccagaaatacagtaatttattaatcgtaagtgataaacgaacaatataaacagctactgacaaattggcgagtgattntctgttagtaccacgtaaatatggcggagcctagagatatgaaacagggagaaacagcgcagaggcagagagagggacagt

SEQ ID NO: 17500 - DNA, 1948 bp, Heterodera glycines
ataattatggctgttaatacttaatattcatcattatcgtgttaaaaaaacaaaaaaaaatttttccaaaaaaaagtgaaaaaattttcaaaatagtgctctttgcaagtagcgcccaaattttctaatttagcatttttggttcaaaaacagcataaatgatctcttatgcagtattgatggcttatagtttgtttccgtgtattaaaccgatttttaagaaaaaatctaatttcgaaattttgacttttcgattttttgttcgagttcgggtccggggttggaaattgagaacgattttcttatagaagtttagtcctatattacaatactaatgccatagaaatttattttaaaatatttgtatcactgacgcattttccactgaccgattttccggtcacgaatcaaatgcaatcaatcaataattagtcaatcgtttaatgaacaattaagtagctcgatcacctccttgaaagtgttgatccatgttatttcacaaaaataagcacagcaatacaattcattcgcttttccatttttgctcggcgtgtgcaaccatttggacaacgcttggccggcagttgcttttggcccatcgtcagaaattccatcgggtaaaagaccaccagaatcaatgaaattcaattgatcaagatcagtgagaagtgtcggcgatgtgcgacgacgcaaattgtccaaatgattggcattaggaaagcacaaatggcgaatgcttttcgcaaaaataggccaaatttcgcgggtaaaaacatcccaaattggttggacatccgtataaattgaatgcacaaacacttccaatttggtgccccttctgtcaaagaatcgcttcttggagcggagaaatttgatcacggaatggtcaatgtagctgaagaaagataaaaatgctttagcgtacacaaaagttaagactgactcaatccaaaggttcttaaagcaaattttgttgggcatctgacgaacagacaacggaaaatccacaaaactgccatcgattcgtataaacattttcggttttggcccttcctccttttcaatttcgattgctctccaaattgtgaattcgcttttgccatcaaaatgtgcgtccaccaaaacatcgaaacggtcggaaagcaatgccattttgaggccgagtttggcatagttaaaagatgggagaattgtccatccacacgtcgttacaaagccaactgagattcgtaaaaaaatgtatgggtaaatgaaaattttgtaatttaaaaaaaattccttaccgtcgattcatttttgtggctcaattttccctttttccaattgattggtgtgtcaaaaaaggcaaggcaaaactctgttgttatgtaacttaaaaagagagagttgggaaaaatgagagagcaaaaagaacgcaaaaacaattttgaaacagaaataaattcatcacattttttacgtgcttattaaaaaaaaattttgaatgtggacccaaacttaaagagtacccactttggcgccaaacgctataacatttttatttatcattcgaattaaaaaattttgatgtgattttaaagcgcttgatagtcgctaatagcctgcaaaatttcaaaaaatctagttgagatacaaaaaagtttggccaaaaacctaaaaaactgactttttctggccattttggcgcagcacgccatatcttttgttaaaacgaatatatttttctagcatcttgcaggctattagagaacacttagacctattttgcggcgccaaaatgtcccgcgccaaagtgaccccgacccctttgctttttgaaaaaaattaacgtcaattttttgttttgttttttattgctttttcataataatgtttctgttgaaaagcagaaatatttaaaagttttttaaaaatttcacaagtcataataattgtttaaaagtcgctc

SEQ ID NO: 17501 - DNA, 1876 bp, Heterodera glycines
cgcccggcacaagctctgcagcattgccatgccattgttgatgaattcataatcataattattggtgtttctttggtgccattgttttggtccgtgccaactttgggtggccttttctctatttcataacataattcttccatttatacgcgaaacattcttcttctcagcaatctgtttggtgaagaataccaattgcaccatcttctcatctctctcggattaattttaacatgttgcaattttatatgaaataaaaaaatagtcaaaaatatttttaaaattaaaaaaaaacaaattactaaaatttttggacttcagaattttcgcaattttttattaggcttgttctgctttaggcttatctaaatatattttgaaatatatatttaaaattttaacaattcattaattcggcttttggatttcgaaaaccataaattaaaatcaaaatttaaaatccaatttaaacgaattgttggattgaaatggcacaaatttaaacacttggattccttagatttgcgtttaaatttaatttccttcaaatccatcagttcctgactttggctcatcattagttttccatgttggcataatcagaaaaatttgcataagcaaccgttaaaagaaaaaaattttggattcatttttgttcaggttttaaaagtttaagtgatacttattcattttaagaaaacattcttttaaatgcttttagaatggtttaataaaatgatgaatttttatttgtttctaaattatttttgtatttaatttatttttatcccttttaattttatccctcataaaagcttcttcttttttgacccaagtccaaaaaagggaattgttttgtttttgtgctgccgtccattgacttgaattattcacacactcttctccctcccaatgcttttgccctcccccggcttttccttttcccctcccatttgtccctcctccgtccgtcgtccattcttcggccctttcgtcgacgatttattccccccggggattgtttgttgtggccactgttgatgaaacaaaaaaacattgctttcattggctatatcaaactttgtagattttcttttattctcagtcttggcttttttattgcaacaaattttttatccaaaattttaaattgtttaggccttaattccctttcatttttgctataaattttttttttgttcgatagtcaatgactttctcgagtcaagaattcttccacttcacgaagtgtcggtctcgaggccaattctctttgccgagtcttggagtcaattttcgtctcttggttctcgagaaacggtatttctcgtgttttttgtgtttcgcagtctcaacagcacaaatctcgagagtattcgccatcactgtcttgattttcgaactccttgaaaaatttcgactctcgaccagtcttgtgtattttaaaacagaaaagtcccggtctcggttttttatcaaaattcccagtcccgctcagctctagtcttatgccctctcattccttcctttatctctgctactcattttcatcttctctcgaactaagcttttctctccctctctcggaatttcgcagaaattcccgaccatcgcggtggccttcgcttcctttccagcattattctttcctctctctgctgatcattgcttccgatcaccgccccgcttctccgtcgtccaattgtttctctgggcaagaaagcttcggcccactgctttacccccgcctcccacaattcggccactttcatgcccaataaattttttatatctccgatgcacttccagaagaacaaacggatggagccgcggggataacgtcaatataatccaaaaaacaacacattttggagga

SEQ ID NO: 17502 - DNA, 1162 bp, Heterodera glycines
  misc_feature (1141)..(1141): n is a, c, g, or t
tgccctccccccccccaattcccacaaattgtgtctcaaattccaatgcaaaaagtcttgggatagggcagcgatttaagccttcatttctttatgtgaaaatgattcacacaaatattgcttcctccggcaaaactttcctttatttataaaaaagattctcctaagtttaaattaccatttaatgaatccctttcgttacattttattttattataaaatagttcctttctaattttgtttaaatcaaattttatatttttataaattttcttttttctttattttattttaatttttcttttacccaattaattccctcatggtgtttgtgcattttttacaacactttctttaattgcactgtcctttatttataaaaatattctcctaatgcttaatttgccatttaatgaattattttagttttttttttattttattataaaatattttcatatctaattgtgttttatcaatttttattttatttttaataaattttcttttaattttctttttctttttttacccaattaattccctcatttattttctggtgtttatgcattttttttcaacactttttttaattgcaagatctcctaatgtttaaattaccatttaaagatttcttttcgttacattttttattttcattattttcctttccaattttgttttaaatcaaatttttttctgatatatttttaataaatttttatttttttgttttctttacccaattaattccctcatttatttgttggtgtttatgcattttttcagcactttttgttaattgcttcccattctctctcctcccaaaactctgttccccattttctcttctcccgctgagattccctcttcttctcctgtaaatctctcctcccattcttcgtcgatatgcttcttctcagtgtttagctattcctccatttcttttggtgatttcgtggaataaaacagtgcgacaaattaactttggcatttgccaaagtctgccaaatgaaaaaaggtggcaaatccacgcaaaaaaaaaacgccgccgcttattctctgttctcattagcaccaccgacaatcaataattttaataaatgtaaatttctttttaattatattgcatttaaaccanaatgcttgaaaatactttttt

SEQ ID NO: 17503 - DNA, 2620 bp, Heterodera glycines
  misc_feature (168)..(168): n is a, c, g, or t
cccccccccccccctagatacgcccttggaaaatatactatttttttgttggggtttgcaaaacgcacaatttccggcccccgttggagtggtgacgagcgaggcaattgccaacgcaccggtggaggacaaccctaaaggaacaaagggtacaacagcactttacancatgctaaaattgttcactaaagctatttggaagtttgtgataaaaggaaacaaacaatatgcgccaaagaccaattttttgacattttatgccgattaatggacgagggagaggggaaataccatcgttttgattggtattggtgagatatttaccggaggaataagatgccaaattcaaattgccatggtggctgttaagggcccattttttgggacgaatggtggtcacctgccccgtacactgcgcaattggagcgcgtccggtccgccatgtcatgcactttgccgtaattgagttgcggaatttcttcatgcaacaactgttcatcgtattcgtcgccaccggcggacgacggcccatcggagggcacttaaaaaatgggaaataaattggaaaaatgtgccgaaattaaaatgcgccacaccggcggatgagcatgaagcagatgaggctgagaaattgcagtgaaaattgggaaaatgaggtcggcgttgaacaatggaagaaacggagggaaagagacgctgagggaaatgcatttttatcagcaatggaaatggacgggaaacgtgtcaaagctgaaatataacctgtttttggggggaaaaaaatttaaagttgcttttcgttttcgtttcgtacgaaaacggttaccgttatttatttttatgtttcattttcgtccaacaaaattttttcttttcgtttggtgtagatcgttttgtaaaaaatgccattatgatggcaattttttcaggattttggtcataatttttatcaaagttttacgagtttttcttggaaatgtttccggttttaaaatttctatttttgtttcattttcatgaaatattttcttttcattttcaaagttattttctgttttcgcgcaactctactggggattgacggccaaaaatcgctgcttttatacacttttacattgcatttgcctacatttacagaagagtggctgctgcaaaaaatcctgtcttttacagaccgagttgatttgtgtttaaatatgccaaaattcagcaacaccttcattttctcattttttgtctccaacttctcgatgattctcgttcctaattgctacgctccaacccaactcatccattcatttaaagctttgttttctctcccaaggaaatcattgttttaattaaccaagtcacaaagtgacatttgctccctcgatcttttgcgtttcgaacatttgtgcccaaaataattacgcctaattgttttcggctcaaatgttcggactcaaatgtccgagttgctaatgtacgcacattctcgccacactcatcacaactcttttccttctcccactcacagttttccttccttctcttcacattcccaattttctcctcccctcccattcgtcgattaacgattaacctacattttgctttctctcctttccacatgtgttagacatcgctgcatctctgccttaacatttattcagcgcttattctcctctaaatttcatttctaattttctgggtctttccaattccatcacttttctttcccaatgtaattgtaatgtcatcattttcatagtaaccgtaatatacataacatttgaattatcttttagcgatcgaattcaacacccattcaatttggctatcatgcaaatcttcgtcaaaactctcaccgggaagaccatcacccttgaggtcgaggcgagcgacaccatcgagaacgtgaaagcgaagatccaggacaaggagggcatcccgccggaccagcagcgccttatcttcgctggtacatcgacttttcatattcctcaacttcttaaactaaacatcccttcatttcagggaaacagctcgaggacggacggaccttggccgactacaacattcagaaggagtcgacgcttcatctcgtcttgcgccttcgtggagggatgcagatcttcgtcaagacgctcaccgggaagaccatcacccttgaggtcgaggcgagcgacaccatcgagaacgtgaaagcgaagatccaggacaaggagggcattccgccagaccagcagcgccttatcttcgctggtacatcgacttttcatattccgcaacttaatcataatcccttgttttcagggaaacagctcgaggacggacgcaccttggccgactacaacatccagaaggaatcgacacttcatctcgtcctgcgccttcgtggtggaaagaactagaacgacgaacggaggagatgattgatccgtatcgatccatatattatgtaacttgagaccgtcctgtattgtgttccgttttattcatcatcatgaaatgtatttcaatgatcacggaacgataaacccatcaaaactgtcttatcttctcccgtcggaaaattaaatttggtattttctgtgcaaaaaatgctgggttatgagtttacaaagtaattggtaga

SEQ ID NO: 17504 - DNA, 3083 bp, Heterodera glycines
  misc_feature (2998)..(2998): n is a, c, g, or t
  misc_feature (3049)..(3049): n is a, c, g, or t
actttgcgcgaattgttcgtttttggtaagcctttgttgcgcacccattctgtcagctcttcgttcggcgagtataagttcgtaatgaagaaaatcgagtggcacatctttcccgtgttgtttaccaatttcgtgttgtttaccaattccgtggtgtttaccaatttccctttgttttccaatttcgttttgttggcattgcattcgctgctctcgtcgcaattctcgcaaacgccttcccactttttccccatttttttgcaaatgctgtccaatttggcgctgcaattctttcccttctcggcacatgcgttcaccacaaattggtcgttgccatcctctgcaatttaagcattttgaaatgcattagtaatttgcatttttaattttcgtgcattttctaggacccggacaggggcgaggctcccttgggactttaatttttggggaaaattgcggcacggggaccagaaaaactgggctttcttgaagcgtgccaccgtttcgcactcattttttaaaccttttggctctgatactgtacttttaccatttttgcatcggtacgtctgacagccgacacttccgccctcgcacacttttgcctttggctccctttccattttcaatcgcttaagcagtgccgtaagctttttggtcatatttgtgttggcagtgaaggcatatacgcaagcgaattcaactcaattaaaaaataaatcgattaaaatattacaattgtttgtatttatattttttatttttccccctacccttttaaagcgcttgataatctctattttaaacatagcataacaaaattcaaaaaatttgaataaagcacaaaaaatgttatggctgtgttacggttttaatgtgttacaaaaatctccaaaaatattataaatattggcactaatgtatcacccctaatcaacagcaaagtgccaaaataagttctaaaaactgaacgaaaaatgtcagttttttattcttttaaatcattaaaataaagatattagttaatttttagaataggcccgtcgtcgaattgagcatttaaccacattttgcggttttagtgaggccaaatccaatctctcaccgtttgtctttccgatttgattttttgctttggtttagtgttttgcttttctgatcattcattccctgctcttccgtttgctgatcagtttgctcatttgtcactgatcagtgagcaatcactcacctttcttcggcccctccaacttcattctgtctgggtcgaggcactcccttttacgacacgttttacagtccggtttcccatccaggcaaaaggggtcaaaatctctgtggctacattggagccccgtcagatcgtccggcgttgcgcacgcagtgaccaaaaagaaatcgtggccatcttttcctgaaaaatggccaaaaataatgcatgctattattttatatataagagaaaccagattatatggacaaaaattcagaaacttgaatttaatattgaagaaaaaatcgagaactctgaattatggaaaaattgaaaatccaataagcttcaaccaagctcaaatagtaccaaataagcttctaaaaatggaagttcaaaaacccggactctaaagatagatttctaacaaatctgttgaatttttaaattttaattggcattttcttaccgtctttgcaacggtaagtttggcacgccacaccttcttgacagggttttatacgccgcttttcttcaactccccatttctgcaaaaatgacacgaggctgcctttggtggactccgacaaatcgttggaataattcgccgagtaaatgcacctctgatctgaacaatttcataaggagccgatcaaacgaaaaaccgctttaagtgaattattttttgggtttttaataaaatattttttgtctttaaattactcagttttaaatgggatgcgatttcttatgctttttcttaaaaagtcttggctatacttatgttagtgcgcggaattcttgttggttttcgaaatggatcagaacggagcgggcaaaatccgtatgggaggctaagttgagcagatacaaatttaaattttatttctcatttatttgagtctgtactcactcggcttgctgcggtgaaatgccaaaacgacgaggagaaagaggcggacaaatttgggcacagagaaaaaggccaaatttagcgggaatttgtgcaccattttgacgggcgagcgattcagctaatgagcaaaaaaaaaggagataaaaagtcaatttgaccaaagggttttttaagacatacgagaaattgcattttagaaatcaaacagacttagagcaacaaaaaaaagaaaatgttataatgccctaaatgtttttgaagccgcaaaaatggcagtgccaaaaatgactcaaaaatataagaattcgtttaagaatttatgagcgatttcgaaaatttattttattttttacattttagaacctactaaaatttatgatgtattaaattcaaaaattatttattacgatttgaataaaaattgaatgatagtaagtaaaaataaatagcaaatgggacggatggacgggcaaaaataaagcgacgaagccaaaaaatggaaatggcaatggatggaatgaaagagtgaatcattcattcattcacatttatctgctgatcagataaataaatatgaataattaattaatattccaaatttattatacaattgttaatgttaaatagtcaatgaaaaaattattataattaaaattaattattaaaaatatttagggattccattttaggtaaatgttcgggttgtgcaccgtccgtcagttcttagccaggaatatcgaacggcattcgactcggctgattttagactcctcggatttcggtttcgttacattgttaagaaacgcgtcagcatgctacgaaagggacggttaaaaattgcttttatgcattaaattttcctttgctcngacattttagtctatatacaacagggctgggcgtaactggattttaattanggaatctgtaattacggcgatttcctaaattaaa

SEQ ID NO: 17505 - DNA, 1683 bp, Heterodera glycines
aaaaaatttttaaaacagcaaaaattaataatatataaaaaaatttcatgtcttaatatctgccggattaaaatgaatgaagaaaattttaaaaataaatctccattcatagccaatattattttgtgtttgtaattcattttggccggagtttggtcgatatttggcattatggtgattcctttgatcggattagagtcaaaaacctgaaaaatttattttaattaataaattaaattttgaatttaaacataagggtgaagattttaaaaagtagtttaagaaaaaattaaaagttatatataataaaattaaaattaaatcacgcaatttattattaatcccaaggaactcattaaacttgtctctataaaagaatggatacttacatcgtttttaatttaatttcaattatatgtatgagttctgccaaaatgaaagaaattaagacgaaaaataaaacaaaagactgaagaaaataatataaaaaaacaaataaatttaatgaactgaataattaacaaaatatataatgattaacataagcagctttattttggtaatacttcaaaacttgtttaacatattcgattcatttaaaaacaaaaaaaaatagaaaaaaagaattgcataacatgaactcagaggcatactgggtatggagcaagaagtaaaattaattatttcgagtcatgctcgtgttttgttgaattttaaaaaattaaattttaaaaaaatttcgagggacaagaacttaattgacaccctaattaagacacagatttttttaatgtgtttgataaattaataaaatcagataagtctaagttaaattataaataaatatgagaaaagcgtccgttttgtataatggaacaattttataaaattattatttaaaatttcacatggtactaaacaaatgggagatttttaaaatgtcgttcaatgaaaggcagactaatgacacaaaaatttgaataaatacacaattgatgatattaagaggtgtaaaattaaagaaaattgatgcttaataatattattcatttatgaatttaaaaaagttagtaacataaaaataaaacttaggaattataaaaattttatttgtattatcttttgatattttaattaacaatatcacccatcaattcaaaagaaacaaatgaataaatagcctgcggaccaaagacaaattgacgagcactcgtgttcagggccataccctggcaaaaaggacgatgaaaaggcaccgaagtggtacctggtcgcccaaattgttgcaaatggcgtggttgcagcacgtgcacagctggcagagcaatggtctgccctaatttgggtggacaacgacattgcccaaaagacttggcccttggaagtcggcgattcggtcaaagtggtcagcgttgaatggacacagacggcaacgggatgggcaagcgccggagattggctgatcatggtcaacaagcgcttgaatcaccaagccgtggccaaggaggtaagtgagtctttccagggacctttcagctcggcggcgtgggagcagttcgaattccttcgggaaggagcattggaagccgttgagcttcgtcccatggtctcaacgcgtgcactgagagaacgagcgaacttctgaccaaaaaccgctgctccatcatcaccaaggaccatgga

SEQ ID NO: 17506 - DNA, 1516 bp, Heterodera glycines
cttcgaaatgagatctttgtattttccacaactattatttaccactcttacatagacagctactttttcatatattttttttattaatcttatttatatgattccaaaatatttatttgctttgcaaatatgaataaggacaatagcaattataatattttttaaaaaatctgttgtatttttcttattgctattttgtaatattttccttgtatacgatttttacaacttatgataaaaaataataaatttatctcatatcattttttaaatttaattttttattttttatacatacaataaaaatttaattagattttaatttgagacggttccattatctcacccaaattataatgtgtagatttttttctattttttcaaaatatatgattgatgtaaaatttattttatttaaataataatggttttcaataaaataatgttcgatcccactttgaacgagatgttgtttgagattatcattttagtgtctataaaattcgtcttattacattatagcatattcatttaaataaatataaattttgaggaataaatgctagtagtagatttatttaaaagattcaattaaattttgtacctggtttcatagcgaactgcttttttataattattattacatacaattttcaaaataaaattttgtgaaatatttcattttcagttttatttgactatttttattattatttgaaatttttttatttttggctatattattatttttattttattctttgacttcaaaaagtagtgtcgctttttgtatgggagcatttttaaacgattaaattatttttgaacatttttaaatgaaattgcttcctaataagcgtcacaccattctcaatttttattttaaatccattttttaaagtttattggtgataagtaatttaataatggagcttttacatttttattgtgatatatatttttgcaattcgatatttattataattcacccatttttatttcatttattagtgaaaatacattgattacaattaatacactctaagtttagcgtaagacaaattgggcatctttcgactccatgaaaccaactcttacacacttaaaaatgaaaaatatttatttttttattgatctgttttttaaatatttacattatatttgctttaatttaattttattttttatgttttaacatgaaactctcaaacaagtttaatacattattttaataatataacttgattttaatatttttttcctaaaaatacttggttaattttcaactgattatatgttgtcatatctacttcggcttggagaatatgttcaccgacggatcggtagttgtcttctttttcgatcagaattaggtcggtatctgatctccttagatcttttaacttttgttgttgattaaaggtgtcattctttacacattcttttattgtagtccgtcttgtttcggtccaagaatttcacttctctagtatcgatttgaatgtcccctgtttgt

SEQ ID NO: 17507 - DNA, 2401 bp, Heterodera glycines
agggtaattggtcagctaattaattaatgatggaaacgatcagagggaaagaagggaattttggagggaacggcaccggctatcaattatggaattaatggccaaaatgacaaacgaatggcgcaggtgttgtgcatggactgggcgcaggacaaacggcacttggtcagctcctcccaggacggcaaagtgatcgtctgggacgggttcaccaccaacaaagagcacgccctgacaatgcccaccacttgggtgaattcggcacttttccgcccgccattagtctatttctttcccaggtgatggcttgtgcctatgcgccgagtggtcaaatgatcgcctgcggcggtttggacaacaaatgttccgttgtgccgttggacccccaggaggacattctgcagaaaaagcgttctgtcgccactcacacttcgtacatgtcctgttgcactttcatccgttcggacaatttggtaattgctgggtaattaactaatggttgctaattaattgcccatttgtattagcttctgacgggcagcggcgattcaacttgtgcaatggtcggcttttgttgcggtccgaataaaataaaattattttggcattcagtgggacgtggagagcggtcaaatgatccaaaatttccatggccatcttggcgacgtttttgccattgacatccccaagtcggacaccggcaacattttcatttcaggcgtaagaatttggctatttttttgccaagactttcaaaaactcacagggtgccgatcgacatgccctcgtctgggacattcgaaccggacagtgcgtgcagagcttcgagggccatgaggcggacattaacacaattcgcttccaccccaacggcgacgccttcgccacgggctctgacgacgcgtcggtaagcaaaaaagccaaaatttaattgcatttttaatccctttcaaagtgccgtctctacgacctccgagcggaccgccaagtttgcgtttacgagaaagagtccattctgttcccggtaggcttttattggccgatcatttctcgacttctctccctaaggtcaacggagtcgacttttccgttagcggtacggttttagggttttcctttccttttaattccttcctttcgcaggtcgcattttgttcgccggttatggcgattatcgcgtcggcgtttgggacacgttgaaatgtgttcggcaattgattttgtacgggcacgagaatcgcatttcctgtcttcggtgcaggtcgaaaacattgccaattacttatacgaattcgcactaattaattcgctgtgttttcagtccggacggaacggccatttgcacggcgagttggcacgtgaccggaaaacagctattcctttcggacaaatcacttaacatttccgatttgcaatttattggaaatgccaaggacgaaaatgcagttgaaattgaccaatcactttttgaggttacaaaatcagtgattaacaatcatagaaagctgttaaaatttattaaagggcgacatcgattttgacgacgatgatgaggattacaaccccgaggctgatgtcggatcagaagatgaaagcaaataaagttatacactatttatttttgacaattgttataaaaacggacaacacaagcgtaaagaaccaaaatcgtaatgtacacatttttttttggcattgaatcaacggtgaaatccattctgctcttatgttctttcggttaagatactttgcacttgaaaatcataggttcccctttggtctgataaagcatagcattgagaagaaagaccgcatcatccaacacataataagcacggctcaagtcgccctcgcacaaatagggaagctgagaaatatgtaaacccacttttaatcatttttgggttttaaatgggtacttttgtccaccgaatcacttcgaacccattgggctccaatttggataatcgaattcacttgggcttcgaaggtcgttccttccgttggaatgtctgaagctaaattaaaacttcaaagcatgtaaaaatgtaatgggaacacatggaaaatcaaaattcacccggaagttttcttccagcggagacaattttatcgtcgaattcgacaaattgtcgaatagggagcacgacagaaagtaaaatgggacaattgtgctcgatggccaattcgtgcaaagaattcagcaatttttttgggtccgaaaaacgtggtaaataaatgaaagtttggattcaaaaacatttacatggtgtcggtcgagcagattcagtgccgttatcaacgaatatggtccactccgttgccacttgtccatcggcagaacggtgaaagcgcgcctggccaaccgccactccatcacctgtacaaaaggggggggggg

SEQ ID NO: 17508 - DNA, 999 bp, Heterodera glycines
  misc_feature (980)..(980): n is a, c, g, or t
aaaaagtgattttcttcatgttgataagataacacagaaaaacagtagaacaacagcagaataaatcaaataaaacaaatgatttgaaaattaattttctttaatcaaataataaataccatctgaaaaatgaagaaaagatgagaaatatttccaattttactattttacaacagtcaaaatagtttcatatttttaaattggaatttcaaactacagcagcaccaaatacaattagtgagtgattaattatagtttgaaaaacaaagaggggaaaggcggaaaagataaaagagagagagagagcagcagcaattgactttgttgtggtggatttaatttgaaattagtgggacgaaattcccgttaatgacaaaccgagagcacaaattgagttctcgaaactctcgaacagtccaatagaataagtgagttcaaaaaagtgattttcttcatgttgataagataacacagaaaaacaatagaacaacagcagaataaatcaaataaaacaaatgatttgaaaattaattttctttaatcaaataataaataccatctgaaaaatgaagaaaagatgagaaatatttccaattttactattttacaacagtcaaaatagtttcatatttttaaattggaatttcaaactacagcagcaccaaatacaattagtgagtgattaattatagtttgaaaaacaaagaggggaaaggcggaaaagataaaagagagagagagagagcagcaattgactttgttgtggtggatttaatttgaaattagtgggacgaaattcccgttaatgacaaaccgagagcacaaattgagttctcgaaactctcgaacagtccaatagaataagtgagttcaaaaaagtgattttcttcatgttgataagataacacagaaaaacagtagaacaacagcagaataaatcaaataaaacaaatgatttgaaaattaattttctttaatcnaataataaataccatctga

SEQ ID NO: 17509 - DNA, 930 bp, Heterodera glycines
taagctttagacgagacttaggcttaggcttgctgtggtttaggcttaggcataagcgtaggctttattttataattttttatcgtacggctgagttgtccatcagccgaattgtctcatcagctgagttgttctcggctgagttgtcatcagctgactagtccagaagccgtgcaacatgcaaccaacttagcctaaattttattacgcgcttttctggaagttttgacaatattttgtttcttttcgtgtgttggttgagaaaaaccccatttattgttcgagtgttttaatttgtaaaatggatgccatatccgttattcagcgaccgtgaaactccctaaaaattgttatttttttaaaatatttatttaaatatatatatccagattttgtgaatatattccccttccttttcaacgtcgtacttttttgggttttgggatgggaaggggcggggtcagcagaaccgagtgaatttcgattaatttcggaaggaaatagggatggtcagcaggtaattacaaatccagaaacataattacgaggtcgaaataaatgaaagtctttacacaatctgttcaaaaacacataaaattgcgttttcgccaatgccttatttatttatttgcaaataaaagaaaacattatttactctgacgcataaaacatgattaaaattaatcacttaaactttttttttctagtttttagtgcttttattctaattggtgtcacttgtgctaggccgatgcaaaaaaaaaaactcagtgattgctaaaaaaaatcacgaaatgtgattggtcattttccggaagcctatcgcaccactttcggggcaccaaaagtgcctgatccggaacgcagtccggcccggtcaagaacaatttttgttcagtttttcacgggctatctcacaggccgggtccg

SEQ ID NO: 17510 - DNA, 2615 bp, Heterodera glycines
ctcaatgcttttgcgtttttaaagttcaccttctgccggacacattccaatgctcgaatttggcgagtggttaattgcgcaaacaatgtcttgcacaatatctatccacttgtacgtgttccgcgccgtaaagtagcggtaaaggcgctctttgatgctacgattcgcacgtcggccattccggcatgaaattggggtgaagtgagcatacaaaagtgttcaacgtcttttgtgcggaagaactgctgtactgcgcgggcagtgaattcctttccctgatctgttaacaccttccacgggatatattttgatcttttgaatatacgatcaaaggcaatgatcatgttagcgctcgtcttggtctttacgggctcaacaaacacctgtcgactaagggtatcaatacagactaacaagtatttgtagccacggttttgtttaccaagtcggtcaaaaatagccaaatcggcctgccattcagtgtgtaagccaagtgccaatgttggcaatcgacggtagcgccgcttggcctgacgatgtagtgtgtatgtacgttgggtggctaaataattttggacatcagtccgattaatttggttggcttttccgcgcctctcagcagcggttcaacgctcgtgaatgatacaggcaaacttaggtccttgtacaaaaactcgagctgaagtttctttaaatccataatgatggcttaaacttaattggggtgtttttataatttcctttgccggattgaccttcgggaaataaatgcctactcaagagcggattctgccgtgccctttcaacaaattctttgaattcagttggctctttgttttggccacgcttgtccttgttcaacaggtgactaacaatgtcatcaacactgctggttataaatggccgcccaccggccctcaaaacttgcccttcctccgacacccctagagattgggcgtttttataaattaattttaagatttccgtttgggtgggttgtcgtttaattgaactcgatggccatggtatttcatcatcatcttcttctaattgttcaacattttcttttcgcgcacgcccaaccttgagatggcgacgcgtagcaacaacaattggtcttttaatgttgattggttttggcatggcgtcaaccacatcattcaaattttctaatttaacaccgacgggacgttcatcctcgtcctttgcgagcttgttgagacgcttaagttcctgctcatatttgactgccctttctgcatcatttatggcgtcatcgtttttgatttgtttaattctgttacggaccagcccaattggtgtaccgtctgacggtggcggtgctgccaaactctgataaatatcttcggggacaagcaaatagcgctttgtatgctgcattttttatttattttttactttgttacaccttatttataattttcaatgacatccgcaatcagcggaagagcaattgatgcaatgagcccaacaatagctgggaggccatctccgtgctgtagcaaatcctttttggcagagcgcgagcaacgtgtacgggcgagacgacgaagcacctgtgcatgagctttcagcttattcaaatgccggggacgcaaagggactcggccctttagaatgtataggcagatttcgactagacataaaagttgctcatcggacgcatctcgaataagggcattcgcctttttggcattacacaatgtctccaaaaagcatttatttattgttattatttgtgaccctttcattttggtaggtaaactatttgtttttgttcatatatatttgttctaaggcggatctcttccggactctctgggtgcatgtccatgagaaggtatccaaaattttttgcgcatgcgtcccggtaggcctcaataaaatgggcagtccttgacgggaaaaggtgggtggcgatggtgcgtatctgcaaagaacccgcaggatttcgcacaacgcaaaaatttggcccgtttgtccgctttcatcgtgtctggtgagtaaaactcccgtgctggaagaccctcaagacgttgcagcagatgttgtcgctgaatgtagaggtaggggaagaagggcttaaccgtcgcctgatggtggggcaggtcaaagctcttctcaccaacgcatccaattcacagaagaaataattgatgaagtctttgaaggtgactcgtcgttggttacgtcccgacagacgcatggagtaaatcttgagccccgttgtgcacaggcgctttggtggcatatttcggcgatgtaatgcctcaaggattagatggaagtcgtacttgccaccgttgtgcgcgacgcacaccgtgtgggccttttttggcccatgatgagtcaaaaaatccaaaaattggtccactgggtcgttgccgtcgttgtcgaatgagtggaagtagaagcggcgctggttgaatgtcggcgcctccactggcacagctgtgttgtctctgggtgcgttggcaaacggtggtgaagaccactgacgcaactgttgtcccctcaccatccctgtcatacagacgcatccagtggctcttcttccaaggccatcgttaacgctgatgcctgcctggatacaa

SEQ ID NO: 17511 - DNA, 1545 bp, Heterodera glycines
tttcgtttactttttgtggtaatttggtgcccaattcttttttccatcttagaaatgttgcttcagaaatacttaatcctttcgcaaattctttctgtttgccttggccatataattctttaaattcatcaaatcgttcaatgaattctctctttttctcatcatataattgttttttcattttctttttatttaaattcaattcatttttccatttttgtattaattttcgatttgttcctaataattttgcaattttcctctcaattttgctttgatcttttcttttgtatttacctttttcacgtaatttttctttaattgcattaaattttttgacaatttctctcttttgctgatcatttatattctgatcacttttaaaaaggttctgatccgtgtaatttcccatttgatcatttcggtcatttcccatttcttcacccatttgatcaactgctgctgattgtgagttctcatttcgttcatttagttcaatttttatcactttttcttctcttcttttttgtcccatccatcgccaaatatttcttcaaaattcggacggattttgccggattcaatacaaaaatattaaaaaatataataaataccacaaattcatttttacatataatgcaaaatatttagaataattactttcatcgaatattgcccatttttttctaatgttactggtattaataaaaatcgttaaatgtactgatttttctgatatgttctgatgaataggcgaacaatttcagcaaacaaattaaaaaatattattaatttaatgataataaattaaaaatacattttaaatatatttaaaaatatattttttaaattctgctttgaaacacactgcttggggaataataggctaacattggcttttttccaggattttcatttttatagtgaatgagtggcgagtgtaatttgtaatgtaatgcaatgtttttgccgcccgcaggcggggcaaatgaccgctaattagattatttcaaacaccgcccccccatatgtaaataaatggcaaaaatgtcaaaatatggacataaatttttcaaaattgaatgtaaaatttcttcaaatttattggttgaaatggctctaatgcagtttacgcgtcgcatcttaaaggagcacataataaatggaaacatgcataaatgagaatttaattgatttattaaattaatttcgatataattaatcgcattagaattcgactaaatgttacttaattattaattaatatattaaataaacgttattattttcaatttacaattttatttcttttgtcccactattctttctacagaaaaacctcaaacatcttcctcacatttacatcaaatataaactaaattacaatatataaaacaataaattggattattatgaattattttcactacacgtataaaaaaaaacgaatggaaatttattataacaccgacagaacttatgaccataaaaaagattcccttttagagtaaccaaaaaaaaataattaattttcccactcacttt

SEQ ID NO: 17512 - DNA, 2309 bp, Heterodera glycines
ttgatcctcaaaaattctgatcaaaactttcttagaaccagcaaaattaagaaaatttaatattattcggtagccctaagtattttcaagttgcctgcaaaaatttaaaaaaattcggccaagcttcaaaaaagctttggacgaaaatgtctgaaaacctgccactttggtacttttggctttaactttgttcaaagttgatgaaatttttttgaaatttggttatctaatagaaaacttttagggatatcgaatgataccaagaatgtttaatttagttgacttagaaaaagttgtgggctgtttttgttgaaaattttcatttgatggttttttatataacgcccttattgatggttttaacatattacgacatagcaccccctcaagcaatcctgtaaaaattcataaaatttagttaattttcaaaaagtgatgaggaaaaggttaaaaaacctagttttttgagtgcgtctgactatgcataagtagcctaagccgaggctaggcctaggccaaatatgctgagatttgatattttactattttaaagcttacatatttctttttacattttaatcgccgaacattttaggacttttaatgaaaaaatatcaatatatataaaatcattattaacataaatgaataaagaaagatccagaccattaacattaaaaaatcgaaatatttaatattaaaaaggggggaaagaaaaagatccggaccaaaaataaagaaaaatgaaaaaatcattaaagaagaaaaataccaacactattaataacgaataaaaaaaatcgactacatgttaaatgattattaacataaaagaataaggaaagatccaaaccattattaacataatagaaaaccgaaatatttattattttataaaatatttttatttattaaaattaaaatgaattccttcgaaagcaatgaaatggaaaaaggagcaattaaaaaagaaatacaaaaagagcccaaaaactgcgcaagaatgcaaagtctgtggaagagttgcgcgtttcaagtattacaaaatacagagctgtgatggtaagcgaaaatgtaaattaataattatttatttaaatttaaaattacaattaaaaatttacagaaatttattagtaaataacttttttagcctgtaagcagttttttcggcgtacaattgttgatcagcgaacattcatttgcacgaaatcaaattcatgtgtcataaataaaggttgcttttgcacatttttggcattttgagtaatttttaaaaaatagtaaaaatttttattcgtttgacccaaatgactttcgaacctcctcctaccccgtaaaaattcaatgaaataaaaattaaaataaattaaaatttcggctaagaaatgacgagtggtcgtgcgtgccgtcttgacaagtgttgtttgaaggcatgacccaacaatgtggaagctgaacaaagtgcggaattaagccaatcatccaatcgctttacgaacgccgtgcatttcttcagcagcagctgaaggagaatgaagaaaaattctgtcccatggatacagtaagatttaagcaaatacagtaacattttggattacttattatttgattttaggaaacggtaattgaaaatggcacattcgatcagagaaatgaaggtaagtcagaaccactggaaaatttattttaatttaatttaccagtaattcggcttttaataatgatataattttacggttttaatattaaattaaactcttttaatctaattaaatttttaaatcttttttttaagaagatgtgatcctcgttcgtatagaacgactcgaaaaattgctcgagggtcagggaatcctacccttatcccaatcctcgaacgggtcgaaaaattggtggaacgactcgtggagggtgagaatcggtatggacatcgatttggtgacgcccaccacacctccatcacttcggcccccaccgccaacaacggcatccaatggggtcaaccgcagccttttgctgggacggacgccgtgtcgcagatgattaccgaggcaatcatcaattccaaatagcattttgtaatttttaattgatcaattttatttgtttgttttcttcttggcaccatgtaaaaatttttttcatatacttagggtgtaacataagttctgtcggccttaattattttaaaattaaaaaattcataactccgtaatttctacatttattttaataattctttttttattttgttcgtcatagtgtcctattgcaattcttaccatggtttcactttttctttgctt

SEQ ID NO: 17513 - DNA, 1148 bp, Heterodera glycines
  misc_feature (1064)..(1064): n is a, c, g, or t
  misc_feature (1112)..(1112): n is a, c, g, or t
aaattcttttggtttattttttgtctttattaataatgagtttttttgtcttattacccgacctctctggagaagtgcgcaataaattggcacagattggcaaatgattttttaaaatataaagtgatgggcaatatatttaatgaatatttaaggaaataattattctagccaattttttgtttcttttaaaaagaggccgaaaagtggttctcaaattggaaaattgtgggatggccccgaaccctattcctgatattttttatttaagtcagtagaaataatgatctgatccagtttttccatttatttaggtttgccctaaatttcaggtcatttttcaggatagtttcacaatgatatcaatggccaacgttactttgtcatcatttttgtcgtaaaagcgattgctcgggtccattaattccttaattgcccataattaggcgccaattaaggaatgccattttccgcaagtgcaatgaaagaaggcaatccccagcccttaagatgaattgctaaaaattgcattgaatttttcagtccgtttttcgccccactcattcgcgagacaatttggaacgatgtcgaacaaacacagctccaatacggatcgtaaatttgaaataattgttttttaataaatttaaatgatttattttattttcacaccttccgccgttgaatgggtttatacaataaaaggcaaagtgatacacatttcttatcaccattatcagtgccatctctgctcgtatttattcaatttttcatgacagtctttttatgttcaatgtttcgctgtatcgacgactctccacttgttcaagcgattatttccaaattttttcaatgtcaattgaagagtcccaaattctgaaattcgttaacaattcgaaaattgcagtgggtacagtatgcggtcggacggatggtaatggtacttttccatgccgatcacttcttccgccattaaaaccctcaacggaacagtaaaaaaaatccagtttcttgacctttttgaaaatggcaaataaggaaattactccaaattttcagacaanatttgaactatcacacaatgaaaattcaaccaaatgatttttctattntaatattaccaattttcttcgaaaatttattttttt

SEQ ID NO: 17514 - DNA, 613 bp, Heterodera glycines
gagaaaaagaagttttcccagcatcgaggctgatgaaccctttgattatttaaaaagctgtagttaagtcagtgatttttcttctttcttccaatgtgagtaaacccgtgatttttaatctttccccatatttttgtacacaaaaccacattttgtaagtgcttttcttgtaaaaaatttttgtacccgctcaattttgtgtatatctttttttaaattagggttccaaacttcggtagcgtattctaattgaggtcgtacaaaagttttataggctgctgttagagtttttatttccctgcttttcaacactctcaaaatttagaaaattctaagatatgcgtttcgtataattttgcttatgtgttctgaaaaattcagtttcgagtcaattataattcccaagtcacgaacattatccgattctgaaatcctttgtgagttaataaaatattcttttttcatattatttttccctaaatataaaacaaaacatttttcagttgaaatttctaacccatttatttttgaccatttttccatagcctcaattgctttatccaactgattcaaagggtcatcgttttcatgtgtataatataatttaacatca

SEQ ID NO: 17515 - DNA, 3090 bp, Heterodera glycines
aataatgacggaggggggggggggaggtcccgcaccattgaccacaaaaataatcacccaaccaacacaaaagggatttatttttgtgtttttccctgtttacatgaagaaaattttgtcagcgcgatttttggttctttgattttttaatatttaaattttaaatggcaattaaatggagaataattaattttttgtcttactaagagtttcaaaaactccaaaaaatgtcgataaattggggacacaatgaaagttttttgtgcattcgaccgtagggtctagtcgaaattttgttttaagaatacggtatgtgcgcccaattaccatagacacggacagatgccgtttaaatgaggcatttttttggcagctaattacttaataatcctgcggataaaatatgtccggacttggatatatgaaatgcaaaaagtataaagcatcacaatatagcataggcacatgggcttggtctttcataagccatctgttgctgttgtggtttttttttcgacgtcatcatcactctctgtgaaaatgatcggcttttaaaaatatttgatcgccattttcttgaaaaagcatcgaaaatgatcaataaagaacacataatttatttatttattttataaattattttctataatttaatttttgggaattaatagctacatacaacagatatgtatatttaagaattaaaaccgtaaaacaatgaaaattaaaaaaattactaatatcaaaaattaaaaattccattttatgcaaaaatataaaaataaaaactcatattaaaatgcaaaaaataatcaccatttttaatggaaaaacattaacctgtgagaacaatttatttgttgaccatctgccaaccctcaattttgcagaaaatttcaattgcccatttttagaaacttttgtaaaaaactaaattaaatttggtatacaaaattttacaaaaaatctacaaatcccccataaatgaaaaaaattccaaaatggggacgggagaagaaaatgtacaaataaatcgcaaatttgtggacgggaagaatgggtgtgaatgaatgtttcggaaggaacaggaaattcatttggggaaggacgagaacgatgggttggggttcttcaacgacgacgacgaggaaaatgtttcaaattgttgagggacggaaggatgacgagggaaaatcaaatcaaatcaatcgagattctcgagaaaatgaatgaatcgtcgagaatgggacaaggacgaacaaaattttcaaattttttcaaaatttaattacactaatttgaacaacagatggttttcgtggcactggcctgtttattgcgcaactttttttcacctttttacacattgggaattataattgaaaatttaagcaaatttttaatttatggcagccaaaagttttcaaaaaaataacaaatattttcaatttgtaaaaatggaatgaaaaaatgataatatgtatgaatcgtcgagaatgggagggaagggatgaacaaaattttcgggttttttcaaaatttaatcacactgatttgaacgacagatgggtttggtggtgaaaccggcctctggccggtttattgcgaaagatttttatttttaatttaaaaaaataaaaaatcggaaaattgaaattttgaattatggaagccaaaagcttttttcaagaaaaactcaaccattttcaatttgtaaaaacgaaatgaaaaaaaatgataataagaagtggatttaaaaaatcccaaaataagtgcgaaaaatgtttaattcttggaattgaaatgaattatattttatatttcttgaattaaatgcaaaaaaaaagtttttttttccgtgggttcaaatttaagaatgcggtaatgctgaaaattgaaaaagtcaaagacgatatttgtggattcactcttctgggataccaattttcagttatttaaattattcaaaaattacccaatttaaattttatttatttgatttatttcttatttattatcacagactcactgacttttacccaaacattaaaaaaattatggaaataatttccaaaaattcgtaataattaaaattgagaatctttaaattgaaaaaatttatagaaaatacgaataaatcaatcgctaaaatgaggcgcataaattacgagacaacaaaaatgaggacaaattggtgcctgtccagcagtatacaataaaaaaattaacaaattgggcacctaaatcacctgaaaaattagatttactcaatttttagtggtgcacaatttttcgggactgatccgtccgtccgcgtgccgctttttaatccctcacaaataattaatcaattttattttatccaccacagcactgcgccccgggcgccacttttgcagctgcaccactccaattccaagctgtctacaaaagttttgttaaaatcaccgaataaaaattggcccattaaatatagcacccaaaaatggcaccatatccccacaaggattttctgatggatcggaacataatgatcgaatcccggttttgccaacaacggttccggacaatccgtcagtgaaggacaatccgtcaatggagtcaggatttttttttcttgcgcaatgatcaaaaattttgcgaaaataattgttcattttaaattgaaaaacaattaagatggattttacaaacatttttaattacttaataattcaagtaactttatgattcttttgaaatattttattttttttaaattactttttttcactttataaaataatagtaaaaaaaagtattatttgtttttttttttttttgtaatttaaatcattttctttcattatttactgacggattgtctgtgtattgacggtgctatgtcgttagtcaaaaaaccatcaaaataaaaaaaaaagatttttgggcgttagtaaaaaaaccatcaaaataattatacactatacgattatggcctatatgcatgcaacactcaattaatgccaaccacttccaaaatatttgccgcactgattattaattaatgcaaagctatcatcaataaaacaaaaccaaaatattacgcaa

SEQ ID NO: 17516 - DNA, 919 bp, Heterodera glycines
  misc_feature (52)..(52): n is a, c, g, or t
tatactcatggcgctttcctatcgacaaaatatgattcctcatagttttttntaattgtattttatcattttttaaagaaaatccgtaaaaattgagcctagtaatcccaaaaaccagccttttttgttgaaaatctgttaacaaatctcactcaaattttgacccctcttctttcctccctaaaagttttttggaaaaagcgcgccgaaaagtgatgttaaaagcaaatctgaatttctattaatattcgatcatttggtccaaaaatgattaattgtttgaaataattgaagtaaattcgatttgaaaattttaattaatttaaacttagctttaacttttggattttattaaataaatagcaaaataaaaaattaattttgtattatttttacttgaaataaatttaattttttttaatttttaaaatttcccggttggtcccggttcccggtcccggacaaaaatcgaggtcccggcttctcaggtcccggcaagtcccggtcccggttttgctcaaaattcccggtcccgctctactctagttaaaacatttcttgcactccatttggtttttgataagtccatgataagccagaaattgtagaatttcctcagaagtctgcttgtaaatccaacgtaaattgatttggttcaaagaaggtggccgaatcggcagattgtcgtaatcaattattaaaaagcgtgaaatgcgtaccatctggtaaaaaaacaaattctgcattaaaaataaaagagttttggaacgaaattttgagggtggaagagcaacagtgggctcttaagaaaaatacaaagacaaaatggtataaaaacaattaatctttaacaaatcattcagtagtccttggaagacatcaacggtataaaatttcggtacttatgtgttatctgtgg

SEQ ID NO: 17517 - DNA, 1515 bp, Heterodera glycines
ttttcacccagtggaatcttaataagagcaaaagtggcattaccatttgtttcgtgggattggctttgactggcacaacgcttccttcgcccttcacctgtgccggcgttgaagtggcaccgccggtgccaccccaattttgccgttgtttggtttgtcgttgccattccgccgtcgttggcatttgcatcgattgcgtcctaacggcgccgctggcacttttcgacggatgaggtcgccttaagtcacgccttcaatcaatggaaatgcgacattaattggcaaaaatgcaaattattagtaaaagggggaggggacaatcgcttggccataaatgcgaaaataattctgccatctgaaacaaactacactcacaaatcaggtcgtagattcgaactttccccttttattggccattctccgcgttccttcggtcatttccccccccccccccccgtacactttgacttttgttttgccgtacccaaaaacaattggccattgggacagaccgccgtaagagccgccgatttgactgttcaaagggccgtaagggcccaacggactgacaatgctttcgctggtgccgtaatggcccacaaaaaggcccgccttcagcccgtagtctttggattcggcgttattaaagcccattgctttgggatttgctaccgtattcacctaccatattttgtgttcgactgtaccaccggaatttgtccattttgaattcgtcgtcggctgttcccttcctccgaatttctctgctgttcaccgttttctgctgctgctgttccctcgaggggcgtgtccaagtctttggcaattagcgcttaattagttggctttgatattggccctgcctttttccgctttcgcttcgtgccgtggcactgttccaccgattccctccgctacgcccatttccctttccgtcaaaatttgtgccaaagagcggacaatggaaagggacaattgggcgatcagttcattcagtccaatcggctgattgtgccgcggctgaggtggtggggaccaaatgggcaaatttcggtaaggcgacggcgcgggggcaaaagcaccggcggcagagttttgggggtctgaaaatgggctgatcagcattttgtgatggagtcagatcgatcagcaaattttggttatacaaacactgataggcaatggaagggtccgcaaaagacgagccaaacgacgacggaaatggccacaaacttttggcgtaaaggacagggcgaggagggccaaattctgaaaatgaaaagggacaaatgggcgatggacggacgcaaggaacggaagggcacctgggccaacggatgatggcaaagcgaagggcggggcataaaagttgacattatgcaattgacaaaaggcattagaaagaaaagcgaagtgagcgatgaatggaaaacaaaaaaagcgcataattaagaggctaaaaaatgggaaatgccccagaaatgggggaaatgccaatgatcagccaatccaatg

SEQ ID NO: 17518 - DNA, 3006 bp, Heterodera glycines
  misc_feature (79)..(79): n is a, c, g, or t
  misc_feature (2981)..(2981): n is a, c, g, or t
tcagatcatcactgatagcgctatgcaaattcgttgccatttcaaatctgcgcaatgactcctgtcaaactgtgccatntaaaaagttaataatattccttttttattgttttataaattttcgtgctgccttagctaactaaaaaagcttgatctttaattgaacgactgattggtagccaattaaaaaataataataattttttattatttttcatacttcgctttcccaacaaatttttatgggttttgcgacacgtgggcacagtctgttgagaatgggttcagacagtgcccagaaacgttggcaagtcatttggacgtgttggtgtaagtcagagaatggcacaaatttgaacacctcgtcccaagtttcgctgggaagccaactgcaatggataacttttttcggcatcctagattttttctggacctggattttcagggatttttatccaggatatccagatccatgtcaaatatgaaaaaagcttgatttcctgggcaaagttttagaatttttatttcatctgaccgatgtatttttaagtttttcaaaaaattattaaaaaatttaaaaacaaaatgttattttcaattaaatatttttatatgttccaaagcaattaattgattttttttaacatttgtttgctttttcaaaaaaatttttaaaaaatcaggtccatgcctcgaaaagcctggatttttcctggacctggcgtttccagggtttttgtccaggaaatctaggtccaggtccaacatggaatccagatataggctgccaaaaaatttgacattctacccaaaattctgtacaaattcgtgaaaaataaattttaattttacattgttttctttggttcaagtgttaggtggccagactcaaaccaactgaaccaattgtgtgccgtttcaatgtcaacaacatttggtccttcgacggcacaaattttgcgcactgtctcctcggcattggtgcccttcttccaataatgacgcaaaagtgcgcgaattgcataaatttcggaaagttgctccattttcaggttaatttaattgaaatctattattgtaaaatgcgtcgcgtatatatcataaaataattttaagatttacaataaacgcctaagaagtaaaaaagttttccaagaaattgatcctctaaatttagaaattttttcttgataaaattttttatttaaaaattggccttattcaaaaaaaagttgaaatatttaaattactttcatttgcaataaaatatagacaaaataaaaatttttatttgcctatttttgtgcctatttaatgcatattttgcgttttttgtgcctaaaaaaggaatccctattaattaatgaatgcatataaatttaatttataaattttaaaaataaatgattaaaaatgttttttttaatttaaaattacggaaaaacaaaggaatattgtcgagaagaaaaatgtgaatgaaaatcaatatgtggtatgtatgtacgcgagcaaatgttggcgaagtgaagttgaaggaaatgggaacgggtcgtttcggcgccgccgattcggcgccgccgattcggcgccgccgtttcggcgccagggtcgtttcggcgccaaaaatcaaaaacgcagaaatagtaatttttttttgttttgtttcagaagatgaagtcaataaaataatagtctatattaaatttaatttcttcattttcactttcatcttttgtgatcttgcataattttgtcggtaatagttagggcggggatttatatggacataaaatcgcaaaatatggccataaaatatggaccaaaaatcgcgaaatatggacataaaatggcaaaaatatggacataaatttttccaaattggggtgtaaattttaaaaatttcttcaaattcgctcaatgtaaggtaaaactttcaaaaatagctaaatatggtattaaaataccatttttgaagaaaaaacacgatacaccttaaaatttactaatttagcaaaaaaatcaacctgaaaagcgaaattttcgcttttttgtttattttgacataaattaaccaatttttaagaaaatttataattcatcaatattttcgtgaaaattttgctaattaaatgattttttgaaaatttttccggtttttgttgtccaaaaggtcaatttagctgctaggggccgttctaatagaggttttttggaaaaatgcaaaaatatggacataaatatggaaaaaatcccaaaatatggacaaatatggatatagaaatccatcctagaagaacagatcaagctaaaaacatatttttcgtgcgtttcggcccaaaaaaaatggtatccaccagttaattgactcgcaaatgacttttgtcaagactacagtggaagcattgaaacaactccagacctcttttacctccgaccaaatgccaatttttaataccctaattaccactttgtcctctcaaattgacctgcttaatggatcgatttcccaactccgctccactgctctctccactgaaggcatgccaatttcagcggaggaattggaaagacagagaagtgtcgtcattattggcatgccagagcacaacgacagttcaccagcaaagcgggcagagatggaccggtcaaaaatcaattgcttattcgattcgctggggatcgaatgcggtaccattgcctatcgcatgggtcgttcctttaacccagcccaaaaaagtcctcgcccattgaaaattctcttgccttcccgtggcttccaaaaacaggctctcgctggggcaagattggattgtgtatgctgggaacgttattttgagagatgaagtgcacatcttccggagtcagtcaattcgtgaatcaaatttttaaattttacaccaaatcacaaaaaaaaacaaaacacttttacaaaaagagtagattacactttccggtcggaagaagaaaattcttaccaaaantataaataattctaattcactacca

SEQ ID NO: 17519 - DNA, 1820 bp, Heterodera glycines
ccaattgtaaattcgggaaaaaaaattctcgatccaatttaagaatccggggaccggataaaactggtaaaatagacaaaacaacattttaaaaattttttacttcggcttgtaaaaaagtatgaatggtcattgttttgaagctttgcacggttctttttttgttagaagtatttccattttcttctctacaacagtaaacataaatatattgtcttataatgcatgagaaacatcaaaatgttgaaaatccccttctatttttgaaattttgccgaaaaaatttttggtacgaaaatggcctatggcatggaaatgggtcgatcccctatgccaatattcatgttacaaaatgtgtcacttaaacatcaattaagcttcaggaattcctttgttttcgttctttcttttcatttgcactgtccgacggattggaaaatgatcaccgatatgcaattgggtattcattcatcctttggcatttgcttgttcctttcattttttgctgcttaggtatcatggccaatgttctcggcgtctccattttcattttggtcattttctaccattacatcgtcgccaaccaaaagaaacagtcgccgcagtgagcgaaagaagcgaagaaaacgccgaagaaagtcaaatgatttgatgggttatgattaattaattaatttatgtattaattgagagggacggcgcataaatttgtaattgattcattgtaaagagaaaacaaagttaattacacaaatgaccaacaacagaaatgccatattcttaaaaattcccaaaatggcaaaaaaaattttgaccaaagaaaaaaccttcggattacccctcctgaatttttttctagctacggtagcccataagccttttagtcccgatgtcggtactatttacttagaagtgaatattttgttgattgattccaagtcagtcagcacccacaaaaactcaaatcactttatcatagacggcagatgtagcctcgacttgaaacagaactttatcaatccgaattttgagcggactagaaagcacaatgggtatacaaataatgaatgtcatttacaattcagatcgaacaatgccctaaaagggtcaaattagggagagagtcagtgaaagagttataagatattataaggccggatgaacaaaaatcagtgggaaaataagagatgaaatggataattaacggagagaaattggggaaggaatgagcgaaaggtcaaaattttatttacaaaaggaaatggcaggcaaattcagaaaaaatccaaagaatccttgaagaaagcaacaccaaaagtacggttgtcgtgcccataactttaactgctgctgattgtgtgtgtcattcatttgatgccggaaatgcttctcctcaggacttttgccgcgtgtttgcacgccgcactttccaccgcttgttggtaatgtttggccaagcccttttgccagaataaaatcacaggcgagtcctaaacagagaaaaattggccgagtttttctatgttttacaaataaggtctctattgttagtgcattattttttgaaaacaaatcaatgcatttattagtttcttggtcctttgttcaactgcattttttgttaaatgggggggggggcaccaacgaaaacattatgcgccttattaaacttttgctgcaggttaaggcctttcatactcactttgggctgacatttgatgatgccgatcactctgttcagatcaatcgcattccgttgcttctttagttgaaatatcaatttggctttgttcagccaatcgttccgcgtgctttgaatg

SEQ ID NO: 17520 - DNA, 786 bp, Heterodera glycines
aaaacatcggagagatttcacgacggaattcgcacggaaagagaacagccaacaaagttatgtctgactttttagaagtcaaactcagaataataataatataagaaactcactcatgtgggaaagtgtaatgcttggaattcatggccattcggacgcacccgacggggaccaattggacgagagaaagcagaaaaagacaacgggcagtccgagaagcacttctggccaaaacctagaaagaaccggagaatattgggaagagaaaaaattgtcggcattaaatgtgccagacctgtcctccaattacaacgtgccaaatgagtgtcgacagttcgcaatttaaccgatcgacgattattcgcaaattggccaaatgaatcagcgattggcgaggcgacagttgggcgatgagttccctctcttccgatgagtccgattgttccatttccattgcctcaaataaacggtcattttccactgggacaatgagttttcaattcaattgctcacagtcagcatgtcctgagttggacaaccctcgagaacaatgtctttgtctaaggagaaagtttgtaattatgaaattttagccaacggaaaaaaccaaaaaaccccaccgagaccctttaacgtcttcagaaggtcgagcattttgctaaagaggaagaaaatgaatcaaaatgagagggaatcgctaacgcaataaacgatacaaaactctccaaaaatggaaattatttctaaatgataggagaccataaaaaatcttaaagtgacacttat

SEQ ID NO: 17521 - DNA, 2232 bp, Heterodera glycines
aaaaaaaaaacatgggttttatctagaagtcccttcccggtgattgatccaaaaaagtgacacacggcgacccggtaaaaacacactgggcccgatccgattcaattattagaaggcacatggaacgtaataccttgcgaaacttggacattttggaattgtcgtcgctttgtccgccgccaaggttcaaaattttgatggcctcctccagatggttgacaagaaactctttgggcacatgtccaacacagttggtgcgcaaaaactccgcgaaaagggcagtaagatcggatgtctaaaataaaatgagcgattttaataaagtcgaaaagaaagattaaaaattacactgcgattcaataaaaacaagacggccataaaatggctgggcccgggtccaaaacaaattcaaaattatccattgttcaacagataaacatttttacactttacaaaggctgttttcaaaattgaaaatttttctaaaattttgcaattgaggaaactgctgttgactcaccggcaccgactcggtgacaacgggcagaggacgagggtccgaatcggccgatgttgagggaacagtgggcagcacctaaaataaacacaatttatcaaaaatgcaataaaagaaaaataaatttgctattaattgagaacatttaaaaagcaactaaagataagagagatatcaattacatttgttgatcggtgcgattgcaaagcagccatggttttgatgaaacgcagagggcggtcgtcccaaggcggatcgtaaatcgattcttcctaaaattgttagggttttacattttttcagtaactgctattgactcaccggcaccgactcggtgacaacgggcagaggacgaaggtccgaatcggccgaactggtctgatcagttggcaccgcctaaagtaaacgcaatttagcaaaagtggagaagaataagtgggttcaaaatttgcgtaaacctcgtggtcactttgctgctggtgttgcgaatgttcgggtgacaaatcaaagacctataaattagttggagaatgcaaagaataatcgggtcaaataatgcgcataccaaagcgaagaatgagctgagctcatcaagaaattgctgaacggtgcgagaagtggtggttttgagatacttccaggcaattgtttcttcacaatggtagaagaacttgaccagtaataggaatcggtcggacaattccttaaatcaatttatggacatttacattatttctacacccctaactgaccttctcttcttccacggttggtcgatttgaaatggggtaattctgaattttgttgaaaaattggttaaatatttggtaaagtgtaccaatcaatacttacgaggtattcttcaagataaaaaaggaagttgtcgatagtctgtttttgtttttctggcccagttgatgacacgatacagagccaaattggctcttgtcttgcaccattatacaatcgttcgagttcattccggcgctgaataaatcggatataaatgggtcagaatttgaccaaaacccttttctatttctaatatgtaacgcacttttttaaatatttccttgcgtttagtgacatggggaatcagaaattccctgagtaaccaggaagaagaaaaaatgttcggaaaatttttgtttgggtacaatatgtaaagggtcatttcactcaaaagttcgggcggcaaatttttcatagcaattgaatttcagggacaattttagggtttggatgaagggccaatatggaattttgaaataggtatgtgtataaaatccgagagatttcacattttcggataagacactatgccaacatttactctcatttttaatttaaatggaaatgcgagcggaccggctcagttgggcccggcacgtttggaccccagcgggttttccgctataacttttttctttgtcaaccaaatccaacattcttggtatcattcgaaagccctaagtgtcctctattagcctgcaaaattgcgaaacatttcgttaaagttcaaaaaagttatggtcagaagaattcaaaaagccaaattttccaacttttttggccataaatttgttcaaaattgacaaaattttttggaattttgcaggctattaaagcatctgaagagctctcaaatgatactaagattgttagatttggttcacagtgaaaaagttatagtccaaaaacatgctggggcccaa

SEQ ID NO: 17522 - DNA, 2408 bp, Heterodera glycines
  misc_feature (2393)..(2393): n is a, c, g, or t
tgattggtgctgctgttgctgcccctcgtcctcgcgactttgcctctgcaacattccgatcagtgccgccggctgctgttgttgttgctgttgtgaatggtggaagggcagtacttgttgttgttgttgttgatgtgttgctgattccatgggaaatgaaagttgctgaccaaatgcaaatccaatgccaaccaattgctgctgttgttgctgaagcatttgctgctgattttccaccgctgctgctgctgtcgacgaatgggtgaacaaaaatttcaacttttcacgcatcgaatcctttaaaagggtaattaaaacaatagttattgaggaaattcaccactttctcaccggaaaatttagaatgaaaatctcggtttgttctttgagcgtatagccgacaaacatatatttgaactggtaaagcaagtcgcaaatggtgtcctcgtagtgaagttggccgaccttctttaccaaatcgccaagaactttgtaaatggaaatgatctgaagaaacccaaacaatcaaacgcaaggaaaaggacaagcgaagtgaaggcaattaaatctaataaaacaatttaattattaacatagggagtagctgaaatttgcagctgccctaatcgaacattgtgcccatgggacacctcgggcatgtgtttgttccgctccttttcgtgaattctctgcaaatacggcaccacaatgcgaaggaaatagaccagctgcgcctcattgtccactttgtgggcaagtcggtttatcacgaaatcgggaataatcgaaagcgaattctaaaatgatttgatttcaaaatattttgcttgtttccgaacattgccgccatgttgacaaaaggaatggattagggccagcatcgagagaatgcgactttccgagtggaggtaaacttcgtggctaagcgactcgaacaattgcgaaggatcagcgtcgacagaagcaatttggggccagtcgaaggactcctcaattcgatccaagaagaaggcttggaaggaggaaggaagcccagtcagcaacagacccaacgcattcagagtgtcctggaaaatagtccttatttaatttattttgttcattgccaaagacttgtggacgaaatatcggtcgacggatggccaaatcgacgagggcatcgacaatagccgcgggagtgtgctggctggcaagcagttccacccatgcactggtcaaggcttgtccggcaggctgaagacgtacaataatatgaaaaatgttgcagaaagctggatggagggggaggggctgaccggatattcagcaaatcgccagtctctgtgaacaaattgcggcggttgatgagtgtatgtgctcgcctgcacaattcgctccaccaacacacgacagaaacgaattgggggcatctgaattcaaaacggtagtgatcaatttatgaatatggggattacattatgatggtgaagtacaaattcgggggtcaaaagtttgctgtggtacccggcaccggcacgagtgctgtgagtgccctcctcctgctccaatttcagcacaatattcaccacaaatttccgaattgtttgacgtccaatgggcgagtcgcggttaaacgagtccaaagtgtgcagcgtttcgtataaaaaagtcattggctgcgctaaattcaaattaagttgggtaattactattatttcagtgatttatacggtggaggcggtagagagggccgaaattgcgtagaaaagagtccaacactttcgggccaatatccacctccaaggcacgttggaaaatgacatcaattagctaaaaacttttccatcacttcgatgcacatttcgcatttggacaactgaccggaaggatccgatcggccaaatggccgtaataaatgggcaaattcataaggtccctttgttgtcccggggactgttgaaaagtcgagtccattgttttttgatacatctcagtgtacgaatattctgggtatttctgcaaaaaataaagtagaaattcctatgacaaacaatcactttgctaaagtcggcgatttggataaagaattcctcggagtttgcgctcgttgtgttcgaatgggcgggcgcaaaggaatgacacgcgtgcagtcgatcatagaaagaggagagtttgttgtcgaggagggcggccaacagaaagagcgaagtgcgaatggacgagtcatcggaggggtggagggctaacgagagaaggaaacgctccacggagacgaactgatggacgaaaagcatgtcgttgagcacaccaaccatctgttgacggaatggaaaaacaatgcgattaaatgccaaattaaataacatcatcaacaacattacgtaccctcaagtcaagtgctgcagtgaaagtgnctcgtcggtgacatt

SEQ ID NO: 17523 - DNA, 2372 bp, Heterodera glycines
ttattgtaattccacattttctagtgtacaattgcacgtaaaagggaaatatgaattgtaatttcacgtttacaactgcacgcaaaaggaaaatattattgtaattccaggaagtatgaatttttaattccacgttttttgtgtacaattgcacgcgaaagggaaatattattgtgattccacgttttcttgtgtacaattgcacgcgaaaaagaaatatgaattataatttcacgtttacaactgcacgcaaaagggaaatattattgtgattccacgttttcttgtgtacaattgcacgcgaaaaagaaatatgaattataatttcacgtttacaactgcacgcaaaagggaaatattattgtaattccacgttttctagtgtacaattgcatgcaaaagtgaaatctttttatggcataaaatgaatcgtaattctcgttttcttgtgtacaattgcacgcaaaagggaaatattattgtaattccacgttttctagtgtacaattgcacgcaaaaggaaaatatgaattgtaatttcacgtttacaattgcacgcaaaatttacaacgacagctttttgataaaattgtattaaaaatgaaaaaacaataaataaagtattgattgtgtcattcataagatgaaataaatagtttggcttaccttttactaaattaattatgtaaaacattttatattatacaaattatttttcattttaattttaaaataatgaaaatattattgctattaaaaagaatcaaacggacattagcaaaataaagcaacaaataatttttgataaaatatttggccaaggatggggcagaagaaaattcatgcccaattggtcaaataattcacggacaaattgctgtcataataagcattttgatcataatggtcaataaatgatttaatttttgatgaacatttggaagtgatataatcgcttacagaaaagacaggtgtgatttaaaaacgagtttttgtttcgtttccattgataataatcataattttatgaaatcatacatgtatgtatgatgaaattttaaatttgttttcaaaattttctaatgtaaaaatcgatgcacacgacgtgaggaaaagggcgaactttgcagctgcactcggcaacatataaagccattgtcttggcctgtgtacagacatgcagaattctctgggcaggccttaaaaattcaaaaattcttgatttaaaaacgcgttaaaataatgtgaagaaaataaataagaagaaaggaatcactgacctgtggggtaccggacctggcgtatggattacaggtacggtagttaccggccaattcaacgggaacaagatttgctggttgaggcggacatacatctgaaaattcactatgcattcaatttaaaatacttaatgagacagctttttttaatttttcgcgcattatttgcgccgcaggcatggacatttgcattgccaagcataatcaacatttgtaccaaacaatttacaggtaatttgaaaatattaagctttccaagaatacagcatatttttaaaaacaaaattaaaatttctggtgacaacttgtttcagaaaaaaaagatgtcctttcactagagatttctgttaaatttaaaaaattttaagtagaattttaaagagaatcattcatttcccattttttttcttaattttctgtttattagtaaaaaaaattgggtcgctttacaaaaaagttatggccaaaaaagctcaaaaaattgattttacttggctttttggcgccgcatgtcataactttttttagtcttataagtcatcaaagaaaaaagttatggtttcctaaaagcggaaaccgaattgccccccaccgataaaccccccccggctacttggtagtcggacatcgctctcaagtccgcaacaaatgtagcgttcgagtgttgttgagtattggcaatgtctgtttataccgcatccctttttcaaatatgtattattatatgtgattattctattaaaaatacaatttaaacattaaaaaaatactattataaatataatatgtcccggacctgaatgccatcgttaattggtgccgacggagagcaatatctgtagggtatagcgccttcgccaggcaccggcacaagttgtggaggacaatctaagttaattgtttcctaatatttactgaaaatgaaataattttcataatttcataatgaaaatgaatgtatggcactataaatgttttttttcaattatgatattaaaaagaaacggtataaccgatttctttaaaaaaaatttctatttaaaaaattaaggaaaatgaattaagggatttgaaattggtaataattctaaa

SEQ ID NO: 17524 - DNA, 894 bp, Heterodera glycines
atcaattaaaatgggacaagcgaagaaggagtgcgcgcatttgttgttgtttttctgttgaattataatatttttaaaatcactccaattaatttaaacaatttgctttcataaatcattgttgggatggcacacattaattaatgttaattacttttcaatttcaatgagcaaattttgtcaataatcgatattaaagtcgaaaagaggaaaatggttggaacagtttcaagttttggtattaaaatttaaaaattagtttccgtttgcttttctcctaaattcggattttctgtccattttgagtgtgttttgcgattactttgtgttattttccggttgttctcagtcgtaaaattgtggccagtcggacggacggatggacagaaagaacgaccaatgaatggaatgaatgattgaataataataataataataataatgggtaagtcccccattattattttattttattatgtccacacggagaaatgcaaaataatggtcagaaaatggaaaaagaaacgccggagggaaaattggggggggggggattttggagggatttacatgaaaagagaaaagcaaatgatttaaatttaattttagaaatttaaatcagtgattggtggcggtggttaaagactcgcagaaacaaataataaaaaagcggagcgacgaatgccccgaggcgaaggctaattaattaatggccaaattaggtggaattggtaaagattggaactaatgaataaaagaaagaaagagagagaatgaatgaatgaaagaatgcacttttggattatacaacaaaaaatgggccgaaaggtttcatttggctatacaaataaaataaaaaaaggagaaaaacaatttgaaacaataaccaaaaac

SEQ ID NO: 17525 - DNA, 1922 bp, Heterodera glycines
gaggcaaagcgaagaagaccttgagaaaatattcaccttcggctggcaaaatgcccttgggcgacgaaaattgattgtaagggacgacggaatggacgccgcgggggaatgaagaaaatgacaccgaaaaatcggaaaatgaagcgaaggatggggggggggagaggggaagggggaagagggtggtcacttgggggtgacgcggggggggcaaaaaaaaaaaacctgtttatacgccatttgaatgagtgtcaaaatgatgaatccacccaaaaatgatgggattaaattccatttgagctgtgtgtgggttgggtggcagcggaatgagcggtgaatgacttaggcctaaatcggaatttgggcggaaaatttcacgaaatcgcggtaatcaatcgacaaaggtttttattttaaggttataaatgcctttttgatcagctgatttgtgtcattcccataatcattcattcacttcaaatttcgccttcctttggcggtctttcttcacttttcgctaaatgggccaatctctaaacaatgttcagcaaagtttcattttggcttcgatcggtcacatttttcaaaattaattgtcaatcactttttcgccctctcttttcggcaatttgtccgaatgatcacttgaaaaatgaatgattcattcattaaatggacgaataatgagcatggaatttctgtttctcaataaggtcaatttcagtttaataaactgtttctttgggcgaatgaatgaaattgactaaattctcaaatatacgataattaatctccaaaaataggggcaaatatttttaaaaaggcggaaaatgaacaattagaaaatgtaaatttctttaaaaaaaggtcaaaattgcttacagtaaatgataaaacacaaaaaaaaaatcttttaggtagaacaagcagtgattgtattgtatgtattacaagagaacactccgaaatgcctgtaattctgaaaacgcacataaaatttgttatctttggaaagggcgggtcatttcgcttgtaaattttgaatattttgggttttagcggtgtctttttttgtgtattttcggcacaaaaatcgaagcgcggtcggccattgattgtcccatcttcggcttccaattttatcccatttatttggtagtgcgattttgtaaccaccgacaaataaatacgggtttttggttttttgggggttataccgcaattttggcgcagcttttgatcgcttcgagcagcagactttattcactgctgtgctgtgctacgtgggacaaaagtctttttcggtgggctaatcacagggcaaaaagaggggggaggggcgaagaagctttgttaatgaaagggacaaataaaagcatttgaatgggggcaattagtaattgcaccaattagggagggcagagggagcgggtggaagaggaaacgccaaaggaaaagccgagggaaaagcgaaggaaaagccaggggaaaagcataaaaagtaagaagaaaaggacaaagacaacaaatgcattcgctgatctgttgatgaaagtaatttcttagaaactttttcgggcgcactgaagaaaaggtaaagaaatgagtggtaatatattcggacaattacaataataaagggcaagaaaagtgtgtaaagcaaattaatgaaagcgaatgagacaattttgtgttgtaaaaagggcgagagaaaagaaacccggggaaaggcgggggaaaagcggggggacggggaaagtttgggagggaatggcgcgggggaggggtaaaagtgcagcacactctcttcactttctctctttttctccgcttttcttcactttctctctttttctccgcttttcttcactttctctcttttactccgcttttcttcactttctttcccctctttttcctcc

SEQ ID NO: 17526 - DNA, 1046 bp, Heterodera glycines
ttttggaacaataaagaaattattaaaacagattattacttagcttaaaataaagttaaacttcttaccgaactaaaaaatatcggaaaagtgaattctctataaataattttttacgcggtgatttggtttctactgatcaatttacctcattcttatatttagttttgttattcactcccttttgtgtgcttttttcttttttgcataaaaaataaagcgattaactccctaatgcagagaaaagtcttgtactatctcgtcatttctttttttgtaattttactcgttttggtatacaattgttaaaaatatgaatttaaaaaataattaatttctcttgtgattgtatcggcagggaaactttgctgatctgaactgatcactccatgtctgtgctgctgcttctgctgctgttttgtgccccgcccccttctcgccccgcctcctcctccgttggaattggcatatctgttgatcgtcgtcgtccttccactttttggtcactttcttcgtcttccgttttgcagtggctaccgtccccctccaggatggctgtacggtaccgtctcaacacattcatatggtatttcttcagatggctcctcagcgcgttggtcggcttccccggcacatcggcccatcgccggtaggcacagtgccggcattcgatcagatccgggccgaatcgataaaactgcgagtagtcaattctctgaacgtagtaaactttattatggtgtcgaaataagtgccatttttagctaaaaatttgccacatttatctgaaaactacagtgcatcgacatgtaatttaattttgttccttcaattggcccttctgcacacattttgtcaaaaaatagataaaatatttacccgttctttgttcgtatacgacttcatcagagtggcaatccgtcgttcatttttgttccctgttttgcattctcggcagcccgacagaaaggtgataatgctttcgaccgtaatgttggcatactgtaaaaaatttaaatttatttatttaatttaaataatatttt

SEQ ID NO: 17527 - DNA, 856 bp, Heterodera glycines
ttttcttctttaccttcactttttccattagacttttgtacttttgctctgtcaacagatttcgcggctgagttcgcttctgtcccaacacttttttcatgtcctccaaatatttgtcgtgccattctctcatgtaaacacttttttgtgtcttaaatgaatgaagtttaactttttttccacatatttttggccaataaattaaaaattgtacctaaaaatttctttcaaattttgtgggcttaaaattggttaaaaagggaacattttttgcatttctttcatttttatgaagaaattcagacaaaatgccaaggttacggtcgaaaaacccgatccctattcatcatttttattggatttttacttttttctgcgctccaacaccaatattttccaggaaatttaattctaattcatttggttcattttctttttttgaattgttttcttgactttttctccccgttttgttggccatcaccacaaaattcgtgcatttattgcttatttctacgttgttcattctgctgctcggctgtatcgcattcattttttgttcccttcatttaaatttttatttatttttaatttttttttgttttttatttttaaattatatatttccatttttacctcgcttttttttcttttccaatggcattttgcagttgcgtcaaagtgtccaaaattgggtttctcagtttttcgtgcattattctgagcccattatcgtggtaaagaggcaaaagaggtaacagaaaataattttgcatcataaataggaaatttgactaaaatttgctggaattgaaaattgctttaaatttcctaaatttaccgttttttaaaaggt

SEQ ID NO: 17528 - DNA, 1400 bp, Heterodera glycines
atttaatagaaataattttatatagcatagaaacacaaatagtttacttctacgcttcttctatttataaatggtaatatttctgctggaacatttgctcaaaagtaaccaaatttttgaatatttgctcataggtaactatttttttttctttgttgaaataatagttcaagaaatgaaatgtaaagaaaatcttaaaatataaaataatcattcttagttatggtttgcaatttcaatattttttattttttaataattttaaacacttcaagagctccatataatttatgaaaaattacgctcagagagaactagattattatcatatagatttttatcttcataaaaagacctaccattattcatacatgtttgaaaatttgtattggttaataagaatcaaagatttcatttttgattataatctattttatttaaataatagcctgatttaaacgtatatccagatagtataataaatatttcatagaaaaaatatttaatattttttcgtgaagtacatcaattggttgcaatgctaaaataatataaaatttattttcaaagtaaataaaaaacataatgctattaatcgaacaaataaaaaagaattatagaaaaagatattaccctaaaagatacaaaattaatattaattgaaatatttaaaatcatcgtttatattattaaaaaattataaactattaaaacacttgtgaatgatgtaatatttaataactaaaaaaaattccaaggaataaatgtttctttaattcagtggaacagaattaaaataaagctggccttaaaatgcgagagattaacaaaataatgaattaatttataaaagtgataaaataatcgaaatagacccaataaataatgcccaaaaaagataataatatagtcgatagaataaaattaagcgaaaaaatcgatctaaaattaaccttttattttgatatcgaaaaagatcttgataaaagtcaaattctaaaaatcaaaattaaaaaattcacctcgttaatctcaattcaataaagaattttattaaatgcattttaattaataataaggcacatcaaacgaatttaaaactatttatttaaaaaataatttcgcaacggatgaataaacaaacacaaacaaaaattacataaaactaattattaatagaaagaatattttaaaaaacaatatttttttacttttaagaataatttacatttttaccgatgttaaagattattatttaaaacattaaaacaatgcgtgctattgttgttgaaaaaaacagaatcaattaaactaagagacaaagattctagttcataaggaaaaatatgatcacttttggagaaaaaaataaacgttaaatggtatgatataattttgat

SEQ ID NO: 17529 - DNA, 1394 bp, Heterodera glycines
aatcaaaattaaaaaattcacctcgttaatctcaattcaataaagaattttattaaatgtattttaattaataataaggcacatcaaacgaatttaaaactatttatttaaaaaataatttcgcaacggatgaataaacaaacacaaaaaaaaattacataaaactaattattaatagaaagaatatttaaaaaacaatatgtttttacttttaagcataatttacatttttaccgatgttagagattattatttaaaacattaaaacaatgcgtgctattgttgttgaaaaaaacagaatcaattaaactaagacacaaagattctagttcataaggaaaaatatgatcacttttcaagaaaaaaaataaacattaaatggtatgatataattttgataaatattaattttttttaatgctatttgttaaaattaacattacattattttctttaaagattatattaacattttttggtaaaaaataaataaaacctaaagataagtatgtaataaattatattaattagaataaaataatttctctacgaataaagtcagccaaaacaatattttgaaagtaataattatttctaaaataaatacttaaatcttattaataaatatttcaattgtgaattaaattactaaatagtttaatgatttttccaataatgacagttaaaccaaaaatttttatcaagaaaaataaataaaattttaggaatcataaataagaacgaagactgaaattcaaaataaaaaaattatgtaaaaaaggaatcgaaattagagaaacgcgatgaagccattgcgtttcctgaccattaatatgcaaatcaaaatgaattttaatggaaataaatattgaaataagatctgaataaatcttaaaataatatatttaattggatttaaaaagaatcaaatttattacaaaaattatactgtaatgtcttgataatataatttttaattaaatacagtcaggtgcaaaagtatatgaaaaaaaattttttttctaaacccggttttccatgagatgcgtgattggatggaaatcatttctatgcaaaaacaaacccccaattttactcgtaaaaaactgcaaaaggcctttccgatcacgcaacccatcaaaaagttacgggtgcccaaacaaattgacccaatttttggcggtgcaaaagtatatgaacaaaatagttaatcgccaaaatttcaattccaagtcggcaaaaaattctgaaaaatttctgctaagctaacttttgatactgatcaaaaaagtctcttacaccaacttgatcaaatcactccttcatggtgatctgaaaagccaaaaatggctaaagatcggggaaattttcgaaaaaaattccaagggggttag

SEQ ID NO: 17530 - DNA, 1564 bp, Heterodera glycines
aacaattaatcattttttggactaagtgatcgaatattattagaaattcagatttacgtttcacataaattttttcggcgcgttttttccaaaaaatttttgaggaagaaaggggtccggcactgccgataggcgccgccgggggaaattttgaaaatttgagtgtaatttgttaacagattttcaacaaaaaaaggttggtttttgcgattattaagctcaattggtaggattttcatttaaaaaatgataaatatatgtcaattaaaataaaactatgagaaattatattttgtcgataggaaagacatgagtatacaaaaagaaaattcaaaatatgttagtttctgtagagggattgaaccaggggaaggaagaagggaaagccaaggagactagccactaggtcacccacatacttgtatagctattgaaaagttttgcctactaactctttatccaccacaagtttttttcttcgccgcacaattgtcgtagttatttttaaagaatatattaatatatttttttaaatttttcctttaactccaattttcatcactaattttccactcagacccccattcttacaagtgcttgtttttcccgattcccggttgccctaccgggaccgggacctgagcttttcaaaatccgggaccgggaaccgggacctcggatgaccgggaattcccggcctggtccttgtcccggtcccgtggcactctattaataactcttgaaaatttaaaagagcattttttgaaatttatgagagattaaattcttcgaagcaaaccccaacaaaaaaataaataataataattgaatcccatccttattggtcacagtaattgagttttgaaaaattttaaaaatcagcaaaactttttatttaaaaaaaagattattaatttttcattgtcactttaatcaaaagaaacatttttcaattgaagtccgatcatttcccatctcagcgcaactgatcaattttgccttcatgacagaaagaatcgcgttttgtttttaattttgccgtgacagattgggcattccttgcgaccattcattattttttcggcacaattgtcacatgcacaagcgtgtccacatgggccaaacacaacactgatctacagtaaatttgaatactatactaattttttttttgattttttttctcgtactgatttgtccagacaaactttgcaaacagtgcgatcctccacctcagtgctagtcgaatttgtaccagcgttggcatttgacccccgggaatggaataacgcgttcacggcatttctaaaagtaatattaaatggttccattgaccgattaaatgtttaatttttgatttcatctttttctaaaacatttaaactgaaaattttaatttattatataagttttgttaaaacttccaaatttttctccatcgccgccttttggcaccgccggacgacaaaattccgctaattaaaaaaaataagatctcaaaaatgtacaaaattggtcattttggcgagaaaatgttcaaaaatattcttttattgcccttaag

SEQ ID NO: 17531 - DNA, 2587 bp, Heterodera glycines
  misc_feature (974)..(974): n is a, c, g, or t
ataataaaaattgttagtttgaaattaccactaatatttataaatattttaaattgtaggttgtttaaaaaaaatacaaaaaatatatatatatttcttttcaaccgatgaattattgttttgtgtgattatttttcgatttgctgggttttgcttgtccgtttggccaagcataggtcggatattggatgacggacgaattgataaaatgtaattaatgcattttatttttcccgtcagcggggggggggggggagatatggcgaagataatgaaaaaaatttcacttggcaaaggtaggagataaagggataaaagagaagcgacttcgtaaaatcgaaaagaattttaaatattaaaaaagattttcaaattagtgaaataatgagttgaaacaaacaaaattttcttaacaaatttgatttaaattaatttccttattaaaatttttttgaaagttttaaatatatttcaaattcagaatcaattttcattttggttaatttctttctaattaatttcttaattttggtactgattgtttcccaaaataattaaacaaaaatttattctgttatttttttagaaaaatttcgctcttaaacgtcactaattacggcaatataatattcccgcccttacattagcatcaaacagcaaatagaatggtgctgtgtacatggtgacattaatttatgccaaggaaggtacagaaaaagtgtctggctgctccatttttgtaggaaaaaacgacagccctaaaattgaacaaattaatgcagtggctaatagtgggcgggtgggggggggggcaatttgtccccaatggagggttaattaaattctttaccatgccaaccccgcaaaatgctccttaaaattcccgcggcccacccacacctttcgcggggggctataaatttgcagacaatgttctcggtgatcaacatcatcatccatccattattgtcatntagggcatcgaattatatgcacatgtctgtcaattttggcatttttcaaaaaaaaaccctctcgattaaagcagctctttggaccctaatgagcgaacaattaaaaaaaaaaaatttaatttcatgtaattttctcaataatattagtaaaaaatttgcctttctaaaaaataggcaaaatataccaaaaaaaaagtccaaaaatgaaaaaaattcgattttttttatacacaatctcttatattaaaaatttttagctttatttttttattttcatctaaataatatcacaccaactattttcgatttttgtattttcttacattaacgaatttaaagtttggccgtcaatttggaaaatttatatgcatattttttactttttatatgcatatttggcaatttttcatgcatataattgtgtgtcctaattatcattatccatatttccggaggccaaaaaatagtgaattcgtaaagaaaaaatctgcccaacctggaagccagaatttcagacaaaaaaacgcaccgggaccaaccgaaatcctccgcaatactgaaccacccctggatatatttaggccatttcttttcaccttaccccctagaaaatttcaaaagcacaattttttggctacccaaccctcccagggatgtcatttattttacagcgcggaaccctatggaattttccggatttttttttggccggggggaggggaggcgagggtttggctagaaattcatcagcatccaacaaataaatttgcaaaaaaatcccgggccgcaggtatatatttttccaaaaatggtctttcggctcggcctcctcctcgtccttctcatttgccttgtccacatggccagctcaaaaattgccgaggacgactattgtggagtggaagataatgtaaaataatcaattaaatttaagaaataagaaaaatttcgaaaaaatctttttaattttttttaccgtattccgagagggggggggggggggttcgaaaattgagccttatggtgtcatattagaagaagaatactgtatttaaaaaatcaacaacaaaaaaaaactttcaaaaaacaattagagaaaaccttttgaaaggtttatatgtatttgaattacttaaaaaagattttccaaattttttaatcaaaaaatttgaaatatttttggtataaaaataggttttttaatttttaaataaaaatatttttttggctcttgaatgaaaaagatttataaaaaaatttaatgaaataatttggaaattattttttgatttaaaaccattttttaattatttttttaatgaaaaattgggttttgaattaagtaactttcaagaaaaaaaaaattaggatttgactaaaaatttcatacatctgtgtaaccgttttaaaattagctttcgatcaaatatttagccgtatgacaatttgccaaaaaatgtgtcgatgggatgcaaaacggtggattggcgccgctacaaattcatccatgaatattatgccgtgttgcgcttctttgtcaactgctactacatgctggtggacgccatctttgaactgatcaactggtttgagccaatgcaaactgtcggatg

SEQ ID NO: 17532 - DNA, 1375 bp, Heterodera glycines
  misc_feature (51)..(53): n is a, c, g, or t
  misc_feature (66)..(67): n is a, c, g, or t
  misc_feature (74)..(74): n is a, c, g, or t
  misc_feature (103)..(103): n is a, c, g, or t
  misc_feature (114)..(114): n is a, c, g, or t
  misc_feature (120)..(120): n is a, c, g, or t
  misc_feature (122)..(122): n is a, c, g, or t
  misc_feature (146)..(146): n is a, c, g, or t
  misc_feature (164)..(164): n is a, c, g, or t
  misc_feature (178)..(178): n is a, c, g, or t
  misc_feature (196)..(197): n is a, c, g, or t
  misc_feature (203)..(203): n is a, c, g, or t
  misc_feature (208)..(209): n is a, c, g, or t
  misc_feature (211)..(211): n is a, c, g, or t
  misc_feature (214)..(214): n is a, c, g, or t
  misc_feature (217)..(217): n is a, c, g, or t
  misc_feature (223)..(223): n is a, c, g, or t
  misc_feature (225)..(225): n is a, c, g, or t
  misc_feature (230)..(232): n is a, c, g, or t
  misc_feature (237)..(237): n is a, c, g, or t
  misc_feature (242)..(242): n is a, c, g, or t
  misc_feature (251)..(251): n is a, c, g, or t
  misc_feature (265)..(265): n is a, c, g, or t
  misc_feature (268)..(268): n is a, c, g, or t
  misc_feature (270)..(270): n is a, c, g, or t
  misc_feature (301)..(301): n is a, c, g, or t
  misc_feature (332)..(332): n is a, c, g, or t
  misc_feature (340)..(340): n is a, c, g, or t
ttcaacaatgccaagaatgagcatacacttgtggatcttctaaggacgagnnnaaatgattaaatnnaattggnacacccttagagattaaaaagttaaaagnatttaaaattnaaaaangnaaaggttattatttatttatttanttatttatttttattgtnagtggagggaaatnaatggaaaaagaggaagnnaagaangattnngnttnatnttttgnanttttnnntttgnggaangaaaagttnaaaagaaatgaaanagngncgaagggaattaattttatttgatgaaaaangaagaggaagaggaaaaggaagagaaggagnttagaaanaaagaagaagaaaaatagagagaaagggagagagagagagagagagaaagagagagagagagagagagagagaaagagagagagagagagagagagagagaaagagagagagagagagagagaaagagagagagagagagagagagagagaaagagagagagagagagaaagagtgagggggagagaaggaaagagacgcaaaagcttttccgaaagtatttcaaagcgaacgaccaaaagcgggtaaaacggatgagagatgaaaataaaacagaaagagagaacaagagaagcaaccgactgtcactcatctctctgtttctctaattgctcctcgcgctgtttcgccgcatttcccctcactgtctgcggctctctccgtccttctcaaccattgcacacattagaaaaaaagatttattatcggccgaaaaatgaacggacatacaaatgttctcatatgtccgcagttattcggtcaagaatctcgagagagagaaagggacattttggtaagtgatcagaagagggaaccaaagaccgggggggggggaataaaaacaaaagggaggatgcgatgcggtgattgctgatgatcactgatgaactgattaggatgattaaaaatggtgggcaaatcggcgcgatggaaagggcctcgccattcattcattcattccctttggtacgaattccaaagattgtcctttttaaatttttaaatttcttcctccatttttctaatgtcacttttcgttaaatcaaactgattttattcagagtttagcaaattctaattcatttttcattccccccccccctttttcgtttacttttttccaacgcaacgcacgcccccgggggggggggggggaagagggcgaacttatgagtaaagctgaaagaagcgaacgagaaaaaagcagcgacaacaaacagggcttatttacgtgtacttttaacggtaaggagagagagaaagagagaaggcagagaggggacaaaatgagagaaaggagtgatgagtgagaaaa

SEQ ID NO: 17533 - DNA, 1939 bp, Heterodera glycines
  misc_feature (37)..(37): n is a, c, g, or t
  misc_feature (78)..(78): n is a, c, g, or t
aagaggaaagagaagagaaagagtaagcgcatcctgnatcattcactatcatcattggcattgttttttttccctccncgcgtccattggcatttccacttccgctgaattattcattattttttattcctattccctcacttccttttccaatttctctcgtgccatcctcagatttatggaaagggaatgtcggcactttgttgtcatggaaattgcatattctcccatttctgcgcaaaggcgaaaagacaaatatttaccattaaatatttaaaaaaaccatagaacgcatttgataatgatgagtgaatgacaagaaaggaatgccagtgccatccccacacccaaaaaataggcaaataggcactgatgttcgtttcggagtcttaggacggcacgggaaaatgggaaagagaatgaaatgttttttagcgaattaattaaagggtgcctgctgttgtttggatctgttttaatagttcaattacagtaaatgctgcacaaacaattaattaattagtcgcaaaagaaatgaactgaataagtgaaaaacaattattgaaaaacaattgaaaagtgacagagcaatcgatggaagtgccaaaattcacaaaaaaaggaaatgcgttttgtgccgttttgtcagtcgattaaaagaaaggccgctcgcagcttcatcttcatcagcttgctcaggttcttcacctccacccgaattcgcatatccttttccaccggcacggcgccctcttccgccagcatcggcgtgctcatgcgaaagtgcggcagcaaataatcgccattttctgaggacggacttttcattgggtgggggggggactgaccattttcgactgtaatttcgaagttgcgattggcaaagtattcgtaaacgagcatttgaccagctttggccctcagttcgcgtgtccaactgtcgcccactccgacgacgctttgctcataattcactttgcccactccaaatctctcccacaccattccatccgtctgtgataaatggcaaaattagcaccgacgaatgccatttttagggcggctttattgaattgtaacttccgtccagcaccactcaccagatagtcccctttgccgtactccgtcggtctgttgcaccccgtcggaaggtcggctccttccaccactctcttcccgccatatccgatcggaatcgcttccggcgctatccatttttcaacttcgtgcagcgattgggcaatgtgaaaacggctaaggatttttccggggaccaaaatggacataatctgacaaaaagaaaagaaaatggtggacaaattgccgaaggaattcaatcaaactttgagaaggatgttgaggagacgcggcggattgacaatgacaacgctggacaacacttccatgtaataggccatgaagacgccaatacgagcctaattaaggaaagcgtgagaaagagagagagggagagagagagagagaaaagagagagagagagaaagagagagaaaagagagagagagagagaaaaaagagagagagaggggggagagaaaagagagagagagagagcgggggggggggaatcgatcaaaaaatgaaatcacttcgaatattttgttgatcggagcgagtggattggcatattggatgatggacatgtgctgaaaaagttttatccatctttaccccacaatgttggcattttgactacctgcatgtcaaaaatgcaaaaggcgtacgacctgcgcccactgcgcctctcttggccaaggatcagttgcaaaaagtattcgcagtggacaaaaaactcgcggaggaagtcgccggtgcgggtcactcgcgccgccatgttcggatcggcgacgcccgtctcgacgaaaacaattgcgttgtaatgcgcattcacccaatcctttcgaagcctcaaaagaag

SEQ ID NO: 17534 - DNA, 1700 bp, Heterodera glycines
  misc_feature (10)..(10): n is a, c, g, or t
gtgatcagcnaacataaaagttgcatttttttgccattgttagcacctgttgctgacaaaagtccaaaagcgcgtccctggcctgcaattcgccctcatataaacacaacagctcgagcaaaagcattttctaatcataattaactaagaatccaaaaaaaatttgagtgaaaaagtgaaattcgatagaactgtttaaaacttcacaaggaatttgtgaaagccactccaacttatagaactctgtgttttcataaaaaatcttttattttctgtccacattcataattcctcctaattctttatcgccaatttaaattatttggcgttttattttaaagtttttgttggtttatgtttactacacactaccaaaaaaaaattcctttttaattagtgatgtacatccgagagttagaatctccagatgagcactccctggttttattcaatccgcttcgttcttgctttcgtcctactagagatgttcgagaataatgaaatttgattttttaggctaaaagattgttatagttgaggaagaaataattttaaatttttaactacatacttagtttcggataatgggtttggacatcaatgaaatcagaaaaatctaggaattgttttcggcaattgcctgtcagcgacgctctatcgcccgtctggacactgaaagggcccgattccgtcgtttgaacggagctcagttccgtgtggttgtgcgattgtcaggttatttttaaaacgatatccaattttagcagtttaatggtgaacaaaccgcgcgcattgtcagctcaccctttgttttcattgtttgaaaattaaacaaaaagattaaaccagggggtcgtcggggcttctgatcacgaatatgaatatcggatttgcaattatttatttaccatagtttatatcatatatttagaaattttgacaaatctaattaattattgaccctaaatctatgcttttcaaaatcactgattttcaaatcaatgttattagtgcgtgatcagaagccccgaaatccccagcagcggggttggtctttatcgataacagaaaattatttttatcgagcccatatccattatgccttaaaaagtagttaaatttatatcttacggaaaattcctcgatttaggaggcttcttgccaaactttgctgctgttatgccacagcaacagaacggtgggttgtcatttcccttcgttttaccaatctgctcatttttggcacattttagtggtcaatgttgctgctgttctcgccaatgccaatcccaatggacagaattataacgtatgtttttatttcttaccttattaaagaaacagcggggaataaaggcggaccgggaacccattagttcttaatcgcgttctcggctaatttagacagggtcccgattccggcgtaataacaattttttaaaagtttctggtttgggaaatttggattctccaatacaaagaaagttcagcaaatcctatttattttttcttttacaacccatgtaaaccagctgaaatttagcgcttgcagcgtttgcatgcggaattatcggagaccatcgcccgtttaactgtagaaatttctcagttgggatacatgtatgagcaattgaccgagcgtcttgaacatctcacgggttatttcaaatcggataccaaaaccaaaaataatttatgag

SEQ ID NO: 17535 - DNA, 2550 bp, Heterodera glycines
  misc_feature (1074)..(1074): n is a, c, g, or t
ttcattgtcgttggcacataaattgccgaaacaaactgcaaattgcgtccaaaaatgtgaaaagtgcgggcaataagaacagggaatggacggcgcacaaaacaatgcacacgcagagaacccgcacacagaccttgaaaaaaaatttttggaaattttaaaaaattttccggaaaaacggacctgagcagtgtaaattttgacaaacgcgagactcaatacgcaaatgcaagtgcctggatgggaaaaattgaaaattttcatttatttagcaactaaatggaatgtatagccccccccccctccctcaggcctacccgcaaaattttggaaaaaaactacgaaaaatgtaaaattttgacagacgtcagcggaaaaaattcgcgtttttttgttgagatctgttgggaaattaataaaaaaaatatcaaccttttcattttccaagattttggaaaatttttaataataattttgcccctaaaatttggcaaatttttcttggggctaatttattttattggcccaaaaagaataatttccatgccgcatatatcccgagggcaaattttccggccatccaacaatctgcttacaaatggatgcttgaaaggccgggaagccgacagaggtgaaggcatgccgaattttgtgttcaacactttggtcggcaatgccgtgcacatttttgccacttgccacccaaagtgccggcccatttggcggcatggaaatgatacgaaacatgggcctaaaaagtagagccggcaattattgatcggctggccaaaaattgatcggttattgtgatcagctggggaggcaaataggttactgatttgttggaaatcggtcattatcaattaactggcaagggatcggttattgattgttttggaaaatggacacttttattgatcacttgaaaaaccgatcgttgttcattaaaatggctggctgatcaacatcctccataaaaacactcaccggcatgtccacgctgaagccgatggaaatggtcacggccgccatcaccaccgggtccatggtcatgtccatcagtgccatgatgcncaaggtttcttagaaatggcacaaaatttcagagaaaaaaatatttggcgttttaaattgaatgttgattctttagaaatcgattggtttattgattttttgggaaaaaccgttcgttatcgatttactgaaagggatcatttattgatttacttgaaaggtacataagtcgattattgattgccttaaatttgattgattgttgattttttggaaaagcgatcaattattgttaatttttgaaatcgatcattattaattagcttgggaagagatcggttattgattttagaaaatggatgccacttaatgattgcttgaaaaaccgatcgattgatcgtggaaattaggaacgcgtcatcaacgcctggaaataagttaaattcaacaggaatttatatacaataaaatagtactttaattaccaataaagataaaaattattataaaataaatttcaacaatttgaaattcatttattttttcatacaaattaaattcataattatttaattagtcaattagttaattgaataattaattaattgacaggcctagtgccaagatcagaaagggagtgaccaccaaaattgaactggccgaacgctggcaaagaacagaatgccaagcgcagtgccgctggccatgaacgggcacagacaggcgaaaacggcgacgggcaacttcacacggcaaaaaaaaacatttagacaaattaatttagtcaattaattggccaatcattactttaccgtattcattatacggtgtaatgataattgtaaatgcaccctagcgattaatttattcctaaatcgaaatcttataaaaattttctcataaaaatgctcagttttgagtcgaggagcccggattttactttttaaaattgggtatctcaatactctttagctcaattttattaattttgaataaaactttgtcatattacacctcctaaatttgtaaattttagcaattattcccctttttatcacctaaaaatatcatcaatagtcatttaatggactcagctaaaattcttttttttaatatatattttgctttttccaattttttatgcttattttgcattttcgtgctttttatgcataggtattttggaaaaatttgatactttttccggtgatttttatgatgacatccgctgcatttgtttctacgccgcacaagcattggagatcgaacggttggtggcccagcaggaaataccggacattttagtgacaacggccgacgcaccgcaggacacaaatcgtcacttgccgttatcgtcacaacatgctccgtttacgacagtggggccgactcgcagcctttctgggctgatgccgccagggtggacgtcgccatctcccgcgcgagccatggaatgatcaaaatcggcgacttgcttctgctcaacaggacggagccaggggaacgctacttggaccaagcgacggcggagacgac

SEQ ID NO: 17536 - DNA, 3442 bp, Heterodera glycines
  misc_feature (3292)..(3292): n is a, c, g, or t
  misc_feature (3350)..(3350): n is a, c, g, or t
accgaccggtccgatctctagtttttagcacctattttgcacttttttagcacctaaaaatccgggctctaactatcattgatacttttttatatttgacctagcatcaattaacctacattaagtgttacctacttactacacattagtttcaattaaaaataaaatcaattacgcaaaaagactaattgataatactcattttaaaatattttgtggacaatttcttatccgcttaaattgttgtcaggttatttgatgggctgaatgaggaaccatatggattattgcctctcgttaatttgatgggaaaaggcgggccaacatcagtaaaatcagtgcaaagaataggtgttttttaacaaactaataaataaattttttaataaatttaaattatattgaaaataaattgattaaagcaaaatttaaatatttaaaaaaaaggttcttatcaatggcgacttgaggacgatgagccggttattcttgtgcccgggatgccattggagtcattttactgggcgggtgggagactgaagcaggacggtaagccaaataaacgaatttcacatgtgccagatgttttcggcacagtgtactgattttgacaaaaaataaaataaaatttattgcgatttgctaaaaaatttcggggagtcgaatcaagaaaacgaagttcgactcgagaacattaaacaaaaccgaccgagacactacagccattttttttattggccaaagattatcggcaaaatccatacattaaattattttaaggcatggtaaagtacatacattaaatttgcaattaattggttgtataaaaatcaaagacaattaaaaatagagttgctatttgtgtcaattttgaattttcaggtggcgttgtgatttacaatgtgaaccatttaaaggtgcgcgatggtcagttggactcggcaatacttgcggcaaaattgtttggcaccaaagcaaaaaaggaagtgggtaatttttgcttttagagtaattggagagctatgaatttatatttgtggagggatttttgaattttttaaaattaaagtttttcaaactaccgaatttcttgaaatagagccccgggggctttgtttttaaccctcctcaaaaaggggggctttattacagggaggctctattttcataaaaaatccgggtaataattattttttcacaaaaaacaaatgcacagactactggattttataattgttactttttatataatatattttatttctttgtattaaatttaaaattatttgtagattaattttgacgagttcgatatcatcacaggtattattatgcagaaacaaatataattttcgaaaaatatactatactgcttcgcatatattatatgtgtccattcagatgcgataaatttgcaaaagatttttgcgtttgcccaagaagtaagtgatgggtgacaacggccgaaggaataaatttttcattgaaaaatattaaaattataatttaatattcaatatatcaaatgttatttaatataattatacatcgagagtgttcatattcatttatcgtgaaatatttattaaattctatttcgacataatttatgaagagtataaacaatgaaaattggggcccaatttccaaaaatttctccgttttatttgaataaataattttgttaaatttcaattttaggctggcgaaggactcttccgcattgattgcgaacgtgtcagtatttaaaaaaaaacattttaagggaatatatttattttttcccctaaaggtaggtaaaacaatgctgatgtcaagaatggaagcgtcggacctgatggaagtgagttgattggttggtctacagcgtgtccatgcattgctgctcgagattctcggcttagagaaatctcggtacttatccgttatgccgcaccccgcgcaaaaaaagtcattgttctgacatgtcaaaacaatttttctagtgtagttttaggcgctgaacaaaaattttattatacatttgactaccagatttttgattagcgcttacaaattagaacaaccacagaaaattgttttcatttgtcgggattatggcacttttttggggggggggggagggcataacgaaaagtaccgaaatttctttgtttttgagctctcaacacgttggttaagtctcaagagcagccagcccattatttaatcaatcaatagtaatgggcgagatctctggttagcgattttcgtgaaattctgatttttttgagttttctcctcacttcccaggggtcattattatattccggtccaagttccatgaaatatttctgactatagcatactgtatttgtagattggccacatgacctttgatcagggattaaaggcaaaaatggcgaaaccccgttccaagcactgtacaggaccgttctttcaacttgtcaggcaaaatttttttacagaattgtttaaaataattaaattatttattattttttagttttcaatttggccaattcaaaattttagtgagttttttaataattctaaaattccgtctcctttttaaggcccgttatgaagttgattgtgcagattttgcagccgcaaaagcgtaaaaaaattatcattttcatattctgaatataaatttttttggtaaaacagggaaccattccaagaaagtgaagaattgccacaaaaacaacaatttgaaggtagaaaatatattaaatttaatcggattaaaatttgactaaattagaaaaaaattattttggttccagaaaattcctcaattggttacatcgagtttggacaggttccgtcaaatttgccactccaattggtcaccacatacccacaaggagccggattcccgtttgtcattgttataaattataatttaaataattcaaaaaagatttttttttgacataatttgaaaaataattaaattaaaaaaaaattatttttttaacaaaatttaaataataattaaattgtaaacaattttagattctttacttggggacagatgtgagtttttaacaaatgccataactcatttttcactaattgtgcctattttgaaggttttttacaagtgctgaccaagaagtggtcggctttttcaaaggcaatggagacttcagcaaaccagccttttacgggctaaacgacatctccaaattggtagcaaaaaaattaggattgtgtaggcccattcagactcacgccctcccgaatttcaaattaaaaattatgtttttaataatccaattanatttacaaattttccccgcagcgcctgtctgcatagccggacgacaaaatttcattanatttttcaaaatttgatccaatatacaggggcggcgaggggggggggggctgagaaacagtactcccgtgagtgacatttgttatttaggga

SEQ ID NO: 17537 - DNA, 2406 bp, Heterodera glycines
ccattgcttaattctgcatgcatgttcactccttaattatgcacttttctacctaaaaacgacaagttcgttcacttttaaaaattgtatcttcctctccttaataatttacaaattgtgtcttctttctcttaattctgcatttttctacctaaaaatgacgttcccaaatgcttaataatttacaaattgtgtcttccattgcttaattatacatgtatttttattaaaaacgcaaataaaatgacaaaattacacaatttttggtataaaacatgaaaaacaaaggtggtacatgtgtgggtacgtgtgtatggggtgtgtgtgtgtgagagtgatacaatgaatgatgaacgataaatttacaaagtgtgtccaaaattgagaacatcataattagggcccactatccctttgcctacatatgggcgataacatttttggagggggcctgaagtgacgtgtccgccacccctaatgtcgggtctcaaaaagtttgggtacatcacatttattggctcatactctccggtttgggcataccgcaacacttcttctttgaatgtgtcgtagcatagggactggttctgcatcacgtcgtagttcagtgtgatgcccctaagcttcagcacaaattcgtcctgcccattacgccggagtttgagtccatactgaaatgataaagtataaattattatgcactaaataaacggtaaattaacctgcttcgctccgccactacaatactccacaatttcatgcttggggtattcatcggtgaattgtcccaagtgtggtcctgtctccaacgggttcatgccgatcgggtggacgaaaatcagcgagtcggtgtcagtgtagagcaaccgacatccaggcgttctcaccaccttctgcatcgctttcaacagcagaaggcgggcctttgatgttgtccagagtgagatgactgaaaaatcccaaaattatacaaaaattattgaaaaaatctcaccaatgttggagcactcgtgctcctccacccactccttcttctggacgtagctgatcaattgatgtttttcgtccagctcatcaatggaaatgatgtcgattgaactgttttccacgtattcagtcaacaccgaagggtcgtcggtgatcaacgtctgggcaaggccaaagtttcgcaatgagaagcgcccccacagattgttgagacacagctttgccaacgaccgcttgcccttgttcactttcatgttgtccttgtcgattgaaattccgaatttctccgcacattctgtgatgaactgctgctccaactcttcatttcccttgatgctggcgtcaaatccggaagcttcaattttctgcgacatgaactcggcgatgtatgggcggaatagcttgtcgtcgccatgcctgtacttcagcacccggaacactttggtcacgcggtagccctcttcaagtgctgcgtccaattcaattgatgtgcatgttgtcacccatccgcgttgttggtcgtcgtgttcacattggtagtcaaaatcaacgcctccctttgggtagtctagacaacactgcatgcacaacggaaaacagagccgtttgttgactttgacgggtagtactggcacatcacactttcgcggcggaatcacccaaaccttgagcaacgacaatttgtaggggttgtcgcgtgcgcttgtccactccacattttcattcaagatgagcacttttgggtgttcaatcgggtaagtggtggagaaactggaaataaaaaattataaattgtgaataatgatcgaaacaaaactcactttacgtacgggtagagggacgtaaagtcatagtacgagattttctcgccctctcccgccttgtggtacagcttcagtggtcctgttcttccacccatgaacgcctcgcgaatgtccaacgggccatcatccacataatcaccaaaactttcgcgcatgtccgggtcacggttcagcattcttttaatttggcattcccagtatacgtccactcgtgacacttgactttcgatgaattccagccgcttctcatcccgctctcgcacctctccagccgtttttccatttggcatcaacatgttgtcattggggaagcattcattgcagccgtgccacacgcatccattcacttcaatggcccttctttcttcctccacccagccatccacggaatattggccaattttcttctctccgccagccgaatgcgccgtctgcaccacaacaccatgctcctccgcataccaatgaaagaagcgaagtgccagcaacgactggttttgggcgttgtcgtagccgcgttccgggacgatagccaagtgtttcttcggcagatggttggtgcgaaaatgcttcatacatgcgccggcgatcgtca

SEQ ID NO: 17538 - DNA, 1033 bp, Heterodera glycines
  misc_feature (989)..(989): n is a, c, g, or t
  misc_feature (1019)..(1019): n is a, c, g, or t
tttccaaatatctgactgtatgttagaaacggtagactaatggctaaatatatagtgaagaaaggacttgtaaaacgaataaatgaagagtgaatagaacatatgaggatattgtagtgcgtcattgaatggacggatgattaattgtggaagtaagaaatagtgaaaaaaatgtcagaaaaggatagaggaatggtataaaaatcagagatagttgaagagagacaattttagatagagagaatttagtgtaaggagtgattgagaatagaagatttggttggaaggtggacattagaaatgagttaacgaaaaatgatatttagacatatagaagacggtttgggataatagagaacaacagtgagaaataaccagatatagaaagagtagaaaaatattaagaaataggaaaataattcaaataaacttaaccctgataaatatgccaaaagctaaatactagattttgtaacgaaaaccaaggaaggtagctttcttcctatgttacctttcaaaggaatcgatttataggataagggatgccgtgacctcacccccctctctccttctcaaattatttggttacactcttcctcatctttgcccttcctctccaacatattctcattcttactccttaccggcgcaaactcactctacccgttcccgttttcagcttcttcctttaacaattcaatgggaaatgtgtttttactaaaaactctatgaaaaaatcgaattgtttgccagcacaaccataccttgtgggacattggttactggagggacaagcctaatcaccttgtgaggtattggttactggatgctcaagacttacgatgtattggttactgtagagacgaatcttgtaaagtattgtctgcccgagagccgaaccttaggatgtttggctaccaaaaaaccacacgttatatatatgtttctgttttttatgcatatctatgactattataatgaattaattnaatttataaaaaaaagtttacaccccccanatctgcattctttt

SEQ ID NO: 17539 - DNA, 2199 bp, Heterodera glycines
ataggaaaggtatatttattctcatataattttagaccacgaggatactaatttgcataaaaatgaaaattcatagtcaaaagaatgaagttttcagtgttcggtgtcagagccttgcgaggtattggtgaccggagggccagagggccaagcttaattaggtattggctaccggagagctgagccttgtgaggtattggttactggcgggccaagtttaattgatattggctaccggagtgccgaaccttacgaggtattggttactggcgggccaagcttaattaggtattggctaccggactgccgaaccttaggaggtattggttactggcgggccaagtttaattaggtattggctaccggagatccgagccttgtgaggtattggtgaccggatgctcaagacttacgatgtattggttactgtagagacgaatcttgtaaggtattgtctgcccgagagccgaaccttaggatgttggctaccaaaaaaccacacattatatatatgtttctgtttttatgcatatctatgactattataatgaattaattaatttaataaaaaaaaaagtttacacccccaaaatctgcattctttttctgataatttagaattaattgtcatgttcatcattcataccgtaacggagttaaatctgtaaacaaaatgtcataatcatttattattcgtcacttccttttgtcttattcactctacaatatttttgctagttattttttatgacttatacactcccttccttaattaatcataatttataaatttcactctactgaaacatatgtaaatctgttgaagttgatgactatattctcagattccaatattatgcttcatagatataatttcattataacccttctttctgcataaaatcttcaattagtaaaaaattaaggaacaattaggtctaaaattacaattaatacagataccatacatacactaccagaaaatcttagtaatttaaccatactaaataattgtaaaagcatctcaccaaacattgttccgcctttgaatgattaattgatttttagctatattacacaaaataatttacgactcattattaattaacattcttttacaactaataaaaatattacaagtcattctcggtaatttgaaataattaatcacataagttttaaaaacatcacacatactataaaaaaatccctatataaaacacttcaatcaaaaataattggttcataaattgtcacaacaattagcccccatatcatacatcactacaaacattctttgtaatttgtcataattaattaataagatttctaaccctcgtcataaattcctctgtaaaaaaacatattggtcaaagaattgtcattttcctacatttagtgattattgtttcttaattaacattacacaaaaaacttgcaataattagacatacagatatttaacgaatacattacaacacttttatacactaattaatttattatcaaagtacattaacccatatatatataattaaactatcacccacctcggtaacttgtaaaatttccatctattgtaataatttttaataatctcgacattagatggtcaataaaaataatatttcgaataaacatttttctagaatataaaaattaatttaatttaatgaatattataaatttagaatttaaacaaaatagtgatggtaaaaaaaaattgattttaagaaaaaattctttattttatgcagttgaaaaagacaataaaattagtagttactaccccctcccccctcccggtccctttaacctagtagcggtcagtcattagcgctcaaattatcacaaccgtgcgctcaaatggcccctgcgggcgctcatgtggtacgcgcgagtgctcaaatgacccggcgtcgcttccctcccgacagctgacgccctttcccttctccattaggctttggttttgcgaattatttattttatttttaatttaaattatttttaatcaataaaaacccttcaataggtttaggttcacccccgcacccatccaataggtttaggttcactcccgcacccatccaataggttttggtttaaaccaataggttttagttttgggattgtttatttattttattatttatttattttttaattttatttaaatttattattaatcaataaaaa

SEQ ID NO: 17540 - DNA, 2058 bp, Heterodera glycines
  misc_feature (1982)..(1982): n is a, c, g, or t
tcgttcactttttggttttgtttaggcggtccgagggatgaacgtttggaggcggaattatttaccggtgtcaactctggcatcaattttgacaaatatgaggaaatcccggtcgaggcgaccggcgttgaatgtccaccgccgatccaaagcgttcaaatttagtttttcttttctttgcattatgcgataaagttcagtttgcggacaccaatctgaatttacacccgtggattgaggaaaacattcgaaagagcggctacgacagaccgacgccggtgcaggtaaaagacgcgacactttggcattaattttgctttgcattcagaagtattccatcccaactcttgccgcgaaggtcactacctcaaatggacaaagcttttatcttattttacctttctgaatggcttttacagcgagatttgatgtcgtgtgctcagaccgggagtgggaaaacagcagcctttttggtgccggtggtcaacacccttttagaggaaggccagaaatggatgaagccggtagggaaaggattaactggcatagaatttatagttttttttatcagaaaagcactgggccaaatggacgcacatgccaataccctctcgtgactatccctttttagctatgctgttttaagatttacaatttaggcactaattatttcgccgacccgggaactcagtctccaaatatacaatgagtcacgcaaatttgcttaccgcactccgattgtttcaggcactttgtttgcccaacaaatatatttttccgttcaatttagcacttctatacggaggccgtgaaaattatcgtgatcagatcaacaaacttcgggtaattgaaattaattattaagaagcattcttttctttagttgggtgtgcacatgcttatcgcaacaccaggtcgtctgatcgatgtcatccaaaatgggctgattggcatggaggcgtgccgctttttggtgttggacgaggcggacaggtgcaaaagggataatttcaaagcaacattcatcctctagaatgcttgacatgggctttgagccgcagattcgtcagattgtgcaaatgtcctgcatgcctcaaaagggagagcgtattaccgcgatgttttctgcgacctttccaagagacattcaaattctcgcacaagacttcctcatgcctgaatatgtgtttttggctgttggaagagttgggtccacctctgagaacatcagtcaaaaagttgtttgggttgaagaggtataaacagttaaaacaaagaccacaaatagtgcatatttcgagttttgccttcgttttagcacaacaaacgccatttcctgatggatttactcgatgccagtgagcccgaggcactaacactgattttcgttgaaaccaaacgcggctgtggagatgtaaaatgcattccatgaaatctcacaatttggccttttaagctgagttacatgctccagcaagaaggctaccattgcgtagcaatccatggcgatttgaagcaaatggaacgcgagcgtcatttggagaacttccgcaacggaacggcacccattttggtggcaacagcagttgccgcccgtgggttggacattccgaatgtcaagcacgtgatcaattatgacctaccggtgggtgaattttaatctgttttatgccattttaaataaagaatgacatcgatgaatacgtgcaccgaattggcagaaccggccgtgtgggcaacattggtccgttcccattttagttaaggtttgtaaatggtatatttaggaatggccactagctttttcaacgacaaaaaccggaacatttctcatgaactcactagtctgattgtggaagcaaaccaggaattgcccgattggctcgaagaaatggcacgcgattcaggccgacacggaggcggtggggggacggtcgcaccttggcgccgggtcgaagcgtggaggtggcggaaatcgtttncgaggaaaggcaacattttactcacattaattatctatgggatattttattgtcagagaccatcgtgttcaaaccc

SEQ ID NO: 17541 - DNA, 1384 bp, Heterodera glycines
ttttcatttattttctcgtgctccgttttgttaaacccccccctctaacaactattattctcctgtttaaaaaacttaacttttaactatctaacggatcaacgctgactgtcatgtgttttaaccaggcgtagggacatttacgatttattttgcagcatttgtttgtttaaataaactgaagggaagatggattcgcatttggattgtggttaaatttcatgaaaacttgggaacctttgtgagaataaatacatcttgattttttcggaacaatgaattttatttttttaagtttttcgacctcttttggggctgttaccgtgaatcaactacaaaagtgccaaatgattcaacgtttgacaagcagctccaacacacatccttacccccccccccctccacgatagttaaaatggaaaaacattggcagaacattttacagtgtcattcctaaacgtaacataaaataaatgtgcatgtttttttcttgtcgttcgctgttcgctcgacacgcagttatttcacgtcccaggcgtagtgtttgttgtgagcggtagtagggtagtagtcggactgacggttggtttggaaacgagcgggatattcctggagggacaatttaaaaatgaaacaaaagatgcagaacctcaggaagacgccatttgagaaccaatggatcatcgggacgacgcacctcgaaaaactgacgatagaagggtttttctgaaattggaatggtgaaatgcgcaaagttggtttttcaccctcaaaaaaggtgttaatggtgttcaaaaatttagaattcaatgagtaaattcaaaaaataaaaaaggactgttgaaatttacaaaaaacaaacaaataatattgatgactcaggcatatccatagagaaaaccttaccgttccagcccatgccgaagttgtttggatacccgccaaaatagaaccttgttccgagacaaataatgaccgatggaaccagcatataccagcccgcagaaaattctggataatatttgagccagaaacgaggctttgccttgataactgtccatgctcggcgccaacgactgacgtaaggtcgatagacaataaccattttcgtaggatatcctgacttggatttacctttaatatatcatatatagtaatgcatagcccaggtacagaccaagatacacggctttttcaagcccagaaaaccctgacccgaattaccgaaaacttcttaaaatatatttttgtgacttttgaaaacaaaaaatttggcgctactgtaaaagtggtcccttttgaaaatttttttcataatggatttctgggctctactgcagtttacgcgtcgaatcgacttttacgcgaccaatcacaggtggcg

SEQ ID NO: 17542 - DNA, 2789 bp, Heterodera glycines
  misc_feature (2765)..(2765): n is a, c, g, or t
tgatatatgatacagacatatcaacgaaatacatatatgacaattcaaatgatcaatcggataaatgtcaatttcttatccttcttctgttgttgtgcatgatgctaatccaacgccacatccgcggttgtcgctggagtagtcgcagcgggcgcctcagtattggtcgccgcattcgtcgtcggagtagtcgccgctccggttgcatcagtgttagtcgccgccgctccatccgcggttgtcgtcggagcagtcgcagcggtcacctcagtattggtcgtcgcagccgtcgtcgtcgtagtcgcaccgggttcgttggcgttggtcaccgtcgctccgtccgcggtcgtcgttgtcgctggagtagtcgcagtggtcgccgcgtccgttgtcacagtcgccgctccggttgcgtcagtgttggtggctgcatcggccgtcgtcctctgctgctgggcagcgctcttcccccgtcgggcacggccttttttcacggtcttcggacgtccacggccacgcttttgtccagcagtgcgcggcgctgccctcgatttacgctatcccttcggtcgtccaaggagcggtttgagcttgagcggacgacgcattgccgagccgcgcttcttcctcgtcctggtcgcgttgccgtcgttgttgttcccctgccgacgtgacgcgcggcgcaccgctgcactcacacgcgctcgggcgctgcttcgaccacgcactggcgcggtccgtctgttgttggttgaggcgccctgctgtcgtcgacgagctctctgaacaatggcggggagggcgtaaaatgagacacggaaatagttgcagcaaaaaagagggactgaagcgggtgccaactgagcttgagaaacttttcagaagccatctttttcggcacttttgctgtttaagggggtcccgaaaaagaacgacagagaatttcattttcacacactatttgcacaattctctttctctgtttccactgtccccttgttatgagaggagagacgcagttttaaaaaaaatgttgcttttgctttacttataaaagtatgcgtctctaccgctcataacaaggggcagtggaagcagagaaagagaaacacgaaaatagcgcgtgtaagactttttctgtcttttcgggattcaccaaacagcaaaagtgccgaaaaatgtgatggcttcttaaagttgtctcattagacgcagttgaccgaccactagcgccagggacggctcaccgaacgcgctgctgttgacgcgcgacggcgtgaagcagtcctcctcgtccttgtcctagtcgctgtttgggtggtgcccggcgtgacgatgtccacagtcatttcggccaaattgtagacggattggtatacagaagacagaagcagggatacggagctaaaatgtaatggagaattgatatatggtaaatgcaaagacattaattgtgaaaaagtcgggaagttatacaaaaaattttcgtttttttacatggggtgaaaaaagtaagttcgggaaaacccaaaaaatgtcattagaaagtttttcacaaaactggcattccatttaggccaatctcgaaccccgggcccgaactcgaacaaacagtcgaaaactcaaatatttagaatcgcgtgtttttggtctcaaaaatggtctaacaatttttttttcattgatgacttttgtttgtttctttgtttttaagccgttgttttgaaaacaaaaatgcgaaactcgaaaaatttgaagttttcaaactttttgttcgaattcacgcccgggggttcgagtttagtcgaaatggatgtgccctattcgtgatcagcgcgaaaccgaaaatacattgggagaaacatttttccatgagttttgaaaacaaaaaaaaaaaattttttttcgctgtttttgttaattggtggggaaaatgtttttttgagagtttacctacataacttaaaaatcccgaaggaactaatcaaattaagttgaaatttgaaatacttactaattcaaaaaacggagtggcgacaaaatataacgaaggaaggcaaaggtgttgggcatcagccgacggaaggcggaaatatgaaaaatgaattgtgtgtgtgggaattggccctaaatttcgttccttttatactgccaaatttcgttggaaacgcggagagagtcgggggtcactttgacgcgggacattttggcgccgccaattttgaagttttctaatttttttttattttgcaaccaaataaattattttgatatcaaacgataagccaaagtgttctttataagcctgcaaaatttgaaaaaattatattagattaaaaaaagggacgaaacccaactcgtactgtttttcgagaaaaaaaattgtcataacttttgttaaaaccaacaaaattaaacattcttggtagggtgaagcgggaccgggaattttgggcaagaccgggaccgggaatgttatagcgtttaatggtgaatatttgagtccatatgcagtacaatgagtttcgtatttttttaaagaattttaattaagacagtttttttcaaattttgataaaattcattccgatttttttgagaaaaaaaattccgttttaatttaaaattcttaaaaaaatttgcacgaaattccatgtgtaacaaaattctccaaataatgaattaaaaagtggcaaaaaaaaatgcagaaataatggcaaaaatgtagcgcaaaaaatgatgaaatttgtgtttttttttcttangaaaaatgtacagcaagaagtgaa

SEQ ID NO: 17543 - DNA, 912 bp, Heterodera glycines
caacaaaataatcaaatcggcgactgatcatcgcaattcctaggccaagctgagagggtgccagcaaatcgaacacctccaaccaacagtcggcagagatgaagctgaaaatggaaaagcaaaatgattagcatagaaattaaattgaaataaattatttacatcgctttttccatttctttatttgcttctttctgattgtccgacatttttttgaattggtaagcacagaaaatttaaaagaaatgaactgaaaaaacaaaatttatcaaacaaatggaatgaaagggaagaaggatatgactggaaagggatttggtcggctttatatactcggatacacttgaggaacgggggatggaataatggacatcagaagaaatagtaattaaaaattcttggcgctttgcttccctttcatcgattatttttctttttgacaaattaataaataaattgcgccttttttatcttcctaaataattgttgcaagttaaaacaggcattttcctctcattttttaaatttggggggtgtaaatgaaaagtatcttatggtgtttttgtgttccttttgctctctcatttttccaatttgtctccttttttaagtttaacaacagatttttgctcttttgagacacaccaatcaaccgggaaagggaaaagtgtgctaattgcagcaacaaaaatgaacagacggtaagcaattaatttaaaaaaaaattacaatttttagtttttctaattttttttccatgtttcagttggatttgtactgatgtttggatggacattttcccatcttttgaccgtcccaaacttggtctccaaatggcattgctttcttatcgttttgatgttttttgatggacaaacattttgatggaaaaagcgaattgacaatttggag

SEQ ID NO: 17544 - DNA, 1921 bp, Heterodera glycines
  misc_feature (1869)..(1869): n is a, c, g, or t
  misc_feature (1901)..(1901): n is a, c, g, or t
atcgctgacgatgggccgaatgcaactgctggccaagcggtgtccaaatggtgcacactccgacgaaaaatggacagccgaagcgattgctataccatattctttcacaaaatctcgaatgggtcaagttcttcaaggaggtgatccgccacatttaaattgtttttatttttctcaattttgtttagacatttctccgtgccaccaccactttcgtctgttacgaaaggtcggcgccgaaacgcagtggacccgttacgaaattcgttttgcaatttgcatgaaaacaacgccaactgaaccatttgaatgggtgaacgaacggaccaatgagaagctgacactaataaaggatggaaatattttttggctgttgaaacggtgcccaagtattggggagacggcgacgacggatcagaaacaacagaagaatgaagaaaattcggaccatttgaaccgagtcaacttctttcttcatggaaattgcattgggtgagcggaaagaaggcttacttttgtaacggagtacagtacagtatcctctgcacggtactttcacagattcttggcagggccagcaggggttcctgttaaaacgggacttcattccttgacttaaaactgggtccgtcagtgttctaagccaatttaaatttcgttaatttaggccgttgtctccgccaacatatcaaagcgacgaaaaagtgttctcttttcccgggccaagtgatcagcggaagaagtgatcatttgagaaattaccgatcatattgcgttttgatcaatttgtgttgattgatgctatttgtttgctctttggactgaccattttggcgctgagtataaaataggaatttgaattgggttaaaaaaaattggaaaattcggcataaaaacttggattttccaattttcaatgttatttcattcttttttagaaaatttcgtccctcataatttttgaaaagtgatcagaagcgcaccacatttttccatcaataagacaaggaaacgcacatctatgatgctggctcccgtattctgaattttaaattttttacttatgcttattattttagaggggtccggcggcgccgataggcgccatcttaaaaaatttgtaatttttaatgcaaaacaaataccatttttttttcttctctttttggcgtaccttaaaaaagtacttatattagagttcgttaaaaaaaatttccgggaatgggaggggaaagagaaaaagctggactggaacgggattcccgcctttttaccgctaaaatcccgtcaaatttccctgttgccgacccggtgtaattactttttactttttatctgttttatacacttttacacaagcaattcaaaaaacaaatttttaaaaagttcatttattttttctaatgcatccaattgttttgcatttgctttaaaaaagctttctcatcaacagccttcgaatgttattaatctctccccttttaatggctaaatttaaatattgatttgttctttaaatcttacttaatatattaaatgtggacttttttcagttcatttcttttaaattttctgtgcttaccaattcaaaaaaatgtcggacaatcagaaagaagcaaataaagaaatggaaaaagcgatgtaataatttatttcaatttaatttctatgctaatcattttgcttttccattttcagcttcatctctgccgactgttggttggaggtgttcgatttgctggcaccctctcagcttggcctcggcattgcgctgatcagtcgccgatttgattattttgttgacgaacacttcaaaacgcgcaaatggacattgggcgaaatgaaaattcgacgcaaaattgggcactnttgggcgttttggtatccccgatgctttcagnttttaggggtcccgcaaaaa

SEQ ID NO: 17545 - DNA, 2086 bp, Heterodera glycines
aagcgctttttcttaatcgtttagcaaaccaataatctttatcattttaaattagtttaaaatgttcaacaaaaaaacaaaaatataatttaattcaaaaaaacaaaaactcacgattattaataaaagggaatgaaaaatttaattaaaggcaccaaccaacgcttcacaatatctcaaggcgagcgaatgattgtaatgggcgttgaaaggcaaaaagtttccattaaaatgtccttgaatatgggcgtaatatgtaaattagcatgccaacatttagatttttgctttcatttgaatttttgaatttggtttgcctaagtatttttttccttttggtttatttaatattttatccattgtaatttaatattttaaattttattttaaaaattattttctttggataatctcttgatttttattttaagttttttggttcgaaaactcagttatttttatgtaacaattctttattaaatatatacaatagcatattaaatcattaggcgtgtgtttttagtgaaattaaagagataaaaaaattttacttttaattttccaaatttttaaatttatttgtctagcaacccaatatctgtcttaagttaaaaatataaaataaaatttaaatgacaaaaattaactgtcaaatatttttaaaaaatttttcaaaaatatgatgccattgtatattagcaaagtcaataattgttaaagttaaaaattttaaaataaaatgaatttaattctgtttatttttaaaatatttctgaattcgaatttttataaagatttgaaacaaactttagtgtctattgttacagaataaccattatttgaaattttctattaataaaaatttttttatttaatatgaagaaaataaaataaatataagaaattaatttttgttatttttatggtaattttactaaattaataacgtctaattaaattaatttagatgaagtctaaaaaagaaacgcttatttaatagataatatttaaataatcaacaaaattcgaaattaatttattttctaatttttttattatattataaatttagtaaaagttagattttactttatttattttactaatttttaatgtgttccgattttaattaattcttagaatggccaattaaataaaattttaatatctttttttaaatttaaaagacttaacaataaattaaaaaaatatataattattttacaaatcaaaatgaataaattaaaaacttagaaattatcgaaaaattgagatgcgaaaatttaataaattaaatcttaacaaaaagaatgcatttcatttacttgcatttttattattctgattaaaatgctattaaataaattctctttataaataaatacaaaatttaggagaagtgactgagaactaaaaatgaaaacaactaaatgcaatttatataatctttaggaatatttaatcacaaaaacaaggttttattacaaaaaagatatatgcaaaccgattattttgcaataacaatgaccaattaaataaaattggttagttattcctttagaattttaaattttaaatgattttaaaaatttatatattaaaaaacaaaaagtttatttattttaaaaatcaaaatgaatcagtaagagcatataaattacagaaaaaaaaggaatttaagaggagtgactgaactggaatttgattgggtgccgacaatcggcaaagtgccattgtacaaatactcattttaaattaaaacatttgtgtccaaccttatttcaacactgaaactaccttgtgattttgattgcttgatcatttaaatattaaaattttaatttcatttgtccaaattaatgtctaatcacagaaaatataaaattatttgaaattcccttgcctaaagaattaatgagtttttaaaagttttcatctctttttacttgctataataatactaatttatgttttcaatttcaaaaaattattctattgtattcatatataacatttatttatttattttttcatttttaataattttgaaaaactatttttattttcattatttaattaataaatt

SEQ ID NO: 17546 - DNA, 3764 bp, Heterodera glycines
ggcccttttattttcaaaataaattttatttttaaaagatatttccaaaaaaatgggctatctctttttttgagaaattttctatgcaacaaacgctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccatggccattttattttttaaataatttttatatttaatagatattccagaaaaatggctatctctttttttgagaaattttctatgcaaaaacgctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccatggccattttattttttaaataatttttatatttaatagatattccagaaaaatggctatctctatttttgagaaattttctatgcaacaaacgctttcgaacatgaaacgaagtgcggtgcgccatggccattttatttttcaaataatttttatatttaatagatattccagaaaaatggctatctctatttttgagaaattttctatgcaacaaacgctctcgaacatgaaacgaagtgcggtgcgccatggccattttatttttcaaataatttttatatttaatagatattccagaaaaatggctatctctatttttgagaaattttctatgcaacaaacgctctcgaacatgaaacgaagtgcggtgcgccatggccattttatttttcaaataatttttatatttaatagatattccagaaaaatggctatctctatttttgagcactcacacacacacacacacacacacacacacacacacacacaggcgcaccctcgccctctcacacacacacacacacacacacacacacacacacacacacacacacacacacacacacacacacacacacacacacacacgcacacacacgcacacacacacacagacacgcacacacacacacacacacacacacacacacacacacacacacacacacacacacacacacacacacacacacacacacacacacacacacacacacacacacacacacacacacacacacacacacacacacacacacacacgcagggagaggggaagacgcgaataagaaagaaaaaagcaacaaaagaagacatagggagggaaaaagagggcagaaagaagagaaagaagacacaatttttgaaaaattaaggaatggaaaatgcaatttcaaattaatagatggaagtggtcattttaaggaagaaaaatgcataattagtgagcaaaaacaaaactaatataacggtacagtactctgtgagcattcattgcgtccgctgtcttcatccatgtctccctcaaatactaggcgcattgttgtgtcggataagtttgacgacgattgtttgtcgtcaatttcagtgaaaagacggcccagccaatgctcgttgttgttgttgatgtccatgtccatgttgtcatcaatcagctcaagaagttccattgggtagtgccgatcctcccctccccccgaaaagcgttcaattatgcacggtgcatacgggaagtgaagctttatgcggtgccgtgcataaaaatgcgccgccacattgatgttgaacgggttgcgcaattgcccatatgcgggaagaaatgcggcgccttgtgccgaaattccagtgacgaagaaagttttggtcaatccattacggtcgttgtaggtggtgcggactttgcgtccaatgatgtgtttcagcacaagcgcccgatcctctgggtggttgagccggtcgcgcaatgacttgacagggcagttgagaagctgagcgcaaaatgtgcttacaagaaccatggcaggagaatgaaattggaatgaggttgaaaaattttacttttatatgcgcaaaagtgtggccacgcctacaccatttgaaaagagtcacggttttagacacgcccactaaaagccaaaacattttgcctgccaaaaacccagaatcattttaccaatttttgtcaaaatgaaaagacgcgttgctcctcttactactgctactgctcctgctgagcaacatcaaataattggtcccgagtcgcccaagccacatgaagagacgcccaaaaatgttgagccgaaggatgagttggcaacgaagaaacacaaagtggacgaccgagagttgtggaaattggcaaaaggcaaatttttgctgaccacttatttgtgccatggtaataattaataacaatttcatcaaattttaatttgaatccataaattttgagatgattggaatcgtctgtacaacaaccagcagaaagtgaagcgcctggagggggaccgttttgccttcggctttgagatgtgtgaggaatgcgtgtgggccaactgccgcgcaaccgaccttttggcgccaatgaagaaaaagtgaactttgaccaaaaaacaataatggattttgatgatgcaatccataatttgaattaatattaattctgcataataaacaattttttttttgagacagtcctcaatttccttttttgtgtgttggttaagatgaaatgattaattggcttgccgaatttgaatctggcaaagacactgagggggggggggcacatggatagggataaagcgagtggaaggaccattcattgtcttattacacaaaccctctaaaaatataaaatgtcccgtcgcaaatcttcaattgctccatcacggtttggagctgcaatgcagatttaaaagaaagaaaaaatttttttgaaccaaattgttctgttgaaggatgcggcgagtgccattcggttcggtgcagggcgtgcgaaagtctgcgggagaggaacagagaaagaatgcgtatgggactaccccatgggcgcatcagcatggaatttgggccgatgaccagagaacagcagctcagtacaacggcagcgcgcaacccaatggaagccgcacttcaagctggtagcgaaacgaaagccgtatttcgttggggggacccgttggcacttgtccagttccccaccactttgttgtacccaaataaaagggggatgtgtttgtgtactgtagagatggcgcaattttttggggcctgtgggcacgtgggactgtgccgtcagtgtttgcttattcacttaaaaatttcacccagtcctgataaatgtccctattgtcgagtgtgcaccacattttacatgcagcattaaatatttgtcaattcttttttttccatatatattttgaataaatgtacgaaaaaatttatttttaaatgatgagaaatggtgaaattttattggtgaaattaaatggtgaaatttaaatggtgaaaatgttcaattcggccggccagtgcactcatcagctcatacactttgccacgaagcgtcgcagtttactcttcgccttaggaaatatataatttaaattaaaaagtgcatttgtgtgcttacatcctcaattatggttttgccctcggggctttccataagcccttttgcgaacaaattattatactgagttgtcctcaatatgaattcatcttcaatgtcatccaactttgccaacactaac

SEQ ID NO: 17547 - DNA, 980 bp, Heterodera glycines
attttacaaccaaaaaaaaatggttcgtcttattcaaaaccaattttggcggggaacgttgacgcagccgtggggtgtcaagatgttcaagtacatttggcgcaagcacagtcgttttttggtgaaaacggttatggtcagttttcgtttttatgacccatttaattatcaaaaaaaaaaaaaaaaattttcctcccattttaaggtccaagaaaacgacatcgacagcgcatttcatctgctgaacaggttattacacattctgtaattttgggtaatttctcaaaataaaaatgttgaaaattttcaaattgagcgtaaaattaaaaaaaaatttggacggacccaaattttcaaaatttcggggctattatggctaaaacaaaaaggatgggtgggaaccctccatttttctaaaagggtgccagtttcgtattcagagggaccccaaaaaccccggggaacaatttttaattggcattattttacaagaaaaattcaacaaattggttccctctttacagcctaatcacaaaaaatttttgttttttttagactcatggaacgtgaagggcttttgaagatcatccgcaacacccagcgctatcagaaaccgtttatgcaggtttttttttcatatttggaaaaaatttttgttgatcattggttccatgcaagcccaaggggtgtctcaggaaaaaaaatgtgaaaattttatcgaaatcgctccagggcttcgaaattggttgaatttacagagtctatttgagacgctgaaacccccaaaataattttgtttcgaattaaaaattttggatttattttttcgaaaagggagagagtgggcaccaccggcactattacccatttgtgtgctactattcacaccgcttttttcgcggcgcgctttttccaaaaatttctgtaggggaacagggtgaatgcctgcgtgcatagcaagacggggggggggggggggg

SEQ ID NO: 17548 - DNA, 1248 bp, Heterodera glycines
tttttcacgtaaaatttcacgtaactcacgtaaaacaagttatggctaaaataaacgatcagatcgtgatcagcgcttaaaattagcctagaaaaaattattaaaaaaatatttcagggggggggtggcaaaaccccataagtaccatccgtgggatgaactgttctcatcagttttaaccccaaaattccgttttcaaatggatgctcctccattcttaaaaaattggtgtttttttcagcgttcccaactgtccatcgaggcgtcgaaggcaattctggaggaggaccgggaccgcaagttcaagttcttggtgaggaagcatcgcgcggacgcgtacccggggcaactgacgatgtgatgggggcgggcggaacatttgtcattgtttttttcactcaaatttttttttattggtaaatattcatgtcttccaaaaaagcatgactttatcggcattcatcaagaattggtgtcccgacgaaaaaaaatagattttgtaaaatcattgattttatcaacgatttttcatcaactacttgatttttccaaatttttttatgaatttgggttaagaaatgcgcttatcacgcatttgaatttctaattttaaaaacaatatttttgtctatgatctctctcatcatttttttagtctattttccaaaagaataactgcttttttgtttaaaaacataaaatttttctttttttaatctaaaaaaaaccatttttttcatcatctctttcttcttctctttctttttttctttcattttattttctgtttcaattattttttgtttatataaaaaataatccgcagccaagcggattcgaaccctgtaccaccgcctcataagactcctaaccattaaatgcgaacagaaacaaaagggcaaaaattgaaggagaaattgcgaaaagtttagggattagtcgagacaaaatttaccaatggaagaagcaattaggtaattaaaaaaggaagccttaaatccgattcattaaaaattagagtgccacgggaccgggccgggaattcccggtcatccgaggtcccgggttttgaaaagctcaggtcccggtcccggtagggcaaccgggaaccgggaaaaacaagcactggtaagaatgggggtctgagtgaaaaattagtgaagaaaattggagtcaaagggaaaaataaaaaataataattaatataaacgataaaagtaacactgccccaagtgtgcaaatggccta

SEQ ID NO: 17549 - DNA, 3827 bp, Heterodera glycines
ttatttcttagcgttttatgtgtaattattagtcaccatgaggcctaaaaatttgcttatattttgtgaaaaataaaaaaattgtttaaaaattaaattttaaaattttaatccttcaaccccagaaatcaaacttttaatgggctggatgacatgataaaaatatactaaaactagtctagttattgaataaaaacgtaattaatgaacttaaggcggcgttctaaaattatacaaattaattgtataaaaaaatataataccaaaaaataattcaaaataaatacggcattatattcagaatatatttatacagaaaatttgttacatttggtcacaaaataaaaattcatttaattaatatacttattatgatattttcaatacttatttaaaaacttatatttaaaacacttgcaaaaggcaaaatatacatttttttaaattaaaaagcaacataaaagatatttaaaaaataatcattaaatcaatttatttagcatttattcaattaaattttttcttcgaaatacgataattattggaatgaaaatcataaaaaaatttcttttaatggacaacaaatcattaactaatagatcaggctttagatttataataagctaaaaaattgaaatttataattaaattattttacaaattagtgaaatgatatttaataaacaaataatgagaaaaccaattgctaaattaaaaataccggatttaaattaaattatagataaataaaaaaacaaaaaaaattttttaagacatttgattttataaaaatatataaatttaattcattttaataataaataaaataatttatgcaataacaactttaaaattttttaaatatgtacaaattaaatgtaaaataaattttgctttttttcaggtaatgatgatttctttgattaacgaccaatggaatacaaatgaaaaaaacttggttattttcccatttttctttttttatactaaatttggactcaagcatgtaatgtttggtctgtcggctgcgtaatgttcgaattgtactccagcggaaaagcaaattagttttgagagctggaattaagctggcagctttgcacctcccctctccccgcatttttttacagaaaatttcacgaaaaaataagaaaatttcagtgaacagtttttttcgttttagacttatataaaagaaattttttgagtttgtaggcctctagagaaaagtaaaaagagttaattttaaaatataaatcaaataaattatttttttaatatttaattactcatcagtggtttaaatgaacttatatattaattaattttagaatatattatgtgtcagtagcttgtatttttcagtccttctcgtcacccatagtgatattctgcgatacttgttttcactcttttaattattatcttttttaaatatactaataattcttatttattttttttttaattgttattcatttttatttcacttatttttaaaaattcaattaaataaatttactattttaaatattttttattcatcattagtcatgaattaaaatttttttaaatttttttattcttcttaatttgttttctttgtctaaattttaacaaaattatattttaaataatattttcagcatattgtgattaatttctcagttgtaaaattgcttttacataaaactgttgtatatctattaattactttataaaaatgtaataaccattgtaaaataatttttataggtttaatcgcttagaaataaactaaaataaagttgaatgtttaagcatcttcaaatttaaataaaaaattcatatttattttttatatcatattagaactgttaatttatataatttctataattattaactgtttttatattaaattaaatttttctttaggtgttttatttctttaataattttcctataaatgatatgatttgtaaattatttataacctttactaccgattccgtaaaaatctcgtccatattaacgggagtcccgggcgggagcgggagtaattcgaaaatttaattaaaaactcacaaaaatataggcattgctttttatttataaaatagttttaatgttagttatatttcaattactatattttactttttattgaataaaataaatatttggtgtatctatttctaaataattcttaattttaatttgtcagttcatcttgtatttttatggtcaaataaaattaataataataaaattttcaaatttcgaataatataattgcaataattttttctttttgctgcttatctcttcaaatcttataatcacaccacattttgaacaaaaataatgttgccaattaaatatttttttattattttgagctatttttgaataattttttatttattgatttatctctttttcaaatactgaatatatcaaattttacaaaaaaaaaaaacaataaaattctctaatgtctttaattattaataatattattaagaaagtaatctctagggctggcaaaaatatgtacaaaaagtggtcaaaatatgtacataaatattaaagaaaaatcccgaaatgtgtaagaaaaataccaaaatatgtaaaaaaattaaagtatatttttggaaaaaaattcttcgtatagggtaaaaagcacaaaatgccataaaaatgatccaaattggattagaatcacatttttatatgtttaaaattaacttttggtatttcttttttttgaaaaacccgatttttagaggtacattttcaaaaaaaaatttttgattttccaagaaatttttaatagaattatgtaaaatatgtaaataatctcaacttttgttcgcaaacccaaaaataaagtttttttctattatttagagcattaagaagcagggaaaaaaacaggtatttacataaaattgccagccctagtaatctcttaaaaattaataaaaatttatttttcttcgtaaattattttcataaataaaaggtattcaattttggaaaaaaattttcagaaaatttcacataaaaatgaattttttctggaatataaaaactttacatattttttattaatgaaattatttcgaggtgccggcgtttttcctaaaatcgcaattttaattaaaaataataaatgcgctagaatttatttatttatataaaaaaagttttttttatataattcaatcaattagttcgaattaagcacatttaagaaacacgcccaggacgattagtaaagtaaaatatataaataatatgtagatttatagaaattgttaatttttttaaatttaattctattaaataatttctgtttctcctataaaatgggtttttatttgaatttttctttggttttattttagtttaattgtttttgtttcttctattctttgtagtaccactctcttaaatccgggcgaggcttttaggtaaatgaattattgctataaaatattactatatgaaacttgtaaacaatattgtaataagtatagaaatatttacaaaatatttatcctgctctctattccttttaagctttaaggctggcataaatgtggacttacaattagtaaaaatttagaaaccctaaaaaatttaataatataaataaattgattccaatattttttgtttggctaaattttgcgtgaattttttgttcttcttatttcctttttaaattataagtaaatgattttttgtttactttttaattagaaataaataattaaattaaatttttcatttttttctttctaaaacatcggttcgtctcggttgacgtttctctttag

SEQ ID NO: 17550 - DNA, 2343 bp, Heterodera glycines
cgtcaataaactgaaagaaaaaagttaaaatttttgtttataaggcagcgtttgtgacaaaaccaacaaaaccattcattagtcaatcattgaaaagtcaacagattaattaattaacttgatgacgattatgtaatcgttaagtcatttcgaccatttaaaacgcacttttatcaccaattaattgttttattttctaaattaaattttaatttattttttttatttagtttattctttttattcctcctccttagttaatgagtttgttcttccgatttcgctatgccattctctttttggccactttttgcatggcttgcatttcgtccaatatgatcgcatttaatttcacccaaattgtgatgagaaggaccaattgggagaacgcgtcctttcccaagaattcgtccattttgctgaaggaaagtgacgtgcatttgaaggtaattagtggttggagtgatcaaacggggaaacaaactgatcaaacccaaaaactgatcaaaaaaattgaaaaatgaacacaaaagactgatcagccttgaaagtggaaaagattgatcagtaaaacatgagaaatagaatgagactgatcagagccaatgattggtcagtgccaaaaaaggaaaaaatgccaaactcttctgaaatgatatcccaaatttgccatcggtctgatcaacctccactctgttgtcaggaggacgtgctgcccgggctcgtgctgaacagcagccacgtggtgcctccgacggtgccctattcgtcgcgggaaaagtcggcgctgctttacgctgtcggcgcggccagcatcgtcagcacttttccgttcagtgccctgtacacgcgcttcggcgctcgtttcgtgttcttcggcgccggtgtcgccagtgccgtggccaccgcacttttgccgttggctaccgcccgcggcatggccgcctttctcctcgtccgcttcgtccaagtcacccccctccccaaatttcctatttatttcttcatttcataaagggcttttcctatggctctatctttgctgccattggtttcgtttgccatcgttgggcgactctccgcgagcacggcttattcttgttgattttataattcgttcttaataaataaatattcaaaccttttcaggtcctttatgacttgttttacgtcactttccgttgggatgactaattatttggctgcttttgtaaattgtttcaaattaccaataattaatttatggctcctttcgcttttagcttagctcaacgccttctttgggatggccttgggtttattacattttggctttgttcactttgctcccgttcgttttgtggctttttctgtactctgatcaaccggaaaagcaccgatttgttggtttgtccgaaaggaaggcaattctgagggacaaaacggaggctgagattgtccgcagttgcaatatgccatatttgttcgtttttttttttgcgtttattttttgccaattgtccctttccctttagcaaaattctgaccactaaaattgtcttcgtcatttggttcaatgccttcgctgacatcgtttccgctgtctttctgatcacttacctccccacttatgtgtccaaagtgctccattacggcgttcgcgagactggcatttggagttcgtttccggcggttgttcagctcccattacgggtccttttcggcattttagccgataaaatcgggtaatgtttgcttttatcagtgtgttaattgcccttaattattcctttttcattttgctaattaacttttctttcagttgtgctagtgaattgaacaaaatgcgcttgttcaattccattgccctcgttctttccgcctttttctttgtcctcgtcggttttgtccccgaaaatttgcctttcgttgccattctcattatgacgcttaatttggctgcggttgcgtgcaatactggtggcttctacaaatgtgccactttggtcactcggttggtttaaatcaatggcaataaatgacaaattcggtaacggatttttgagtgattggttaaacggtaaaattgcctatttttattgttgtcacagtgccgaacacacgcgaaagaatggggccggaagagggggaaaggaggggtgagggggcattccttgttttggattttgcccttaattatcagtcatgagtaatttcaagaagtttttgatttgtttagtcaatacgcccattttgtggttgccggcattcaattcgaaaagtctgtcactttgttcgtcgccccctttctctacgcccttttcatctccgatgagtcttcgctcgtccaatggcgcgccattt

SEQ ID NO: 17551 - DNA, 1284 bp, Heterodera glycines
ttacctccccacttatgtgtccaaagtgctccattaccgtgttcgcgagacgggcatttggagttcgtttccggcggctgttcagctcccattacgggtccttttcggcattttagccgataaaatcgggtaatgtttgcttttatcagtgtattaattgcctttaattactcttttttcattttgctaattaacttttctttcagttgtgctagtgaagtgaacaaaatgcgcttgttcaattccattgccctcgttctgtccgcctttttctttgtcctcgtcggttttgtccccgaaaatttgcctttcgttgccattctcattatgacgcttaatttggctgcggttgcgtgcaatactggtggcttctacaaatgtgccactttggtcactcggttggtttaaatcaatggcaataaatgacaaattcggtaacggatttttgagtgattggttaaacggtaaaattgcctatttttattgttgtcacagtgccatacacacgcgaaagaatggggccgaaagagggggaaaggaggggagagggggcattccttgttttggattttgcccttaattatcagtcatgagtaatttcaagaagtttttgatttgtttagtcaatacgcccattttgtggttgccggcattcaattcgaaaagtctgtcactttgttcgtcgccccctttctctacgcccttttcatctccgatgagtcttcgctcgtccaatggcgcgccattttcatcggaatggccgtcgttttactaattgtttgactatttaaatgattaatgcatgtgacctttattaacaaattgaaggcaaatgcttttttcgtcgtattggcaaccgatcagccggcagaatttacaaaagcgaaaaagaaaaaggacgacgaagagaaaggaggagaatgggaggaagagaaagaggagcaaaagagaagagaaatgaaccgaaggaaataataaaacggcaaaagcaaattgaaaatattaattagacttttattaaaaagaaaacgaaattggccaaattatcatttaaatttcgaattcttttctctgatttcttttgccctctcacttttcccttcccttccccctaaattatttttttattttatataattttccattttatttctttttccattctttttctcttttctctctttccatttcaccaattccttgcgtttacaattaaaaaagaaaagaaaattacacaaattttctaaagaatgggcgaattggccttcatcagcgtattgccac

SEQ ID NO: 17552 - DNA, 1519 bp, Heterodera glycines
atggttatttaaatccacaaaaccttaagtctgaatttttgtccagaacttttttgaaactcaattaaattttttgaaattatattggtaaaagaaaattttatcttattgcttctggaaaaaagttataaagcattaaacagactatgttttttttgccacagtcatgcgaatataattataaacatttaaaatttcaagtaataaaatgcaattgagccaaaattaatttatatattcgatagcgcttagaattctctatttacctttaaaatttcagaaaatttcattgattttgaaaaaagttctgggcaaaaaattccgacttaatattttgtggaattttggctccataacttttttataatttcatataaaaattttctaaattaatattctgatagacaacactcaaagctattaatgattccatgaaaatttaatttggttgaaattgagccaagatacgaatttatatgtcttacattttttattttcctacaacttggcagtttttaagaaacgacctagccccaaagggggcagaattttcgaatgtatcagacggtaaaaagaggatcgggaatcaaatctgttaatgaaccataaatttaactattttttgcttttcaaactcacttttttcggcgcaattttttcaaaaaaatttttagcacattttcaagaaaattaaggatttttaggcccggcggtgccgataggcgccgccgggaaaatttttcgaaatttcaatgctatttattaacagaatccgaggccccaaaaattttcggaaatcagaattctgaccccaaaatttttttgaaaaatttaatgctatttgttaacagattttgtccaaaattgaccaaatttcgcacttttttactcaatttcaacaggattaataagtgaaagccgatccggcggtgccgataggcgccgccgtgaaattttttgaaaattctagatgaaatttgagagaaaaaatgatttaatttgattgaatttattctaaattaattcaaaaattttggcattctattctttcaaatttcaaaaaatcaataaaatcccgcagaatcccgtacaaaaagtcaaaatttcggatccggctgcgggattggaactcaaaattctttgcgggacgggatcccgcgggattaatcccgcaaatcccgcattttccaaaaaaatgcgggaatgaggactgggatcccgcaaaatcccgcgcgggatcccgtcccgtgcctgtctctagtttttagcacctaaaaatcgaagccctactaatcatcaagtaacaaaatattggttggcgcccatttagcggcgcccattccacccccaccagcggtgggcaaaatttcggcgctatgtaatttcgacactgggtaaattcgacactgagtattttcgacactaagtaatttcgacactgaattatttctaaaactttcactgttttcctgcattttcgacactggaccatttcgacattgagtaatttcgacactat

SEQ ID NO: 17553 - DNA, 576 bp, Heterodera glycines
ccacgaattgtccaaatcatgaaatgtaaaagccacgaattgtccaagctacgaaatgtccaaaagagtaaaaaaccacgaatgtccaaaagtctaaaaaagctcataaaagcccggaaaactggtctattttagggttttaggggttgctgaatacgaatacgacctttatattgccctttgccgaatcctggacccaaatataaacataaaatagcaaaaaaaaaaattcaagacttctacaaagggtgctgatcaaaattcgtagggttcccaggagatctaaattgtgccatcatttgttgtaatagcgcccgccaaaattcgcgtaatgaccgcgtcctgcaggacgtgtattgtcacttgtgagtaaaatggctaccagatcgggccgcgtccacctgtctgtccataagtccgagagagcagtggtgacagagatcattaaatgttttttcaattttacttttataaattataaagaccataaagtcttgcgtgttattgcggtcatacaagacggtatcctcaccacgttttcacgtaacattgctggaacgacaacggtcaacgggt

SEQ ID NO: 17554 - DNA, 3465 bp, Heterodera glycines
  misc_feature (15)..(15): n is a, c, g, or t
atccaggtccaggtncattttggaaatccaggtctaggtccaggctttttttcaaaatgccgatctctagttaaaatgttttgtcaaaacaaagttcagttttataaataaaattaaacattcagaaatatatacacaaaattataaaacaactgcgaaattctgggcaattttgcacaaacacaaatctatcttttgcatctttttttttgtaataattaataaatgccaccatttttggaacaaaagtgccgcattcaaaaaatcccaaaaaaaagagagtcgtaaatttacaacaaaaatgtgaatgtcgtcagtcaactcaacccagcagttgaggatggaacggcacagataaggaagggcacagtttcattccattgaacgaatcgaacgcgttggatttactggcgaagaatccgccgatgagagaataaatacttgggcaaaatctttgagagtgtgtatatgtgcacaataataattttgcgattgggctggatcaagatgggcaattctgataaaaccaaatgtgggattgatttgatgtaggatttggcaggatttttaaaatgggaagaattttttttttttgaattttttttttgggggaggggataaattgtaatggatgggattgattctatttaggatttggttggatttttaaaatgggaagaattttttttttttgaattttttttttgggggaggggataaattgtaatggatgggattgattctatttaggatttggttggatttttaaaatgggaagaatattttttttttgaatttttttttgggggaggggataaattgtaatggatgggattgattctatttaggatttggttggatttttaaaatgggaagaatatatttttttttgatttttttgcgaggaaaataattgtaatgtaattaagtagagtagataaatttatttgaatggataaaagtttgataagttttactcggtggtttttggcttttgatttaagtgcaagaaaacagaatttaatttaaaaatttaaattaaaatattcgattttttttttaatttagcatattttatttttgggaattaaatgtcggagagattttgaaagaaaaaaatatataaaattttcatggatgcgtaaaaaatagatttacaaaaaggaaatcatcgattggggaagaataagtataatgaaatcaattttgttttttttttttgattttcggtgaaataaaaattttatttgtgaggcgtggccaagcaaaacctttcggcgaatcagagggacggaatacacatacagtgttgctgggaacaaatcctggatgaatgtgctcggaattctattggcccccgaggggaaaggggcggaacggtgagggggaggggacaagtgggaaggaaaaaaaattgtatagtctaaaataaaaaattttaaaacagaaaatttagataaaataattttttttttttttttttaaacttaaaccctttgaaaattatattaaaaaaccctatttaaaaagttaaattaaaaacgtgacaaaaaatagataagcccattagagaagtttgttaattaattatattataatatgtataagctaacataactcagtgataagtgacaaaaaatttttgaagaaaaaaattcaaattttaaaattaaaaaaaaaattaagtttaaaataaaaaattttcgaaatttgaattttgcataaataaatttttattacttaactcctttgaaaatgataataaaaaaatatatttaaaaaatttaaataataatgaaatttctttttaatttttagtatgaacaaggtaacaaaaaactcaaagttcagtgaaaaagattttgaagataaaaaattcaaattttaaaattaaaaaaaattcttggccctgaagctagcctaaaaattgtttgcacatgacgcctaggaaaagcgtagcaagcaccattattccccactatcccaaccagcaaatatgggctgtgcaatgggcgggggcggaggattgtgctgggctagcccacgagggctgggcttggcccgatctgctgaagagggggggcggtggacgtaggaggggacggaccatagcgaccggaagggcttcttcgtgctcccggaaactcaagactctcgactccaacccgttcggcatataaatacttatcaaaaggatgggatgacggcggtggaggaggatgaggagaaggaggaggtgcgcggatgggaaaggaagggacaaaaattttgggaggagggcttcggggaggataagcgatgggcaaatatgggacggattgggtgcgcgggtgggtggcccggcaccagcacaccaccaacaacggcttcacaaaacagtcacatagaggccggctaagcgatggaatgcgttctcatcagcagcagcgcggtggtctctgtcggccgggataaggacgactgagcaatgccaaactgagtaccgctaggcgctaaggatatggaagagaaaatatgcacgtattatataattgtttttgtgatttaaaattaatggggggattaagtatgggatttgattgagtgattccacccccccccctaaaaaaaattaagatttttcaaggagcgagtttcgcgagagacgtgaccgagctttatggcataaaaatgatgatccgtatggctaaattacgaacaacgatagctgttcgttcataatgccattcagctgatttatcattgagtgcaataatcagtgatcacagatcaatgattatgtcaggatcgggtttctgtttcttggttaatgatctttaatgaatgacaacaatatatttgtgccaaaaaggggcaataaaatttttataatttgattgaactgacaagaatgaattatgccattttgaccggcagcatttgattagcatggcgaggggcagagagctcatttgtcagtcggctgagatgggactcagttgactgtcgaggacttgggttaaaaccataaaaaggaagtgccgacaccacacacccacccagaggcaaacacaaagtagccgagccgaacggcgcggatgggtataattgggaggtgatggaattggcaaacattgactcctccggggcttagggagggggcaaatttcgggggcagaggtgagccaccgtccatcatccacctgtttctctttagaaagtcacaaaattccagtgtttgaagaagcgattttggtgtggccaaggctcaaagatttcaaccaacaacaataacaacaaaacaggctaaagctatgtgtggttcgtcccccgatccattcggggacaaaatttgtcggaaaaagcaaggatagaacccaagaatgcggtaaagtaaattaattttttggataaaaattcccaaattttaattgaggtaatgtccgccctttggcacaccaaatattttgatgccaaatgttgaaa

SEQ ID NO: 17555 - DNA, 2563 bp, Heterodera glycines
ttttaattttattttctaaaaattccttcccaaaatcccttttttggtgctcattaaatgatagtgcagccaaatcggcatttatgccgaactttgcaaatgattattttaccgttatggcacttattttaattttattttctaaaaattccttcccaaaatcccttttttggtgctcattaaatgatagtgcagccaaatcggcatttatgccgaactttgtaaatgattattttacctttttggcacttattttaattttattttctaaaaattccttcccaaaatcccttttttggtgctcattaaatgatagtgcagccaaatcggcatttatgctgaactttgcaaatgattattttccctttttggcacttattttaattttattttctaaaattccttcccaacatcttttttttggtgctcattaaatgatagtgcagccaaatcggcatttatgccgaactttgcaaatgattattttacctttttggcacttattttaattttattttctaaaaattccttcccaaaatcccttttttggtgctcattaaatgatagtgcagccaaatcggcatttatgctgaactttgcaaatgattattttacctttttggcacttattttaattttattttctaaaattccttcccaacatctcttttttggtgctcattaaatgatagtgcagccaaatcggcatttatgccgaactttgcaaatgattattttacctttttggcacttattttaattttattttctaaaattccttcccaaaatcccttttttggtgctcattaaatgatagtgcagccaaatcggcatttatgccgaactttgcaaatgattattttacctttttggcacttattttaattttattttctaaaaattccttcccaaaataccattagaaatgatcaaattactcggttatcgcaagaaagtgaacccttcccggcatgtcgacaagctgtttgatgtccgaatcggcctgaaagtaaatgcttggcacacagcggacgggggagttgatcacttggaatatccggatcagctgattggcgcgcggttcgaacagataaacgccgccctgggcagtgccgagcagaaacacggactcagagtcactgatcggcactttgtccctgggccgtccccccagggcatcttcgacctcttcaccaatgtccaatcccttaattggccatcacttccttctcgaccatttccttctttccccgccgtcattacctttttcgctttgtgctttgccaatagtcccgacaatgtctcctccctttgtccttcttggcctttttctccttttccgtccccaaatgttttcccattttcccgagaagcgctcgacggcttcaaaagatgtcttttggggtgttaatatttttccacaatttttcccactttcgcgtccccttttacccgtactttgccatttgtttgtggcaaatgtccctgggcatttcctctttgatacggacacttccaaaaagtgccaattttgcgtcgccctccgccgaatggcatttgaatgagcaaatggtcccattctgtggaagtggttaatttctaatgaataataaaatatatgcgcagaaactccgaccgaatcggctgctaccaacaaagtgccgtcactgtcccagagaatgcagcaaacttcggacatttcggcaccgatcgcttcgctctctgccattagcatttatttagattttttgaatttattttaaagccaccgctttttctgctcgggttcacaatgctcagattccccgtggtccatccgatggcaaataaaggctcaaaagggtgccaacagaaacagcgggggacattcgcaggacgaaccgaagaagtgaagaagggctttcccccctgagaagcacaaaacggagagtgatcagacaaaggtttgatcggcagatcacttcggtcgcatcactcacctttttggtaaagaaattggcaaaccctccgttttggtcggccaacaaaacggaacaaacgcccaaaaggtcccttgtcggatgccattccaaccgaaggtgttttgttgatggcatcaccaagaaattgcaattttatatggatgtaaaaatgaatttattaattagatttgattaatttttgggggttttgttacgttgaattgcatttgaatttgaaaaattcattttgttgccatagaaacgattgatttatgccgaactttgcaaatgattattttaccgttttggcacttattttaattttattttctaaaattccttcccaacatctcttttttggtggtcattaaatgatagtggagccaaatcggcatttatggcgaaatttggaaatggttattttaccttattggcacttatttttattttattttctaaaaattcctttcccaaatcccttttttgggggtccttaaatggtagtggaaccaaatcgggatttattgcgaactttgccaatggatattttaactttttgggacttaattttaatttattttttaaaaaatcctctcccaaaa

SEQ ID NO: 17556 - DNA, 1517 bp, Heterodera glycines
  misc_feature (1454)..(1454): n is a, c, g, or t
  misc_feature (1498)..(1498): n is a, c, g, or t
tcgggtacccggacccgtctaaccctaattttgattatcgcgaaaatcgtaaaatttattcaaaatagtaatagcaaaagaatacttaatattgataattttaatttagggctacacgagtcagtgtatttggacaaaaaaccgggttctggtactgctgggttctgaaaagacgtgttcgggttaggggtgaacgaaacttcgagcttcgtgcttcgaaaactcgcgttttttttgggcttcgaacttcgtgcttcgaaaaaagttgggctcgattcgagcttcggcttcgagtactaagccgagcttcgcgcacccctggttcgggtccggcccaagttttcaaccgggtcctgaaaaaaattatttataattattttcattaattaaaaattttatgaaagagttggtaatttattattattaaaataaaagatttttaatagatttggtagcaaaaccaaataagatttgataagccagcaacactaagtaatttttagtccaatgctggtgaggtcaaagaaaaagaaaagaaaaagggtttgcttcgcacagtgtcgtcccttttcacaaatagtaagaaaaagtcatcaagctcaagcaaggaaaatcatctccaagaatttgtaaaaaggcatgcaaaattggtgccacctcaaaaccttgaaaaggtgagtttaataaataaataatatggtacagtgctgcgcacatggactgagtttggtgggcctgcccagcacgacattagaattccacctccttcggttgtttcggacggcacaataaaattttttatttcgtttccagtttatcttaaatttgggttttccgagatccataaaattaacttgttcacttaaaaattgatgaaaacattttattaatttcaaaaaatatttttaagacctttcctaatggattgtgttttccagctttgttatcaagttttgttcaataaatggtccttttttgagtgaaatttgcgactagacggtgccaatagtgcgtgccaccagaaaaaaattgggattatgaatgagactgtttagaaaaaatttttgttttcaaccctcattatttcccactgattagaagagctttctagataactgtcctatttattaatttttttcaaattagggattttttaaaccaacaaaagttatacattcttagcatcaatctatagctatattttctctattagcgtggaaaatttcaaaaattttctcctgattcgtatagacgttttccagtaattagtagttaagagtgattaaatttttttaattttttgattaataaaaaaatctataattatataatgataccaaaatttatagcgttttattatttagcaacaaatccaaattataaattatcggatgattccagtgaaaagcaaaaataacataaaataataaattttaataattttgccttacaanaatactatatgtaataaacaaataaatatcttttgctccattangctcgtcaatcgtttgagc

SEQ ID NO: 17557 - DNA, 1830 bp, Heterodera glycines
cgcaagtggcatccaatcagaatcaacaccaaaagccagcaacagtgctgggaaaaaaattgggcggcttttccgctcttcatctgtgtcagtgtcaaccacacagaaaacatcagaccaaaagcaggagcaaaaggatggcttaaaagggcctatgttgcaacgattaccaactataaggagagacggtgggacaaacagtagccatgtccgctcaaaatcattctcagtaacgaaagaagccagcggtagtaagcatggagcagaacaaaatgttagttcaagtgggcctacgttgaaacgagcatcgtcgacacggagagacagtatgccaaaccttggcaattccaattcagaatcattggcaaaagaagaaagcgaaatcaagtctacgaagaatccacaaaaaacccaaaggagaaattcggaaccaatggtcgggtcggactataaaaaataaacaatattaaatattaagcaaacaatgaataaatttctgagtttgtaaacgaatatttaaaaacaaattatttttctgagctactattgttttttaaaaaattcatttaatcgattttggtgtttgcctaaatttcttaacaaattcaataatgcataaatataccccctaataagcgcttttgtattttttatatttataatatttctcaattaattaaatcaccaaaagtaaagtttcaaaaacataaatttaaataaatctgattttgatgaaatttggcatcgaaggttttaatagttttgtctagaaaccggcgcgggacgggatcccgcgcgggattttgcgggatcccagtttgcaatcccgcattttttggaaaattcgggatttgcggatattgcgggattaatcccgggggatcctgtcccgcaaagaattttgagttccaatcccgcatagtttttttgtaaaaaaatgcgggttatgaaaagcaaaaaatagtcaaatttatagaccattaacaaatttgattcgcgatctctttttaccgtttgatgcatttggaaaatcttagtcgcccctttaatgcatccctcaagcccctaaaaatttccttttcaaaatatcaggtattttttctttttggaaattttatgaaatataattaaaattttcaaaatttccaaaatcccccaattacgcgcggggaacccgcaaatttgaaatttccggtgtttagttttgcccattttcaactctaagttcggcagttttcacctgttattttgaacatttatagtaataactttggtccaacttatcactatttattaagtgttcatttaattaaattttataataattaaataggaacggaaacgcgtgtcattcgaacttacaaatgatcaaaaagacggcggcttattagaagaagagttgaaaaagtgtaatcaaccgaagcaatcattaacactaccaagggcattgtcaacgagggaagttggcggtggtcacaaaaaagctgatgaggtagtaaatctctaaatatgaattaacaatatctgaattataatctctatatttatcaaataaatagtcgattttgtcaatatgaattcataataaagtgtcgggtattcaatacgaggtgggattcttaataagtgtcggggtgccagtattagtcgggtcagtttgagtggggatttgtaatgtgagttgagggtaacaattagtattcgggatatatagtatgagtcggggttccatttcgagatggggcagtaggagttgggaaaaattagtttgagtcggggtaccagtgtcgagaatgggaaacttagtacgattcggggtaccagtacgag

SEQ ID NO: 17558 - DNA, 2507 bp, Heterodera glycines
  misc_feature (23)..(23): n is a, c, g, or t
  misc_feature (46)..(46): n is a, c, g, or t
  misc_feature (65)..(65): n is a, c, g, or t
atttgaagaaatggacggggcancggtggaatgggggactcgatcnaactcggggagcaatcgcncaaatcggactcaacggacacaaaagccgggactcgcccgaacggacccgacccggggggcctagggggaacggtgactcgaattggggccccctctcgtccctctccctcaaatcgtcgaggtcaaatgggagcgttcgccgaagggagtgcctcctccctacaagaacagtgggcaatggctgataacggatgggaaagcaattcaaattttggcgaaatccgatgggaaccgaaaaaggaggaagaaaacaatttgcagaacgataacgccgacgaggggatagagggagaggggggaaagacgaaaaaaggagacaaaacaaacaaagatgggtccaaaagtgcaaaaagacagatgtctccctcctcgtttgcaaacgggggattcgatcaaagggagggggaaaacgacgataaacagcataattttgggcgtcattttcaattgacccgcccctccccccaaggaaagggggcattcccccttcattcatctccgcacagcattccgtggccgcacaattcgccaccttcaattgggagattctcccatcttttctcatccactttttcttctagcacatccccaactgatttgtcttcccaatcttcaggaatggcaaaagttgcaaaccggaagcggaatgagcgccgaattcgtgccgtccaagacttggcacggcacctcaaccaccgaatgaaccgccaccgccatcggcagcgcgacggaaaacgggacccatcggaggaacggcacatccgaatgaccgccgaacgttatgctgatcagctctctcgcctgggagatgaccacattcaccgactgcagcaccaattcccgcaactccccaacccccgccggcgtcgatcagaggtggggggcaatctgaaagggggaaagtcccagccaaaattggcatcaatggtggtacgcccgccccagggagagttgctcccttcaaaggatgtcggcggcgcggcaccgggcgcatcgaactcccatagccgaaacgagaacgaagaggaaggccgtgagaaggccgagaaggaaagaggcagccgcccgagggtgctccctccgccgggggacagttttggagaattgctggagaaagaggcgaaagctcgggccgaagtggccgagctcgaagcccgggcaaagaaggcgaaaatggagagggaggaggaggaacagaaactgaaatcggcgaaggaagcgcgccttcgggacttggaaacccaagccgacgacttgcgccaaatgttgggcgatgcgagctggccgtggtcgaggggcaaagacgggaaaaatggggaggcggtggctccccgcgctgggaaagcggtagccatgccagcagtgccgatggaggatgatggagtgtcacttgccgattcggaaatggaggtggtgccggccgggggcagtgtcgcaagaagcgacgagatgaccaaaacgggcgggaggtctgctcccgccaaaggaggaagccattcatgggaaggttttctagtgttcggagtggacgatggaaagccccgggaactgtcacgggaggaggaggactatttcggagggggtgcgctcgatcacccggtggcatttccccgccgggagaagagagggaaaagaaacaaatggtcgaacgggagcacttcccgtcgcaattgagggacagagcgagaggcgtcaagaaaatgattggaatttgccttttcttcccaattttctctatttttcacctctttctttttcctcccatttttctcaacattttgctatcgtaattttattcaatttttgtcgtatttcaattttgcccccttttcttctctttttcacatctgcgtctgctctcccccttttgcccgccgctttgccatttatttttgaattcacctttgtcttcattttggccgacacttcccctccggccttctccgattcttttccgatttttccccattttttgtccctttgtttttgtcaattcaaactttggaccattcacatttttcgcatttttccattcacaatgtttacgatttgtgccagggagcttctctccccggcctttgactcttcccttttcttatcgcatatttgagaatcattcgtttgctcatttgtccaatttgcatttatctgtgcctaacccccggggggaaaaaacattcgccaatcactccctttccccccccccctttttttttcttttcatcacttttgttggccatcatatcattcattcgttcatttttatgtctcactcccctccagggagaaaaaattgttctttttggccttaatctctctcctcaccactcaatcacggcatccacttttactcctcatttttgccgtttgtcacttttatgcccaccccccctcccacgggtttaattaccccaagtttgagcgcttcatcaataaactat

SEQ ID NO: 17559 - DNA, 1306 bp, Heterodera glycines
actgttgctcatctccgtggaccaaaaatgctggaaaatatttttgtttgaattttttaatttaaatttcaaaattttaaattttataaatcctaagccacttgaaaattctaccaaatataattaatatttttcctaatttttggcaacttattgcccagaaattcacaattccaactttcttttgtacatacatttattatgttttatttattttaaaaattatttgctttaagccattaaaatccacgaaaattttcttgttattaaaattattaaatagacttcttaatccggttcataatattttttgagtttagacctcttcttggccatctgttcgatttatcgggaatattttctgatttggagaaggtccaattctgacaaaaaattgactggcaaaaattttttttatccaaattcatcttaaatgttttatgaatattaaaaatttaattattattcatattttttgaatatattgtgatatattttttaagaaatcttcagatttttggccccaaaatattgccaaattttaatgtctcagaaaaataactgttaaaaaaattctaacccaaaatttgctgcaaaatttctttaaccctcataattatcccccgcggaatttctttgtaagaaaatttcccactttttttgtcactttgtccgcctcctccttctcctccggcgccgcccaccgatcgtcgtttctccgaaattgccacaaattcgttggcaccgtccgttgtgccgtgcaccgcaatgccaaccgcaaccattgaccgccggtgatgctccgcgtccgccttggccaagtcggccttggtgaaatggtacacaatgccggcaccgaacgcgtcgcccagcacattgatggatgtacgaattcgatccctgttcaatggcacgaaaattacaataatttggcaaaaaattggaggttggcacaaattttgatagtaaaataatagaatacgtgaaaatagaaaaaaatgatggcaattcaaattaataaaattattttcctaatggacaaaaaatctataaaaattaaaaatatagaaaattgtaactttcataagtagaaataaaaaaatatatatttagaaaaaattacatatattgctatattttttgattattattaatgattcattaaaagaattcttaaaaatttttaaaaattggtttaaataaaattatgaaataattaatttaaatattattaaaattattaaaaacatatttttaattaaatggaatttaaattattcctaatatttcaaatattttaaatcaa

SEQ ID NO: 17560 - DNA, 2516 bp, Heterodera glycines
tgtaaaatttttttttactattttttcaaaaggataaaatattttaaaaattaggaaaattaggaaaatgtcaattcatttaaaaatgttaaatttttaaatttaataaatgaaattttgggaattttaaccattagtagccccacctgacagtgatcacttggccaaacgaaagatgcacgtcattcatttgcgctaaatgttcaatgttttttaattattaatttctattttatttattatttcttaccaataaatattgtagcgacagcctcgtaaagtgccgtgccatcctaaaaaaaatttgtaaaaattttagagatttttcaaaaaaaaaattttcaaaaatttttagaaaattaaaaaaagacaaattttgccatgttaattgtggcgccaacgggcagcacaaagcgagtgacacgccgatcaacgcccaaattttcctccaagcaacggaaagagataggcaaagtggcggaactgaaaaatttttttgaaaaaattaaattgaaattgaaatttcaacaaaatgcctcgaggcggtgcccaacgcagtgatccacgcctgaagcaatccgcgcatgaacacgtacggattctgccgagtcagcacaaaaaacagcaatggcaacgagactagggaatggatggccaagccgagcagtacggtaacggaatactgtacaaaatttaagggcgtgtcagagaatttaagcgataattttttggcgaaatgtttattaggtgaatcaaattgtgcgtgtgaaacagggctgggcaaagctcggcttaatgttagtatttgaaaccgaaacgaaggtgaagtcccaaaaaacggaaattttcaaaatttttgacactcgaagcatcatttttttcaacaaaaaaaaaatcagttttcaataataaaattttaatgggtggtaaaaaaaagttttgtaacaaaaaccatgaccatgaaattaatgagagaatggagagttaatcaattctaagtattttcgcggtttttgagtcaatttaaaaatttaaaaaaaagtaccgaaaatcaatttttcaatttttcggtcataattttctaaaaataaacgtaattttctcaaaatattcagcctcttagagagcagtgctgtcgaaatcgaaaaggcatttaatttaatctcctccaagaaaatttggcaaaaagtttttgccaatgacacaattgtgccaaacaaaacctaccatagccaatgagcgtgccgtgttgctcatgtcttcaacctgcaaaatgtggcccatgatcagacagcaaatgccgatcggcgaataccacctcaaaaacaaagaaatttgttcttattaattttcaaaaaaatgccaaacattatgagggacacaagacgcatgatcaccttaattaagtggggtcattaagaaattgaaaaaaatcttaatagtttctgaccaggtccaaaaccgcaaaaaagtccaccataattcgggcctgggcgcccagctgactgatcacaatgccaaacgaaatgcaaaagacgatgattcctattgtagaaaaatactgtcgtaatttacccctcctactgtaggataaatatagtagaatttagtgtaattgctaatattttgattaatttttattttctattaacataatttgcatattggaccaaacacaaaaaaaaaactaaaaataaaattacacaatgcaaattaactatgttttcatcaaattagtggactattagtaatttataaatttaaaatcggatgtgccgaatacgtataaattttgaatagcaaaaagctcgcaaattctaatgaaaacccattgatcagttgcatttggattggtcggggtttcggtttctcgtaaaaatttggctctcaagcagccccaattaaatagggactcaactagccggacgggctcactggtactgaaagttggcttttttctttaactcaaaaaattctcaatgaaaattccgaaaaccctctcaaaaaatctgaaatgcccgaaaatttgagcccgttaaaagcctcttttggcacactgtcaaaaaacgtgccgagaatgttcaggccgtccttgtacaccgtcttgtacttcaacggcacgtccgttttgttggcatcatacacataagtggtctccatctgctgcattgttgcctgcacaatgttttccgggaacatattcctgaaaatggcaaaaaattttgcgggtaaaaaagtgcaaaaacaatcgccaaaaaatgccgaaactgacaaatcatgccaaaaaaatgccaggattaaaatcgagaaattgaaaacataagaaatcccaaatttggttgtttgaaagaaattagaagatttaaaaaatttacttttgaatgtgacagaaacaaataaaacttaatggaatttttattttaaaaaaaaataaaaataaatgaaacatttttaaataatggtaaaaatttcgaaaaaattagttaaaatattatttaaaaatcttaaaaattagt

SEQ ID NO: 17561 - DNA, 1959 bp, Heterodera glycines
cggcatcatttggcataaaaatgtatgccgacgatgttaaattatattatgcctatggaaatgatgaccattcaaatcagttggataaagcaattgaggctttggaaaaatggtcaaaaataaaatcgaaaataataatataaaaattataaacaaaatagaagtaaattgtaattgcttagttaaaaaatattaaaatataacaactttagtttttccgagaattaatcaataaatttcattagcaaattttaaaaattcatatgtggcagtgttagtgaaatgcttaatatcgtagtcgtcttcgatagaaatgaagctttttatgcaaagtaaaacataaatatttcataaaaataaattaatatataaaatggtaatgtattgcgtcaaaatgattcagaaattttattaactttttttgagtggctttagttatggctgttcattgaatttttatttaatatttgttagtcaaataataaagtgaatgaatggaacaaaaagagatgttattgaagcagtacgaagaaataaaagttccatataaattactgaatattgaaaaattacacaacagcgtgcttttcaactataaactgaatgatatttaaaacagcgctatcaataataatgtagaaatttgacaataataatgataaaaaactacttaataatttttttcaaaaaaaatataaaaaaattttaatattttattaaaattattgttttctgtgtagtctaaaatgacagtatttagcctatcatcaagaccgcaagccattcagcgtgagaaatacaagaagcaaactatgacgtttaaaatttgataaatttgaatgtagtaaatatcctatttaatgaaagataaaataataacaaatgttaagtttatatatatgaaatgaatttattcaaaatcatacaaatcacattctcgatcatttaatttattatttactattagatcttttttaagttaaagttttttgactcgtgcgataaaataatttcatacactaatataataactattgacgctttatattttagttattaaaatgcggcgaaaaagaagcctaattatgtgggagacaattaattaatttattggattgtcgatcatgttgagttattgaataaaaaatttgcttctatagttgttttttcctctcttttaaatgttcatttactgctgaatattttttttcgaaaaatatatctgttaaatttggttaaggaatttgttatttttgataacccaacaaacatgaatttaagaaattgtcattactaaagatattgtaaagaaacaaatgcaataataatagaggcatgctgaatatcctgtttatggctgtgcgggtttccttacaaatttgttgaccaatttcaaataatttttcataatttttataattgttattatttaaatataatttgttttagatttggctatgaaaaataattaaattgcgattttaaagtattatttaattattgaatgatataaatgtagattcgtttattcattattgcttttatttacaataaaattttaaattagaaattagtgcctaccggcactgcagcgccccaaaactcttatttttccttataaaaatgatacaaaaatcgcaaaatttgatcatttttttagtgaaaatatgtcaacaaattttattcaaattttcaaaaattttcccggcggcgcctagcggcaccgcctccatctgcccctcttcccaaaaagttttggaaaagcgcgcctcaaaaaaggtttttattgattttaaaatttggaaaaaaatttaacaaaaaaatgttttgttttatgattttgactattaaaaatttgtagaaaaaatttcgcgtttcacatttattttcatttcgcattttttacttttgcaaatttcgcgtttcgcattttattttcagatttggcccatccctgat

SEQ ID NO: 17562 - DNA, 1325 bp, Heterodera glycines
  misc_feature (1298)..(1298): n is a, c, g, or t
cgataaaaaaaggttatttgaaaaaatactaaaaaggcatatgccacaaaatccgggctctagttattaatattaaaatagattatttttcttcctactaagaaaaaattatatactctaaattccatttgctctttttttcatttttaactatttggtctgctcaacagccactcttttggttgttcattaattatacatttttgggtaaaagaatgcttttataaacagcataaagtcaatagttttattttcttgtttgtcgcgaaacttaaatgacgaatgttgactgaatgctggacctgtattcataatgattatatttcaaaagatgtaatttcttctttattaatattcctttgctattttttgaattttgcgtttatttcaattcaaattttcttcaaactaattaaggcttcaaaataaaagattttattttcttgaaaaagagacaaatgcttctaaattctcctttgttaacgaaactcacttttaagattttttgttcaataaatattattagggatgcgatttttaggtaagaaaaatcccagaataggtacttaaataggtaaaaaaaaatctcaaaataggtattaaataggtacaaaaattccaaaataggtaaataaaattttttattaacgatttttagtggaaaaaagcaaacaaagagggaaaattttggttctgcatatctctttgtaaacgaaaatttaaatatattaatattttcttagataaattgacttttgttatttttattaaaaaggattagatttgcttattcttatccaattattaatatttaaatatttatttatttttataatatgcatatgataatataaatttgcttttgtttcaatttttttttttgtttaatatctttaaaaaaatcatatatgaatacattttgcttttttttcttttttaaagtgattttttcgtaatattaaaaagaacttaaattttttttttcaaattttgcactcgcgcacacgaacattgcagaaaatacttaaaatgagaaatgcttcatttaaatattttattttaaaacatttaaataaattatatttttttgtaagtattttgaaacttatttggattgactttgttttatatttagtacaacttcgatcgtaaaatttgtataattttaattaataatatttaattttatattttaatatcatttgtatacatttattcatgcttcaatatgcaatgtattcaaagattattttattaatatataaaagggctgatttatgttttgtggttgcttcaanttatttaatgattgtgcttttagaaat

SEQ ID NO: 17563 - DNA, 3110 bp, Heterodera glycines
ttgttaatttggtggggaaaatgtttttttaagagtttacctacataacttaaaaatcccgaaggaactaatcaaattaagttgaaatttgaaatacttactaattcaaaaaacggagtcgcgacaaaatataatgaaggaaggcaaaggtgatgggcatcagccgacgaaaggcggaaatataaaaatgaattgtgtgtgtgggaattggccgtaaattccgttccttttatactgccaaatttcgttggaaacgcggagagagtcgggggtcattttgacgcgggacattttggcgccgccaattttgaagttttctaatttttttttattttgcaaccaaataaaatattcttaatatcaaacgataagcctaagtgttctttataagcttccaaaatttcaaaaaattatattagattaaaaaaagggacgaaacccaactcgtactgtttttcgagaaaaaaaattgtcataacttttgtcaaaaccaacaaaattaaacattcttgttagagtgaagcgggaccgggaattttgggcaagaccgggaccttttcgggttgaaaacccgggaatttttggctgggaaaaccgagaaaaaaccgggactagtcccggtcccggtcaaaaccggaaccttggtactcagttgtccgctctgcatttccgctttcactcactttttttaattcggctttatccctaaattgaatttttgcaattaaattttagcgcttacacatttccctctctctctgttgctatcacaacacaattccaattcgtcaacagcttcatcttccatgggcctcggcatatatctcttggttggctcggtttcattcatcgtcggagtggtgggtttttgggggtgggggaaatcatttattttgtgtctaatttgtccccacttccctttcagtacgcagggctcatgctgtccatccaaattatttgtgagtgccgccactaatcatctcgcacaaatttaaaagcagtggacgcaaatctgacgacgacgaatgccgacaacaaaacggcgcctgggaatgcgaccagaagcccctcaagcagcgacagtgactgaacgacgtgacgacagtgaatgaatgacgtgacgcgtggtacaacaacaataacaacggcatggagaaaagaggcgatcggaatggatgagaattttgcagaggatactaattaaatcacggataattgtgcccatcttagagatgctgtaatgaaattgagcctgtaaaacccaactgatttgtgtatgaatttccacactaatgccatcatttgatattaccaataaatacttttgaattggctttccgcatgttttttcatcagagtcgctgatcattgatcactaagggttgcgtggtattttgctttatgcctgctgagcgttgataaattcgagagtacagtactgtgctcgaccaaaattatgaatagcccccaatcaaagagggcaacatggatcaatggtgcgcttttctcttcgagggtctcggaaaaaaccgatcaaaacatttgctttttgatgattgccagtgatcaggaaatggtagcgttttgattcactagtttaaactgacgaatttaaggcatttacggactttcagcagaaaggggaagattttttgtgaaaaatggctatattaatcggtactcagccgtccgaaaaaagcgacaaaaacagcaaaaccgttttattttgtaaaagaagagtgtgtgggttggttaatggtacgagaatgcgacagcaaataaaaggggaaaaaagggagacaaaaaagggtgtcaaaataaacggaagaaatcaaaagaacaaacaaacaaagaattcgaaaagtggagaaaaattggcacttctaacttttttaagtgaatggatcctgaatttttggtgaaaatctgaaaatccgaactccattaattgcctcaacataatacctacagcgaaaatctcgacaaaaaactttcatttaaccttgtatcatctttatccaaaatacacaaaacaacatacagacatatacaatatacatacataatacacattatggtggtacagattcatatacataatacacacattattgcgggtggtacagattttcaatgatggatcgatcagtcgccttgccactggtgcggttcttccggttcttcagggggaattgcgctcatgaaattgtagcggcacacgggacagttgatgttgtatttgagccagcgatacaggcaccttgatggggggataataagcgatgatgcatttatccgaaatcattaaaatcaaaattggatttttaggccccaaaaaaaatccataaaattccaccctgtcaatttcggggatacgcagcggttcaaaactgatcggaacggatttcgaatagcgatcagaaaaaggcaaaaagaccaggaaaagtactcggcttttagacttgtttgaattcggggatccatgggttctaaattaataggaattagccactcctccacctgcgatgaaattggtgcacacagcccatggtcacacgcgtcatgtcgctcactttgctcaggcacatcatgcacttctcgcgtcccatcgcattgcctgactgaaaaattggcacaattaaaaaagggtgtcgaattgaattaattagtgtattaattgcccctccctccctctctcgcgtcacccacatgtccggctcgtccaattgcggcacgcgccttcttggcatttcgacgattgattttgatggtccgtgctcgctctgctgatgcccttgtcctggccgttgttgctctgaccatcctgaaaaaagggcacaaaattcagttcattttaaaaaattaaagaaaaaaaactgacgggaattatttattgtataggaagacgattcgaccgatggaaagaaacaatgggtgaatgcaattgaatgaatggatgatttttgtggggaattcatcgcttaaatacgcagaaaatttcataaatttgtcagtcatttttaaaaaagtataaataggacaaatttaagttttttgctcattttttttgtttgaattcatcaaattcactcttctcttctgtccatttt

SEQ ID NO: 17564 - DNA, 1240 bp, Heterodera glycines
cttgcaccattgtaatgatactttggctgatctcttccccccaatggtcgatggttactgacattggcacatttacttcgtttaactgccttcaataatactagatcaacacatttattggtctgatcactgcgtccatcatgttgatcaacttgaagcatacaatgatcacttatgcccgcactttgatcagtttctttcactgattgatcattttgtccaacattctttctccacattttccatacattgatcatctttttcatccatatcaatgatttgattgatgttctgattcattatttgggtggatttgttgttcattttctttctttttcaacaacaatttctctttaatatcatttgctataagtagctactcaccaagattttgggggttgcatttcacccccgccatttcagtcccagtggaaagggacgtttcagtaccaaatttaaacctttaaaaaacatctataataaatatatccaatcccagaagaggtaaataattgaaaaaacatctggggccgtagcaaaagaaggtggttatttgacgaggtcatttaactatggttatttgacctggtcatttgaccacgaaatacgagaaaaacggtagcaaaagaagatagtaaattttctgctggagcaaccaccagtcaccgttttttaaccatgaactaacttcttttgctataccaccaactttctaccacgaaatttttatttacatatatatatatattttgcttcttttcatggaaaacaagaagtcaataagttgttttgcaaatttgcagctgaaaggatgaatggatcaatagaaaatgatcatgaaatatatttttattttttgttggtcgctaatattgttcgcctatttttcattataaataaaccaatataattttgcatctttttcttcgtccaaatgttaatatatccttccgagtaaaaatattcagaataaacttaataattttatataaaaattattaaagaattaatacatattctcttatttactaaaaatgtctttgttctccaaacaaatgtctgagcaaattgcaacttcaattaaagacaattacgcaacattcttcccaaacagcaaagaagctaaatttgcccagaagtcaaatactgcctgggacgacttaacaaatgagcttatgcaacttggggttcgtcggtcactgtgaaacagtcaaagaaaatggccaatatgaaaaaagat

SEQ ID NO: 17565 - DNA, 1697 bp, Heterodera glycines
caagtgctgacgtgatttggaaattcagtctttgactgaagctgggtttgaggtgccaaaaaagaatatcatggttttcattccctttgtagcaagtgccaacgaaaatgccgaagaccgagttcggggcaacgccctctccttcttttttgccaaaggcatttcgtcgaaccgtaaaccctgttgtcgatctgcagcgcgatgtgctcgaactccaaaaagactttttcaaacattctgccatgcccttggttgacaaaatgtcagcttactatgactataaaatcgccaaaatgatggcttcgaatgatcagcagcagaaaagtgaagaaaaagaagaaaacaaagaatttgatgaaaatgagttggattattaattattgactaatcttatgatttggcatatttggctttataagccttttgatcaattaactaattatgtttaataaacatacattaatcattttacatcttagacataatcggtttaacttcttttttttatcggacaattggcattgaaaatgcgtttgccgttagccggagatgattttgatgatgaccaaccatccacaatctcttttactgaaatttctgcaacagagcaacaatggcgaagtgaacgccagtcaagacaaattgctcttgaaaaaagaatgaatttaaccgcacgaattgagaaataaattaattttcatatattatgagtttgtttcggaatttatcaataaaaaattagatattcagtaacaaaaaaaattaaatatttttaatttactcttgattttaaaaatttgggttattttgttaagttttatttttttttatattaaaagtaaaatttaataataattttttacttttttcgaaagctaagacttttctctattttatgaatcttatttgggatttttatcttgtttctctgaattttggcagatttttaaaagttggtggttaggtctgcaaccatgggtaggggcagggttgcaatttaaccatggtaacatggttaagtaaccaccaaccatgttcttttgctgcgcgttcacaaaccaccaaccatcatggtcaaatgaccatgttaaatgaccatgaactcgtggttgcacatttgctacgggtttaccatcatggttatggtcatttaaccattaccaccttcttttgctacggccccagaaggccaagttaatgtaataagttttgtatcaaaattgttttaatttaattaattattaatttaaatgttatttttatttgtccgttaattttttctattttcgtcaaaaaaatcatctcaataattgctttaatttttgcgggacgggatccaacgggattaatcccgcatttaaaatttgcgggatctcgcgcgggattttggaaattttgaaaaaatgtcaattaaatttaaaaaatttccaaaaaacaaaatacctgtcattttgaaaaagaatgcgggatgcattaaaaggggttgtgaagatcattattggtcccgaaattttttaattttatttttttatcttaaaattttataacacttttctaggggtgttttgaggcgctgagcacgaatccggcctccatttcgaccaattccgaatcccaagcccgaactcgaacattttcgggaatcaaatttatcaattgtaaaaatttattttaaaacattgtttttagtgttttcg

SEQ ID NO: 17566 - DNA, 1378 bp, Heterodera glycines
gtaaaatgaggaccggagccgattcagtgccaggaaaagtggaatgaatgtcgagactcgggaccaagaatttcgaaatttactatatcacatttttcagtgtttgtttgttaccctgcggcactgtcggatcattgatcaatgcccaaatttggtccagcatttcgtgtttttcccgctcgatgatgtctaatgtctgaataagcattggccaataaatcaatccagtaatattttgccgctcccaaaaaatttgttggcactcgcctctcttcggaccgcaatttcgtttggcctttccaattggtagaacacaaaggcaccaccgacaatgtaacaaacggacatcaaaatgagtccgacatggggaagaacactgaaaattaggggggggggggggatcgaaattaattaattaattaggggcaattaattaatcggagtgacagagtctggagtttcgttttttagtctgttttatatgcaatactcacatccgcgcatatttcttccaggccggcattttctgaaataaaaagttgcataggtaatttgaaccaatgattggcaaatggacgggcgatttatgtgaaagttgaaatgagaaatactcaagagtctcgcattttccataaaaatatgcttcaccggtgccatcggcgatggttcgacggctcggggaacaaatggcaaattttgaaggacggagtttcgtttgaggaacattttgagagattatgtatgatgttatagaggtctaatgaggttatttggaaaaaagtcaaaggtgggtagagggaaagcagcacagcgaatgaggcgaatttggccaacggaattgggcgaattggagggattggttggccaattcgggaatgagtgccgaggcattttgtctttggtgccaaagacagctgccaaattcccccagggccattcagtcaaattggcatttttcgggaattggatgggctcacttttggcgtcaatttcgccaattctctttaacattctcgcgctctctttttttagcccactatctctttctgtacatgatgagggcttaggaaccccaacagaacgaacccctgagggagcattaagtaaatgcaaatcgagagataagagaactctatgtgattacaagacttggtgtaagcagtgataacaataggcttctaaacggatgatcggaaatggcgagactcgcgagcaattgactttggctgtcccttctctcgttttctctcccttctgtctctctctctctttttctctctccctctctctctctacactttctcctgctcacccccatgttctcactcacctcctcatgctcatcctcctcctcttcttccgcttcttcttcttcctc

SEQ ID NO: 17567 - DNA, 1340 bp, Heterodera glycines
agagtggagtttggatccgctggatgggccttgcacttcgtcgtctgccgtcgcacaatcagcggacgaagggagccgacgcaaagtgtcggcacatcaaaggcagcgtaaagtgtcacggatcaaagggaccggcgcaattagagacaaagtgatgcatgacgaaggaattggcgaactgaacgaagggatggagccggatgaaatggaggaactgagggacaggtgggggagaagcggaagacaatgaggggaggaattaagtgccaaaaggggaaacgaaggaaatgtcagcaaaagtgccaaaaacggcaaaaagggggaaatgccaaaaatggggtaaaatttaaaaacgcaaatgaagaaagaaaactgtgcaaggagagggggaagattatgccagcaaagttagaaatgatttttaagactcggcgagttggtggacccgcgcgagtcgctgctgcaacagcgacgacgacgagtcggtttggggaagggttggactgtttgacaaaccaattaatcaaatttacaaaaaacaatgccagtttttcgcttctcctgatcggaagagattagtgcttttcgtaggccgaatcgagtcggacactagaaaaactgataggaatagacccattgattgttgctcgggtcccggacccctcgagtccattcgatcgtttcccgtcattttcggcatttctgttatgttcaacggtgaacacaacgaagaataaaaatagtttatttgtcggaggcaaaagaataaataataaaattgatgtgtcggtggatgaagaataaaataaataataaaatgatgtgatgaatgaagactgaatgtggaacaagccaaagtgagtgacaaaatgatggctatttatggacgatgctgagagatgggtattgacacgaattgggttcagtaaatggcggacatttgaatattgagtgatatacacaacaatttccaccccaaatgccgtcaccccttttagccggcagtgttcggcaccgcttccgtgccttcccattcttcgtcctctgtctgttggacgggtcattcctcttcttccttagtctgttcttcgctcggcttggacggcattgaagcagcagttggggatgaccgcagcacagatgaggacgagacggaggaggacaacgcccgaggggaatgcgctccaaaaaaggctcgtcttcttaaataaaactcagttgtagctaacgcattctcagtctcggactcgattatcggtgaaattccgcaaattgtttgttttttgctagagcagcgggaccgagacttccgcgggattcttacgggattccgtccctct

SEQ ID NO: 17568 - DNA, 3441 bp, Heterodera glycines
  misc_feature (3416)..(3416): n is a, c, g, or t
gtctaaagtgaaggcccactcctgttagccgttatattttttataaaaaatctaaaagttccagaggaaaatagcacctatgaccgttattctggtacatggttatacacgggagttgggggaattgtagctttacccggtgtctcgagtagagatgctgctcgacagtaaccccgaggaaacctcggtaggcaaaaagtctattagaaccgttaaatgcgatgtcatccggtgagataaactgattctgcctaaggtgtctcgttattagggcgtgtcttctcaaaaatttcaaattctctttcttccacagtcttagaatttcagatagctcgtgaggttcgcaatcgttaaaatcgcacagaatttcaacgagagaattcattttgagcaccagtaggcattttcatattcgttgcaaatccttatataccattacttcaccactgtaggatgagtttttgccttttctctttaatttcaaaattctgagaactgaaatacaaatgatgaccactaccaaatcgacaattgacaaaaaatacaaccaaggatttgaacttgaaactttaattttctcaaactctttgaacatgacaaagttaaagaattcactatttgcatctgacacatatttgggaagtatctcgtttgagtcaaatcgatctttgtatattttcttttccttaatcagataaatttgtccctcaattattaggaaatcggtaaatgaagacggcattgatccgatcggtttagtaataatttcggtgccattatgatgtgtccataaattctcgattgatctaatgtcaatctcgtctattcgatcgtctctgattacaaaaagtcgaccatcaatatgatcaaatctaaggtacccaccgggaaaattcctaacaaccttttcttgactccctcttgttattgaagtttcatttgtattttcgttttggaaaattaaataactatgatcgttgtaataaaagcacgctcggggctttaattgtcgaaaatcctggtaaagcttaacattagtgggtccgctcttttctattgaattaatttcttggattgatacactccaccctgaaatcagattcctatttatcgtacataatctaaagcgatcgaatccgaactgtctttcattgaccgaactctttgtcatagcgagatacttgtcatcaaaaagttgtgtatcagaaagaatagtaaccctttctccactgagttgaccgactatcgttaggagaacaattaaattaaacattactgacaaattgcttaactaataaatcggccctcgggcgaaccttatatagaccgtcaatgacctcacaataagggattccggagcagcgaagtgccaagaaataaatacaaaattgaccacaggcatctgagaattgatgttggacgatgcggtcgttaatgagaattcgtttgaataggttaagatatgaacttaaatcttcgttgggataatcgcccaatgaatcaaaatattctatttctgtcggcgaatttacaaaacaggcgacccagtgttcacctatcgtgcccacccggtcggtattcgccacaaaacagtacggaaaatgcctgtccttcaattttggcatcttgtcggaagaaaaaacgccgataaaatattttcgggttgtcggatgtttggatagaaatatttcaatctcatgagaattcatcatatgcttccgtcgctactgagcacacgattagcattaatagacaaaatcgaatcaaattcccccagaacgatcatctcataacctccgtcctttataggctcattaaattgcaccttgatgctggtcgttccgtttcgaatcaattcaaaaccgggggtgtcctctagagtagaggtcatcgggatgacgaagaaacaccacccgtttacaaatttttgtatattgatcgacattgtcctttctccgtcgtccatcccgagccccgtatacatgtcaacaaatgctcgaatgtatttgtttctatcaaaattaagagaatagggtgacccggggaaaatgtttccattcgcttcgacactgatagagcgtattttggcatgttcaaagacgaagggtgactctttcggatttccggtgtacgcaccggttgaaacaaacccgacaattaaacgtctcggaacaatgctggtaaaaacattgtgtgagagatcagaagtgccccgtgggatgaaaagactcctgatctcaatttttctaaccgggtatttggccggggtggtttgtagttgattgcttattacgttatttaatgactgggtaatgtcgactgtttttacataaattctaatatcatgtatgttaatacgatatgtgtgcgggttcgctatgactgcatttcctgaaacatatggcggtgccataattagaaaatcatcggtattacgatgtatgctaaaaatgacatccgagttattaagcaatagattgggctgacgagcgagatcaaaattaagtttcaccatggtttcacatttggcaccatcagcaaaacgtgacgctctgtttttaaagccgctgtttgtgtaatcatcctggtcgacatcgtcgacataatagcaagatgcttcacagagaccctttttgacatcttctgaaaatcgcaattcattcatcatatatgccctaaacgcatagtaaatgccggaatcataagattcgacaccggaaattgacacctttaaggttttgacaaagctgtgcccaaaattttgaatgacaccgacgtgttggtcagcttcactgtccttggtaatcggaatccaattgcttttgtcttttctctctattgaagttgacaaataaagaaaagttttattgagatcacaaaactgattatctgaaaaaagtctaaagatatatggtccagattgatttattgctgaaagagggagtaattccctaatactggatttattaattgcaacgttcgtcggggggatatcgaacagcgaaaggcccccctcgagaccgtcctcactcgccttgtcaattttcttaagagttgacattttttaattctttgtattatttattctatttatacctttagatgaaacttaactgatcatatacccgttttcgattcttattagtgatcaggtccctttttcctttcccacattgttgtaacttatcggtaaggttagtcagcccctgtcttgagtgttccctgacggcatcccttaaatcacggccctgagcgatgtcactcagaactctctgcccagcggctagcccctcatgtcctgcactcgaggcaatattcctcgcaataggggtcaagaaacgtgccacattaccgaggaaaacgaatccccgttgatacttgcttccgacaaagtattgcttctgtcccctcccatngtgtgaagtgaaaaaagatgaccaa

SEQ ID NO: 17569 - DNA, 964 bp, Heterodera glycines
atatgcaaacacattttatgtgcttgtggcggtaaatacacaacatttgacgaggaatttgttgaggtggtggggtggttggtcatcggtcatcgcagcgcttccaaaacaagaaaatgatgagaaatgagtgggcggggggggggggaaatgggagccaacccccggggggaaattccaacgaattgacgacgaccgatcgggtcggcaccagccgagcagcagatctgccagccaatctctgtgactgccggcgctgactgacgcacattttgcaacagttgcaactcccccctccccctccccgcgccatcggcgcacgcttaaaatccgccgcctattcaaacgccggaggcactgaatgaattcgtgccctcggcgggcaatgaatgagtggcatgggatggaaatttcggctgttttcacttcctttgggagagattggaatgtgttgggtggtgaaactgcacggaaatggaagttttgcccgtgggaagacaataaaataaactatttttgggcatttctcagaagaaaaattcactttcatttcattggttggcggtcacagcaaactaaatgcgttgggataatttaatgtcattaaaatggcctttttgtgggccaatgattagcaacatgagaaaattgatgcaattattttttaattactatttttgatttttttgttcaatttattaaaccacaatccaagactttttgttaatattgaaaatcattaaaagcagaaagtttataaaacctatattttttgaagcacaaatttgttgaaaaaagcaaaaataagtaaattcgattaagaaaaataaacaaggaagtgaaattactctcgaatttagtggtttttcaaaaaaaaaaaagaaaatcccgaaacgcccattcattcccgcccccccccccctcagtcattcatttttcattttcgaagacgggggaaaatggg

SEQ ID NO: 17570 - DNA, 2130 bp, Heterodera glycines
  misc_feature (2121)..(2121): n is a, c, g, or t
taggcctagttcgtaggcaggacttttcaagtctccgaaaggtttcttcaatctgcattcgcttcgaatagatattaacaaggttgtttgggtgttcgaatttcaacaggtaagttagttgctagactgcatggctcctttgccgacgctgagtagattttaggtgacgagtggtgacaatgagtccgtgtcgagcgctgatattttcggcctatagagcgagatctatacaatagaatttggcatgagattggattgcttatagtcagcctcttatagcataaagtctgagagagactagatgacatatcatgtaagttgctgataggtttccagttttccgctcgtaggtctgcatatcgtacttctcatcttactcgacctaatcagttcctactcagattctcaacggatatataccatggcactctaaagtccacatcacagtcaatgagcggtgtggtgctactcggtagaatgctaacaaggtcgattagacaatgatcataatctctgtcgaaatcaggtcactgtcgaaatcagccactgtcgaaaattcctggcacgttcggttttacacattttaaacttgaagtgccaattttgaccaattgtaacatgggggtcaaaaaatgtgcttttccccactttggcacctatatttaacaacaatgtctttgttaaaaaagacaaatattttttctgaaacaaaatgcattcgatagaagaaagaaagggctaaaaattgatataaataaaatacccaataattgtcgtattttagagaaataatcccggagtactcatttttatcaatttggaggtccatattcaaaaatcaatagctgcacgaaatcccgatttccaacatcagattcccgtaatttttgtgccatggaatttcggttttcctttccgaaaatttttggggtctcgaaatgctatccaattgaacacgagagcaagagttatctatggttcttcccctactatctgggaaaaaagtcggggaactggtatcaaattccccgagaattatctataaggctaaaaaaaaattttaaatgttgggggggggggtcaaaaacttggtcgtcaaatagaaaaaaatatttttctaaaaataaaaaaagcactctcacccgacagagtgaaacagacgacgttcgaattccccgaacagtgttggggatcaactcttctttaatcacttaaggaacagcatctcactttggccagtgaaattaattctttgaagtgtaaaaataaaatatgatacctttaaaagccaaaaataaatttttatttagttttgcagtctccattccatgttttgagattttttaaagaatatttttgttttttcccgaaattgtccgcaaatgtctggtagccgttcaaagtcaacgattttttctttcagcatttatatgtacaaatgattatttccgattaaaaaaatgctaccacatttgataatttttaattgattagggaataattttaaatgagtgcttttgaaaatgccattcccgaacaaatgcatacactcaaaagtgcacagagagagaaaacagcacaaaggtggacaacaacaaaaaacatcagaacatttaatggcgacggacggagtttccgcttgcgcgcaacgataaaaagcagcgatatgaacgaactaagaagaagaagaagtgaaaggaaatggagaagaaaaggagcaaagaatggaagaaaatgaataaataaatgaatgaataaaagggattaatgaggaagaaaaagtaaaatttgaaacgggaaacaaaacgatggagggggaaaaggagggcataaactgtgccaaaatgattttaaagagattgtaaagaaaccaagcattccgaactaatccaaactctcgacttttgccaattagtttagtcagtgcttggatgggattctgcagatagaattcgggaaaatgccggatttaagactctttcttacggcaaaacggggaatatattatgcaatagtccatctataggctcagattcggacccatcagtcagttccaatcagaaattgctacgttgaagcaacagcaagcagcagcccacttattgcatatgagctgagtgngagtgcttt

SEQ ID NO: 17571 - DNA, 1760 bp, Heterodera glycines
  misc_feature (1721)..(1721): n is a, c, g, or t
tttgccttattattttatctaaataatgtgtttatctttatttttctgtttaacaagtctctttcgatgcggtgtactaattatacattctcttttattgatgaatttgttgatttttttattctaattgttgtgtattactgataaatgcttaatttttaatacaaaatatgcatcagttgagtcttcaggataattttttgtaccattgcattttttgattaaattttataaatttgttaattaataaatttgtataatgtattattttattctaataattcagaccactttatatttttaactaccttttgacttaaatattaattataaattattttattatttttaaattatttttcttaagtgattttttgaatataagtttttccccattcccaaaaagttaaagtgaagaatttctttaaaattcaaatgttttaaatatttcaaaaatatcttgaatttttcaagaattttttctaagtggttgggaggaggacacttttaagaaatgcgcaatccctttttgtcatttttaagaaatgtaatcgcattctttttttgtcacatttttgcaagaattttttttgaggtttaaacaaaatcagcccttacgaagaaagcaattaaaaaaacaagtataaatattaacaataataaccaaaataattcgatttaagttaaaacatgactttaatagaaagaacgcagaaatgtgtctatgacgagattatttatttctatatttttaaaatatctaagtgactatcgtcgtggattttgtatatgaattaatttatatatttcgaattgaattaacagtttattaagatatttaaaaagaaattaaaaaataaaaaggaaattttgattttgattttgtaaatgatataaattaatttaagaactttataaaataaataaatataaacaaaaatgttaaaataaataaagatacacaaaaatgttttttgatttatatagcaaaatagaaaataaccaaaataattcgatttaaaaaatgccttcaacagaaagaatggagaaacgggtctttgacgttaaacgaaatattaaaacaatcaatgaaatagcacaataataatacatatttcaaattgaattagcaatattaataagtgataaatatgacaaacttaaaaagaatttaaaaagcaaaaaagtatattaagattttgtaaataaaataaatgattttaagaattttatgaaataaataaatatacacacaaatgttatctgatttatttagtaaaatagaattattctattctaattcattttatatttataaatatgcataaattattataaataaaaatgaccttaaaaaattaattctttagaccaataaatcatgataatgggtttgaagtgaagtgttgcatttcggtagcacggctgctatatttttaccgtataaccaatctgtttctgtttcttttaataatataattttcttttaattatgaaatttgtttaaatgattttcttattcgaatagttgtgtattactgataaaagccttaattttcaatgcaaattttgcttcaactgaatcttcaggataatctttaagaaaatttatccaatagacatttctattttttactaatttttgaattaaataataattaccaatcattttataactgttattttcttttatttgggtaactaaaattgtatttatttanatttttaaattattttttctcttgcaatttcattaatta

SEQ ID NO: 17572 - DNA, 1673 bp, Heterodera glycines
  misc_feature (10)..(10): n is a, c, g, or t
attttgtaanagcgaataatatgttcttttaaatacaaaataaattgttttttctttcttgatttttaactttggttataaacatgatagtgtttaaatctacttaaaataatgttaaaaatcaaaacatcgtttattaaaatcttttttcctgattgtacttatatttaaattgctttggttttggcttcggcattaagcctactaacgatacccgcgtcgggaacgcaccaaagcatcgggtaccaaaaaggggcttgagaggttctatgatagttaaagggatcacttatatcccgccttatcatacgctgcacccctctcattaatgcagcgattaacttaccgtaaagcccctttaaaaacatgttatattgtctttttcgttattgttgactcaaacaaatatatacatactttcattatatatattcttacttttattaaatatattcttatttttatgaaatatattcttacttttatcaaatatatttttacttttattaaatatattctacaaagctgaccaaaaacttaaccaataatggattataccgtattaagttatgtacattctacttttattgattcggtacctttcagatttatttaatcagataaaatttctttataacaaatatttttcactttattctctttattttttggatgcaatctaactttaagcccttcccatgattttgttcttgaaaaagcaacatataattgaccatgttgaaaaacattattttgtaaatctataccaatcttattaaatgtttgtccttgtgatttattcatagttaaagaaaacgctaattttattggaaattgatggcgagacagtgaaaagggaaaagtttcatcatcagttaaagtaattcttggtaaaagtattttagtgccagctttatctcccgttaggatttcacaatgaagaactttatctaacatttttaaaattctgagcctagtaccattacaaaggccttctttaatatttaaatttctgactaacattacaatggcattattctttaatctcaattcatgccttggtagactggttgtatataatgtattaaggtattctggcacacaatcaaaagagctatcatttcctgcagtgtcaatacttttgtatattttttcctcagaattaattaagtctaatactttttcgttgatctcatctacatcaacattcaatggagccaaaattactctatcagacatttccttaaaattatttccggtggaaaagtcgccaaaaatttcattaactaaatcagtatagcaaattacctggtcaggtaactcaagcatatcgttttcgctatttaattttccatcacccattttaagcaaaaagctagaaaaatctttttcattttcaagagctcgtaaattctttgttagactaaacttttgaaaatttttccaaaagcatgattttttaattgaaagatcaattagctgagactttgttgcaaatttttgaattggtaatgtttgacgaaaatcaccaccaagtatcacaattttgttaccaaataattcatttgtaccagttatttcttttaatttttcattgattaactcaagcatttttttatgcatcattggggattcatgaattataaagatttcagaatcattaagtctttcca

SEQ ID NO: 17573 - DNA, 916 bp, Heterodera glycines
  misc_feature (46)..(46): n is a, c, g, or t
  misc_feature (756)..(756): n is a, c, g, or t
cccctaattaatgaaacaatcgcacaattcccatggcatcttctcntgggagaaacggcggtcattcaatgctttttcatattttttggtgatgaacagatagaggacagagagagtaaattgccaaaaatgacccgggcttttaattaattataattgtcaattgatcgggcaaagcaaagtcctacaaattgccccggggcctttcaattaatttgccaatttgctaattgttcattctttttttgtccgctcacttttcaattatttcgctcactttctgctgcttgtcttcgctgccgtttcctcttctgatattccgtctcaatttcttcccaaagtgacggccgatgagagctttgaattgaagcagaatgaaaacactctaaaaatggcaaaacaaagcaaattcataaggaacaaattgaggatttattaattggggggagggaatttggggggaaaaagagcgggagacggacagtgacgcaaaaggcggagtttttgattcgaaaaagaagggggagggaatgattggaacgatcggaaccgatcaaatcacaacaatcgaccgattcccgacaatctttgcccctatgactgatgtggtgtctctttgaaatttgataacttttctatttttgtttcaatgaaatgggcaaaaggctaaaactttcggcattttgtgccgcttttgtgaggtgtgggaatgaacattatttcacccataatcgtcaccacccaaacgcacagaanatcaatttatttatatatttttgcttttttgtagggacgtaaaagagaggcaaatgatggagatgaattggccaaaaaacgcaaaatgaaagggtggcggggaaggggcgaatgacgggacacggggaaaaaggggggaaatgggaggtggggaaagcgg

SEQ ID NO: 17574 - DNA, 1118 bp, Heterodera glycines
tgaccgacccctgttcatgctcatctgctgctggtgctgctcttgctccgtcccctctctcttccgctcttcctccccctcacttcctccgctactcgtcgaccaatcgtctccgaattcgtcctcctcctcttcttcttccgcttcttcttcctccccactcacataaaacgtcgatttgccattggctccgatcggtgccgtcccttcgcttttattgccatttcttcgcctcatcgacgcaaaattcctttcagcgaagaaaaaacatagtaaacgaaaaaagaaagaaagaatgaattggtttggattttttgtttcgttttgccaatggtccgtcactttcgcttggccattttcactgctaatttaaaaaccggttttggttaaaagccgagctaatgaaataattttgggatgcttttaaccgcggtaatcaccggtaatgaccaaaaaatctttttcaaattagcattagggtgaaacgattttaaaatgcttttagcgaatattttggccccaaaaaaacggacttggcattgtcctgctgggcgaacaattttttgccaattgcgcaaaaatgggcggaagggcaacaatgtctggtgttgagaagggccatccgaaagcgaattttatccatctgaaaataaaattggggaaatttgacatttggggaaggaaaacgaataaacaaaaaaaacggaagaagagaatggatgaaagagagcaaagtgaaaagagagcggaaggacaaaaaaggccaacaattaattaattaatcatcaattagtctgacatgattaatagcaccgacccctctgttcaaattcaaccgcaattcgttgctgaatcggcccagtttttgttcaattatttcactcttgacaatgcgcgaacgatggcgtgccattggcggagagggcactgaaatggcaggcgacgaaatggtggcagctgagggcagaaacatcgaacgggacagaagaggggacgaattgagacagatggagcagcagcaaacggatggagaggaggaagagaagaaagtggactaaagagggagggcgaaaggcgagggaggggacgaattgggggaaagggagagggggagagta

SEQ ID NO: 17575 - DNA, 1477 bp, Heterodera glycines
ttactgcaccattctatttcgcttttgtctcttccagtcttttattacaccattctatttcgtattgtgccattctatttgttggcatctcttccgttttctcattgtttcattctatttcgcttgtatctcttctagtctctcattaccaattctattcgttggcatctcttccggtctcttactgcaccattctattttctattgtgccattctatttcacttttgtctcttccagtctctcattacaccattctatttcgtattatgccattctatttcgttgggtatcgacgtaattcgcgcatgtgtttgtataatattatgaaaactcattttacatgtttttatgcacgaatgtttgtttatacattatataaaatggaaataaaaaattttgctttaattttaaattttgctcacatttatttttttaataattaaataaaatttctttaatttttataataatttttgagtttgaattttttgtttaattaggaaaatatgttctttttgaattcaattcccagcgagaatgggctcattttgctactgtttgccatcagattcatttcaacactttgtgtagtagattcaccaaaggctggtaaagatttaaataaaataatattttaaaaaaaattaattttaaatgttttcgacaaatttatttaaatcaaaggattagctatctgaaacagaagtaaatttagtcaattctcatgtgtattattttgaaaatttgtagaaaattataaaaaaaattacaaattattttaaatacttattttttcctgctttatttcgattataaatatacgaaaaacatatttttaccaaggaaaatcttcgctttaattttcatatgcccctagaaatccttattttagattttttatacctaaaataaggcccctattttcgcgtttttttctcctatttttgcccatgttttagtttttttaatccttaattctaaattaaattaatcatttttatagatgagaatgtggaggataaaaacaactcacaaccaattgtgccaacaatgaatgaccaattgaatgaatatatgcaaaaaaatgaggatggtcaatcaaataaaaatgagggtaattaacaaataaattaattaatattttaacaaaaataaataaataattttatttaatttagatagcagcattcgtgccgaacatgcatcagtccaatccagctcatttggtggtaaataataatcaaatgaaattactaaattaaaaaaaaaatttatttaatttctgtttgaaaaagtcagtttttaatggattaattaagtttcattaaattttattggtttccgtcatccacatcttttttaaaaattatttttagcctaacacggttataaaaaatgtttcaatttcaaaatttacatcttgggtaaataaaaattttaaattaaacgatttttagggagcaaaataaaaagcca

SEQ ID NO: 17576 - DNA, 1613 bp, Heterodera glycines
  misc_feature (42)..(42): n is a, c, g, or t
  misc_feature (134)..(134): n is a, c, g, or t
attgtcaatggacgacgattgaccatgttgccatcagattgnagcagtcgatcaaattgcattgcgttcactccactgatcaggaagattgaatgcagcgtatgagtttttgatcaaagattgggaaactttcnccgaaacaaaaaatggtaaaaaaaataattaaaaaattatatttatcattgtatagaatcgaatataagcaaaattgatgaagaatatgtagcagaaagtagtgaccaacaaaatgttggaaaaagtaaatttatgatcaaaggaaattgtaattgttttaaattaaattaatttaataaatttggctaaaaacttaaaattattattttatttccgtctcaaataaatatgaaaaaaagaattatgaaatagaaaattaaatattttttaattgaattaaagattttagaaatataattttaaaaaaagttgatttttcatataatttttaaatattttttctatacatttttaattgaaagctaaaaatgaagatctgacctcgtcaaatattggagatgctaacattgagaatgagattcatgaagaaggtaaaatggttaaatttaaatgaatttaaatttgatttctctgcctattatagctacaaaattggacggaattgaagaaattggtaataaaagtgccaaaaataacggcagattggagatgtatgaacagaatgccaaactcatagaacaattgaaccgcgaccaaagtgaacaaaatgccaattaaaaaaatttattttaaatttaaaattttaaggcacaaatgaagcagacaaaaatggcaaggaaaagagaataaaacatggcaaaagtgcaagtttaatcaacttaatggccgacaaatttaaacttttccgcgctaattcaaattcaaaaatgccacgttcgaaaagcgtaaatgagaacaatgaaaaagaggtaaattaattattagtaaaattaaaataagagattttaaaaatgaaaaattaaaataaaaaattttgaaatttttaagctgaaaattcgccgtcactttccagaaacatttcatttaaattaatatcattaaaaaagattaaaatgtctctttaagaaaattcttttttccattttttaaatgataaaaaattttcttaaaaaatatttgattatatatatatttttttcaattttatgtttttagtcccatcaaaattcacctaaaaatataatggaaagacaattggacaacgcggaatcaagtgttgccaaatctgctgaccatatgccaccatcatcaccatcaccaataggttgggcaaaaggaagaaccgtcagaaacaaaatgccaaattaatgaaaaaaaatgttaaataattttaaaaaacgccaaataaaaattaaagaatcggagttagtgaactaaataaaattttaagtgttttcataatttaagaaaaatttgaaaaaaaattttcatttcctaaacttccgacattttctgtcctggtcttttgtttggtttttttttaaattaaagacaaatatgcgtttattgaattagctatttcctaaataaaaggcccctccgctcacccctgaaataaagcccccccccccctcccc

SEQ ID NO: 17577 - DNA, 796 bp, Heterodera glycines
ttttcttgagatttttctataaaaatttttctagtaaatttcttgaaaattgcatttttatccctaccccctccccccttcactcaccggcttcgttttcatcggttgaccgcccacggtgccctcggtgagaatgtgcgcaagttcggccagctcgccacggtcggtgaccaggtccacctggggaattcattgttgttgttttttttgtaaaaattactattaaatttaaagcaattttacaattaaaaaatgaatctttttttttgaaaacgccaaatttcagcgatgcaagacgaaatgaaaaatggtgacaaatttttaggaatttggactaaaaattgcaccctattttcgtctccaaatgaattttttgtttaagaatttgtgccagtttcatgtccaccagtcagggacggtccggggggggggggggggggcggggttatttttcaattaaatttagttgtacgatctttacacatatgctggactggtgccaacccaaattgtcaccactggcattcttgctatggtctgtttttgcggcatcgttctcaacatgttgctcgtctatgtcaccgtcaaatcaaagtgaaatgccctcgggattttcggcgccataatttattaaaaaacaccatacttaatctgagataattaaaaatgatatgtttaatcgaatttttggggatttgatagtttttggcacaaattttcggtctatgtcagttgggccccagcacgtttgggccccagcaggtttttggactataactgttttctttgacatcca

SEQ ID NO: 17578 - DNA, 1663 bp, Heterodera glycines
  misc_feature (1480)..(1480): n is a, c, g, or t
  misc_feature (1502)..(1502): n is a, c, g, or t
atatttgatgaatttaaatttttgaattttaaaaaaatgttcgaatccgggttcggtattcgaaattggtcgaaaatgtggtcagattcgtactcagcggctcaaattagccttagaaatgtgtttccagaattttatttaaaaaaaaaatcgggaccaatgaacaaccgaaagattgccaaaaaaaacctgatggaacaaaaatttttgacttcgaaaccaattgcttttttttgataaaaaattgacttaaaattcgccaaaattagtctaaaaagcactttttgtggtcggcggaaaacggacagaaaagcaaccaataaaaattttgtggttcagacttcaattatttcttttgggcacaaatgtctttagagttttggacagcaactcaattttttttattggcggaaatggtaaaatttgacggaaaatgccggaccaagcccctaggaaaaattgaggaaaattccggtcaaattccctgacattcggtcaattttcatggggggggggagactcagtcgtcccggtgctcacccggactgtccaccaccaccagttggaacaagtcttcagtgagtgcagtcactgtgttctgtgtgtgagagttgtgaaaatataaaaaaaaatttgtcacaaaattttaaaacagacatttaaattaatttttttattttttggattagaatcattcaaaatgccataaattgtgtggcgaaacggtacccgtctggtggtgtcaatcagtttgctcactgcgcacacatttgcccgtatcagagcattctgcaaaaaaaaagaatgatttttcaccaaatgaaatttatttagttcttttcaaagggtgcaccccaaaatctcaccgtacaatttttaaaaaaattctcaaacagaaatttttcaagaaaaaaacatttgaaaattttcaacgatttttcttttgaaattttatgataaattactgttttttggaaaattttccaaaaaaaaagattttgaaaaaaatatttttaaatttctgcggcgaggctttgggcttcgagattttgtcccgtccctttttcaaagaccgcaaaaaaaatgtttttttatataattttttcgggggagagagacagtctgctccagctgatggggccaaaaagcccgatcgtttgttattggtcccaaaattaaggggtcttttcgcggccacgatcaatacaacacttgaatctcgagcactattttttgaatggacatcatcccgactcccattgacaacacaatcaattccagcaggtgccaatcccggacaaatagtgcaggtcgagaaaattttgtttactagagagagatggacagactgaccgtcagtgccgacttcccgacattcggcgcgccgatcatcgccacccgaagggcacagtgtgacatattatcactttttgtatgcagcaacagcaaattgaaattgtgcgtttaaaaaagcaattanaataaattattttcgcaaatanacaaaaagcaaaataataattaaattaaattattcgttttatttatttttcgcaatttatgcgcgagaggttttttcgtctcaaaatccgtttaaaaggtaatgttttgtgaattgaagcaatcatttgagagaaacagaattgagagaaagaaaaggaga

SEQ ID NO: 17579 - DNA, 2486 bp, Heterodera glycines
ataaatttgtctccttagatttaatagaagaattagaatatcaatgagaaaaggctttaatactgtcaaccttttttttgcctgtagtatttattctcggatgatatgaatcatagaaatgtgaattgtagttttaaagtttggttgcttttgagcaaattcataatagacgcaatgaaaatttttattttcgaaaattttcaaaaattcggttttatttaattttggacaggcgaatattaaaaatacttttatatttttctccatttgttttaagttgccttcaagagtttgtgcaccaacacctactgaatttaaaattaaagacgcaacgaaaatatgcttcttaatttagctaaactcccacgattactcaaaacaatttattcatttttggatatacaattcacatttgcatgtttcctattatcagaggaaaattattattctaaaacgcaaggggaaatttggcaccggaaagtttgggcaatataaaattgggcaccaaaaaatttggccatcaaattaaggaaataaaaatattttaatatgtaaataatatagccgtctaatttaaaagcatagttgtaaattataatcaaattcgagctgtaaagtctttaacaaattgcccagtcaattaaccatgtttatatggttgggattcattacaattctttgtatattaattcatatatatgtattatttgtagaaggctcaatctgttgaagactaccggccttgatattttcggtcccatataatctaagtagtctaaacccaaatataaactggtatgcatcgaaccctaagtatttaatgatcaaatcatagcgtaatttatttttttattttttaaatttttcaattttcaaattaataacattggtgcccaattttcctggtgctcaaatttctggtgccaaaatttcaatttcaggtttggattttttttgggcacataaaatccgaaaaaagtagtttatgtattaaatccaacaggtgacacgcaaacctttttcgaatggtaatttttcttttcaatataaattaaggaaactcttttcatgcttttcttaaaatagaattcttccgtgcatttaatgccattttaaaaaatgccattcggatcttttggctcaattcaaccgtgccacatttttacttttttagaatttctgttaatacaaaaaaagatataattaattcactgaaatgtgcatcttaatttcacacacgcacaaaattttttgccgtgcccattgagataaaaaaaatttcacattaaatggcaattagtcaaaggcatacaattaatggagaacacaatttgggtacaacggcacatcagaggcggaaactctctctttaaaggcgagttgagaagttataatttgcttcttatgccggccctccatttaaaactccgcacaaaatgccattataattaaaagttttagaatattccaatttttattacattttttctattattgcatacagtaaccgtaaaaaatgctttttagagaaagaaaataatgatggcttcttcctcagccattccgtcgcccatcgacaattcctttccgaatttttccacaaatgtctcagctgcttaccaatattatgtccaattttgtgacgacccaacgcggcgtgacctgacgctgacctcgtccgccatcactttgttcatcatttacgcgcttggcattgtgtcccaattggttgtgctgcccgccaattggcgcctctccaaacatcgctccgcctttctgctgctcctttacattgtgcgcatattttgagtttcaaaaattgaatttacaacagtgacgggaccagtacctgtttttagtaaaaaataaactacccggctcgaatcttgcagtaccggcggtaccgcaactaaccgtcctgttgatatcgataccggtcgtaaacttgcatacggtatcggcataggtgatcgcagtaccggcatctgctttagtgaagaataccggtgccgctctattcaatttacaaaattagttgaaatcttttcaatattctatattaaaatttgttaattattatagaatttaatatacatggcatataaaatacaaaatcatttccatatgtcggttttatttcaagattaaaaataaaatattttggctttagaatctcttcgaccttatttggctgctcgaatatgtttggctttccttggagtttctcgttggcactcgcgtacatgcaaaatacccatttggtgcctatctgttccgtttcgtcaatttttgcattgacactttttacatcgaattggcattcaatcggtgcaccgctttccttttcccacgtctttacagcaaaatttgcacagaaaagtttgtccatttaactaatgagaaaaattgtatttggtgttgccaagtggacattttttgccttcgagggaaacctttggagtttttagagaaatttgaatttaatt

SEQ ID NO: 17580 - DNA, 2960 bp, Heterodera glycines
ggacataaatggcaaaaatcgcaaaatatggacataaaatggcaaaaatcgcgaaatatggacataaatggcaaaaatcgcgaaatatggacataaatggcaaaaatgtcaaaatatggacataaatttttcaaaattgagtgcaaaatttcttcaaatttattggttgaaattgcatatgagatacatttccaaattttttgactcggtaaggcgctttgacaaagacggctttcgttttgcaattagtcggtcaacattcggaaattggtctcgaattttttcggcaattacgtgcaatcattttaaaagaaaaaaaacataaaagctaaaatttattaatttttttagcgcaaaatcaacaacaaaagcgaaattttcgcttttttgcttatttttgacataatttattaatttttaagaaaatttaaatttattcaatattctcgagaaattttggcgaaaaaatgattttttgaaaaatttttcgggttttgggctcaaaaaggctaatttagctgctgggggccgttctaatagaggtttttttgaaaaatgccaaaatatggacataaaatatggaccaaaatgccaaaatatggaaatatggacataaatcgcgaaatatggaaaaatatggatatagaaatccttcttttctgtcttcatctctgcaggcttttctcccaccaatatatcgatttttttatggtgacaattttagttgtgagcagatagaaagaaaatggagaaatagtgtgggttagagaaatcaaaaatatttggaaaaaacggatgaatcaatttttgttctactgttacgtcgggattaatacaaaatgtttgcaattgatggaaattttgaatttagcgaagaaaatgctaaaacaataaaaataaacaattacgattggtgaaaaaatcctgcagaaacactcgaaattgttgagatgactcggaaattgaaactcaggcaaagaagttgaatttaaaattctttcaatttcattttattaaacgcactgaaaatctgctgtcgccaatttcgcatgttaaacttatgaatgacattcaattaagtctgtgcaaattcgttttcggctttttggcaatctttaggttttttttcatctaattcgctatatttggccattactttcgagttatatgtaatgcgggatatgcatccaatagtttcgtcatactgcagcagaaccaagacctgctgcagttcaagcagcacaaaatggtagaggaagcggtccaagagcaggaacgtcgccggagtatcgtcgtcatggggttggccgagtcggccgaaacaaagccgtcggatcgcgttgctgccgaccataccgctgtctcaagtgtactcgatgagcttggcatcaagtgccccatttcaaactatcgaatggggtccccccaatggaagaacatgaacattcgtccgtcgctgagcccagcggaattggacgtacgtcgacagctgcagaaagaatgtgcagagaagcgaaaagacggcggtgactgggtgatctacgctgggacggtcattgaacggtcggacattcccaatttccggaaaatcaattgacttctccccaaatcacttttgacaaatacatatttttcacaaaataagaatatattttccggtcttaagcatgttaagctcaataaaccaatgatgaaaataggggaagttaaagcctgcttagttaatataagatcaatccacaacaaaattgatgaattgctttaaatttggtaaataaaaacatagaaatttttctgttaactgaaacatggacaaaggaggaaaacccaatcctctttagtccatggataagcgaaaactataactttattttttgtcataggaaatcacaaaaattaacgcgtgggggcggtttcaaagcacaaatgccaatggaaattttgtaaacattttggagaatgtgccacgttttggcacgggcgatgtggtcggatgtggactgaattgggcaactcgtcaagtgtttttcacgattaatgggcaacgcttgagtttgtgtttattatgccaatttacataaactggctaattgcctaataaagacaacaccaatttgtacgttgacgatggcacggcggacctttacccgaccgtgtcaatgctcagccacagagcagcggtcgaggccaactttggtcccaacttccgatacgatttgtccaagaaattttgagactttggaaatgaattaattgcttatccaaatgttgaaaattaattaaaaattcattttttgattaatcacaaaaatgcgtcgtcattcatgcccactgaaaatggcaccaaatgtacggatttgcgtgactgagagtaattaatattacaattgaggcccgtatccttggtatcaaagcaaagatttaaatttaaatttatgataattaaattctgggctaaatacaactgatgaaaaaaaatattcttaaatatactcgaaaaatgctgaattttattatgttttctcagcgcatttttttcttatgtcaatatttgctctatttcttgtttacttataaattcccgagatttaattggttcggaattcactgaaatgaatgtgtttcttttatgataagctatcccgaaaattcccggctgaaaatttttttttaaattttcaggtgtcgaaatttatgtacacatcggattccgtcagttcggccccagaacgtttttacaagatagccgtttttttttgtcaaaatggcaacataattggcaaaataaatgaaaatgataaaaatgttaaagaaaatattcaaaaagcagtgaaaaataaaaaatcattcttatcaaacattaattaatttgattattaaattcggaataaattcaatttagtaaatgtccatcagtttcagtgcgtccccgagatatttagctattatatttctaaata

SEQ ID NO: 17581 - DNA, 1418 bp, Heterodera glycines
taaatcgcaaattgtttctttttgcactacaacccccgtatgatccaagggcaaaaaagaggacgataatctttggcgaaattcgcctctcagaatcaacacagcttttctgttactacttgcttcgtttaattatgcaggtttcgccattaggctattcgctcgcgatacaattagccctatagaaacttggagcaaaaactagtaatattttatcctttagaaagcatgcaaaatagtttgttatagacttgtgcaacaactatgaaataattcgctgaaattaatgtcctttcgacaatataaaattaatttcgtttattttagaaccttaggttctgatgaattaggtaaaattaagttctaatttattattaaaattatgaataagcgtcaaaaagcaattaacaggtggtaaatcgcaattgtttctttctgcactacaaccccgaatggtccaagggcaaaaaagaggacgataatccttggcgagattcgcctctcagaatcaacgaagcttttctgttactacttgcttcgtttaattatgcaggtttcgccattaggctattcgctcgcgatacaattagccctatagaatcttggagcaaaaactagtaatattttatcctttagaaagcatgcaaaatagtttgttatagacttgtgcaacaactatgaaataattcgctgaaattagtgtcctttcgacaatatgaaattaatttcgtttattttagaaccttaggttctgatgaattaggtaaaattaagttctaatttattattaaaattattaataagggtcaaaaagcaattaacaggtggtaaatcgcaattgtttctttctgcactacaaccccgaatggtccaagggcaaaaaagaggacgataatccttggcgagattcgcctctcagaatcaacgaagcttttctgttactacttgcttcgtttaattatgcaggtttcgccattaggctattcgctcgcgatacaattagccctatataaacttggagcaaaaactagtaatattttatcctttagaaagcatgcaaaatagtttgttatagacttgtgcaacaactatgaaataattcgctgaaattaatgtcctttcgacaatataaaattaatttcgtttattttagaaccttaggttctgatgaattaggtaaaattaagttctaatttattattaaaattatgaataagggtcaaaaagcaattaacaagtggtaaatcgcaattgtttctttctgcactacaaccccgaatggtccaagggcaaaaaagaggacgataatccttggcgaaattcgcctctcagaatcaacgaagcttttctgttactacttgcttcgtttaattatgcaaggttcgccattaggctattcgctcgcgatacaattagcc

SEQ ID NO: 17582 - DNA, 819 bp, Heterodera glycines
tttttgctgatgcggccaaattttaatttattttttctaccttttaaacaaccgcctcttttactctttcataatttttcccatttttgaacattactttcacaaatacttacatatgtcttctggggcctatttcttgcaaaattgggttggggaggggggcaaaaaaaacaaaatctgttggggcttctaatttcgcttttccaatttgaaattggattcgaaactcttatctttaatattaattataccatgtaataaaaatactattaaaaatattatacaatatttcttatttgttttatgttctttattgtaaatgcatattcaaaattttattggcaataaaaatgttaatgttgtgttggaaattttcgttttttattgcttcaaacgcatattatatttgggccggcatattttgagtaaaattaaatgctatattcgttcgtttatatgtacaatttgtgatcgctgatcagtacattgaaaacgaggatatatttaaagaatttgtccaaaagtgtatggagcgtcagcagtccaacggcggcactgccgcaatggcaccgacggtggcgagcagtgcggagactgcaacggtggcggcggatcagcagcagcagcggtcggacgcctgtgtgtcgccccaccaattgacggagacggggtgagcgagacgtgccgtacgggcattttgggagggggtcgggcatttttgctgtcatcaatttattgatttgacaaaccgtttctcgggctgattgacggagttttgcgaaaagtctatggacccgccagaagaggccttactgtgct

SEQ ID NO: 17583 - DNA, 1267 bp, Heterodera glycines
tgccaaatgccttttccctggactcgccactgctggtgcaaaaagctggtgagttatgcacttcgtttttagaaaagtgttatttttcttgaaatcttatgagggtcgccttggttgtctagtgcaatctttttgtaatgccataatgcgtgaaatgattcggaatttggcaggctaacaagccagaaaaattttcgggtgggggaattcgaaattttctttttatattctctttaggtacgaaattttttgccattcttactttataaaatcttcggcgccggagcgagaaaataggatttgtagtggttttgccaaaaaaaggcaattttttgccattggctaacaagatgttgtcgggtgaagccaaaaatgctttttccgtcggctttttctcattctctctgcctaaaatgacctaccaaattgaccactcattcgaatcaaacccattgttattttcattattgttgttgttgaacagatgcactttcccaccaaattgcctcggtgcacgagcggcccaccgacgcgggccgtcccaccgttttgtgcgtcggtcgccagctgatcgccgtgggcaccgcccgcggcctttgtctgctgttcgagcgcggcacgcagcgcctgcggcgattcattcgcgcggaacagagtgagttttattcactgctcctgcgaatttataggagaaaaaatatacaaaatctggagattttacccatttctttgtttagccgtttttcaaattaaacttgccaaaaacgaagggatacattttttgatccattttcaatctttcaaaaagttcaaggcaaacaaatccccaaaaccttaagcattcggctccatctcctgcttggacttctcgcccgacccgcaacagcagcggctctgtgccggtcacagctccggcgcactgaccgtgttcgactgcggccggggccgtgtgctattcagcggcaacgacctcatccagccgggccgctcggtgctgcacgtcaaatacatcgcgaggtgagcggacagtcggaaaaatgcctataaaatgtttgggattttttttaattttcattcatttttattttttcgttccacatttatataattttatctaaaaaaaacaccctcattatgtgttggttcagctacgtgttgctgatcgtggacagtggtggcaatgtgtacgaattccatgaacggcaccagcgccagcagtcccatcggagcaatgtcgtaaacggaggtggcaaaagcagcagcaaac

SEQ ID NO: 17584 - DNA, 1365 bp, Heterodera glycines
aatggcataaattcccgttttttgtttttttgcaggtgttggtccaaaaatgtcaaatttggcacttcaaattgcatttggcaaagtggagggcattgcggtggacactcatgttcagtggggttgccttcccgtctttgtcggcacattttaaacaatgtttttttggcaggtccaccgaattgcaaatcgactcggttgggtgagcacaaagagtgccgaagaaacggaacaacggctcaaggaactgctcccaaagtgcgtaggtgttaaagccagaaatttgaaataatttttgccattttcgggtatcgtttttcttcatcaacaagaaaatggtaattcctacgggaaatgtttccatttttaggaatcattttcattttatacaaaaattttgctttattgacttgttgttagttctttgagcggcatttagatttttcaaaaagaaaattttattgtttgatttataaaaaataaaaggaaaaaaatttttgaatactttctcagcaatatttttgaaattttgggaaaaattagtaattcatcataaaatatgaaaaaatcgctataaatatttttttcttgaattttcttatagaaagatttctataaaaaaatttttgtaaaattctaagtagtaaattttcggaggagaaacaagctgcttcccatactttctcacatcatctcccctaaatcagcaggtctgaatggccgtccatcaacaaactgttggtcggctttggtcaaacaatttgtttgccggtgcgaccgaagtgcgacgagtgcgccaaccgttcgctctgtccatggtcatcaccagcaaatggagcagcaccaaaaccgaagagcaagaaaaagagatgacacagagagaatgaagaacgatgaaagaaaggcatttgccaccaaaattcacttacaaattaaaactgatcctcgaaggaggccaaaattttaaatcgactttttttttgccacccgtcatagctttcaatatgtggaattagatttcggcctggattcaggtccaggccatttttttgacaacttggatttttgtccaaaaaataatgataaaaatgttgttaatattggttaattaaacaaagactctcaagagcatcggtaattgattttattgacggacccttcaaatttctaaaatttttatcatgaaattttttttattacgtttacacctttaaagagattcaatatgggtcagggctgggaccgcgccgcgatgtgcgattcgcggcgttttttttttgcgcggtccgcggcaatttgaatgcgcggccgcggttttttcctgtgcgcgccccacccctgatatgggccactccactaatgctg

SEQ ID NO: 17585 - DNA, 1174 bp, Heterodera glycines
gcgcaattttaattatttaatcaaaatcaaatgcttttttattgttcacccaatgcaattagtgccactaaaaagccaaaataacacattgttacaattttcatctttctgaagctgaaccgccgcggattccccaattttgcatcgtttcattatccaacaattgtcctccaagtcattttcctttgctttgatcagtgtcagcttttccttggtctgttcgttcgctaattcaaatggcaccatttgcattgacggcccatgaacagaaaaatgaatttcgtaacagacggaagaaatggcattggcacggagaaattgctaaacaattgggaaaacaaaaatagaggcaatcaaaaagcattgatttgccgaaattatggtcacacctccttgaatttgttgacccaatcaatgtccacatgtttgttaaaatctttgcaacgcaatcgcttgggttggccatcttttctcggagtttgcaaccatttggacaatgcttggccagcagaaattgttgcatttggcacatcaaaatcactaattggatcaggcaacagaccaaatgaatagattgaattcaattggttaagatcggtaagaattgtcggcgaagtgcgacgacgcaaattgtccaaaccatcaccatcgataaagtccaagtggcgaatgtttgatgcaaaaattggccacatttcacgaacaaaaacatcccaaatcggctggtcatccgagctgtgtgcggaataaatccacaactctaaattggtgcctcttttgttaaaaatttggtgatttgaacgaagaaaagcgatgacgaagtgatcgatgtaactgaaaatggaaggaaagctttcattgccataaagctttgatttttaattactcaatccgaaggcgcttaaaacggattttgctgggcaacggacgctcgggcaacggaaatggcacaaatttgtaaaatttttcatccattacataaagtttcggttcaggtcctttgtccttgtctattatgattgttctccaaattgtcaattcgcttttgccatcgaaatgtttgcccaccaacgcattgaaacgtggcgaaagaattgccaatttgaggccgagttgaggacggtcaaaactgggcaaaatgtccatccaaacgtcgttgcaaatccaactgaaa

SEQ ID NO: 17586 - DNA, 2628 bp, Heterodera glycines
gtgtcgcccattccgagtagacttcgtttcagttttcaacacgagccaatcaaaatgggcagcacggaaatcggagtcgcgaagttcgtttcgacaacacaaatggacgggcgtacacacgtcgcaacggcagttattcgtcggaaccgtcgtcgggtcgacgaagctccttttcccgtcatcaagatggtgctcgtacatacgtaccctccactgcagtacagcgaccgatcagcccgaatgggtgtgacagtggcggcatgtttctaatggtcgaccccttcaacattccaaacacattgggcgcccagtaaataaacacattaattttcattcatactatattatacataattcttataaattaatttatattattcagaattcaagtatttgatctccaagagagttagttcctttttattttggcatcattcgcctttttatttatatgtccaaaatcagacgcgaatttaggcatccgacatattattggttactgcattccattgcgttgctgtgtgggtctgttcaagcacattcagccatgccgtgccatcaagtcgatggaaagtcaatctatggatgaacagttcgcgcacaagtacaaattccaccccaaccttccattgagcgttgtcccgcttcacgacacggaattccatcggatgatgggctcaccggtgatgccgttgcgcgacggttatcagcaacgtaacagattctttgtgcgtccctcttccccgcggttggctcaacagcagagacacgaattcgacgacaccgcgatgcattagtgagtgagcggagattgtggggtttttaattgattgtcaggtgttcgttaaacaaaattttcaaaagaataatgcttactcagtgctttttggtattacacctgtcaatatgttatgcgtatgaagaaagttcttgctaaatcacaattttaattaagcgtgcaacacaaattcaaacttcagtgagttttgttgggttcttctgcttttaaaaatctgttttagcatgaaccagcatctcattgcttacagactgccagatggccttgactgttaccttcgtctggaactcgccccacattgtaatatatatttattcttcattttatatttttatttgtttattttttcccacttttaacgtatattttaaggccagagcctattctctgaatagaggagattgcggcagcgggaaaccatgaacatgatcctttttgcatatatttacatcgctcgtgttaataagaaaaatttttgattttttgcattccattggctttgacaaaactgcgaaaaaagtatcattttccaattgtttatttgtccgtgcataaaataagattttctgcagtgtacatagattttaaaaaatgagagagataatagtgtagagaaaaaaattcgttgtatgctacatagaattatgagctgctgagtgcaaaataagcggcttcgttgcaatttacaggaccataaaagacatggccataaagtaacttggcaacttaatgctcacagcttttcagatttgggctcccattgcaaataaagggtttttctcacagtcggtggattgtgaattagtcaccaaaggggaggggggggggtcccaggttaaggtcctccatatgttgtgtgtaaatttaaattcattccaaatttgtttatatgaccaataacgctctaaagcagtgcatagacaaggaaattaattcgattactattcataaatcatggaagtataagggaaaaataaaaatccctttccctaatttagtctgcaaaaaatgcaattcaaaatttattcattggaaacaaattaaaaacaatagacagataaataaatattctttgagacaaagggtacaaaagtcaatcaaagcgaacaattggagacaaaggcgacccctcgctggcttagcatagaatgatcaaatccaattggtaacaaattaagtccgaacaaaaatttggccctgttggagtacagataaacaggcaccacaacactcgctggagaatgtccttccaaggtccacgtgaactgaagccgtggcactccaacatgcacttcatctgtcagcttaatttcgtcggcctcacaaagaacgccaattgcgcgaaggtctaaaaataaatgtgcgatgaaaacgaagttcatcatcatcaaccacctgtcagtgtgaatgccgttgattttaattgtacttcctccgtttttgtgatatgcatgtacatctgttcgagcgaccagccattcgtttgggctatcagctgacgcgtagccgttatatacgcttcaggaaagaacatcccacccagccagacttcctcatatctcagattttcagaaagtgacaagcgctttagttgttccatcctttgcacaaagtctcgcatccattcaagtgctgttacgtcttttggcacggaaaattggagccaattgtctggcacacgttttctcttgaccaatgcagctattaattcacggctgtgattgttctgcttctgatccccatgacaaatggacaacaattcgttgaggtcccgtcgaatatcggacaaaagtctggcgcccaaagttgatttcacgttcaaagaatcg

SEQ ID NO: 17587 - DNA, 2985 bp, Heterodera glycines
tgcgattgagataaagcaagtctcacaaaagattagagaccgaaattttaattgcacggggcctggtccaggaccttcaacatgcaaagagagagcgtattacaataaaatttgattaaaggatttttagcaatcttcggatggaataaatatgataagatggaaccaatcaattcataaaatttcgtagaattccaatttcaaaatttcgagagatctattacatttgtgctaaaatatatattaaaagatttgcttgtaagtgttggatttcgttattatgcaaatacaacttttttgtataaatgaaatgttaatgaatgcatgtcgtcgcatgccatgcaattattttattttcctttttttcatatttatttagaacatattcaaaaaggtaacttttacaatgtatgatgaatttgagcaattttacaaaaaattcacaactcatttagttttgggaaaaccgggacaggtgctaggtcgatacgaaaaaaactcaaagaatcataaaaataattaatttaattttaaatatcggtgtctgaatttaataatacgattattagccttcggcaagccgtataaaccagggtgacatttaattattattatttttatttatctattgcttttctttaggttcgtatttgtatttattattattataaattatttactctcgctctgggctcactttattgttgtgtcagacgttctttttatatgttcaataaaatataaaataattataactgtttcttcacctatataattgtataaaattttgttttgtgtgatttaatattaagttttggtttatattatttctccttcttttgtgaattaattgcctttttatgcaattatttgctcaggatttattagaatataatatgtatagatttgatttattttctatattttgtttttatttttttatgtattaatttggtttaacaattgaaatacattgtgtatatttactctatttttatattaaagttacttaaacaaaccaatgacttgctttgtatttatattggttattaattttggtgatgcgacatttgcgccgcgccatttgcgccgcacagcaaaaatggacatttgcgccgctcagcaaagtcgacacttgcgccgcgccatttgcgcctcagacagttgcgccgcggatatttgcgccgctccatttgcgccgcgacatttgcgccgcctagtaaaaatggacatttgcgccgcgcagtcaaaaataatatttttcatttcaatttcactaatatcaataagattactaaaaaccaacgacgaaaataacgaagtgaaaaatttcaaaaaatcactacttaaagataaacattaatttttttatttttaatcattaaaaatcttaacatttattaggtttatcaaagatatgaaaaatgaagaagaataacaactaaacagactgacactgtttgaattagtcctactcatggatatttgaccgcccacggctcaaaaaataattgaaattgatgagtagggtggggatttttaggtttttagttattttttctgcggcttttaattcaatgagaaaagagaaacacatttttaacacgaaaccccccccctatgttttctgtaagaaaaacagactattttttgctttttattcaaaaaaagatgaaatttatgtatgtattttgtcattaaaattgttaaaaagttatttacatcgattttaattttgaaacaagcacatattttaatttttcgcccctatttcgcgatttttgattgaatatcaatcgattataatttagaaaaattgttgggtcaatcttataaaatttttaatgagcggcgcaaatttcgcggcgcaaatgtcgtttttgttaggcggcgcaagtgtcgcggcgcaaatggtacggcgcaaatgtccgtggcgcaattgtcttttttgctgagcggcgcaagtgtcgcggcgcaaatagtgcggcgcaaatgtccgcggcgcaaaagtcggctaaccattaattttatattttctattaaaaacggctaaacatatattttcaacatataattattctcttggcggtgtgcaattgtggttgatgtgattggtgccgtataataaaaatatttatttaagaaatttctaataatttggtttaattatttttttatgaatatgctatattatattgcttctggcatttattttattcattattgtgtaatctctgttattattataatgagttcattgaaattaaatatttttattttacttaaattttttttgattgtaaattcgtttagtgcgctagaatatatatttatcgtttttatttaagctcatacatgtagggctttaatttatttcaaagtataaatttattaataactgaaaattttataaaataaattatttaattttatagaccttttatctgctttgttaagactaatacgaaacttatattgaatttgttatatgcaattattttgggtttatttatttgtgaatctcaataatcaattttcatttataatttctttccaaccagcagcagaaagtaacgtttgtaaaaatgaaaaacattaatttcaaaattaaatttaaaagcaaaagatgtcatgcgagggtaatttatcaacaaatatcacgcagaatatatatttagctccattaattctcgtggtgcagttgtgatattaatttccataaaaatactgattaaaaaatcaaaaaatttactccaaactgaaaatacctaaaaaaatgttgttcgaattttaaccaacattttcacgtttcggctggggagagagagcctcacatacgcgaaagtccttggccgaagaggatttttttcattgccaatttggcgcaaattcaaaaaagcggccatttgggtagtaaattaattatgggaaaattaaaattaatttcagaaaaatattaacaaaaagtgattaaatttataattt

SEQ ID NO: 17588 - DNA, 1794 bp, Heterodera glycines
agcgtactttgaccctttaattctttcatttgctaagtgggtctcgggtcttttcaagtgcagcgatccttgcgacttattcccaacatttgttgttaccgatcactccaattgtcaataagcagccctccaaattgattaattaatgagtatgaaaggacaaacgaatatccaggcaattaggttaaagaagtatttcccgtcaatcgatcactgattccctctaaaagtgccatcccctctaataattgacgaatgtatggacaattaaaacataggctacgaataaatcaatttttatttcaataaatgggaaccattctatttaaaacaatgaagaatttaagaaattcgtatatttttgataacaagttgccatctttaaaatggtcggcagagttgcgctggtggcacagcggaaaatggttatttttgggacttagggaaccaacggcgtagccaaagagggctaaagctccccgaaaaaccaaaaatgtgaacgaaaaataaattgtgcccacgatgaaaaatcttagtgatttagactttccatgaagtgaaatgcaatggtttgggaggtgagtttcttcataaatttatcatattatgtacactctggttttttggcactaaaaagagaaaatttggcgttacgaagaaaaataaaaatggattttttttcttaaaaagatttgttttgttttttacttttacttgttcaaaaataaataaaataacttcctgtttcccactttttgttaatttttcctttctgcactaatcactaataatcaaatgcattcccgagtccaccaatgtaattccaaattcatattagataatcataagcaaatgaaagattcagattcaacccgagaccaagttcgagtgcccaatgtgattgccttagtcggtttgcctgcgcgtggaaagacttgtgagaattgactaattaagaaccaaagactccaattaaggagttgtttattaaattttttattagggtttgaaataagtttcattcttttttttgctattttcttcttcagatatttcacacaaactttgccgttatctgaattggattggcatcaaaacgagggcattcaatgtgggggagtaccgtcgccaggcatgcgatttcttccagcaaggagcatctgaattctttagcccaaataatcaaattgggacacagatcagagagtaagtgtctgtttctgtttttgtatccattttttctcatttccctttagccattgcgcaaaattggccatggaggacatgggcctttacctggagaaaaaggagggcgaagtggccgtttttgacgcgacgaacaccacacgccagcgacgcaaatggctggtcgactactgccagagggagcgcatcaacccaaagtttcgcatattttttgtggaaagtgtgtgcgatgacccggacataatcgcagcgaacatttcggtctcacccattttggcccatttctcaactaaaatgcatgcatttcaggaggtaaaagtcaattcgcccgattatcgcggaaaaatgacggaggaagaggcgaaggccgactttttgcgccgcatcgaaaattacaaattgcaatatgaaccgttggacaacgaaaaggacgaccacctttcgtacatcaaagtaagtctctcgaaggaattaccgtatttgctctaattatcccctagtctccgttaatcccccaatctccaattatcccccagtctatgagggggtttgaagaataatccctctatcttaatggccagtcctacg

SEQ ID NO: 17589 - DNA, 2080 bp, Heterodera glycines
cagtctacgaggatgtgaaaaataatcctccatgggggataattagagcaaatataacccatttttcgataaatttaaaattgtaaaacgccttttctggggttttcggggtcgttgacaaattgcctctttaaaattaattcgtttaaattttttattattgggcattggaaggcaatgtttgcttagcttttattctacaaaaggcatatggattgcttattgttaggttggcgtcattttctgtcctttttcgttaggttattaacgcgggtcgttccttcttcgtgcacaatgtgaatggccacgtgcaaagtcgggtcagttgggtacaaaagtcgggtcaatgggcggtggcgagtccaccgttttaaaatgcatttggtttcgcttcctttcactcattttgcctttccatacgttcaggtggtttactttctgatgaacatcagtcttctcccacgttccatttacctcactcgagttcgtttctccaactttcgacctgtttaatgcgttggtgttaagcatggcgaaagcgaatacaataaaattggccgactcggcggcgacagtccgttgagtgataatggcgttaaatacgcggagaagttgaaagaatacttcgaggcatgtcactttacactaacaattaattctataaaaaaaattagcatgaaaacatcgaagatttacgcatttggtgctcccaaaagattcgtgcggctcaaacggccaatcatttgaagaaattgtcttcatacatcgaatatctaaaagtgcttgacgaaattgacgcggtaatctagcaatttttgaccattgtgacaactcaattgacaaatttagggaatttgtgagggtttgacctacgaggacttccaaacccgataccccaagcagttcgctgagcgggacaaggacaaataccattaccgctacccgtccggcgaaagttacgaagacctcgtggtacgactggagccggtgatcatggagttggagagacagtccgacattttggtcgtttctcaccaagccgtgcttcgctgtaagaaaggaaaagcaaattgcaagacaataatcccatattaaggcattttggcgtatttcaacaataacaaccgggcagacttaccgtatttgaacgtgccattgcataccgtaatcaaactgaccccaaaggcatacagtgagtgggcggttacggcacgatctctgctaattggaaatacattaggctgcaacgtcgaactgttcaaattcaaagtggacgctgtcgacacttatcgggagaagccaaacgagccgatggtaagcgaacggcggaaaatgaaaattgtaaacaaaaagtggattagttccaattaatgattcttcgcattgcctttgtcctcggaattcgcttcatttgtctttctttctcatgcctctctctctcttgcattccctcgcatttattcgttgcctcttttgtagtgggaacacatcgaaggtgaaggctgcattcgcatttgtcgctctccctggtcagttgcgcttgttttgcccacttttcttttcaatgtctttctgttgtgcatctttgcccaccttttgtgcttggtcccccccccctaacaaatccattaactgcgctatcactcctttttggcttctttcgtgcttttgctttccttacaattattttttggttttctattactttttaccttggcctgaaatgcactttcctctctagtggtttgcttttttcactttctccactcttttcgttttttcctaatttttctgtttcattaattaagaagaaactcttggccgagcccatccccgcaccaattcccgaggagagagagtcgtcaatctccgatgatgctgtcgaacctccaccatcccaaatagttcctctcaattagaagtcaactcatttatatgtagaacagataacttactcaaaaagttcattttgatattctcactaaatttctaaaattgagtgtatttattgattcatttttgtaaaaatgtatttacgcatgttcagttaaacagaagaataaattcttatttttgaagg

SEQ ID NO: 17590 - DNA, 719 bp, Heterodera glycines
  misc_feature (656)..(656): n is a, c, g, or t
atggccagatgagaatttaaaaaatttcttttactcaaaccataggcggagtagaggtttcagggccggagaatccgattctgatatccatttcgactcaattccgaactccggacccgaataaaaagtcgaacttactaattttttaaatttctcattttggtttaaaaaaagatttttaaaaatttttattgaatcattgataaacttttagtgtatttccgtatatttaagccggttttgaaccaaaaaatgcgaaactcgaaaaatttgaatttgaagtttcgactttttgttcgagtttggtccggcgctcggaattgggtcaaaattcataaccgcccccatctgcacctggtagtatttggtccggttgaccacctcctgcgcgtcgtcggccggctgctgagaaggggcggaggaggaagacggtgctgcaccaccatcacttgcacccgttgttgttgacgtcgttgttgcagtttcctcttcgcttgtgccaccggcaacaatctttttttgctctgccaaaatttatttggattagatgggtttcaaacccttaaaattctctctctttctctctctctctccttatccctcctttattcctatttcatctctccccaccctactctctctctcttcctctcgtncttcttcccctctctcgccctctctccttttttcgtctttctcctcccgctcctactctctct

SEQ ID NO: 17591 - DNA, 1262 bp, Heterodera glycines
catcaaacggttcgcggacgaggcgacggaaatgccgacagcggaatgggcgatggcacaacaaaggtccaccaaacggctcgcggtcgaggcgacggaaacgccggcagcgaaaattcgggcgaggatggcacaacaaacttccatcaaacggttcgcggacgagtatacggaaatgccggaggaaattctggagcgggcacagcaaacggccaccaaacgattcgcggacgagatggaaatggaaattccggcagcggaatgggcgatggcacaacaaacggacaccatgcaaatgccggcagcgaaaattcaggcgatgtcacagcaaacggcgccgacagcgcaaattcaagcgatggcacagcaaaatgtgtcgggctccgaggtggccgaattgcagtcagacaacgctgcgccagaaattacaacaaagagagggaggccgaaattggagtacgacggctatttgtacttgttcgagaggcggagtgcggacggcaaactcaaattctggcgctgtgagaagttcaaaaccaagtacacgaaatgctcggcccgactgcacaccgacgagcacaacgccatgcgaaaaacactgaatgagcacgtgtgcgaccaaagtgcggcacacgtggaggcgcaacggttgcggacggccatcaaacggtacgcggccgaggcgacagaaatgtcggcagaggaaattcgggcgattgcactgcaaaatgtgccgggctccgtggtggccgaactgccgaacaaagacgcgatggaaaaggtaaaacataacaaaagattttttgtttcgtattttcgagtgatttggcacttttttcagatggtgagacgtatgcgccaacgaaattgacataagctgaagggagctaacaaatgaggagaaaggaggaggaagcaaagcgatgtcaatgccgaagcgatcaaaaaaggacgaaaatgcttattgttaattaatgccgcccatatttttgtgcacaataaatctgtgcgtatacatgcccaaaggctcggtcaagagactttcgattgggtgaaaatgaggggggggggagggtagactgggccaatcacttgtgaaaacctcattagactccttttaaattaaattggctgaatttcaacaattatgtatacgaaccatttttgtttaaaaaacaaaacgaataaccgcatcatcttattcatttgcaatgtttttttctgttttatagatgtccatcggccactctcccccccccccc

SEQ ID NO: 17592 - DNA, 1460 bp, Heterodera glycines
ataaccattttttgacgtattttcgccctgcctctgatcagcagtgccttcttcttctgctggtggagagctatttgttgcatttgaaaagtgaatgaaaagggtggcaatgaaaagaagggcgaagttggacattcttcagatggtttttaattttctatatgaatatttattatattttattatttatttaatattaatcaaattgcctttttctaaatttaaatacttctaatatttccttccgttcacatgaaaagcacattttattattatttggtcgacttcctcttccgcttcatattttttataatatattttttcaattagtttttgtgtttttcataagattttttgtatttattttatttaaaacgtaaaatatttaaaataaacacataaataaacaaataaaaatatggaaaggcagcaaaaaaaaagtcatacacatgattaatttaaatactgtaagatatactgtatctacaatataattgatgctaacactgtaattatcgtcataattaaaatggccaattcgccgtgggcaaattcagtccatccaaattccgtcccttttcgtctcagaaaattcctttgccttttctcactttgtgcactttttctgctgtccaccaatcgctccacgcggaaaagtgcttcgtccaacggcggaattattcgatcagtgaaaatgtcgcgcaatttgtgggcacgcgaaagactttttgggtcggaaatcaccgaaaaagggacggagaatttaattattattattttaatcattattttccaaagtaatttaaagctgaactgtttgaattgcgtgaagaacactctgctcggtcaggctgtatttgttgatcactgctgccattcccatggccaatagtaaatgcgcttggtgggcctatttggcgacacatttaaatttaaaaccaaaccaaaaagccgaaaaagcgacctgttcagcaaaaagtggcatgacaatcattggcacaccggcacaaaacccttctcggacacttaaaactgagaattaattgaatgttccatttattttattggatatcggaattcctggcattaaaacattgcgaagaaagttttaatccttaattgatgtccaaataatcaagatattttatgttgaatttaattctgtttctgcgcctgcctcttcagtccgccatgtgtgataaatgccacggttttggcgtgtgccaaaatttccaactgcggtacccacggcatcattttgatgtgatcgtccaatttgggcgttgtttcaattggggggccgtcgtatgcaaaaataatgcgatattcggagagtgcgttcattgcgccaaaaagtgcgtttaaaatgcgcggcggtgccaattgccagtcggggtaagagccaaaggcgaaaagaacggtgccgcgggagaacggcacgtcgacaaactcagagaacg

SEQ ID NO: 17593 - DNA, 1159 bp, Heterodera glycines
ttgacggaaaagttcggcccaagaaaagtttgggacgccaaatttggcgatgtttggcattgtgtaactttcagctttgtgtaattttggcgaacaatgttattttattattgtgccaactcactgatccaattcattagcacgatttctgcaaaattttcatagaacgcaaacagacgatgggagaaaagggaggggcgaaagacatcgcgcgaatcggtgggcacaaacggacagaatggcacacgggagacccaattgcgaccaaaaaagagaaaaggggagaaagacatcggagatgaagcggactttacagttacagtcaacttttcatggaattcatgtgaatcatcttattgctataaataaatattagatcgtgatcactgatcagagtaaaaaatttaccatggaaaaatatcaaaaaaattagggggaggtgaaacctagaagtaccacaaatcattccaaagaaaaatgacatttgagaggcgagtgaatgccgaaaagagaggaaccattttcattaaatttgactgaccaaaaatcttcaggttcttaaatattacaataaaattaatttattttttaattccacagctcattttcccccagtttcggtgttcatcccaccgacttattgcgcgaacggattcggctgaaatgagcgtttgtgcggcagtgccataaacgatcagatgaggccttggcccgttccgcgcactgtcccaaaaacggcgtttgagagtggccataaaatagccgaatggccacatcaaatcatcgatcacaagcaaatcccaatcctcattgatcagatcgaccatctgttgaagcgaagaaagaaaaaataatttctatttttggtggctaattggtattaattattttacaaatattgaaatgaaatttaaatgcatttgctttttttccattcgtgccatttatgactccgttttggtaataagcttagtcctcagtgctcgtgcaccttctccgaatggttaagcatcagtgtggccaactgttcgtccgactggcggtaaaattcgggcaaagtgacggaagagtccgtttggttccaaaagaattccgcaaatgcgtgccgttccgcctcgtcctccacttccgcgtggggcaacggcgcgcgaatgtgccg

SEQ ID NO: 17594 - DNA, 1502 bp, Heterodera glycines
  misc_feature (20)..(20): n is a, c, g, or t
  misc_feature (1374)..(1374): n is a, c, g, or t
  misc_feature (1453)..(1453): n is a, c, g, or t
gcatagcatagctgaagccnctgtggaaatcgctgttttgcaatttggattggtgacaccctttgtagatatttttatccgtttacactaatatagccttcttggcaatttctaaatgctgtgggtatgcaaatacctagaagcatgaactcaatgttgccaactagatcggaggaagcctcgcaatcttctgaaaatagttgatttctacattttctaatatgtcattgtaacaaatagaaatactgatgcattgtagacgcattcgatgccaaaattcagcccatctacgtgtgcagaaagtcaaccttcctttctgtaccatgtttttgtttcgaaaatatttccaattttgtttatgatgaaatagacaatttacaaaagtatagaaatatattagcaccactacagtaccacaaaattctttcgtaaaacacccgatcaactgaaaggtctgatcgctagaatatgtagctttctgccatatgagagaaatatgaaataatggtatgagggatgttccaattacatgcttatgctgttactaaggctacttttagcggcagatctgtaatttgtgcaacccttattatcagtgagattaaacacaggattagagaaatgccaacctagcaaacgaagcatagcatagctgaagcccctgtggaaatcgctgttttgcaatttggattggtgacaacctttgtagatatttttatccgtttacactaatatagcctttcttggcaaattctaaatgctgtgggtattgcaatacctagaagcatgaactcaatgttgccaaactagatcggaggaagcctcgcaatcttctgaaaatagttgatttctacattttctaatatgtcattgtaacaaatagaaatactgatgcattgtagacgcattcgatgccaaaattcagcccatctacgtgtgcagaaagtcaaccttcctttctgtaccatgtttttgtttcgaaaatatttccaattttgtttatgatgaaatagacaatttacaaaagtatagaaatatattagcaccactacagtaccacaaaattctttcgtaaaacacccgatcaactgaaaggtctgatcgctagaatatgtagctttctgccatatgagagaaatatgaaataatggtatgagggatgttccaattacatgcttatgctgttactaaggctacttttagcggcagatctgtaatattaaacacaggattagagaaatgccaacctagcaaacgaagcatagcatagctgaagcccctgtggaaatcgctgttttgcaatttggattggtgacaacctttgtagatatttttatccgtttacactaatatagcctttcttggcaattctanatgctgtggatattgcatacctagaagcatgaaactcatggtgccaaactagatcggaggagcctcgcatcttctgaanatagtgattctacatttctagtattcatcgtaacatagaatactgatgc

SEQ ID NO: 17595 - DNA, 1980 bp, Heterodera glycines
tttttctcacaaaaatcttccaaaaatatgtctttaggggttatttgggccgctgatcacgaatacgtgatcagattttacttttgacatcgtcaagacctcagaatccctgtgtgattggggattctgaggcatcattttgaggggggggggggcaggttcgaatccggacggtgtaacattattttttttgtgcatttttacgttattttcaatgaatttaattaatttaaaatattttgttgagttaataaataaaaaattatatttaatttaattttttttttgataaataaattttataagtttaaattaattgtttttttaattgatagaatttcatgtatttttttaattaaatttgttaaaaatattttcattttaatttaatgaatttactaatcactgttgtatcaatttatatttaaagatttgttgtaaattaataataaaagaatttatgtaaaaaataacaattatcttttaataaagaatttcatatttttttaattgaatttataaaaattaatttcatattaatttaaatattcaattattgtacatttcaaaattctctttttaattaataaaaggaataattaatttattttttaaaatttataataaattgcattcaatttttgtacctcttctaatcactgttgtacctcttctaatcacagttgtacctcttctaatcaatcacagttatacctcttctaatcacagttgtacctcttctaatcacagttgtacctcttctaatcactgttgtacctcttctgatcacagttgtatctcttctaatcaaagttgtacctcttccatttacttttgtacctcttttaatcaccgttgtacctcttctgaccaatgttgtacctcttaaaatcacttttgtatctgttctaaaatttaaaaaacggccgcgaagcggccgaaaagaacaacaaaaattagaaacgggcgtgaagcgcccgtctgagtcgatcaaaatttaataacggccgcgaagcggccgtcaaagcccaacaaagtttaaaaacgggcgcgaagcgcccgtccaaggccaacaaatttgaaaaacgggcgcgaagcgcccgtccaaggccaacaaaaattgaaaaacgggcgcgaagcgcctaacaagctaaaaaacgggcgctaagcgcccgtataagttcaacagatttaaaaacgggcgcgaagcgcccgtccaaggccaacaaaaattgaaaaacgggcgctaagcgcctaacaagctaaaaaacgggcgctaagcgcccgtgtaagttcaacagatttaaaaaacgggcgcgaagcgcccgtcttgagcctcgatgtggactaaaagcctctaataattttttaaaaattcaaaaaaatctctccaaccaaatcgatcaatttgaatcgcttcacagtctaggtagcgaagctcccaaagcgcgaagcgctttttcccagcgaaaatgccaacggttcacgcacccgctagttactatatatgttatattgacaaggagtttcgtttcaaaaaacaaaatctcccggccgaaggccgggagcgccctgaaagtggtggaagggtcttacaactttttgaggagaatccgggaaaactatagaaaaaaattcagcgcggacgactgagtcccagggacggatttctcattttttcgtgcgtttgacggcccataactttttttctgaaactcggatcaaaaaattcccgctgtgagggcactccgcagaagtgtcctctataatccagtattttttatttttttattagagccaccccctggcctgcacgcttggctaattgaagtgtgctcaaaatgtacacttcagtaccaggcgaataactcgccaggggttgctttgaccgaaaaattgtttctgagcaaaaatgtgtagtatttgaaaggctatccaaccaagttttaaaatttcgaaaatttgaaaattttcgagcta

SEQ ID NO: 17596 - DNA, 1809 bp, Heterodera glycines
ccgcagctttcgtttgccaacgcttctgtcggtcgaattcgcgcagctgaaaaacaatgggcaaattcaatgaatcattcagtcgaccctttgatcgatcagtataatttggacccaatctttcttacccctctctctctcttatttctctatgctcctctctctctctccctctctctcacacacactttctttctcccaaattcgactgatcacccatccatcatctctcaatttcgtgatccatcattcatttgcatttttaaattcttaatttcctgccgacttgatcatccatttccaacttttctctcaattgtctgttcctttttccaccgtttgtcactttgtccacctgtctgatcacgtcgttcagcaccgcttcttcttccggctcgcatttgagcacttctcttgccgttttcatgtccgcttgtccgtctccgtccaacaaaatgtgccgaaacagtttggcacgtcgcaaaagttcggcttcgcgttgggcctcaaatttggccaattaattagcaaaaggcgcgtcattgctgaaataattttacccttctgcagacacgccaaagtcgaccgttcaatttgatcacgagccttgaaaagttaggggaagtgatcgggcgatcaatcgcatggcaaaaactatgggatgtcaagtgatgccccctcccctccacagccaaaagtgccgttctcaagtgagtcttctttgctctcggctgactcggcccattccattctcattaattacccccctaattagccccccccccccttcccacttcgattctgtccattctgcgcctttcttccgcctcgcgttccgcttcctcccgtgcgacacgttctcgctcttccctctcgcgcattctctcctcttcaagcgctctctgcgcctcgcgttcagcggacattttccgttccgccacttggcgtgccaattcctcctcccaagtgccggaggcgtccatggacagagaacgccgggcggaccgaacgccaaaatttgcctgaggagaaaagcgggcaaaaaataaaagaattcgaaaaattaaataaaaaattaaattaattgattaattaaaatcaaaagcaaataaatccaattcaattgtataatttaaaaaatcccagtaaatgtaaaaaataaatgcatcgcttttgttgattatccattcgcacttatcgacagatatcagtcaaagatatccgcgaatttttacagcaaaaaattgcggcacatttctccataaattccctttaaaatatgtcacatttttctgctggaaatcggtataatttaactaagattatatttttagattagaatgaatttcaaatttatttttgtaaattccatttcaaattagccatggaataactatgcttgcttaaacataaaaaaaacgaatgatacaaatttacagaattttggcaattaaaattaaacaaactcggtgcccaaactgaccccgagactctcgacccccctgcccctttttttacatttggtgatgccattttgttgacgttgttcttccccgtgggcgattgtgtgcacagcaaagtcgagtcggcgccgttgtgctgttggtgttgttcaacaatgtccacatggcatactgtatgtgtgatgtacaattatgttacagtaacagcgttgccatgcggcggtgtgatacggtgctaccgttctggtggtgcagctgctgagtttgctcggccgctaaattgttgccgcccgtttcctccacggaggacggacatgagacgggaggagttggaatcagcggatga

SEQ ID NO: 17597 - DNA, 1400 bp, Heterodera glycines
tcattataatatactaaatggatcatttgtgagtttcccctttcgaagttcgtaattttattataattatctccatagtcccttttttgttagttttattcgcctgttggtgcgcggcgagaatgaacgcggcggtgtcaatggcctgaggcggtggcgcaaattggggaaacattggcatggcgccggcaatgaattggcgttggcattgcgcctaataggctaattaataggccattatgaccaattctcttttgcctgatattctccaaaaaggatcggctgcactgcagcgggtgacggagtcgtgaaaaagtgcagcgccgaaggcgcttgcaggggaaaagcggacggagtgccgtaaagcattgccggagggatggacggcgggggatggacgacgaagggagacggcggatgatcaatggggggaggaggcttaaaaaggggcaaagggatcaatggggcaagctgaagaaagagggcggggatgtagaagggaatggttattcccgacactcattagttgattaattaccccctcattaactaattaattacctcaacgcccatcggctgaatgttcgtctgctcattattcagttgcatttggtgacagtgagatgactaagtatatttaaaataattaattttcaatgttttcccatttttattcatttctttttttacattcgccgccattccgtcgcttttttcgctgtaattttccccctgcctttgctcattctccgacggctctttcggcgttgcccacgcgcggcgtctccccggcgtgtgcttttggccaaatttggcaaaccatccgccggtctgttcattttccactgaatttgattaaatcaatagtgaatggcgatgaagccgggccggatcattagtcgtgctaattactgttaatccccccctttttctgccacctctttctctatcccattgctcctttttgcgctttgtcagcgacccgtctcgtgaatgcattccgttctctcccggcaatttgtgcggtgacctaatggacaccattttctgctagttttttttgtctgaaagtgaattttttaaataaaataattaattaaatgaataataaatgtaaaaataaagaataataaaaaataaagagcaaagaaagttctccaaatagtattctgatcatgtttcttttcgactgatcgatccgcgccccaactgatcggacggtggataaagcgtgcccattcgtccgaccaaagcatttggacgcattggccaacgtcggacccttttcacgtgaaatttgatcaagtcaccaagccaagggatggggagggatttatggcagtgagtgatttgtgtgctatcgctgatcagtgctctcacagcacgtaataatcggtggt

SEQ ID NO: 17598 - DNA, 2360 bp, Heterodera glycines
aatacccgaacactccgtgaaggccagcggtgagctcgtccatcaacttttgaaaaatgctcggcgcacttttgactccgaatggtaaacgtttatactgaaataaaccacggtgcgtgtttatgcccaccagctcctttgactcttcgtccaattcgacttggaagtacgcgtcgcggaaatcaatttgactaaaaactgtgcaaccctccagcgaggcaaaaatatcatcaatgcgtgggagcgggtggcggtttagttccagactgttattaagcccggttgcaaaatcaatacaaacccgcacattgccacatttcttcttaacgaccacaatcggcgccgcccatttgctgaagtccacagattttatggcaccacaagcgagcaaacggtcgagttcgtcgtcgacagctgctttggctgcatgtggaactggacgaggccggcagaaaattggctgtgcgtccggtttgagctggaggtgcgcccgcatctttgtacaaagacccaaacttgaggaaaaaacttttgaaaatttttgttttaaatttttggccaaagtgtttgggtcgtcgcaaactgtgacggcgtgtgcctgtgcgagattgagtgtcgtagcgattggtcgctgcaatgccatttcgaacgctttgatccatggcaatccgaacaaattcattggtccgtccggggcgacgtggcatttgagttgaagagtgcagccctggtacgtgactgaacacacaaaaaatcccaaaatttcgaaaaagtgaccagaatatgatttggcctttttgatgccacttatgagtttgggtttacccaatttttcccataaaccaatctgaatgaccgacagacgggaccgagagtcagccatcaatgacgcatcagtattgttaatcctgcagttgatcattatccattccgataagtcgtcgtccgtaatgttgaagaccgacattgttgtgttgtaccgttgtgaattgggccgggctgaagatgctgagcggcattcggagcggtagtgaccacggcggttgcactttgagcaagtcggcgcctgtgaacaatcacgcacccaatgcatttgaccacaaaacctgcacggtgatggcggctttggttggcgctgaaaaggggaagggctgcgatttttgttgctttgtgccttcgccgatgggcgctgcgatatgctgcgctttttgagctgctgttccttcaatttctgcggcttgagagtgatggcgtttgttccagaaacagttgccaaagattgagatgtgttgcgcaatgacaaaaacgcacggcactcttcagtaagcttctcaaaagtgatcacttccggcggtgttttcttaatggcttcctccaaaatccgcaaacagcgttccctcagttctctgtcttcatccgagaggccagtgaggaaaatgagggccttgatttcatcttttgtcaagtccattttcgaacgttcacacatggcattcacttggctagcaaaatctaatggtgactgggaaaatgatttagctaactgaaaacactcatatcgacgagtgaaaatgcttttggtttccccaaacaaaattttgagcttatcaattgtctgtgccagagtgaaatcggtcggcagttttggaagtacacgttcggcatgacgagcgtactcctcctgaccgagcttcccaagcagcagtcgcacttgcattgcgtctggaaggtccttgccatccacctgaatgaacgggccaaaacggtcgagccatgcttgaaaagttaaatccaattctggattatatgtgaattggccaagttggctattgatagtcgaataaatagtggaatgattgacggaatttggatttgtttgggcatttcggagaagggcttgaaaagcctccgtctgatttttaactaattgttgaagaatttgaccaatgtcagcggccattttgatcagttaagtgcttttcagtcggaccaatgtttgtgtgaatgaaaatgagtaaatgagagtgaatgtttatcgccagcaaatattgggagagttcgccacgcacagtcaataaaatcaataaacgacctttgttgatgtggaagttgtaatgaggtgagcacagcggtcgcagtgacttgtactttcccaaatgtgtctttccttacaacagtgcgttcagaggctttttatggcttgaacgttgccgcaagtcttctcggtttgcttggcgtccgagggttatgctttcgccgtaacgtttcaaaccgatgtgttacgggggaaggtaggtcggagaaattaaatgctaataaaatgtgcaggcaaattcccaattatagcaataagataataa

SEQ ID NO: 17599 - DNA, 969 bp, Heterodera glycines
ttttttttacagtttcacttttgtatatccaccggttaagaaattgttttttttgtttgcgcgaatggacaaaaatattacaaccaaattgggtaaaaatcaaatggacaaaaggaaatggccaaaaggaaattgaaatgggcaaaagaaatgggccaaaaggaaatgagcaaaaaggagttggcaaaaaaaccctttttcaacgaataagccccggggtaatcatttcatacgttgcttcttcttcgtcctcctccatcccgcttgcgtttgagtgctcatttggtcccactccatcgcgttcgcaaccgtcgccatcgcgttctcagcagcattcgccatcgcgtccgcaaactgcttgctcgcctcggggtgtcccatcaacctaaaagctccattttttacacttttaatttttaaaattttattcatttatttgtgaacagttccccgtataccagggacggtcccaggattttggcttgggggcgggtacctcccctcgggcgacgactttttttttgcctttcacataattttctgttatttttaaaaattcattaacattttttgagaattgctagcattgctgggtggggaggggtaccaccgctctgggcgacaaactttttttgtttgttgttgatttttacaccacttttttgcggcgcttttttggggaacaaggaggccggcggtgtggcgccacttggggaaattttttgactttctaatgtagccaaatttttcagaaatttccccttcatcgacaaaatccaatctgttaaaattctattagttttgtgaaccagaatgggtccgccttaggcgacgcctgcagaaaccacccccctcccctacgcttcgcataattgacgcctgctaatccctgcttatcggagatacgatgcacctaccctttcttaaaatttaaatttttttcgaggtctgactggcataataagttaa

SEQ ID NO: 17600 - DNA, 1662 bp, Heterodera glycines
  misc_feature (14)..(14): n is a, c, g, or t
  misc_feature (76)..(76): n is a, c, g, or t
  misc_feature (1392)..(1392): n is a, c, g, or t
  misc_feature (1469)..(1469): n is a, c, g, or t
  misc_feature (1521)..(1521): n is a, c, g, or t
gccgtaatctgacnccacaaaattttgggattttacccttttttcacgcttaacatttttttttgatctcttcatntatacaaaacaagacacttagggctatcgaatgataccaagaatgtttgatagggtaactctggagggtgaatgtgtttttttgtattgttgaaaaaataagtgaattgggccaagaccaattgaccctgttacaatttttctttcccggttgtttgctttttatttaaaaaaacaataaccttgcggaactcgtcgatacaatccactttgtcccagaggaacttgagatgtcccacctcgtggatacaggtgcgacccgtggtcaattgatccaacgcttcgccctcgttaatgctatgcaaaaatgccacctcttcgtcacatcttttcctttgtcctagttcccgtttcgttggaatttccattattcgtaaaagaagatattatgaaaataacggagctaaactgaagtgtttaattggctacaacaacctaggggaacggtgcagatacgtagaaacgggtacaggaattgacaataaaaagaataggcaagaactcacttaagaaatgcttaagacgcaaaaaagttaaaagagttagctgtcatcagattcattttcgaatgttgtatttagctcactaagagctttcgattgataccattaacgttggattcaaaaacaaaaaatccacttctctcgcgttcaaatgtcagcgctcaatcggcccccttcccattaaaaaaacgaattgataacgccaatgtgccaaatttaattgtcaatttcagaaaacgcagccaagaattcttccgctgctgttccttggtgcgcgttcggttgaactgagcatttttggagtccacaccgggggcgctcgatgacacggtgttgtgctcgtgtcccatcataatgaaaacattttacgatttgaattgttaaatttatattgaatttccgtcgaaaaataggaataactttgatagaagaaaaacaactacttggatgagaactaatccaaaggaaacataatgaaaagtgccaagagcaccaccactcgaccatgcatgtgaataaacaaaaaaaagcaaaaagttaataaatatgtgttaattttaagttcatcaaaagccaatcactagggtgcattttcacattgaaaactcgctctttaggggtgtatttttaccgaaacttcgggtaaaatagcagaagcacgaagttaaaagctcaaaaaacccgaagttttcgaagccgaagtttcgcccagccctggtcccgactcttttctagaaatgttaaaatcaaaattcaagaaatcaaattgtcagaattgtatgaccaaatttttttttgaaacttgattcttttnttgggggttttacaatgaaataatagagaaatctccgcgccatcgaaatatcattgatatttgtctatataaggcanaatcggaagtttcgtctactaagccaaactttgggtattcttttttaaattntgaggctagtaaagaaaagttatggcttcggatgagaccaaaaattgaaaaattttgtcgtttttgcaaagttatgaataattaattatcagtggcaaaaattttcccattatttttcagcctgaaaatccgatttgagct

SEQ ID NO: 17601 - DNA, 2883 bp, Heterodera glycines
cagcaaagcgcggaaaatctcgaagtggaagagcgcgtgccaaaagagtcccgtcgcgagcagaattatgacacggaacaggtcaaaatgcacgaaaactttggcgaagaggacgagtcaagtgagtggcccttcctgatcgactcggttatgaatgagtccaattaaggacagcccgattacggttcgaatggaattgatccggaaggaacccacaaattacgggcattgaagttcttgaaatttgaattatcaataaatcagcaaaatttagttttttggttattttgttaagtaattttccaaaaaatgtcgaaatagtgaaaaatagtgacaaaacgccaaaaaagtgaattttcactattttagtgacgaagcgccaaaatagtgctttctagtgaccaataatgacggggccaggacgttttcgcgtggccgttttcgcgtgagggacgttttcgcgtggcccgttttcgcgtggggtacgttttagcgtgagtgcctattaggactgaaattggtcggatgtgtgtcgaacatacatttcgacctatttcgaatcccaaacccgatttcaaacaattttttgcttttatttactcaaaagcgtcctcatttttatgcttgcaaagattaacaacttcaagtattaacaacatgaatgagacacagaatccgaccatcggcatcacgacatttctttaatttttttcttttttccggggcggaggactcttcttttcacatacatatcctatagattaacccattggaaagtcttaactgttttgttcaattttttgccgtacaaaagtaatgccccaaacattttacgcacaaataactcaattttatatagaaaaaattctgtaataggggttggaaatttttttttaaattatgataaataagcctgccagaaagagagaaaacaattttataccaaattgcatttgggatggtgagtttacactaataccagcagagcattagaccgtgaaaaaattatttgactgtataataatttgtcagtcttaatttagtttataaaattcacttaaatatatattgaattaagcaccagaagtaaaacgggagtgaaaaaattttccaaactataaaaaagtaaaaaattcgcttatgtgcaaccacgcgaaactgccacgcgaaaacggccctcacgcgaaaacggccacgcgaaaacggccacgcgaaaatggccctcacgcgaaaatggccctcacgcgaaaatggccacgcgaaaacggccacgcgaaaacggccacgcgaaaatggccctcacgcgaaaatggccacgcgaaaacggccctcacgcgaaaacggccacgcgaaaacggccacgcgaaaatggccacgcgaaaacggctacgcgaaaatggccacgcgaaaacggccacgcgaaaacggccacgcgaaaacggccacgcgaaaacggccacgcgaaaatggccacgcgaaaatggccacgcgaaaacggccacgcgaaaacgtcctggcccgctaaaatcataaatttttatacaaaaagcaacaaaactatgccaaatcaatattgagataaataatttttaaaatcaaagatttgccaaaaaaacaaataaaaaagattttggagataaattttgagaaatttttcgtttcttagggttgcattttgaaaaatttcgggtcaattcttaggggtgtattttttgaaattttttatgtcgatttattttcgtttgtatgctgatgaaggttcgtttgagctttataatattttcaaatttttcatttgaaaaacccaaaatcctttcttttcaccattggtatccttatcgttggtaatttcagtgcggtttctgttttggcatcatttaattttaaaacattgcaccaaaattgaaaattttgtttttttagttattggcacttccttcggtgagcatgaaaatgttatttttaacaatttttgattgaattattatttttcatttctatcaatcccaaaagtcattgacaaatatggcatcgcccgtcaaaaagaagaaaaaacattcccccgccgaccatcgccccatttcttctgcagaaattggtgaacataaacagcaatcgatgggttcactggtgacatcatttggcaaacgacgaagtgttcgcgtggcaaagaaaatgaataaacgaattttgaggaaactttgagaatttatcgaattaaaaattttaaatcgctcaattattccacaatttcagaattaacaattcgcatgggcgccggactaaaaaccaaaactatctgtgcggattaatggcaatctgtgccatttccattgcccgatcgtccgtttccaaacaaaattcgctttaattaccttcggattgagtaattgaaaaattaattagaagcagttcatttaaatatgtagcactctgtgctcgcatttctccgctcaaataaacaaatttttgacaaaagaggcatcagtttttatttgtcggatgattcacacaaaaacaattttttgctggtttggatgttattggccgacaaatcttgcccatttttgcgccaaacattcgccgcttggacttttatgatggtggtctcgaccatttacttatcaattggccgtcaattctccaagcaaaacatcaattcaatcgaatctggtgatgattcgatcgttgtgtttggtgattttgaggcatcgcatcgaagaatttatcgaaaataattggtgcttataattggtttaatgcaacttctgctgctgattatgttttgaccaaagggttgcacactccgacaaaaaatggtcaaacgaagcaattgcattgcagagggagttcaagggcgtagccagaccctggctttggggg

SEQ ID NO: 17602 - DNA, 1232 bp, Heterodera glycines
cattggccatttccctctgttgtctacctgctaaaccttttctctgatggcacacaatgggttgtgaaatcctgatgctgttattcgagagtctcgactctagtcaaactttcagtctccaacagcatggaccaattggacgcccatgactcagcgagcgccaattaattatagctaattagcctaattcgctaaaattcaaatcggtcaaatgcccaaaatgtgcctgccctccattgattaaacaaattagtgaaaaagcaaatttttgtattaaattgagatggtagccattaatttgattgaccagaaataacttatgccattctaaagttggcgacgccaatatgcccctttcaacgcaattttgaatttagtgttgtcgaaaaggaatcaccggttggcggagtgtccggctccgcaacagttgcctcatttacgccactgccacccgcaccgcccgacgcgtcgcacgcgcgtcgccgcctgctgcgccaacaagcgcactcggcaagcgcggacaatttgctgatccggaccagcgatttgggcaccgccagggacgtgccgcgatcactgccgcttgctgcgccggaaccgcgcggcgtcggcggcggccatctgctcgacgaacaaagccttccggcaccgtcgcctggaaagacattaagttttgaagaacccgcacaggacactgatcttggtaaatagctaatcagcgaagcaaatcttgacaaggataaatacctaaaaagccaaatctttgtaaaaaaaataaagagccttggttttggcatcattaaaaataagaaaggacaattttccaaaattggatcatttttgaggaatttttattaaatcaaatattatttgttccgtgtttttactaaaatcttaaaaggcaaaatcaattattgacttttcttgaaattttttgaattttttttttgaaaaacttagtaactcaccataattttttttaaaaattaaaatttaacaaattaatcattttagctgatcagccgctaaaacgacagcaaatgccgcgccgtgacgtctcgccgcataggttgccgacaaaggagagcaccaaatccggcaccttcatcagccttggcgacaccggtgatcagcaacaacaacaatcgtcgcaacgtgatcggatgatggcacccgtgtcggacccacgcatacggcacatttggtcggaagccgttgagctgggcgaaatt

SEQ ID NO: 17603 - DNA, 1973 bp, Heterodera glycines
  misc_feature (1961)..(1962): n is a, c, g, or t
  misc_feature (1969)..(1969): n is a, c, g, or t
aaaaaaaaaaaaaattttttttcctggcttaataaaatatatgagaaacttttcttttcttgcagatttcgttctttgcgtgcacaattgggaattgacgtatgatttttacaaacaaatttatttaattattatttatttttaaatgaacaaacaaaaaaatgaaaattttaacaagctttgaattacccatattttagcaacttaaacttgcgaacactagttataataaaaagttatttttaaaatcctaaagaatctacctaaaattcaaaaatgatcacatttgatctacataaaatatctttaatagattttcctcctattttttcaaattttatccgggtctatattttatcaaatttttcagtttttagcatttatgctttttttatttttttattttaaaaaattaaaaaaaatgattaaaagaaaaaaaatttaaaaatttttttctttaaaaaaaagaaaagaaaaagctcttaggtacatgtttatgcatttttaagcaccataaatcctagccctggacttttatatacaaatataataagctgatttatctgaacatatctcgccactttttcttatcatttaatcaatttgatgatttttttgatcagtcattgaatgtgaaagtcaataattctaaaaaatgtcttttatcataatttttttttacagaaaatttcatccgaaacgttgtcccaataccatgtcaaaggtcacatggaccattttgatcagcccgccatttgctacccgcgctatcgtggcccatccacgcgcaatcggttgcccacagggctgaaactgatcagacgggtgggcgaaaagctgatcaaggagaactacccgagcacggaagagtgagcataaattagggcaattatatctgccatattagtttttaataacaaattgagagtaacaacgtaacaacattttaaatgatttttttgaatcttttcgttggatcattcgttatcccatcttttccaacttggcattctgcttttatatctattattggactaattaatagatctaattttcctaacttttatattgttttgagcaaatgatttgagtacgtttcgctcggagctccattttccacttttctgctaattaatagggatgcgatttttaggttttggctacttcgtcactaaaatagttaaaaatcactattttggcgtatcgtcactattttttcactatttcgacattttttggaaaattccttaacaaaaatgcaataaaaccaaaaaatacacccctaagaatcgacctaaaaaaatttcaaaaaaatacacccctaagaatcgagctaaaatttttcaaaatatactcctatgaaatgaaaaaaaattttctcaaaaatttactttcttggcaaaaatttttaattttaaaaatttttttaggtaactattttgggttttttggtcttaaaaatcccagtcctactcatttgcaactgcaatcagtgaataaaaattatttttgctcaatttttggctgaaaatttgtcactattcgtcactatttcggactttttgtcactatttcttcactattttggcatttttactcactattttagttaacctcgattcaattccttttggcataaattacacagattttgtctaaagaattaccaaatttattgatttatgctaattttttaagaaaaaataggttttttgggggccggtggtgccgataggcgccgccgggggaaattttttaatgaattttgttagaaattagtcaaatttttcataaatttcattcttttggatgaaaatacgccctaaaatcagggacatttcttagaaataagcacataaagaaaccctggattaatcagataaaaataaattcaaatgaaaacgtcaaccggtggcgactccaaaaagaaatactggtgggggtgaagcactaaccactannacacaantata

SEQ ID NO: 17604 - DNA, 1764 bp, Heterodera glycines
cgagacagttaggtgtgtgctagtgccaaattagcgcatcttcaaaatttaaacaatatgcaaaaaaaccttaactaaaaaaaccaatcggaacattcggtacactctcctgttctgtggtgcacacaaacattttccatttcgaagtttaaaaaaaaagacgattacatcttaaactcttgcatttatttcactaaaattttttgcttgtatttactactagtagttatgtacgtggcaggaaactaatgagattttgctcgaatatgagccgggtcgtttttcgagtcaaaaaatttccacatcattctcaattccgaacacaccccattttgattggtcatgattattagcaacaataattgtgcagcgaaattcttcttgccgctttttcattattttatcccccataacacacaggcggatgacaccgtggtgattgacattggcactggcaaagtgacggactacgtgaagtttgatgctggcaacatttgcatgatcactggtggacacaacattggccgtgtgggcattgtcggacatcgcgagcgtcacccgggctcctttgacattgtgcacatcaaagacgccgctggccactcattcgctacacggttcgttcgttcattgttttttgggtttagttggttgtaaaacacttcatgaccaccacttttgggtcccaagcgtttacccgacattaattgttaactgtcatttcatttattttttttgtgaattttactcagtttccgcaaattttggtcgcgtataacggaaataggcatcaatttgtgtagcaaattatgtgaggcatagaaaattgggtggaaatttcttcattttcgaaaatatttaattgtttggattatattccaatccctttaaattcggaaaatcttgtcttaccagcaatcaggccccctatttccaaaataatttttttcttttctgtccaggatgaccaacgttttcatcattggcaagggtgcaactccgttgatcagtttgcccgcttccaagggcatccgtttgtccattgcggaggagcgtgaccgccgtcttgcgcagaagcagaaagtttgagcctgatcccgaagaacccatttttttgtcgtggatgttattgttttgtttgttggcataaagaaaaagagtgttgctattttcacagagcccccaattaagggaggaaggcccgaaaatgatgaacattttttttgttacttttctgcacaaattagtgtggggggagggggggggggaatgcataatgcataacgcgtaaataatttgctaacattttctatacgaccaatttgccaccgaccaattgccgcacaattttattatttgaattattaattttcgcttttagttttacaacaatttaattttttattaattttttttagagcgcgaaaatatatgagattaaatgaatgcgctttttacgtttcttgaacattttgaacgaaaaagatagcgcaatgtttgctcatgtagaccaaattgcgcaacaaagtgtgttcacaagaaaatttattgcatggtacattcgacaaaaaaggaaaaaaccaatttaaattcaatttttggtattctttgtcaatgaattttaaaaattattatttttaaaaaaatatttttaaaaaaaaaagttttataaaaatataaaaagcccctgattttaaaaaagaacccatgggaggattaccgaaaattgaaaacaaaactaaatttttaaaggaacccaagcgc

SEQ ID NO: 17605 - DNA, 3428 bp, Heterodera glycines
tgcgccggcttgtgaccattgacggacacctgctcaaggcggtgacaatgttgtgccaataaatttctgcggttcaaatggataaaaaagtgccaaataattaaaaatgattctttataatcaattcagatattcgagaacccgacagcaattttgtcgagaacgattcctggacgagaatggaaagctaaagcgagtgaatgaattgatcccattctcagttggaaaatggtaacttttggtggattgtaatatatttaataaatttatagttttttaaactattttaaacttttcttatttagaaattaaaaaccactttagaaacaaattacacgaccctaaacctcgcttattgttttttataaaagtcaataggccgtaccatgattaaattgttttacatgatgaaagttagtaaaagtggccaatttagttttccctaattacgcatccaactggcacatcgttttcttgatcaaatacatttttttcggctttttaaacaattttttaaataataattaaaactgattaatttttattggcttcccccgtcaccactgtttcgccgtcatttttgcgcttgtgtcgcatttgccgactgacggccatttgtcatgccgcagtctcagccgtccgtagttgtcactgattacctcatcaaatggcacggaaatgtttttataaattggggcaaatttgtgccaattgttaatggtggaaaattgaccaaatatgtacatacgtaagtacaaaagggggattaaaagtttgatgccaattcggcgttatatgaacttaaccggggcaattactcattagtgatccatttattccttttcattttagttagtttttcttttctaatttaaaaaatgatcattatattatttttcaaatgggataaattattaattaagttttattttgcttaaccactttccatgaaattattcaatgtgaaaaactgaataacattgtttttatgaaaatttaaattttccaacaatcttaaactatgaacgcataattatttgggaccatttgaacccacgcgatggaaagtgccaaaatatactactcctaagttataaaaaaccaaatcataaaaaattggaaattaaataattctacaattttctctttttagcttagaatgactagcttcattcctcccgaacttttattcgaaatttttcaatttacgacgtccgttaacaacaaaaatttggttcgcttacgatccatttattacagaatgatcggcacagttgactacaaaaaaatggcaatgttatgcagttttttccaaggaattgtcaactcgtattttgcaaagcggaaatggattgtcgattttattgaaattcgttgcaatgaaaaagagggcaaaaaggagtttgaacttgcggaaaccagaagcaataaaacgattgaattgccgaaacatctgccagacaaaattcgtggttttgtatgcatctcgataacgtaaagaatataaaattgtattgattttaacattttgtaacatattacaggtttcttgaccaaaaagccattgaatttctgcgccattttcaccgacttttcggcacgtgccaaataaagttgagtattggaacaagcagcattttggcaattggattcttttattgtttcttatggccaagaatcaaaaaccaaatatcattcattgaatttcgggatgaccaagcgttcagccgaatgcgagacattgcaccgtccatattcagtgaattgccttctctccgtatttttgagtcattggaagatccattccccgcgtttcctgccatcgacagtaccaatgcggtaaatggacagctattggcacattggctgatcaaggcgcttccgaatgaaatccctaaaattgttcgttgttcaattgaggaacccgacacggcgggtgatttgccagcaaaaattggcgcaattaaatcggtatataaaaaattgaaattatttatgtttgtaactaactgttaatccctttaggcattttcaaaatcttctttttctgccaatttcataatccaaatgacgatacctgatgaaacaatcattgcaccattcgatgtgttcaacaaaaaaactggaagacgtctgttgctggatgattcccacgatcaaaatctgctgctaatttcatgcccaattaaacgggacaaaaaagcatggacgaaatggagggaagaggctcttcaaggaagtgagatttacacgtggaatttaattgatctcaccgcgggggacgctgacattggcgaatggtgaaaaatcattttgtcaatgcataaatttttatttttaggaattcggcacaattccccgatttaatggcgaatatgcaaaagtgaaaggatggataaaaataattggagatttttatgatctattttttacatttcatttatcatttgatttttaaaaaatatattctgaaattgaattccttttctgaagtttaggcaattacatttctctaggacttttttcatgaaaatcatataaaatggtcacgaaaatttaaatatttcctatttaatacaaaattatgtcgataattcaaattcccggtttattaacatcttaattaaataaattcaaaactaacaaaatgaatattaattcttattcagtaagaacatttgccattgatctgtcgtccgtaatcatctataattagaacaaattccaatgatgttcggcttgccaaatgggctcgattctctttcccatttggcccatttttgctcatcacgcgcaattggacaacggaccagcaaaaaatgtttgatatgtttgatgccattctttttcaatgtaaaacgttcccccgtctttctattgatcatttcaaatggcacaatataactaacatctctccatggaggaaacctaatagcaatgatgaaattcacgggagaagaagcattggcaaaagcctaaacggaaaaaaggttaaattagcaattaactattaggtggaacgcggacagaaaaattaagtgttttcttaataaattcgggataattaaattttatagctttctgagccaatttttagtcgatgacaattaatttatacgcaaaaattgatatgttccgttccaccctattttctgttactatcaccgatttaatgcttataattttcggcctccattggtgttctcgaatttgactgcacacaatcaactttggaattccatcagaacgtggcgtcaaaagccaactgaccagagcttgttcaatcgaagttttggcactttcatcggttgaaaaacggggaaagtgccgataagaatagaacaaacgaagagtttggcactcgttgagaatggaagtgacaaattgtcgtatctgatgagactgtttgttttcaatgtggaaataga

SEQ ID NO: 17606 - DNA, 2574 bp, Heterodera glycines
  misc_feature (58)..(58): n is a, c, g, or t
  misc_feature (162)..(162): n is a, c, g, or t
tgtgtatataattattttggcaataaaaaaaagagataaaatggtgacaaataattgncattgttatgcaattttttaattatttatgaaaagcaattcgatagttcaacattatggacctaggattccatgttggtcctgattttttagacaaaaaacccnaggtccagggtaagtctgggttaccgaaaaaccgaaattctgatttgtaaaaacggtttttcaatgaacatcgtttagagcaattcccgaatttgttcgggttccaatcccgaatgccatgcctggacctgagttttcctgacaaaaatcaaggaaaatgcattttattatgatttactagttttttcaaaaaaattttaaaaaaatcgctgaaaatttttgaaatttttttttacttttttaataaaaattttgtaagtttttttataaagataatataagatcaaataattttttaaatgtttagcaaaaatttatttattataaataaatttcaaaaaacaaaaaacaattcatttctcatttttatcatttaaattgttgtccatttcgctttcctcctcctccttcttcacctcctccattcggcgccgatttcgctcctaaaatattgggggatggcatttttttttgaattatttttttgtggcattttttcttcccccgtcacctctctgctgtatttgcgcgttttgacattgcccaccagtgcgggcgtaaggccaactcgacgagcgtgacgaatagctaattttgaggaaaaaaaacaaattaagacaattgtaagcaaaatcagtggcataaatttttgaaagattttcaaaaaaaaaatgtaaaagattcccccccccccctcaaaaaatgataatggtttttaaaaacccaaaaattatattttcctgcggaaattttcgctgtttttaatgcttgtcagagataaatttatataggtacataaattaaaatacaattttttcggagcaatgccaaagtccggaaatttatcaagacttggcccagaagtgactcgagatttattaaatattttgctggcactttttcccgcatatttttccattttaatttaatttaattatttctaattttttacccatttgctgttgttgttgttttttttgttgcccattttcactgacggaaatcgcattagcaccagtaacaacgtaagaagcagcttcgcccgatggattttgtttctgtttttcgttgagcaacatgtccgaaaagtgttccaatttcttaaaaatggaaaaaataattaaatttacatttaaataaattaaataattaatgtgcctccagcatttgggcgcgcagcttccgcttttccatgtacagctcttgcgaaaagggcaactgctcagggtcaatttggtccgaatttgggcggtactcaaaactctgtgaaaaaatgggagaattttgtatcaaaatttgagtgaaaaaattccaccggcggttacggtaatcgtaatttaaaccactcccccgccaactacaaaaattaaaaatcgtaaaatcctaaaaatttatggggaaaaaatgagcaggactcaaaaacttaataaatctttaattgaaaatgataataagacttgtttttgtacagtaaacaggcaaatatatacagtatacgtataccgatcaaccgtaacccgtaattgcgggacgaaaacaactaccgtaagctcacggccccaatggtgggcggccatcgcccaactcatgcggcccgtgtacacctcgcgcaaaatgttggccaccaaccagcacgggatgttgcggctgacatcgctgaaacaggcagccaaatttaaattcaaaaatggttaaaaaatgccgaaatatttaaaattaattattttccaaccgtaaataattaaatttaattattattattatttaaaataataataattatgtctatggcaataaccaaatgtgctggtcaagcggcagtcgatagcacgggagctgttccgccagcgccgctttgctgcaacaaaattggatggaaatggttcattaatacggtatcacgaatatacagtaacccacacgatgcgattagttacagtaggtctcctaatacaatgaaccacagagtttactgtgttcagacaggcccgtatttagaaaaaaaaaattcggggagggcacctggagttttttttttgttgcacttcgagccaaaccaatttttttcttcggtattatttttctaaattttgggcgccgaggcgaaaaacaggaatttctcgctgtattgtgcccaaaaaatgaccattttttgccattttggggcttaattaaatttatcaaaattttgttttttttgtacgtcggcaacagccatttctgctcccagtcatcaaatgggagcagtacaaaggcacggaattggccaagattttcaggcaaatagtcaattgcgcgttggctgacatagacaatttggtctgaaagttgggatgaaaaaaaaattaatgtgtgcgttaatcaatttggaaaagtttttatttccatttttaaaaattataataccaaaaa

SEQ ID NO: 17607 - DNA, 963 bp, Heterodera glycines
aatagagcatgtgaggagctttcgaatgataccaagattgttagatttggtcagcaaagaaaaaagttataataaaaaaactgaggctggcgccaaaacgtcggcgccaaaacgacccagtcccatttgctgcctatgttcaaaatcggattcaaattaaaaaattttcaagcccagattaaaaataagaaaacaattaggagcattaattatgttgtttgaataattggatgcttttttaaaaagtttctaattaaagtttgaacccaatttttgacataggcgtaaatgtggggtaaccatttatgtaatgggttttgatgtgtgtaaattttccttttggatttaatttgaatttcgctggtctattggacatgccaaaatgtcccatttggcggtgccgagtcgtaaaagcatcacaaaggttgggttgtgtgtgctgtgcagcagcaggcggaccgaccgccgacacaccgaacggagtcaatttgcaaatttgcgttaattgggcagggggggggtgaaggagagggagtgatcgattggactccctttggcaattttatgattattctctaaatagcaatgggttacggtagcatcggaaaacggtgtccaatccgatgggacccaacaaaaaatgtactttttgatacgactttctaaaagtgtgctatttattaccgtatttggctgttgtattactcatttgccatattttttttcttattaatttgcacctttcttcagttgcggctccttctcctcctcatcctcttcctcctcttccctttcccctttctcttcctctttttccccttcctcttccttttccttttcctcttccctttcccctttcttttcctccttttcctcttttccatttttctcctctttctctttctcttccttttctctctttgaatttgtcttcttcctccgttccttctcccatattttgtg

SEQ ID NO: 17608 - DNA, 1506 bp, Heterodera glycines
ctaaaatattcataaaattctttaaattttgaagtgaattttggccagttgaatttttggcaatttttgtgttaatttttgccataaaaagtcatttcaaatccgtttaaaaggcactttttgtgaatgttcgggagaaacaatcgctttggaatgttgacaaaaagcaaaacgcaaattttgcatttccccaaaaaatcgcatgaccaaattttgcgtgcaaaaaaattctgattttaggccacatttttgttgcgtcgtcgcccaaactgactgaacgtgtttaacccaaaactgggcggactttaaacacttcgcggccgacttttggttgttgccataattaatgggcgggagagaaaaaagggggaaaggcgggggggggaggggatgcacaaattacgcaggggggtcaatagtcgagaagattttgggtgacgggagtgaagatcatcggaggagggggggaggcaattgtaccaaatccaaatattttggtagtaattacgaaatttgcaaaaattaattggggaggcaattgataatacacacgcaaaagtaatgatggttattaacactaattgaaaactgaaaagaaaagaaaaagaaaagaaaagatttttacgaaaataaaatgaaaataaaaagagacaaattaagaagaaaaaaagaaaatattaaggaataaacactaattaagagctgattgattgtatctgaaacaaaataaagcaatcaaaacaaattcccaataaaatccaaataaattatccaaataaatccaaataaattatccaaataaatccaaataaattatccaaataaatccaaataaatgtcctttggcgaatgtttcccctcaatttgtgccttcctcctacagtattcgttacgctttttcctcggaggaatttaacacggcaaaatttgacgggagagggcaaataaaaaaggggagggcgggcatttttgacacatttgggggggggggggcacaacagacacaaaacaatggacgaaatgagggggaaggcggagtttggaggaggaagagagacattggaattgagggaacaatcggcggagaatggaatttggggataagggagaagagcagaaagaagagggataaaaagggggtaaaagagtaaaagagagagggaaagagaggagaaaagacaaattaaagaagagagagagagggggggggggggggataaaagagtaaaagagagagggaaatgagaaaaaaggataaatcgtagtggaaatgatggcaatttaatgccaaactaatcaatgatctatcgacacttattctgaccgatttaattgtttgctcatttaataattttatttaaatatggcaaaacaaaaattgagcaaaaataatgtccaaaatgtgcggtcaaaaattgactcgttgaaagggttcacccaaataaacaacactcgcagaaagagcacaaaaatcggcaaaacacccaaacatcgtccattataaag

SEQ ID NO: 17609 - DNA, 3202 bp, Heterodera glycines
ccaccgtgcagagaaaagcctagtactatctcgtcgtttccctttttctttataatttctctcactttggcgtactatctcttcattttaattatgtaaaaaacaacatttacttgtctccatataactttttttctatgcatacaattaacaccaaatttagcaatagatagagaaaaatattttgaacatttttaacgctcaaattttaattttttacgctcggtgcttaagttatagtgtgatgaaaattttgcatttctttttctctcgttttggcgtactatttacatgtctctaacacataaaaaacatgaaactcaaattctaacaattttggtttataggctacaagatcaccttggacatatagaataaatagagtgccacgggaccgggaatttttgccaaaaccgggaccgggacttgccgggacctgagaagccgggaccgggacctcgattttttttcgggaccgggacccaagaaaaaccgggaaccgggaccaaccgggaaattttaaaaattcaaaaaaattttaaaaatttaaaaaaaattcaaattttaatttatatcaagtgaaaataatacaaaattatttggttttttatttaataaattaaattaatgaaaattttcaaacaaattttcttcaattatttcaaacaattaatcatttttggactaaatcatcgaatattaatagaaattcagatttgattttcacatcacttttttcggagcgctttttcaaaaaacttttgggaaagaaggggtccggcggtgccgataggcgccgccgggggaaattttaaaaatttgggtgcaatttgttaacagattttcaacaaaaaaggttggtttttgggattaataggctcaacaatttactatggattttcatttaaaaaatgataaaatatgtatcaatttaaaaaaaactatgaggaatcatattttctttataggaaacccacgagtatacataaagaaaattcaaaataatctaatttctgtagagggattgaacaaggggaaagaagaagggaaagtcaaggagactagccattaggccatttgcacacttggcagtgttacttttaaagaatatattaatttttattttttatttttccctttgactcaaatcttcttcactaatttttcactcagacccccattcttaccagtgcttgtttttcccggttcccggttgccttaccgggaccgggacctgagcttttcaaaatccgggaccgggacctcggacgatcgggaattcccggcccggtcccgtggcactctggtttccaccaccgttcgttccttgcttaaaaactatttttgtaaattaaaagaaatcaaatttgtgtcccatatcaaacaaaaacaattttctaatttaaattaaaaacaaataaattttttaccagtttaaaaaaacaaatttaaattcttctcaagtaaaaactaatatatttaaaaacattttaaataaacataataatattcttatatttagattacctaaaaattctcatttttaatcacatttcgttagcacaattacaaatttaaaaatgtttcaatgctgtttagagtaaatatttttctcactctcaaagatttataattatttttcggaatttcttcgccaaaattcaaattttgccctaaaagtgaaaaaaagtcataaaaaggtcaaaaatgcaaaaaaaaaaaaagaggaaaaaacttggacattttgccaaggttttgatgccataaaggctaattttgtaataaaaaaaattcaaattttttcaaaaaatcgccaaaatatgtgtcaaaaacagtcaaacccccaaaatatgtttatatgaacaaaaaatccaaaatatgttttttagttcctaaaaactcgctctgattgcaaataaaactggtaaaaatgcctttcatgcgttagcatattctcaaataaatatgttaaaacataaaaatccaagcctgtatcctgtatatctatattaaaataacagtaagtgatatctatgaattttaaggcatgttcaaatatttaatgtcatcatttaattttttaccatttgtcaaatttatgaagctaaacaaacaccgccaaaaagcgcaatttaattatttaagaaataagggttgtaatttcataaaattaacagctgctgcattttcatttcttattcaaattaataattaaattttaaggtgaacgaacatgactttttcaaccaatttcatcattgtccttggcaccctcgtccacttaagaaaaaagatattcggcaattatttaaaaaatgaactattctggagtcggagccctcactgttccattccaaagttgacaagcgtcttgttgtatatggacgttgatgagcttgatatggcgtcaaagttggtaaaatcgcagaaaatttgcaattcatttcaggaaggttgccgtccggaccaacaaaaatactccaaataatccgaaatcacgtcgtcattaagccaattgtcaggctgttcattttttatttgaaaataatttataaggaattttcttgtacctttaagcatatgcgggtgtcgttgagtattccgttgcgtacccaccatttatctttgtagcatttacaatgaagttcttcattttgcaaaaaaagaaggcttcgctagcattagggatgtgcgagaagtgatttttgccgggaaccgagaccgagaattgaccccgggaaacgatacgagaaccgagacccaaaaaacccgagaaatttctcgactcggcaatcgagaacttttacgagatacgtcgggtttttcctttgcaccagttcgttgaatgataagcagccctaaaaattctaaccagaaaatcataattgttttcaaattcgtttttagacacctttttgtattttaaagtgttgatgttacatggaaatttaatgggctttattacactcaatggcacattaactattgtggttttttttttgaaacgtaggataaataatgatttatccttattttattgttttttgcaacgattgtttttcgcgttaatttaaaatatttttgatccttcattttaattttcctttttattgttgtcttagtgttctctcaagttttttatatattttgtgcttttctaaaagagtaataaaactacaaaatttggtgcttttccccgtgg

SEQ ID NO: 17610 - DNA, 2986 bp, Heterodera glycines
gaagaagatcgtctacttaaagctgttgcaaagtatgctcactttggctttcatttggcaactcatttcactgcgccaattctgcgggacttttgccgacccaaaagtcaattcatttaaatttcacaaataatcaaaatgccgtgattttcaggccttcctccatgacatctctgttggccattgcaaacgctttacactcatcggaaaggactcaaaaagcggcgaattcgacgccgtgttcgaccaggacaaatggcacaatcagctgttgatgagcagcaccaatggacgaccaaccgaagaacagcaacaccaattcatggacgaattggccgcgaaattgcctcccgctggacgactttgtattccgatatcggtcagtcagaaaaacgaataaattgatcaaattaacttttgtttgtttttgtttttttcagatttcgcctgctgactggttttttgacgtgattggcatgcacaaaaaccccctcaaaaaactcactttcttctatttttccgaccaactgttcgtcgcattgtgctcgttttacgtctgttacgccgaattaatagattttctgctattctctggggaagaatatgaagtgagcgagcgtaacacgtggccacaacaaattcaacccgacaaaatcgcgtcaaaaattgcttttcagtcgaaatccgatggatttgtttgtggatcaaattgaaattcatttgctggttttgtcgtgtgagtttctttgttcgcgaagtgttcaaaaagcatttaccattgcgtcgcttaatctgtttttgcttgttagatcactgtcaattgggttgccttcgcttctatcttctgctggtgttgctgtgctgagtactccttcagattgctgctccattggacggacttttggacttgcgtcaacttccaagcggatcacacaaatgtgccgttgatcaatttcgtgagtttttttgccatttggttctccctttgccaattttaaacttttttaaggtgttcagcatcagcatggtgtgtttgtacgtcttcgagatttttcttcaagatgcggaatgatgtcgccacggaatgtgccatcgagtgaacataagcagagacgaatggaacgatgctgatgccaacaaaacataaccaatgcgatgaaacaataatgtgatggatgatatatgatatatcagattacctatatgttcataaactgttgtattccattatataagtagatgtatatgttatgcatggttgtataaactcactcagtattttgctgaccaattagttttggagggaatcgccacattttgggtttcacacttttcatatggcttttaattgtgatatttcagttttttattcacaataaagacataataaaacccaagaattgatggtactagtgcagttggtacgaatgcgaaattcgacttttgctcgaacccgggttaagggttcgaaattaatgtcagattcggcttcatcgacccttaaaagcccataccggtggaccccttcacaaaattggccactgacacacccactttttatgtatgaaaatattagcaaagccctaatttatttatttgtgaatgaacgaaaatcaaatacaacaacatttaaataacaatgcccaacatttagatcaaataatctcataagccaatcatcaaattcattttttaatgtttctgatcagtgatcacacctggccccgggcaaatcgccgagaagactgaaagaaaaacaattttaaaatgagaaaattagcagattttttacattatctattttcacttattgtcgattgcgtcgtctccgatgaaaatgccaattttgttgttcttttgtcctccgaccaattcattcatttccttcatccattttcccttaccacctgctgcaattgaacaacggataagcttaaaaacgttgacatattcttgtgacagtgtcaatttctcttgggtaaattcgttggtcagttcgaatggcacaacggaagaaagagaagaggacgacagaaagccaacaaaaatgacaaaggaaacaggagaagaagcattggaaaatgcctaaaaagtgaagaaaacaatttaaaaacgaacgaattaaatttgacaaatcaccgctttgatttgtccctttaatgtcgaccattggttcacagctaaattctcaatgctaagcatcttcggcaaattgtcgggattaggcgagaacagccatttggccaccgcttggccatccgacgcattggcactgtcgtcgggcggaaattcgggcaaaatgccgtcatcaaaagcaacaacacgaagggacggacaaaagttgagcattgacggggcaaattggcggttttgacgaaaagtgatggggttgaaaatcatcacatgaattatgtccttgaacattggccaaatggtgaacacaaagaactcagaaattcgaatattttcagtggtaatgtgaatttttgtttcacatttggtgaaaaaacggcgaaggaaagtgagcacattgtggtcgaagaagctgaaaatcaaaaaaattgccagaaaacatttacaaattcaattcatttttcacttgatcaaaatgcttctgaatccgatgaatttgttcggcaacggattttgtgggattggcaatgcttttccattggcattgataatttccatttcctttgcgccattgtctccgattttgcttcgaatttacaatttgtccaatttccatttgcgggttttgaaatgttcatcaacgaaatagtcaaatcggtgactgatcagcgcaatttcgaggcaaagctgaaagggcgacagaaaatcgaacactttgagccaacaatcgacagagatgaagctgaaaacgaaaaagcaaaatgatttcatggaaattgaaatttagattaattatttacatcgctttttccatttctttctttgcttctttcggattgtgcgagattttttt

SEQ ID NO: 17611 - DNA, 2412 bp, Heterodera glycines
tctttcttatttgtcgcgtgggttcaattcgccataagaatatgagatttttcacattttctttaaattattttaattgaaatttaattagtaagaaaatttatctaactttagaaattatttttcttttttttaaaaacaaccgtaaacccactaattaaccaattatagttctttttttgtacaaatctgttacaaatttcaataaaaatttcaatttttttcccggcggcgcctatcggcaccgcctgaccccctccctgtgccagaaaagattttgtaaaaggcgcgccgcaaaaaaaaatttaataaaaaacatcttctaaataagttgaaaacatagaaaaattctctaagaatattttggaattttaaaaataatagacaattttaatgaaaattattacatgcaaaaaaattttctaggaattgttttgattattttaattaattaaaaataatattttctaatatcaaaaaatttttgtttattttttaaaacagacatagacccaataattaaccaatgattgggcattttttggaaaaggtgcgccataaaaaagcgattttttaaaagcaaaaaaaaaaagaaaagtttttcaatttgtgaaaattctttattttttcgtcataatctttggaattttaaaattattagacaattttaacgaaaattattgaattataaaaaaattttctacaaattttagaactcaaaaaataaccaatttttccggcaccattgaaaatattggtaccggtttattttttaaacaaatcaatcccgaaaattcaatttattaaattttaagttattttttgcccaaaataaaagcaatatttaatcatttaaatcgaaacaatttttaaaaatgtttaaaatataatattttcatttaaaaataattgaagaaaaaattttagaaaaaaattaaattttttcgtaaaaaaaatttcccgttcccggcgggattcccgttaaaattgacgggatttttacgggaacgggaaaaaggcgggaatcccgttaaaattgacgggatttttacgggaacgggaaaaaggcgggaatcccgttaaaattgacgggatttttacgggaacgggaaaaaggcgggaatccagttaaaaatgacgggatttttacgggaacgggaaaaaggcgggattcccgttaaaattgacgggatttttacgggaacgggaaaaaaggccgggattccccttcggggaattccccccccctttttttttcgtttcccgttcccggaaaaaaattttttaccgggctctacctaaaacctacctattttggcagtttttagcacctataaatatcatccctacttttaagttggtaatattcaaaaatgtttattaaaaatttgatccaaaagttgtgccgttttccgtcattaccgtaccaattttgcctaattattcgttaatttatcacatttttgtaccattgtgcccttctttggaggccaaatggagtgcattgagcccattggaattgctcgtgttgatgtcgatgccgccgcgcagaaactcgagcacttggtcaatgttgccggcacgcgctgcgcgcaaaaacaccgcattctgatcattggcctttgtcggcgccttaattggaaatttgcattgcaaattaatgggtcataagataaacattttcttcaaaatggtatatatcagtgaaagcgatgaggtcatcaaaaattttggcaatcggattacgagtcaaaaatgtcggaatcggcaatcggcatgccgacacatccctggtatatatatatctctattaaattctatatttagtgtttcccattttttatggctggtcttctttgcatatttagacacgtccgtaattagctaattagtgctcgacacaatcggtccctaatgattgcctaatgacccctggcggtacaccttttgtgctggctgttgttgctgctgttggtgttcttcgtctaattgctgttgatcatcattttgtcgatgttgttgttggtcgtcctggtgatgttgctgtgtactggttgatgtgcttggatcaacaacggtcattctgctgacacttggagttttttgtttgtttgtgtgatcaaatcgacgatggacggacgattaatcgtcacaaattaattgattaatttgttccacttcaattttagagcaattatctttattatgggaaaaagcataaaaattgcataataatgaattaacaaaaaatgaatgcgaggaatgtaaaaaaattgaaattatttaaaaaattaattaatcataaattatgggcactgataaaaatttaaaagatttccattcttatcattttttaaaagagccgtggagtcaggtatgataaaaagctctaatccccgttacagcccaaaa

SEQ ID NO: 17612 - DNA, 1887 bp, Heterodera glycines
acttcatccattcgagtcacttcgtcaagcagtgccattctcacctgagaaagggtaaaaggggcgacagggcagaagaattaccgccttcagcagatcagtttccgacacaaaatacaattgcttacagctgaaagagaaattgtgaagggaaaggcgaaagaagtgatcagacaaaggaaaggacagaccgatcgggaaaacgttcgcagtcgatcacatcgacgtggggacgcaccgattgggtgctcttttgctgctcagtgtccaaagaaatgaaattcccttcaatgggaggggtcgagtccgttccttcttttcgtccttctctctctctctcttcccttttcttctattctctcgtccttctctctctctctctctcttcccttttcttctattctctcgtccttctctctctctctcttcccttttcttctattctctcgtccttctctctctctctcttcccttttcttctattctctcgtccttctctctctctctcttcccttttcttctattctctcgtccttctctctctctctcttcccttttcttctattctctccgttctactcactctttccttccccactctttgtctgcccgatctcttacctggctgcactctctgcatcgcttcgtccagagtgacggctccctgaaatctgtccaaaaattgttccctttccgtttcattctcttactgctccatgaagatggactgttggtcgtccctcttgaacatggccacataagggaattttttgattcctaaatttaggagaaattaatcgttggagaatggggggaaaatggcagagggagaggggggagaggggggggggggcactcgttgagaaagcaattccgacgcccaaaaaattgggaatcggaattccgagcctaaaagtgtcggaaaacggaaatccatcgtatcccttctctggtgcaaatgcttaatacgccctctccctcactcggccttttcctctgttttggtgctaatgagtccctgccgattaatcaattattacccaacattggcaccagcggtgaatttgacaacgtccgtctcactccgatttgtttccgattctgccaaaggtcgagaattgactaaaatgcgaatgagcaaaagccggtgcttttgtcctcacttggacaccaacagcgtcaaattgttcaaagattatgagtaaaaagttggcggacgggaaaatgccatgccaaaggtcctcaaaacgagtgtttctgaacttagtgaaagagatgtaaaaccatcaaatggtcctccaactgacacagtcacttccaaatgccgaaaattgggccaattcgaatagccaaatcggttgtattcattgagaagctaaatgtttcatcatttttgtattatattaaccgtcccatttctccctccgtctcactttcgctgccaattggtccctaagatttgtgccggaatgcgcggattccatcaaaatgccatcgctgacggaattggcagaccgaggaaaatattttatcatcggaaaataggcaaccgaattggaacgacaaatttgaccattgaaattgtcggcacaattcacggcgccaacctaatgaaagtgagggagaaatttgatcgggaaatggaccaatggccttctgatcaggccttacttaatctcaattctcacctgtacgatatcgctccatcgctttaccaacgaagcgaattggcgatagaatggagcaaaagcacggcaatgaccgcacctgaaaaaggggaaaagcctaagaaaagggaatccatcaaatgaccgaccaatccgcgtaaaactccacaacaattgcgttgtcccggccaggctcaaaaacggtgtctgcaaaagtgct

SEQ ID NO: 17613 - DNA, 758 bp, Heterodera glycines
  misc_feature (96)..(96): n is a, c, g, or t
gtgggcggtgtttttttaggatttgtgaaaaagggacagaaattgctgttttaagcagaggtgaatgagttcagttcggtggtttggtgtaaatgnagcggagggaggggcggggggggggatttgcccccggagggatttggcaaaagtcactcttctgttcattctgatttgtggtcattgaagggaatgtgtggacgaagtcgcctttgctttctcaagaggaagcaaaccaaaaacaagaaaaaaaattcaatttaatctccaaaaatacgaatggattttcggactcatcgaaaggcatgggacattaagaagagaactgctgacaatgagccgactgatgcggacaccggtgagagagggaggccagcaggaaaaggggcatttgtgatgagagatgaccgacggaagagggatggcttttctcctcgggaatgcgacagattgagagagatgggagatgagggccgtctgtgcaaatcgtccattttcactcatttatcctctcaccacacctggcgaatgcgcaaaatcggagcgatgtttggcggggatttcccgttttatttactaagatttataggaagaacagagaaaaagggacggaaaaagtgctcaactcattggaagtgacagaagaaaaagctaaatgagttttgactgataatgccgtaaatatttatcaaagtatttgtaaaaaattatattaataaatatttcggtgaaaagtttatttttcttcgaatgaccacggc

SEQ ID NO: 17614 - DNA, 2088 bp, Heterodera glycines
atttttgtgtatttaaaaaacctattttgcgattttttgtgcctaagaaagggaatttggaagtgggtcttggcgcccagttggcggcgcccagttgagctggcgcccagtcggcggcgcccagtcgacccccaccgaagaaaggagctcaaaaaacgcatttctgtgttaaattttttcattctgaagtcactatcggtcactagaaatcagtattttgcctattttcgcttagttcttatgaaatttgcaaaaacggcgcattctataacgacatcaataacattcacctcccccaaaatgatcacaattatgccaatgccaatgtgaatcccgaaaacattatcaattttctcactggtgtttcccgaaactatgaaatgcgaccttagtttgttctgaaatttgttattttttgttatatttttataaaattttaaatattttttccgtttgacgcacatccgaccaaactgacaaattactgtagaagatattagccgcaagaaataaaaaaattaaaaagttaagaaacttgtccgaatgcgggttcggattcgaaacatggatgttttgcacaaatccgaccaatttcagtcctgaacagctactcacgcgaaaacggccccgaccgattcttagggggtctaaaaattttagctctatttgtaataaattgtttgaaatttgccggaaattccctgagaaatttaatgatttttttaaaatcgttaatgggatttggggaacaagctgtgctcctgcaaaacccacgccacaacataaattttttgcctatgtaatcgaatgaatgcatttttctttcgaaaattgtgtagttttcaggattttgacggggatttacgacatccattagcaatattagcaccggcaaaatcaaaaagtgccgatttgctgctgttcctccctcttttctgcttcattctctcctcctttttgcgccgaatttttccttttcctctctttctcttccgtctctcctccttccccactgctattttcatccttttcctcctcttccctcgtttctccatttttgctaccaacaaatgttggatttggttgacaaagaaaatttctaaccttttacttaaaagcaatcaaatttttaattccttatatcattcgatagttctagatgttttctattagcctacagaatttcaaaaagtttcgttaagtttcaagaaagttatgagctaaaatgttgtaaaaaacttgggtttttgagcttctcaagttataacttttttgaaacttaacgaaactttttgaaattttataggctaataaaaaacggtttggcctttttatgtcaaaatgtttccgcgccttccgtttttgtcaatgatttttcgcctcccattggccattggcaacaatttaagacgaacaaaattcaaaaattgttggataaaatgtgattttcgttagaatttttggttttccgcttttctcattatataaaaataaagtttccaacgcaattaattcttctgctatttgtgtgacatcattcggaactcgtccaaattgtgctaattgccacaaaaatgaaccgacggtaaaaggattttaaaagtctaaattcagcattatttagctaaactgttttccataatttcagttggatttgcaacgacgtttggatggacattttcccatcctttgaccgtcctcaactcggcctcaaattggcacttctttcgccacgtttcaatgcgttggtggacaaacatttcaatggcaaaagcgaattgccaatttggagatcaatcgaaattcacaagggcaaaggaccagaaccgaagctgtttgtacaaattggtgacaaatataacaaatttatggaatttccattgcccgaccgtccgttgcccagcaaaatccgttttaaatggcttcggattaagtaatttaaaatcagagttatggcaataaaagcattccttccattttcacagttacatcgatcactccgtcatcgcaggtcttcgttcaaatcaccaaattttcgacaaaagcaggcaacggatttagatttgtcgattccttcatcacatacca

SEQ ID NO: 17615 - DNA, 2009 bp, Heterodera glycines
ttgcttaaaatttcaaaaaaattacttaaaattttcatcaaagagtcgttcatagtcaaatggataagtgtgccgacgactcgaccgttcaaatgaaaaaccccagcaaaaaatgtcaatttgattcagtttttcctatttaaattttttaaaaaacgaatattttgctcaacaaattttcagtttttgtaaatttcactttacctttaatgagtagtaattaattaaattgtttgaattttactcctttataactagggcttatttttttggtttttatctatttttttctgagctcccagtggtctgaaaagcacgaaaaacgtataacttgaggttgtttttatgctacttttcgcgttattagggccaattctaggtttttacaaaatttttagaacataaaaattttaaaaatttgaaaaacctattttggcgttttgcacataacctttataaattataactagagcgccacgggaccgggacctggtagcggacaactgagtaccaaggtcccggttctgacaggggaccgggactagtcccggttttttcccggttttcccagccaaaaattcccggtttttcaacccgaaaaggtccctccctgtcccgggtttgcccaaaattcccggtcccgtggcactctaattataactttttttcttttctctatttttttgccaatttttgtattattttttgctctttttttcactgttttcctcctccaaaatgtcccaagaggaattgctgctgtcgttccaagatgaaactgctctggactggttcgttcggcttgcccatccgtcgttgtcctttcgttctggccatgccgaattggacgcactaaatgccattgtcccgggcgaactggtcgaaattgttgggcgggaatcatccggcaaattgcaggtggaaaatgaatcaaatcgctgaaatgccatagatggtggacctctttttgaaaaaaaaaatttttttttaatttttcgcgaataaaactatttgggaaacccgagtttgccaatattttggtccatatttatcaattttcgagcattttagtccatataattgtctgccctagtaaaaaactaactcattctttttccgataaaaataatcgtcaaaaaagcaacaaaaaataagaaaacacattcctaagaattgaaaaattttaaaaaatgatcctctaaaatcttttttttcttgtgattaagtttttaaatgttttggctaaagcgttactaaaaatttaataaattttcccatttttgtgcctatttaatccccattttgcgcttgtttctgcctttttcacgatttttatgcctaaaaaatgaagccctacttatggccaaaaatcgtaattctctgttatatttttcacatttaataattttttttaaattttgtaaaaaaatagagaaagcgctaacgaatgataccaaaaaatgtttaatttggtcgaccatttacaaaagttatgacaatttacctaaacagttggccatgactttggtggcggaatttttgttgtgcgaaagcaaagcggcacagcaccgggccgtggttttggatttcaacggcagcttccgcacggagcggctaatgcaaattttggtgaacaaaaggccacaattggaggaaaatgtatggaaaatgaatgggatgggaatttgtaaaataccgtgttccttcaattcagtccccccccctcaattagaagcgccccctgaaataaaggcctcactttttaggtgggggtcgaaaataaagcccctggggcggagtagctcagttgggctccggcacgtttggggccccagcgggtttttggctataacttttttctttgcaaaccaaattcaacgatcttggtatcatttagttatggccagaagaatttaaaaacccagattttccaacctttttttgccataaatttgttcaaaattgaagagattttttcggattttgcaggctaatagatcatgtgaaga

SEQ ID NO: 17616 - DNA, 2158 bp, Heterodera glycines
ggtagagcggtacctgtactggtactgaaaaacatacaactgagtacctatgtaccgggtttcaccggtaccggtactagtaccgggtttttaccggttttcccagctaaaaagtaccggttttttttttacaattaccggttaccgctttaccctagttaaacctcgaccccgaattcctccatctttttgggtttctccccgatctccggtctgtcatccctcgacgatccccgacctccgatatgcattccccgacggggagcgcggaatttttagactgttaaggattgacttgtcaaattaaattctcaaaagacaatatgccaaaggatttaatgaacccaagttcggctcccctcaaagaaaatggttttttttttgctctttctttcttgcgcattattgaaggcgattataaatatttaataagtttggttttcccattggattgattattcactcactgtttttgaccagaaatgcgccaaattcgtccccattttctccctccaataaattggccattttgtccaagtgcaatttggccaccatttcgtcaccatctttttttcttttatccttcaaatgtttgtccatgcacagaatgaatttggcaaattgcgtcagttcgagttggaaaagggcgtccaattttatgtcgacaaatttttggtcgtactcatccgccacttcgcttacgcaaattttcagtgcgcggaacagagaaacgtcggagggcccatcctcccacaaaaacatcggctgatcatcagtctgatcagctgactgtaaaaaagagtgattgatttagccaagttggcacttgaaaattaaaaaaaagaatatccaatgcgaaaaaccatattttggtatcaatgataaaaatattattgaaaacaaacattattttaccattatgaattctaaacaaatttttttaaattttttgaaaaaaaataattttttctaaaaattaaaaacctcctaataatatacaataatttaaatcctatttcaattaatttttattaattagctcacaaataagaagaaatcttttccttcctttaattcacttatcatttctttcattttggcaactttgtttttactatccttggccatttgatgcgttactttgcgtacaattttttctcttttccaaaaattgcttgcataaaatatccaataatctcccaaattgtgaaaaaattttactcttaaattatcctttacaaaatgtttttcttcgctaacatttccttaaaaagcattaaaaattaatttattttaatttttattaataaataataaatactcacctgtttttttgcttttattttgattttcttctttatagaaaaagttttgcgtccattcttcgtacaatcgaatttccaaaatcattttggccctccaattgccgatttttgaatgatttgtaaacaatgattcatataatgcataaaaaacatttttatcatttctctcacctattttgcaattaataaggatgccaaaaatatgtataaaaagtggtcaaaatatatacataaatattttaaaaaaatccagaaatatgtataaaaacccaaaaggtaaaattcaagaatacttttacctcaacaaatttaacaaatgatatatcatgcgactcctctcggtctgtaacgaacgaatccgaaagatttttttcggaaagcactttgggccgagtaatgggcccgtgactgaaatggccaaatggcttcgggactgaaccgtagtagttaaccgccccggtgcgtagtttgggcgggaaaatttcccgcacaaacgccagcctattgggcggttttaggctttgaagttgccgccacctgtcaatcaaaaggtggcgggggaggggaggggtcgagagtgagtgatcggtggagagggtgcgcgggagggggtgttgggtttaagcctaaacctattgcgtagtttggggaggagtcccgtaggtgttgatgggtgggtcgggatttttttgaaaatgtgagtgggggtcaaggggtcaatgatcagatgtgaaattcacacctggtttggggtgaaggggtattgaaattggtgattacgggaggtcaggggacggacaatttaaggtgtgaaatgcgcgcgctattttgaa

SEQ ID NO: 17617 - DNA, 963 bp, Heterodera glycines
gagaattggacatgtacgatgacgtccgattggtggagccgcaacttggtaagcgaattgggggagggaaggggggggggggattggcggatcagcgaaagggctaatcggagtgattgaagagcagccactgttcatccccgagatttatcgcaatgatacgcgggaaggcaccacaaaagcgccaaagggtgcgaaaggcggcgccgcggcaacaaacgcaaatcgcccattggtatcgccggaagttcagtcccgaccaccgatcactgtccggtacgaatggaacaacggaaatgagggaaaatgtatttgggacgcaaatcgttttccgtcctcccccacttcagtacgaccacccctcgcccgagttccgccactgtccgtccgccccatcccttcgggcggccgcctcctccgctcgttttaccgcaacagccacgacttccccctcaggtgccggacccggtgaaacagttcaaataaacctctgaaataacagcatcctcaaccgccccggccttttcccccgcctaatgcgccccttccgcagcccttccggcaaaattcgcaggtaattaatgcagaagggtaattaaacgaataatcactcgcgcatgtccattatgtgttaccaattgaactcttgtgcttcgttttaagccgtcacctttgccccattcgccaaacgctgtgccgcgaccaatgccaaatcagcaacaggtggcccttcccccatccctcgcttcagccctaccttattacccatcctcaataatgagtcgctaattattctttactcaaagtgtccctttgtttagcagcggccgctaaccccaaacattggaatgggtcaaatccggacgggaggtggccaaagactgtttatttttttaatttgccatttcgcgtctcagtgtgccatcaggccattttctatacgccgcagtcagtcagcgaagc

SEQ ID NO: 17618 - DNA, 1908 bp, Heterodera glycines
ccagcagcagaaaaagggaaagaatggacccattgtcaattggtctgatcgaattccgatcagaccaatcgaagcgggcgcagaaaatttcatagttcgatttggcacttactgagcagcccaaaatcggcttctaattcagcccttccaccgcttttcgtgttcaccccgcctgtccccaatggccaaaccctttgtacaggtcaaaaagcgatttgtcactgacaattctcggctgatcagtgtccctccctttaggaataatgttaaatctggccaaggcccagtccgaattgcgtgtgtgacgtgccaacagagaagtgattgccccgaaattgaatgattgaccaaatttatcacaggacgagtgccgaaaccgggccaaaattcgccaatgccattcaatggccaaggcaaacaacagcaacagacaattgtaagggatacggtaaaggaaacgggaacagagatactgtacaaagaaaacgggagggaaatcagcagtcacacaaacaaaatgatatcaaatttatcaatagtcataataattttcccatttcgtgtacagtccgtcacccgtcccgcggccggcgctgctccaccgccgccgccgcatgtgatccggacgacagtgcgcgatcggctcaacgccgggccgttcttgcaaaacggggataacggcccgcggatcgcccatgtggccaatgcggcggcagtgctcaaaacgaccgaaaggggcgaagagagcgaaacggggcgcgatttgagtgccgaatttcacaaattggagaggtaagtgacgaaaaagaaactaattatcacttaatattggcttagactgttaaaatcggctgaagattatttggacgaaacggaaccgaacgaagcgaaacgaacggcgaaagaagaaggaaggaaagggacggcggtggggagggaagtgccgtcgtggacggagggacacccccaaggtaaaatgggcaacaaatcccgaaaatgaaacaccgattcaggcgagggcttctcccccctgcgcataaatccgcttcgaaggccgtttatggaggacccaagccgaccccacgcgattttttactcaaccgaaaaaatgccgcggccgaaaagtggggacaacgaaaggtgagaagggatttaagatagaagggtttttattttttaaaatttaaatgccagaaatggagaagaattttatcaacggcgaatccgacgaaacgaaagcgaagaaagaaaagggaaaaaggagaagaaaatgaataaatgagagaagaaagggagggacggagggaggacaaatcaaattgttggattaagaggacaattaaagacaaaccaaaataattttattgctcaaaaattaataataattgttaaaaatatgcaaaaatatatgtttttattggcaatttcatttttcaccacttttcttcgtttttttcgcgtgccatccttcgctttccgattacaatttgtccgaaaatgtctgcgattccgttgcctttcttttccacttccattcgcttgacccaatttcgccgtcaccaaagtgtttatcgatcaaaatcccttcctcccctccccatttctgtccaatttgtaaatgttttttcactttttaaattggctggcagcaggccaaccttggcatttggttttgtcggttgtgttgcattttcttggcattttcactggcctttggatttggtatatctttccaaaagaggtaaaataaatgaccaaagataattaattaattacacaccatatattaatttcagcctgccagaatgaacagcggcagaagagcagctccgagggaattggagaaaggacaatcactgcttgggaaggaggacgaaacggaagaggagagagtgggcagaaatagca

SEQ ID NO: 17619 - DNA, 934 bp, Heterodera glycines
  misc_feature (884)..(884): n is a, c, g, or t
tcaaattatcgctcatatatgcgctgatcagatggactccgatgccgacgaagccgccgaattcgttttcttcgcaaatttggagtctttgcctgtgtctgccgaagaagttgctttgtgtaccgcagatgaagaactgctacaacaagtaattgggtatgttcgttcgggctggccaagcaaatgtcctgccaacgatttactgtcgtttttccaaaaacgtaacaccctctcggttgtgggtggttcccttttatcaggaaacagagtcgttgtgccggcatcacttcgcaaacgtgttctgactgctttacattttgctcatcctggaattgtccgcatgaaagctttggctcgtcaacatgtctattggcccggcctggacaatgacatcgaaatgttggtgaagcattgtaccgactgtcagtccgcggcaaaactcccgaaaaaagctccattgtgtccatggccgacttctaatcaaatttttggtagagtccacattgatttcgcaggtccatgccccgacggcaaaacgtatctgattcttgtcgattcgttgtcaaaatggccggaaatcactgagatgcactccaccacggccttacacacaattacggcactaaatcgcatttttcacagatatggttttccatatgtacttgtaagtgacaatggtccaccattttcatcctttgattttcaacagtattgtaaacaaaatggtattaagcacatcttttcacctccatatcagccgcattgcaatggtcaagccgagcgtatggttgacacattcaagcgtcaggctaagaaaaatgccaattccaaaaatcaaaattggatttcagagttccttttctcttataggtcaactccaaccncagtactaaatggtttgtccccctcagaaaagtttttgggacgctctctt

SEQ ID NO: 17620 - DNA, 1525 bp, Heterodera glycines
ttcaaaaacggtgacactgttctcgtgttgattacggaaggtctggcaagcctaattggttgaaggcaaaatagtcgatggtaaaggtctaatttggaaggtcaaaattccacttttgaatattactgtcactcgacatgtaaaccaaatgcgttcttttgtcccttaccaaacagagacaactttttcggccgatttagttgaccaggttcctcaacagaaaagtccttgccatcacaatgtcgcgaccactccggtgccaaccttgccaattcaaccaacgcctcgtcctcagagacaacgccgccccccaatacgttattcgccgtgaggaaacaaattttaagaagggagatgttggagatggatgttgatgttggattttaattaatttgaattagcgccatacagtaacagtgatgttcctgtttgtttctccgcgccacatttccagttattattttccctccgttgttttcctcctcattcattaattatttccttcttaatttttcggttctaaattaaatctgttttgctccttccattttcgtcattcctctgactccgtcgtcatcttttatttatttattgatttcatttgtctttccacaataaatttaattctgttgttccttgcggacacaacaataataaggacggagaagaagaatacagtacccttataccgtcacagtatccccgtttttgaaaatacattatttctgaagctttttctattcccttttcagctctgatacagcaaaatgggtcactttctgcagctgaatttgaagaggcacttccgcttggctcatttataaaagatttttacggaatggcgttgcgaattgtggcactgtaacttaccaagggcattgaacaaatgcacggaacgaaaatgtgcaaaacaatggtgggtgctgtaatgatagtatacttacgacaatcgaattagttgatgggtgggtactgtaatccaaatggtggcttgatttcctgtaataacttagcttttctccgtccatgctaatgtcagccttttcgatatgcaggtggccgccctgaaaatttctcttaataaagttttttattttctttagcctgtgccgaaagcgtcaaacattgaccatttgggcacaaactgtacacaaattgtgtttgccgaccgtatgccacagttttggctgaatgtgtccgtttctccctattttattgcgtgcgaacaatttaaggcgccatttgatccctcgactatgttcaatcagtctcggaccagcagtgatttgtttgatgcatgtcaaaaggtgccaacaacaccgaactgcgagaagttggcacattatctgtgataaaattatttaaaaaaaaaccataaccaatgcacaaattcgaggactgtcattggtctttaattctatgattttaaattttcagaaattccgtccttatttttcccattatctcgaatatttaaaaaaaactgttctttttggtgcaaaaaactttcaaagtgctcaaaaaa

SEQ ID NO: 17621 - DNA, 1974 bp, Heterodera glycines
atctatttgttgaaaaatagtccaacgtaggcgtattataagttaaattgcgaattagtaaaaatataattttcataatattatatatttttaataattcatagaaaatggatattaccatcgcaaaattaataacaatttatattttaatcgtttattttccgaataattcgaccacaattgacttttctggtggaacaaatgaaggacccaagcaaagtgaacactcaattgttacttttaatcattttcaaaaccagcagcagttcaacatggcacaaccttgttacggcaaattctccgtaaaaaagtttcggtatttaatagaattaaaaataatttaatgtttgaaaatatttactgagattattgcagtataagaatcgaattggattgactatatttcggttgcacctgatttttaattcctgctaaaatataaatccaaaatataaatccgacgaataaattgaatcaacttctaatcttaatccatccttcgatttattttaaattagataaagcgaattcagacctaaagcaaatgaattgatccaattattgaatatgtcatttgaatttgaatcataatcggtcgataaccagcgacaacaaaacttttttctcaaacacaaaattaaacgctatccaaaaaaacgagaccaaattaaaccatttatggtgaatttttttaaattttttaatttaaagaatatttttaagaaagaagaatttgaacattttaaagaattagtgaatgatgacaattttcttcgcacaaataaggaatgcaaaaatcatcaaagtttcagtcactacaattgacagatggaaaaaaatactcggaatcacaaagaattcatgtaagcaacatttcagaaggataataatttattttttacaatgttatattgtcaaaaattagaatttttcttattttcaataataagaaacgcgaatgggtggcattgggtcggaaaaacccttttggcagtttttagaaacgcactggaaaaaatctttgtaaagtttgttttggttttttgagaatttcatagcaaaaaaaaaacggtttcaacttagttgcctctaatatgaattttgaaaggcaatagaaaaaaattagtgtcacaaatgtaaaattgggagatcacagtgtatttttgctgctaatgtgcattttgtcatttcatcggccccttctcccatgcttctttcagcatggcaaaatgatcttctggttttgtttggttatcaatcaatgcttttccactgatcaaattccgctgaacaatgccattgacagcagccaaagatggagcagtattatttgtgccaaatcttacagttgcatcaccaattcgatgattatagaccaaatgattaaatccaaacattttaccaatacggttcacaaattggcataaatccctcttcaaaaatgggtggcatcttaaaacttttaaattaaattaatattttaaattttacatttgtttacgttataatgaaaaattcgataagaaggccgaaaattgagttgataatcgcaaccaaattgaatatatgtatataaaatggcaaattgagaatgtcccataataaaatcattgtccccgcgaaaatgttgcccaaattcagaaacagtggcggtattagctgtttgccaatgcgaatgttttcagagagctttcaaaataaataatgattatataattaaattatatggattacctgataacgaattgacagattatttgagccaatgttttggaacattttttgataaattttggaattgtatcggcttaattggtagaaaatgcctaactcaatgcttccgaccagcaattggacggcagttgtgatcagattcgttattggttgcttatgatcatgtggtgaaggcgttgtggtggcaatataaattgggatgatcaactgtaaataaaaattgatcgcttatatcttatc

SEQ ID NO: 17622 - DNA, 2240 bp, Heterodera glycines
tagaccaaatgattaaatccaaacattgtgccttacggttcaaaaattggcacaaatccctattcaaaaatggatggcatctaaaatttcaattaaatcaaattttaattttatatttatttacgttataatgaaaagttcgataaggaggccgaaaattgaattgataatagcagccaaattgaatatctgactataaaatggcaaatcaagaaagtcccataataaaatcattgttcccgcgaaaatggtgcccaaattcagcgacagcggcggaattagctgctttccaatgcgaatattttccgatagcttacaaaataaaatagattttttattaaatatttatttagttacctgataacgaattgatagattattcgagtaaattttggaattgtatcggcataattggtagaaaatgcctaactcaatgcttccaatcagcaaatggacgacagttgtgatcagatttgttatcagttggttttgttcactttgtggagatggagaaaaagcgatgtaaatgggaatggtcaactgaatgaataccaaataaattttgtttcgttataattagttataattggctaataaaatgtgattactctcaccgcaaaaggcgtccacagaacggtaaacagatggccacgatttttttcatatgttcggacaaataatgtggccaggatgagttcaatgaccaagaaataaaatgtgattactctcaccgcaaaaggcgcccacagaacggtaaacagatggccacgatttttttcatatgttcggacaaataatgtggccaggatgagttcaatgaccacgacaaatggcacaaaattacgagcgtaaatgccaatgaaatacatttttaaaagtgacgggaaaaattgcatagattcggcaccaattggatcccaaaggaaaatttgaacagacaaatgacaaaacgacaggaaccacgcttaaatttagaataatattacaaataaaaattattttaaacaatattaattatttcaatttaaatgaatctatcccacaagtaacttcttatttcaattttaatgaatagcaaaatatttggtaatagaaataattaatgaaaagtgacaatttaattttgttcagaatctcttttgtttccaggtgtaaaatgaaaaaaaatcttattgaatctccgccaaatttggtcgattgtccccgacggtaaagacgcaactcgtttttggtcaatttgtttttaccccaaatcgttttattattccaactcttttatagaattgaatcgcgaaaaatcgaggccgaatcaattagaatttttaagtcaattgcgattcaccttttttggacgaaatttttatttttaatagaacctgaaaacatatttcctgctgttttctgggtagctagcttatcacgaataacatacatttcttccgataacaattaaaaattctcaaaaaacttaatatatttctttcgaaattcaaatatgaacattaaaacattagttcaaaatcgcaaaaattggtattgttgataaaaaatctgttaataaatttggggaattggagatgggccaaatatattttgtccagtcaacactggaataaaactttattcaagtaaaaattgggaagcgccgatattttagaaaacaaaattgagggcagtataaaattaaaagaatttcagagcataaaaaataaactaaaagcgaatgacgatgaaaaaagggatggaattgtgaactagtaaagggccgcttccttgcgatcgagttgatagttagttgaccaggatccagtccggaaggttgtctccgatgttaaaagggacattgtggcatgcatccgctgtgaattggacttcaagattttttttaatgctaacatggcgatttgcctttactcacaaagacaaaaaaaggcacctgccaattttgacgatgaaacattgccgttaattttcgttaattaaaaattatttgtcaaatcaaatgaatgaataatttgtgattctgtggcgtaacagtaatttgatttccagcgttgacaagagacaggaacagaaaggcaatttacataaaaaataaattttataattcagattaaagatcggctacggttcggaccctatacgggtttttgcgggtccgtagtccgtatttttttgggccgatacggacttatactgagtaagggttttacgggtttttagtccgtaagtccgtatgg

SEQ ID NO: 17623 - DNA, 1643 bp, Heterodera glycines
  misc_feature (1484)..(1484): n is a, c, g, or t
  misc_feature (1606)..(1606): n is a, c, g, or t
gaagtttgggcaccagaaatttgggcaccgggaagtttgggcaacagagtaagggatttcaaaaaaaaatgtaaaatgtaaaatggttatataaatcattaaaatttagaaaattttaacaacccctgtgcttaaaaatttatattttcttgaaaattaaaaaaattatgtaagaaagctgataatctaattatttggtcaattcttacagctgtttaaacgtagaattaaacgtgtactaattattgtttgaacttagaatacccggattagttgggcccgaaatatcaaatgatcagggatgcaaaaaatatgcacgaaaagtggccaaaatatgcacataaatatgcaaataaagtcgtgaaatatgcaccaaatatgcacaaaaatcgtaaaatatgcaccaaatatgcactaaaaaattgaaaattaggggtgcaaattcaataaaaaaaaattttttttactagtgcacttgccaatgagctgctacatttcttttataaaattctctttagcaaatattgacattttttaaatcaaaaattttctcatgaaaaaaaatttgggggaagaatttttgagaaaatttccaattcttagtgctgtgtttttacaaattttcggtcgattcttaggggtgtatttttttaaaatttttttagatcgatttggtgtattttccgtttttattacattttttaacaaattttccaaaaaatggcgaaatatgcataaatatgcacaaaaagccaaaatatgcaaatatgcacaaaaacctcgaaatatgcaaataaaagtcccgatttttatacgcaaacacaaaaaagaaagtgtttttcctgctatttagagcatggagaagccaggaaaaaaatgcatttgcatgtttttttacatccctgcaaatgatccgtctaattatgtttaaacttataaaatttaaaagtcttgaacataccgagccttgtaataatacaaataggttatacatacgccatgtatgacattgatatagaatgaattttaatgagtctagcaaaataagcatgcttaattgagcggatatctttcaaaaactttcgattcctaacttgattataatttacggtgccaggaaatttcgacagtggctgatttcgacagtgaccgatttcgacagtggatttcgacagtggctgatttcgacagtgaccgatttcgacagtgaactattttcatttattttactgttttccgacatttccgacagtggctgattacgacagtgaccgatttcgacaatgaacaaaattatatttgtgtattagtcatttttatttaaaaaagtcactatttaatgggtgaaatttatatatgatgtagtaaaataaagcatttttcttttattttcaatgaggtaaaactcagttgtactgtactttggccgtaggccgttgatagtggaagggccggtcgttcactttatattgggaggtcaattntcttggaggtcaatttgataagagaattttgagaggaattgttttggtgttcccgaatgctgatggtcattctcgacttgtcattgctggtgttcatcatttgctgttccctctattcgttnttttccgaattcattgaccaatggctctactccgatt

SEQ ID NO: 17624 - DNA, 1642 bp, Heterodera glycines
gcttaaaaattagcgcaggacaaaaaaatcggtgggtgtgtgtgtgtttttacatttatgctaattttttccaacttttagcaaaacggcaacttgacgcattaattactcattttatgcggtaaaaaaaaggaaaggaggaagaggaggaggagaggaacaaccaagcaacaacaacaacatttaactcataaaaatacattttttgatcacaccattcattcatttacattttcatttcaaaaaataatctttttaattttttaatttgattaagggaaaacaaatttattgaaaaaccagaaggttatgttatatgaaaattattccaatgattatcatagacagtgaagtgatcaaataaaaaaactgattacagtattagtcccacccatggtgcatcaaatccgttcaagggaacatattctcaaaaacattcacctctcgttcgatttctgcgctcagctggttgagtgcatccagctttgattcacgggccagcaagtacaggattcgtgcctcgatttcgccgatctttgcgttgagtcggttcttggcatcggtcaagaattctccagcgaaagccgtgcctaaagcgggcagcaaatattatagaataaatgtaaaaacggatgtccataatataaataaatataaatggtcacttccaaaaaaattttttgctttaccgaagcaaaaatttaattcatttaaatcaacattacgactaattaccgattgttttggtttgcgcttcttgatggtcagacagtccattttcaacgccaatttcttcacaccaacattgacacgtacctaaaggggtaccgtatcataaacaaaagattatgtgtcgaaaatgatggaaaattcaaaaattaaatccatttaaataaacattatgataattaccgattgttttggtttacaattcttgaactgtagctttgcatgctcacaaaagaactccccacccgcgattctcttaggagtttttttaactcgagtcatttaatattttttgtagggagggaaaaaagcaaaggaagtgagaatgagatgagaatggtaatgaaatggcgaatggcatttgttgctacgatcggtgcgaaaacagcgatgatttacttggggggggagtggctgaggaggggttgtaaatatgtcaacacttttcacactgggattacgaagagagttaacacatcttatggaaaattaatgggctgtttttgtaaagacacaaaaacctaacggagatgaaaacacaaatcatcaatcattcatcaacgattttggacagctttattaaaaaaacagatttgagtgaaatgtcagaatgaaaatttctaagcacgcaacaacaaatttaggctcattaaaacaataaacccatcgttatcgacctttatatggtaaaacatcgagatgtagcccactttcttcatcaagtgcgtattgaagagcaagtaaacggtgtttccatctgatcggacttgggacagtataccattgcgattcatctcacatgcagtctgattcaaatatgtaggcaaatccttggggagcatgacgcccacacaaaatccgtttgcgatgcagaacggattgggagagcagaggatgaagtcatcagctagct

SEQ ID NO: 17625 - DNA, 1685 bp, Heterodera glycines
agttgatccttgatgcgaagcacagctgataacaattgctcattgacgaaaggcacttttcggagctcacaagtcgcattgaatttctcatttaacattgccttaatttaaaatatttgaatttaagtatgtaaatgatgatcgctaaccaatcgattcttgaatgtgttgtgctcatttttccttgactggcgcacaagttcaaactgccaattaattggaccgatcatcgagagccatcgcattttttctataatcttaatttggtaaaattaaactttattattatttggcacccgctcttccgtcgaacaaccgcatcataggaatacacatgatcagttcccagatcaacttaattgggagcggcttggaaaatttgactttttttaaaaaaggtgtaaagcacccatcagaataacgcttcattttggcataaaagtatatgtcgagatcagctagaatgatttgagcatttgatcggtacgagaaaaggtcgagaatggcgccaaaatatgcatgcacgccgggacctcgagcctgaaaatggacgtggcttaccattcaagacccgaaacaccgtccggatcatacacccggctaattcgacaaatcattctaattttttgctctttttttgtttgtcccgctctccttattccttccctcatctccttcatctcctatctctgtgacaattttttaaattgagtgaccgtataataaaaataaataataaaataatatatttttttgatgttaaccagggcggttgctttatatctccgtttatcctggcagcaatttgccttttaggacctgaggttaatctcattacgtttactaatttccgagcagtttaggtgccctgtcgtcttgtgcttcatgggtggcggtgtgctgctcgtcaggtcaacgttggtttaacgctatgatcaaacacagttcactgtgaaataaatattcctgttcaattttcctaccacatgcaacaattttcccttccgcttcccacccctaccatgccatcgttcatttaattgtatataaaatgctcatgctgctaagacccgtggatggcccagctggaaattttacgactatttacacaacaagcacggacaacgtggactgtttcatcaagacactgtgcagctgatacgccaaatcaaagcaccattggatttgaacgcatatgacgccgatacgtacgtgcccctcgtcatcagccactggaacaatgctcatcaacagcagcagcaccgttttgcactgttcatttttggcaacagcgggcactacaagccaatctacaaatatattgacagcacttacgacacaccattggctttatactttaacaacaatcatttcgatggtgtgcacttcctcagcggactctttggtggcaaaaagtattgtctggagtgtgagaagctttacaagaagccaaaggaacacgtgcaatcatgcaaagcacactgtttgctctgctcacgcgttggctccacgtttccatgttactcggatgatgatggcttcttcaaacaatgcaacggatgcagcaaaagcttcagaaacagcagctgctatgaccaccatctgcgttccaaagtctgcaaacactccaaaaagtgcaaagactgtctgggggggggaatgtggcggataacaacagaaaaggg

SEQ ID NO: 17626 - DNA, 3206 bp, Heterodera glycines
ttccctccacagtttactctgatcactgattaatttaaccgcttttcaacattttgaggggtcccgaattttcgcaattactttctttcgagattattgtcaattgtaaaaatccgttcactctaaatttaggcttcctaaatcacccccccccctccccaactttgatcgatcatcgcctcgttctccctctcacagatacgatcatgtgcgtcaccccgtttttgatcgccggcgtcggcgtcgacgacgcgttcatcatgcttcagtcgtggcaacatcatcgggcgattggctgtccccggcagcggctttcactcgtcatggtccatgtaggccctttaaactagcgttgaattagcagcaaattttgcggggataccccgacaattaggccatttttgcgggggtatcccttacaccgataattttgctatttttggagaggatattcctgaccacgaccatttgaaactattttggaagaaaatccctgacctcggcaatttggccatttttgcgggatatccctaactcggctccactgaccccgacaattgggctatgtttcccaaattaaataataactcactatttcttttttctactttaaaccccacacaaactcttattttgattttggtattttaggaagaaaaaaatttaatgataaaattttattgtaaacttttaaatatagaaagaaaataagattgagataataactctagaaatagtgaatctaataactaaatggaagggataccccgactctgcaaatttggccattttcggaaggaccccgacaacttgggcatttttgcggggatatccctgatcccgaccgataatttggtgccatttttggaggggataaacgacaatttgcccatttaaggggggcgggggtggagggatattcccaactagaacatttcctaacactggcaatttttctacttttttggcgggttttcccctacccccgagtggcctcggtttttcgaggctaattggattaagacttttgccgaaattgttgttgatcagaccaattaattaatccctgatcaattttctccgccgccatttcaggtgggcccgtccattacgatcacttcactgacgaacacaattgctttcggcatcggcttcttcacgcccacgccgcagatgagcctgttctgtctctgcacttcggtcagttttgagatggcaattttttaaaatttaaaaaaaaaaaaaattaattttaatgccaaaaaatcatgaaaattttaaaatagtgtcggtgaaaacaaatttttcattagtttgcgaacttaattgcaaaaaaataaattaattatttgtttgacaacttaaaaatttctcttctaccgaaaaaacgatttttaattttttatgttttttgtcacaaaacctcgaaaatttctttaccaaagtgacttttctgaaattttttttaaaaggtcggtcttagggggtgcaattttttttactcttattcaattttttatttaataaaattttacaaactttgaaaatactaaaaaaacaaattaaaaaagcataaaatatttttttcaatgtttaaaaaaattaaacgcaaaaatgtatttatttttgagcttatttcttaaaaatagagcaaaaaaaaaacaaacaaacaaaattttgacttaatattgaaaaccaatttttctgcttttaattttggaagggaaatttctgtgttttttgattattttttaatattaatcaaaaaagaaaaatttaaattccataaaatatcacaatgaataattgtatttgtgttttttgtattcaaaatcatcgcacccttaaatatcatatcgtttcctattttaccgtatccttttttgctgaaatactgtattattgccgaactttccaaaatcggtgcaaaccaaattttcactgacaaatgagtttaattgcaaaagtatttgaaaaccaatttttctgctattaatttttagaagggaatttttatgttttcaaaatcattttaatatttggatgataatttaatcaaggcacttttatggagtgccgtgtaaatggctcagttggtaatgcttctgatagacactgttgagcgctttcttcggttcgagcccgtttgcacgcgcaattttttattttattaatttgaaaatatttttatttttatttttaacattggttttttaaaattcagataaaaaatgtaaatttccataaaatataacaatgaatataatatactttttttttcctttccaattcacacgtttaaaattttatatcctcaaactaccgtagctcgttttcaaaaatactgtattacggccgaactttccctggcgcatttttctgatcacaaaaaaaagcttaaatattaatagagggatcaaaaatgtgtccttttataaaaaagaaacttggacatgttgcctattttttaaaattttattttttttttcaaaatttcttacagtattttttcctgtactctcacagattgccgtgttcatcgactacctgctcaccttcacgctgctctgtcctgtcgtcgttctgctctcctcccaccagtgttccgctgttgtcgttgctgatgaccagcagaagcatccgccgcttcttctcaccgccgccgcttctccgcctgttgtgccgtcatccgccggcgatgccgaagccaccggcaaaatgccaccatccaccgctgcgcttccgtgccgtcccgtcgtgttcatgccgtcatcgccgcggtcgtcgccgcttcatccgacgcctccgccatgggtgcaccgctatgcgcgcttcctgcactcggcacagggccggctggcggcactgtgtgtggccgcgctgatgtacgcggtcggcacaagcggagtgctcaggtaggagagggcaaagcaaatccatgcgtcagcatgtcggctgcggcgctatgccgtgccgtgcacccgtcggtggtgccgacaggcgcaaccccccggcggggaaataaaattgccaaaatatgcaaataaattttcaattttcttctaagaattcttgaaattcgattcagaaagtggaaaaatgattaactatgttaataaaaattagtttattaagaaaaacgaaactaaaataaagcaaaattcattaatttttaccagaataaaataaataaaacaaataatacc

SEQ ID NO: 17627 - DNA, 3494 bp, Heterodera glycines
ataattagagaaaatacggtaatactttcatgaaatattctcaaaacccaaatttgtgccaaaaggaatagggacaaaaaaagcaattaaaaggcaaaaggaagtgaaatatgccaaaggcgactcggtctttgtacgattcggtgccaattcctaaataaaagcgactgctctttccatgcttatttccctcacatcaaaggaaaggataggaaaagcaaagaatggacaatcatcggctgctcacccaccgaaggcacttacgcacttattagcattgctttttgtccctttactactaaaattcgccctttccctccaatggacgccttttcccccgcgtaattcacaaccaattagcgggcaagggaacctccgatggccgaccaacggatgcgcaaattgcgcaattcccgccccctcccccgcccaattgagtcccctggggcatcgcccgcacagacgcttaaggagcaaattggccaacagctgattgaggaagaaaccaagccaatgccaaggaatagctgtttttagatggagaaacaatgctttaggggagggaatttaatttaaatggaatcaaaatatttgaggaacaaatttaaaatagaaatggtgaaaagttgatgggaaatttctacataaaaatagaaatgtccaaaaaggctaaaatgcattttgagttcttaaaaatttatttaaggaggcgtgagatttgttcacaaccaatttaacgtttttgtattcagtggaatttactaaagaaaaaaaaagaaagcccttttaaaccaaatggccacttttattcggagttttagatttttggtaattgccaagtttaacatcggattggtaaaatatggaattgcaaataatttttattttgataaaatgagaaaaacaattgaaaatttacgaatgcaaaaaaactaaagcccgttttgaacaaattggccactaaagtcgcgcatcacagtcggtcagttcgttgtcagtctaaaagtcaaatcccttttttccattcactctcattctctcccccccccttttttaccccaacgcctccaaaatgaccatgcacacttgcgccttccccgcctttttgttgctggagggaagcgaaggtgcgtattcgacgccatttaacacagcctaagggaacattgaagttaaatggcaatgatttcgctgtttccttccctcactttccaaaggtatcgccggttgttgtgcggacccgactcagcacaagaaaaatccggattcttccagcgatggcgggcgcactgctccatcagcacggagaccgggtttttgcctgaatttcggggttttcaattcgtttaaatagcagcggaatttgctgtcgaccggcagagtcgagaacactttcccgagtcggcgcccgctcgagacaagagaaaagacctgccaaattgagggaaaaggattaatttaacaaaggcaatttgtgcaccttttctgtccgccttcacatccaatgccaacggctccaattgcccggccctttcacggccaaggccttggcccggctgccagcccatccgctgcagcaatttcaacccaattccgctgttaatctccggggctgttcgaaattggtcctgaaaagcaaaaccttcacaaatgtaaaaaaacacatttggcatttcaaaaaataactgccaatggacggagaaaaaaaattgatttagtaaaataaaattgccaaattttgcctttgtttccggcgccgttggcagttatcttttacgcattctgccgcaatttcgaagatggaaattaaattcattaaaacaaacattgcaatgaatattaaatgcctcgtcggcacctataaaatcgaacgtgtttcgaatgttgcgcgttagaaaagaaataaagaaacgcgcaacattcgaaataattggaggaaaacatggggagagacatcgaaggtgggagaaaatgctaacaaaaatggaatcaaaaaaataattaggcattaaaaagaaacaaaattcgattctcggtttacccaaccgaaaaaactcggaaaagatttaatgagaagaggacattttgtccttttttagcattttgtcccataaatataagcaaatggcgacagctcttcccattggtgaagagtcggaaacaaattctgaataaaaaaaggagcggaacattccttcaagaaaaaccaatgatatttattgaaggaatgttcatctccgcaaggacatccaaatcaattccgaatataaccttgttgtgagaactgagctcgacatagacctggaccggaattggaccttctggggttttgccagaaaataaattcccgaccgattgcgatgcccgagactgaaaacttcaaaatcggactcaaaattcacgagcatcactaccatcaacaaataacccaggtccaagcacattgtgatctcaaactgaagattaaaacggccaaagcaaaagcgactgtccgcccacctttttggcccaggcgtgaaaacgcgggtcagacggttccaattccttctcgctgagcacacgagcaccagtatggccagtaaattcgccgggcaatgagctgtcctgggcccacgaattcatctgaaatgggagtgaatgaatgccattgtcaaggcattcctcggtagtgaaactcacttccttgtccacccgtgccaacgcttttctcgcctcgtaatcatttgggtcacgttgcaatcgctgattgtagcgcaaccgttccgcgaccaattcttgaacactcttttgaggcttaagtacaaaattaattaattaatattttgggagaaaaagagtgccttcgtcagcccaatggggtcgggccgagaggaggccaaagagaaaacggcggaggaaggacgagcggagaaggccgaactgctcgaaaaggtggccaattccccgccggaggggccgtgctgctgaacagccgttgacagaatggtcgcctgcagtgccgactcggccttctgacgggcgaccttaacaaagcaattcgcctgaggcattttcaccccaaaaaacaaaaggacctgtgcctcgacaaaagtattaaatcggtccaaaaagtcctttccatggccccccgtcgtttccttcatcgtctcattgctctgttgaccatttgtcgtcctctgatcggtttgtgccggatttttggtcgttggcaataccatcggtgtgccagagtcggaagggacgaacgctaatttggtggctggcggcaaagcgggctaaatgtaaggcataaaattaaaatctaaaacggatactgtagcaaatgggtgttttttttttgtgcaatttatttttgctttccctcattctctgggttttgactgttttcattcaatgtcaccatcattgtcacaatcgctcgttaacttctcccaattcagtctctcttttcggaatgtttcccttttttaattgtccctccgcccattaagtgc

SEQ ID NO: 17628 - DNA, 3460 bp, Heterodera glycines
agtaatcccaaaaaccaacctttttttgttgaaaatctgttaacaaattgcacccaaatttttaaaatttcccccggcggcgcctatcggcaccgccggaccccttctttcccaaaagttttttgaaaaagcgctccgaaaaaaagtgatgtgaaaatcaaatctgaatttctaataatactcgatcatttagtccaaaatgattaattgtttgaaataattgaagaaaatttgtttgaaaattttcattaatttaatttgctttattttgggttttattaaataaaaaaccaaataattttgtattattttcacttgaaataaattaaaatttgaattttttttaaatttttaaaatttttttgaatttttaaaatttcccggttggtcccggttcccggtttttcttgcggtcccggtcccggtcctgaagaaaaatcgaggtcccggtcccggtcccggcttctcaggtcccggcaagtcccggtcccggttttggcaaaaattcccggtcccgtggcactctatattttacccttgattttattaaatttttttagcttataactttgtcaataatagaccaaataaaaccattttatgctcattttgaagggaaaattcggaggaatatttctaatttagtcaaaagattattaaaattgtttattggcaaataaataattcttgtgttattttatatggtagagacatggaaatagtacactaaaatgagagaaaaagaaaaaactttgtcctgggtcaaaacttttttcatagggtcagattttcttgaaattttgcataggcccatattttgacctcctctatcgattccctctttatttatttgcactgggagcccaaaaattggaaatcgcggttgaaattaatgactaatttgtgacttttaaaaaaattcattaccgtctgttcatttttgtggcacttagcagaatttgccttatttggaataatgtcacacagatagcaaaataagtgtactttagtcaactccccggaaaaaaatggcacaaattatatagccttgtcttggagggggtaccaccgcccggtagaatttgttaacatatttgttcacaaaaaaggttgatttttgggagattatttttaaatttttgcttttaacaacaattttcttcactaattttcactaaaatccccattcttccagagtattttttggtatccgggtacccggacctaccgggtcgggtaccgggtattggattttcaaaaaaacggacccgggtaccgggctcgggtattaaaaaaccgggcgtgcgtcccagtaaaatggaaacttcagtaccgaaaaataataaacgggaaataacaatttataagcaaaaataaaaaattcaaaaaatacatccaatcgacctaaaaattttcaaaaatacaccccctaagaattggaaaaatttcgcaaaaattcttcccacaaattttttttcttgttcaatatttgctaagaacatattttataactgcaatcagtgaataaaatcgtttcattaattttaaattattttcatgtaaaaaacagctatttaaaaaattacacccctaaatttggaactttttcgccactattttttgccacaattttggcatttttttgtcactatttagttaaatattttgggattttttgccactaaaaatccgatccctagtcataaaatggaattgatgaatgaatgtttgtatgtatcattagaatagtaaatttacaatttgattttaagttttgtactgatttgtttcgatttaaattatatttaatttgttttgaacagctccgccagccggactccgtcagttaggcccccgcaagttttcccactgtagcttttttctgtatcatccaaatccaacattttttcttttttttttgaaactttcatggaaaaatttatattaagaaaaaactttaaaatttcgactttttcgaaattttcatgtataactttttttagaaattgcctaatcgcgcgaagaattatcttagaaatcgtttctaaacatgttaagctttcgaatgataccaagattattgaaaaataattttaacaaagaaaaatgaatgaaataagagaaaaatgaatttaatgggggggggggaattcgtgctctgattgaagtggggtcatttaacgattagtcatgaaggtgaacgtgaacactaattagggccatttatttatgaagaattaatgacatctctaagtgggcagcgaaatgacttcgcccgtcccttcccatgcccttttattctctgttgggtcatttctttgcttttggcaaagagaatttataaaaatgcaagccatcagaagacagaataaatgcattttattaaggcagggctgccatccgtccttggattcggtgctgggcatttcctaaaaaccgccacccatgcgcgtttcctaaatccgccaatgggtttgaatacaaaaaatgggtaatatttataaatacactcaatttcaaccaaataaatatttcatgtatcatttaatagctttaattgttctctttcagagtataattttctataattttttccttaaatataaaaaaagttataaagcattgaatatgctatgtttttgaaatggtattgcataccgtttatatgaaattgttctttaaaagaattgcgctccgtctttgctggacattcgattttgctgaacaatgactcatccgacattttttactttgaaatttcgatcaaaaatttgggagggtgagagcaatttgtattttaaatataaaattcagttagtaacattttttttacgtttagctttcccatcgttttcggattcgccgtcaaacagcagacaaaattggacaaaagaatttacccgcgtaatggcacttatgcacgctcaagcaatggcacattttggattaacggatcaccaaaagggccaaatgccgattattcttacggtgttggcgatgttgtcggatgcggctttagtttggccactcggcaaattattttcaccaaaaatggacgtcgtttatgttagtaagagaatgaagaaaacccaaggaaacaaaaaaataaaaagtttttttcttgaaatttatgaaaaattttattctatttttttgcaacaacattttggagcgtaccgatatactcaagtgaatccttagaaattgttgatttgtttagataataggctctattggataattctcaaagaatttttttatgcaaagcaatcacaaaaaatgtaacaccctcttatttttcccactttttgaacataaatttttgcatgaagcattagaattgtcatgcattagtcaagtactaaatgctctgaaaagagacagtaacttatttatgcttttaatttttctcagattcctccgatttggtcgaagattctcggtttgcttctgctgctga

SEQ ID NO: 17629 - DNA, 1546 bp, Heterodera glycines
tttgcctttgtttcggtaaactaatttaatttaattaccaaatttatttatttctaacaaatttaatttaatttaattaagaattataatagtttgaaaatttaaatttttctttataaatttaattaataagcatatgtttttacaattttatttggtttaaattatttttttgcagttttattacaattttaattttattttgcaattttttttattttatttttatttaaagatgattttgttattcgctcaaagtgttccaataattgagggcgaaatgagtggcaaaagaacacatcaaatgtacttgccattcttggtcattagtgtatgtttttaattgtttactaattagacaaattaataataaaaattttcaacaaaaataattttttattgtattgaaaaatgaataatttaaataaaaatatatttgtatatattcagtgtatccaattggcattcacaatgattggaggaattgtgatgttctttacgctgggtagtaaaaaatttatatattttatattattataaatataaaatagatcattcttagctcaaaatctggtaacaattaggcaaataacgcccaaaaatcccacaaatttctgcggcggcgcctgtgggccactgaaaaatcttacacgtcgattgtggcattatgccggccattaatttgtcacattttttaaagaccaaatgcgtcaacaattgggcgggtattcaactggaataattctcggctatttgtttggacttctgttgccgctgttcattttcttctggtgctactccatcgtttttcgagcctacaaatttgtgaaggaaaaaaatgacgagaaaaaccggcacaacgccaagaaggacattcaaatttgatggtgtagagaatttgttaattaaatgttttctaattttaataaacaccgtttttcctaaaatacagtaacaaatactgtatttcttaaaatacaggcacccaactgaattagagcctccccttttgaaggggttgaaaaacaaagccctgggggttctattttaggaaatacgaagacaaaaataattcaaatctaaaattttcaatattgaaaaattcaagaaaaaaaaaattttttttcatttttttcttgaaactttcttatttgctaaattttttttcttaatttttgttgaaaattttttaaatttcgacgacgaaatttgtcccgtccaactcaaacgcggactctaattcaggaggtgggctgcattataggaaatacggtattttaatgatcataaaattgccaaatcatttgtgccacttttgtgtcagtaatatttaaaaaaataattaaattttgtttgaccgctcccaatttaaaatcacatcataaaattgcaaaaaaaatagcacatccaagatgaaaatttgaatcctatttcagccattcaaatccggactatccatcgacaaaaggccgacctataagtcatacattaaaatttgcaaattttaattttctaaatttaaaatttgaatcccggggttcgaatt

SEQ ID NO: 17630 - DNA, 2346 bp, Heterodera glycines
tcaaaaagggcgttatataaaaaaccatcaaatgaaaaatttcaacctaaaactgtccataactcttgtcaaagtcaacagaattaaacattcttggtatcatgcgatatccctaacatttctctattagctcatctaaatttcaaaaaatttggtcaaggttgagcaaagttatggccaaaagtacacaagcaaccaggttttcaaaaatttttggccataacttttttaaacctaacgaaatttttttaaattttgcagggtaatagaggacacatagggttaccgaataatagcaataaaataaaaaatgaaaataatttctaactaaaattttttaataaaaataaaattattttgatcatcaaaaattctgatcaaaactttcttacaacaaacaaaataagatgatcttgatattattcgatagctctctatgtgtcctcaattagcctgcaaaatttcaaaaaattttgttaggtttcaaaaaaggtatggccaaaaatgtctgaaaacctggtaccttgtgtactttttgccataactttgctctaacttgaccaaatttttcgaaatttaggtgagctaataaagaattttagggctatcgaatgatactgagaatgtctaattagattgactttgacaaaagttatgggcagttttttgttgaaaattttcatttggtggtttttttataacgtcctttttgatggcttttttataacggctcagcaccgatacgatttttaggttttagcttattttttcatgagctccccgtggcctgaaacgcacgaaaaataagttttttttggtggttgttaagctacttgtcgagttattcgagcctattttctaggtctttatttttagagcttaaaacctaaaaaatttttgaaaaaagctatttgacctattttggcgtgacggaggggatgagcggaagagcaagagaaataacgggggagatgattggaagatttcgaagaatgccggaagagatgaccgaaagagtaaaagtaccggagggtatgaccggaagaggaacaaaccctgaggaggtgaatggaaggaatacagaaaagccggaagagacaagaggacgaataatcagagcaaagcagcggtggttcatccgtgcccacataaaggtacggtatcaagaagggaccgatacagtaactgaaacagtatcaacaaaggatcactacagtaacagaaacgatggaatgaaggcaaattttatggtactcttatttggctatcggaactagcgaccagacgggatcgggatcttacgggattttctccggatcctgcaggatttaattcggaatcccaaccaaggagtacatcccggttgtttttttcaaaatcttcgggattaatcgggccggcatttggacgtaagcttgtactgctccaactccatgcatgaagttcgagctgtacaggtttgttgcgatcccagagaccaaatctaagaccatattcgaactcaacatacccgatttaccttgtttaattaaattcagaatttccaaaaccacttttaaaacattatgttacttggtggtcttgaaaaatgccgtttttggagaccactttcagtctcggctctccaataattcaatttttgtaattaaaattttatatttttgtgttcttatagtcctaactttgctctatttaatcactatttctctggctctgtatctcttttatttttctttaaatcagccatcaaaaataccgacctctaaaatgaccatttttacttacttaactctaactccctaaatacttttccattggtattgatctcttgccagaataatggcaacatattattgataataatggcgggtattttgaatcatgattgtgttttgttgaaattaaaaaaaaatttttaataaaaaaatttgggtatcaaaaattatgttccaccctaaagtaaataattattcttttctttttatcgtgttcttctaacaaccctctttctgtggaccacgatctatcatttgcatttttaattcaatttagctttttatattcatcaaaataaaattatcttttttccatttattctaattttattaaatctaaatcaagaagaaatcatttttagactaccatttaattataaaatttttattttttttcaaacagattcgtattaattttaatactttgaggttagatttattgtttattatttatacaactagtccacttacgctccaatcataaatccgatcagacgcacaaaaatttggcggctatataattgagggtatagttttaaaaaatctccagattcgctaatgtaaaataaaa

SEQ ID NO: 17631 - DNA, 1860 bp, Heterodera glycines
  misc_feature (880)..(880): n is a, c, g, or t
caaagtgtgccattccttctgtttaaattcatgggataacactggtacaaaaatgacgagaagagcttgcaaaattcacaaacaaggaacagaactttttgatctctaaggaccgaaaaattttcaaaaatttcattttttgggttttttcaaaaaatattaataaaaaatgtaacttttttaaaaaaatggaaattatggaaaatatgtccaaaaattaaaaattttctattttactcagattcttcaaaattaataaattttagctatatttttgcatttagctattttcgagatttttagcttaaatttaacgaatttgaagaatttgtgaaaatgttgcccaatttggaaaaatttaggtatgtgcatattttttactttttatgtgcatattttgaaaatagtctcacaaatcagtgtcaataaaaatatttaaattgaattattttaaagctattttttaattgaatattaataataattttaaattttcaaataacaataatgtaattcgaggttcaacttttcttcaatgttttttaaatgctagcttcgtaccattaataaatgcagaataatttttgagtggaaaaagaatagggatgaaggaaaatttatgggaaaatgcatgaaatttatggggaaacgaatgaagaacttaaatttacgaaaatattgggtgaaatttcagtagaaaattagtaatttgtttttttttctaaaattgaaaaatccactagtaagcttacttgcaaatgaatttgatgggttcatgatttgaaattaaaatttttcgtttccatgtaattttttttggtcggagatggaatgctttttctcttttttattttattttttaaataatcgtctattaaantttatggcgctactttaaaagtggccgtttttggaaatttttcaaaattttttttacacatttttttttgtttgtacatgcttttaaactctttttaagcaaatgttaaagtttccagaaattctatcattcatcccagcaatctgccggtagggctaccaacattggacgaaataaatttgagatggattttgcacaaaattctgacgagatgttacaatttttggtggtttttcaaaaattgtgactcttcctgacggcacccaattcaatgtcaacacgaacaaatgtgaaggattttgggcccaattgaagcagaaacgaaaagaattcatggcacaagcattaaattgtccacatcttatatggaagaacaagtttttagattgaatgctagagctaatggaatgtctgtatttaaggcttgtgttgaattgttgcattgtaattataattttaatgattaatcttgttaattttaataaaataaatttaaaaaatgtgtaaaaaaaattttgaaaaaatttccaaaaacggccacttttaaagtagcgccaaatttattatttttcgacaccgatttgaatcgtataattaaatttaaatatttttcattttttggcacatattttagcttttttttgagttttagcacatattttggggatttttggcacatatatatgtacagatttggcgtttcttagcacatataaatccgttccctgctaattagataatttttatggtattttgtgccttttttcaagaaaataaccattttaaaaatttatttacatattttttgtacatacttttggcagccctactaatatgaatgatgctttttggcaaaccaaaagaatgccgtctaaagttttcagcagaaaaacagaagaaatcactaaaatgattttacacaaattttttgatcggctgaattttgagtttaaaatgaattcgccagaagaaagtgccga

SEQ ID NO: 17632 - DNA, 1105 bp, Heterodera glycines
tttttccttaaaagaggataatgtttgatatccaacaggagtatttcctctgaattttaaataattgaaggctggaagctgttgaattttgcaatatatgcatagacttaaccaattttttccaaaatatttgtctacaaatgctaacatcggatatgccattctatggatggcacttttccgacaaaaaagcgtatttaaacaatgcgaataagccaaccaataccaaccaattagcatcattaatttattcattaaatcagccaaagatccttcaaatatgtcttctccttcttcgtccgtctctctgcttgccatcgtcgctattttctgtttgctgtgcaaatgttgcatttcggcaccgcgtaattaatctttcttactagtaattaactgtaattaataattaattgcttttcaacagatccgtgctgtcccggcagtcaaaaagtggtttcgctgatggccaattacgttggcactttcgcccattccttttccaagtcatcgctttgttcggatgcccaaagtgttgcgggcgcattgaaaggccaactgatcggctgctcgaagggcggcgacgcaactcttttggccgacatcgaagcatctcttgccactcattctgctggtaatgatggactaatggatcaaactaattgccaaattagccaataattattttatttattttaattattttgatgtttttcttcccctttttgatgagtgtgcccacagcctcggcttcgtccgtgccatgttcgccattgccgcctccgcttcttcccatgccagcaacaacaacgaatggcaggcattgagtgcccagtttggtcagcaaatcagtgaaattgactcgaaatgtgccgagtttggcattggcattgccaaagtgccatatgacggccccaagggtaaaactaataagagacaataattcattaattatgcgatctcttaaggtgatcactcccaacgaaatgtgcatggcacggacagtgtaattgccatgcctggattggccggctcacacaaacaatgaatagaatcaatgagtcactgaatggaacgaaatgattgtggagttcgtttttgatattgt

SEQ ID NO: 17633 - DNA, 2561 bp, Heterodera glycines
  misc_feature (291)..(291): n is a, c, g, or t
ttttttttaattttttattaattttttttattttgccaacaatttatatgaaatgtttttttgttccttttcatttcatttttttgttttgtcactttatttttaattttgaaaataaaatgtttccggtcaaattttggtttttcaaattgcttttcaaatcccatccaactccattgatgccgtcattaaactgctgaaggatgaagctgaaaaaggagaaaaaattatttttaacaaataatttgtaatttgcgggtttttgtcgacttttacaaataaaagaaatgnaaaattctttcaatgggttttcaatttttctactttcagtttttttaaaggaatgtttttttttgcacccaaaatggcaaaaagttgaacctggattttttgaaaaaaacacaatctctaccgaaaaaaaaccgacaaaataaatgttctcagaaagcatcagctgctgtcgtgtaaaaatagcgcaatggttaaagcgcgccacagaaatccatgattgcgggttcagccccacgagcacgcatttatttttatttaatttgacatgtttccacacagataattcaaataattattttttggtaaaatacctaactaattaaccaaacaataataattaattacagttaattcgaggctcggattggtctatcaagtaatataaaaaaaagttgcgctatttttttattaattcacaaataaaaatttattttataaattcttaataaaaagagaggaataaatgattttaaagagcatctctgctgtcgtgtaaaaatagcgcaatggttaaagcgcgccacacaggtttaatttatcgcgggttcaattccgtctgcacgcagttttttaatttttaatttgatgttttctcgcagaaaacatcaaatatttaactatgtaatgttctcctgtaagccttgtttttcctagacctgaattttcttggaattttgcctagtatagaacccaggtccaggctgttttcaaaaatatccaattaaaaaaaaatttgcaatcaccctgcaacagtctgtcgactcgctccagaatttgcatcttttggctgcccgaatttggcatttttgtcttggttgttgcttcatctgtggcattttgttgcactcggctccaactttggtcaaattcaagccgataggcgccctcaaaatgcatttgtcggcacgctaacgcgcactctccgccccattcatcgggcgaaattagggaaaagaaacggcggcggcactgctgttcttggcatttttgctgtggtggttcgccgtcatcggcaccagcaccaacagggcattgttggtacaaaaaatagacctgaaaacaaaaagaataaggaaacaattattgaaaaaattatttattttttagaaaaagaaaacattgtaaaaaactggagccagccggacgggggcatgccgcccaaaaaatgaggggttttatacacacattttccaaaattttggacaaaacaaaaacaatgaattagagacgctttaatttttcaccagaaattcctcttgtgcttgatgttttttaaattctaattttgaaaacggaaaagtatgtaccaaacctggacaatattttagtttgattattccaagtgacaaatatttttttttgagttaccaaaaaatggttaaatatgtaggtttcaaaacattatctctgttaattagatgtttagcttttccgcagcaatgaaatgattttttttaacattttttttcttttaaacaaattccaaaaaatccagctccaggcctggggatcaagcccatgacaagcctttcgagaaatttggacctctattttatgaatgtattttgattagcaaaagtgccaaactcaacttgcccggcactttcttcactttgcattcaacacaatgcagctcattgtcatgttgcgcttttcgcagcacttcaatcgcttgctaaacaaacaaccgtttttcaattatttatgccaaaaaatttttgagtcattggaatcccgattttccacaatttttttaggcttcggcacttatccctggtcccgatcatttccccccaaaaaactcgggagtcccgagaaatcaaaaattttttgattgaaactgtcataagaacttccgcccgtccgacgacacacttttcgcagaaattccatctgttcagcgatcatttccaactttccaaccgcctgacatttcacaaaatcacgcgcagattgaattgaattggccaatgccaccaattcgtgggcgtcagccaatggcacaacatttcttggcgtgatttgaactgccgagaaatatgtatgtatttttttgtttttgccgatttttttacctttattttccatgctttttacaacatcaagccgtgttttgctgttgttgtcaaccatttttacaataatattacagaattttgattcagctgaaaattaaaaagaggctgcttaattttctgattttcatacatatttggacacttttttatttggggtgaaaagatgaaaaaaaaaacaaatttttttttatt

SEQ ID NO: 17634 - DNA, 1356 bp, Heterodera glycines
ctcctccatctctaaaaaaaactcccccccccctccctcaaaaaatttttttgcatcactccctcaataaaatttcatttcccactttttaaaaattaaccctcaccctctaaaaaaatttcccaatttgccaggtgttggatgcgcgtgaccccctcggcagtcgcagtgcacaaattgaacaattggtgctggacagtggcaaacgcctggtgctgttgttgaacaaaattgacttggtgccgcgtgacaatttgctcaaatggttggcccatttgcgtcgccaattgcccaccatcgcgttcaaagcgtccacccaacagcaaactcagaagctggtcggcaatttatttaatttttaatttattggaatttgtgtgcattttattgcgggttcacttcattcccgcctcctccgcttgaaaaaaattatttttaatcaatttttcataaaaaaattttcataaaaattcgagaaaacatttttctagcgattccttttaaaattttaaaaaattcgtggttcagcataaaattgtgaggaaacgctataaaactttttcaattttttcttcttgcaattataaaaaaaaatctatgattaatttaaaaaaaaacaacaaaaatttcggcggcgagatttatttgggtgcttttttggaccaaagtttaactctttttttgtctctctctctttctatcttttttggttaaaaacaaaattttttttccttgtttccagggtcaataccaaagtgccaatctgtccggcacattctctgccaaatgcattggtgcggatttggtgatgaaattgttggccaattattgtcgcaacaaggacatcaaaacatcaatccgagtgggcattgtcggtgagaatagccattatattttacgcattttaaatttctcgaacgattttattgggaaatttttttgaggatttccaaatgttggcaaatcgagcgtgatcaacagtttgaagcgccggaagtgttgccaaacgggtgccatgccagggttgacaaggtaagcaatttgaacaaaaatagtgccgacattttgctaaaaattattttcggtcggcacaaaattgcctttttgtgttgttttgttttaaaatatccaattatggtatttattatgaacttatttatacaaatacctcagaattagtagaaaactgcaaaaaatatatgatggagaaggtttattggtgccaaaattttgaaataaatatttgggtctgaatttccgacacagtccagtagtgtcttgtccaaatccgccaaaatcggcatttttccaacaaaaaatggaataagtttcctaaagacaaatgttttaaataat

SEQ ID NO: 17635 - DNA, 2814 bp, Heterodera glycines
ttcgcaatcaacgtcacttgcccaaggttattttattgtaaaatgcaattaccaaatcttttatttgttttttttgaaagtgtctcaaaaggaaagaaaaaacgcggaaaggggggaaatgtgtcgcaaaaggagggccagcagcaaattgggtcgggcagtgacagcgaagagggcgccgtaggggcaaaggcgagcggcggatgcatcagagagaggggcggcagcggaaattgggtggtttacacaagcgcattcggatggaagccgagtggcgagcagcggacgcaaattgcgaaggatccgccgcgactcgtccacggagacatcattttggccaaactcaggccgggccaggagatcgaggcgaggtgggtcggcaaaggggatggactcacccctttacgatgactttgccattttcagttgtcattgtgtcaaaggaattggcagagaccacgccaaattttcacccgtcgccaccgcaacgtacagactgctgcctcagatcaaactgaaaaaggacaactttgatgaggagcaggcggcacgactccagtcaagtttttccactggcgtaattggaagggacgaacagacggggagaggtgagagagaagggactgatgtgaacgtacaaagggaagagacgtaaaagaggtgcacgtcccccccccataaaaaatttaaaaagaaattcacgttacaagtgggtgggacgaattgtcgagtttgagggggcaggggacgcatgtcttggagaatacgacgcttttcaaaaaaacaaagaggggtcttttgaattttatcaaaaacaaaaggggggccttttgttttgcaaaatttttttatgataaaaaaacccatgaaaatttgttatccggggttttagagggtcgctgatcacgaatctgacatctaattcgaggtcatttaccccaataaccccattaaataaattttcatgactatatattaaaaaattttgtaaaccaaaagggtccccccttttgtttttactttttgataaattcaaaagactcctctttgtaactagcgccgagaatactcaaacaatgaattgtctttgtttcccagtttatgtgcgggatgctcgcgctgacacttcgagtcgcaacgtgttcatacacgacgacctgaaagatgcggtggaaatgggcaaaaagaaaacacatttcatttgtaaggcgaacaccaaactatttgcactcaaatgctcataatcactttctttagttagcgttgaatcggtcggcgcattgccttctcacaaattggtcattgaagcgtgcaaagtgatgagggaaaaggtggaccatctgagagagcaaatcagctcaagattagaaatgctatgaaaacagtcgagaattcgttgttgatttattgtcttgataataaaagaaattttcagtgctttcatacaaacagagtaagggcatggttttaagggaataaaactagtccattttgaattcactttctggtattagaaaataactaaaaacacatgccccaacaacagtatcaataataaattacaatatgcttgttgagcaattacgatgaagtttcggtggcatttgcaagcctattcaatgcttccgtccttgagattgatttggtcatgtcttttttctgttctttcggctgactgtcggtcatcaccacacttggcatcattgggttaacgacggcgctttcacgcaacgcacttttgccttccccagaccatgggaaagtccaatttcggtcctgaaaatgatgattagctttgttacaaatggtcgatggttgcccaccctccgcggcattcgcatttcgtcctgcaattccgtaaccagcacattcagtcgcattatctcctggctcgtctttttgctcagctctctcaattcctcggcgcttgccaattccttctcctctttgtgtgtgaaataggaataagcgtaaaacaccacgacagtgtagccgaaaatggccacttgatggatcacttctgaagcctgaactgaacggatgctggaaattatctttttaatttaaccatattagctaattggtggcagaaatcacccccccccccaaaaaaaaaaatcagattatacgttaatttcaaaatggaggagcccatggtgacccaaaggtgtcatttaaatgtggacctgttcaagcgctgtctcttccgatacatttaccactgaagttggtgagccgaggtccaaatttttcattcgcaattttgtggaccaatttgtgatagctgaaattgacgacgattattctttggaactttctccggtgcacacacttttccctattggtattaacactctgttccgaaatgccgggtgttctttccccaatcccataaaatatccagtgatgggctttgacaactgtctggcgacgatcatataaatttggataattggaagacccatcgctgttaacaggtcgctaaaaaattgaaaattaagcaacaaagaaatgatttttactaggtcgttgcataaaaaagggcgcttttttagaaaaaaaattttataaataaaatatcaaaaataataatcataacaactgtaaatacaatatcactcaacaaaatagtttccctggaccctaacaacctttctccaacgagaaggaagtttcctaatgccgcgacggaaaaaatctgtgccgatctttgaggtcaggtactgccccaccgcctcctcgacctcggcgtcttcagtgaagcgcctacccagaagaaagttttgagagaaagaaaaaggtggtaatccgagg

SEQ ID NO: 17636 - DNA, 1280 bp, Heterodera glycines
ggcgtcagcaagttgaagactttgcaaaccactcagcgaatggaatacgtggcaagggaatgaaacgcaagcaaacttatgtggaccaagacatgaatcttaatgagttatacgtcacgcgaaacaatcgccatcctctgcaatatttgcgcgcaatttcccaccgaatggcagaacctctttaggacaaaaatcaatgattttttatgtttatagtttttaaaacgtaactaagaacctctttaggaataataattgatttatttttcatttttaaaattaaaaataatttttaaaaatttaattttggtgtcgtattttccgggtgtcgcattttctgttttttaaaaaaaatttacggtgtcgcattttccgccggtgtcggattttctggtgtcggattttcttggtgtcgcattttcagggagccatctcgacagtgttggtttcgacagtgattgattttgacagtaaagtttattttttaaaaaacttattctaatggtataagagggtcaatggcaactcgtacaattggcaactcatacacagtgcaactccgctgcccgtcatttcgtccccgcgtcgtttcgtcccctaagccaaaatgagtcgtttcgtccccaaattaaattatatttttaaaaggcattacatttcgtttttagtgcctattttggcattttttagagcctaaaaatccgatcctagttaatgaagtaataaaatactttattaattgagcaaataatataacataattgaaataacatagatcaaacaaattctaaggggcattcatcgaatcttccagattttcatagtccttcaattttctgtgcctggctgcaatgtcgtcgttgatgatggactcaatgagtactgtaccaacggcgaattttgctccactgtcgacggccatgatagtgttgagggggcgggcgagtcgatgccaaattgcaagggctgccgtgagtacgtatggtctgatccaacggacgaaaatgatgtcccagcaaacgcttaaaagctaattaaagaaaaataaaacaaaatgaaaaaacggacacgaaaatggagaaagaccaccaggacgaactccaaacgcattgtcaccgtcaacaagctgttgctgcgtcattccgatgtacgtcctcgcaaagcagagaacaaactgctccatctccataggggcggtgccgacaatgacgctgaatgcacgactgacgtaagttggcggcaacaatggcaaagataggacatttctgaaaaatttatga

SEQ ID NO: 17637 - DNA, 1345 bp, Heterodera glycines
tttagataaaaaaaatctaaattgattttttagcctagaaaaacttttaaaaaattctttagtttttttacgaatttttcagctgatttttttaaatttcataaattttttgaaaatttaggtgttaaaagtttggataaacttatttgttagtgaacgccccgtgaaaaaatggggcaaattatataccaatcgattcgtctcgaggagctaagcacggaaaaatatgtctcgagttgcggaaatgtttttgaaccggtttaaaactcgaaaatttgagtgaaaaggggggttcctgaccttttaaaacgctcaaattcggacaaatttagtatcattcgaaagctcttgatgagctaagtctaaaaaatagagtgccacgggaccgggaccgggccgggaattcccggtcatccgaggtcccggttcccggtcccgggttttgaaaagctcaggtcccggtcccggtagggcaaccgggaaccgggaaaaacaagcactggtaagaatggggtctgagtgaaaaattagtgaagaaaattggagtaaaaggaaaaaatttagaaataataattaatatattctttaaaagtaacactgcccaagtgtgcaaatggcctaatggctagtctccttgactttcccttcttccttcccctggttcaatccctctacaaaaattagattattttcatcctcgatctgtacagacaatttcggttctgggccaatgccgtcgcaaattttgattgtcctccaaattgtcaattctttttttccgtcaaaatgtttgtccaccaaagcatcgtaacggtaagaaagcaatgcaattttgaggccaagttcagcacgttcaaaagatggcagaatatccatccaaacgtcgccacaaatccaactgaaatgcaaacgtaaaaaattacttaaaaagagaaaattggcacttttttatagtttaagggcccaatgtaaaacaaaagtagggagtaggtaattttgaaaaaattacaaatcaaaagcctgaaaccgcaaactcgtactgcgatttgaggtaaatttctgttttttcacagtacgcaaaagttgtgagcaaatttttaaaatttacaaaatcaaaagccggaaacccaactcgtgccacgatttgagacaaattttttcaactttttgttcgaattcaggtccgggattcgaaattgctcaaaattaatgttggattcgggttctccgactcagaaaaccacatgaacatgttttcacgactttttagaacaaaacaaaatttctttcaaaaaggggggccaccatctatagtatttactagagaccggcgcgggacgggatc

SEQ ID NO: 17638 - DNA, 2411 bp, Heterodera glycines
  misc_feature (2406)..(2407): n is a, c, g, or t
ccggccaagtgattttaagtgcttttttggtgtctttttctggattttgtaatttctttttttttaaataaaaaaataccacaaaaagcacccatctaaaaattggcttaaaaattagtcaacaaaatacactcctaagaagttatttaagatatttcctcgactttttcaatttttgtgtctttttatcattttcatgtctttttcattattttaaaatttatgtgcctaaaagtccgctcacttatggtaattaaaaattatatattttttaataaattaaaaattcaaatctaatatgttcatcttttgcttttactttattttctgagctgctggaggatgcttcttcttcgttgatttttataaggtgagcatagcccaaaaaattatatgtcaaaacattggacatattttgtcgatttatatgaattttggcatacaataaggcatggtaattggccaaatcatttttcttgtccaccaaaattgtgcgattaaaatacaattcgggtgggtcaattttgcctaaattgacggtgtacacctttgccatgtttgtccagtacaatttgaatcgaattcttcggaccattgttcgaatgtcttcatcatccggttggttttcattattttcattcgccgacggttggtactcattttccattggtttcactgaaattgcaaatgtgagtgaaaatttctccactttggcctcgtcctctggctcaattaaaatgccaaaacactcgccattttgaaaattttccggcaaatttttaatttctttaatttgattgtttatacgaaattcttccaatgcaattttggtttctcgtttcgccactgttttctcatatttgacacaaatttgtaattgttctgttgtctcacaacagcggaaaaagacattgggaagaacgaaaaatataaaagtaataatattaatacggtaataagaattgctttccatctttattcaattaataaatttttgggtaattgttgaaactaattatttgaatttcttaattttttaatgaatttttgacaatacatgataaaacaacgaaatatcttttgaagctatcaaaggatatgaaaatcaaaaaataaatatttttcagtatttttttaaatggtgatattttttaagtagaccagtaaaggtgttaaatacgaataactgaaaattcttttggtacttttctgttttgtgaccccacctgaaattttcaaataaaaagtcatttctagggtaatttggggcgctgatcacgaatatgacatttatttttcaatattccgaatcccgaacccgaattcgaacataaatttgaaattcataaattacaaggaaaacatatttttatgggttttcgaggtcgctgaatacgtactgggtctatgcctaagcctaagctgaagcctaagctgaagtctaagcctaagctgaagcctaagctgaagcctaagcctaggcctaagcaagctgaagcctaagcctaggcctaagcaagctgaagcctaagcctaatgtgcgccgcttgcttcgctccggtcgcaccactacttgccctcctttctccgcgtgctggccattggcgaacgctcctcggcctttaaaaaaataatattaaatgccaaatgtggtcaaattaacataaatatggaagggaaggccccaatcgttagttttattttgcttccgatttatgttttccttgtaatttatgaatttcgaattttggttcgaattcgggttcgggattcggaattatgaaaaataaatgtcatattcgtgatcagcgccccaaattaccctagaaatgactttttatttgaaaatttcagggggggtcacaaaacagaaaagaaccattctttttaataaaaattatcaatgcgaatgtcctgcttaatttgtgccatcgattttatgtgcatttgttgctttaggaaattagccgttaaaaatcgatgccgtttaaaaaaatacaaaatatttttatcataattttatacaattaataaatgtatgcacattatagttgtataattccggaatattgaaaatagaaaattagccgtgaaaaatcgaggcaaaatgattgtaacgggtttttgaataacagatcactacaatccaaatattgtaaaggatagacaatacaaattaaacatctttttcaaattcaaggactcaaattggaagattctaaacgattttcacggcgccagatttgtgctcaaagccaggcacaaatccaaattcagtcgaacatttcgttgcacttcgtgagcattcgctcattgtttgtcttctcatcttttctttggaggatttgccttagggccaatagcctccattttctttcgttgcttgcttgggaagatgtggactcnntaga

SEQ ID NO: 17639 - DNA, 1217 bp, Heterodera glycines
acgggtgccacgcatgcccattcgccaagccctcgctttccaactgagcacgggtgccacgcatgcccattccaactgctcacgggtgccacgcatgcccattccaactgctcacgggtgccacgcatgcccattcgccaagccctcgggttccaactgttcacgggtgccacgcatgccattcgccaagcctcgggttccaactgttcacgggtgccacgcatgcccattcgccaagccctcgggttccaactgagcacgggtgccacgcatgcccattccaactgagcacgggtgccacgcatgcccattccaactgctcacgggtgccacgcatgcccattccaactgctcacgggtgccacgcatgcccattcgccaagccctcgggttccaactgctcacgggtgccacgcatgcccattcgccaagccctcgggttccaactgttcacgggtgcacgcatgcccattccaactgctcacgggtgccacgcatgcccattccaactgctcacgggtgccacgcatgcccattcgccaagccctcgggttccaactgctcacgggtgccacgcatgcccattccaactgctcacgggtgccacgcatgcccattcgccaagccctcgcattccaactgctcacgggtgccacgcatgcccattcgccaagccctcgggttccaactgttcacgggtgccacgcatgcccattcgccaagccctcgggttccaactgagcacgggtgccacgcatgcccattccaactgagcacgggtgccacgcatgcccattccaactgctcacgggtgccacgcatgcccattcgccaagccctcggtttccaactgctcacgggtgccacgcatgcccattccaactgctcacgggtgccacgcatgcccattcgccaagccctcgggttccaactgctcacgggtgccacgcatgcccattcgccaagccctcgggttccaactgttcacgggtgccacgcatgcccattccaactgctcacgggtgccacgcatgcccattccaactgctcacgggtgccacgcatgcccattcgccaagccctcgggttccaactgctcacgggtgccacgcatgcccattcgcaactgctcacgagtgccatgcatgcccattcgccaagccctcgtgtcccactgctcacgggtgccacgcatgcccattcgccaagccctcggg

SEQ ID NO: 17640 - DNA, 2258 bp, Heterodera glycines
  misc_feature (30)..(30): n is a, c, g, or t
  misc_feature (34)..(34): n is a, c, g, or t
  misc_feature (37)..(37): n is a, c, g, or t
  misc_feature (39)..(39): n is a, c, g, or t
  misc_feature (52)..(52): n is a, c, g, or t
  misc_feature (54)..(54): n is a, c, g, or t
  misc_feature (2248)..(2248): n is a, c, g, or t
atgttggggagtgataaaagatgattaatngatngantngggattgatcaananatgtgtcattttttaaaatatccttttcttaaaatgtaatgtaagaatccaccttcccccagtgaaatttaacgaattcaccaaacgggtgtgtgaatttcaattgtaatttctgaaattcgtttcgattgtagacgatgaaaatactcggtgctatatatacttcactaatcgatcctgggtcatcgacgacgttaactattcctaagagtggagccatctggttcccgataattgtgttttcgattaaatttggtgcataaatgtatagctgccttacacctcccgtcaaatccggcatataagtcgcctcttccgcgtgaaatagccttgtattcttaaatccgagcacataggctaggtgttttgacaaatctatatgggagacagcagcggaaagatagacaataaatttttgatcaatgctgtcgtagttaaattgaacatcctcattggctaatctctctcttttttgtggtcctttctcagcttcagatacttgtctattttcaatatctttacgtttaatatgctcaccgagcgcctcattaagcctattcactatcccgctaaaacccttttccgatttatcattatatccctcgagagttgatgtatatttggtctttgcctgtctggcgattccctttgcgacgtcggctgatttctttgcttttttcaagtcattcttttccacatgctccaatgttatgtttttggctttatctacttcttcttgaaaagacttaagttcatttcgggatgtttgaatttcggttcccatctcaaccattttgtcaaaccaaatttttatatcaggctcttctaaaatgtgaggatttgtttctcgtagtgtgtttagttgggtttggatggaattcgagatattgttgatctgattaaaatgtctttctacgtctctcccggcgcgttctgcggccctctttgcgacatcaatttttgaatctttggtatcttcagccttggcttctctctttccacgttgttttttgattttgtaatgatggctgaatgcctcgttaattttatttcccaggcccccggcggttttaaaattcatgtccggtaaataaacttgagtcgggacactgctgtcgttttcccatactttaataaactcttgaccgtttatactgagtgcggtgaatgagtaggggtaaataattgatgagagagctactgaccaatttgtgcccaattccaaagtctcggggagtcgtactgtgaattttgatgtaccgttccctggtcccggtgtgttcgagggtagcacaatgtaaggcatccatctattttcactaattcctggttatataatattccttttattaaatttccttccaaatcttcgatcctgtatgaatctggtgtcgtcgaattggcaacaacaattttaaacaattcttcggtaaagtttgggaggtatccctttgaaaattttcccttttccttggtaatacgaacgatatcaccgattttaaattttttcttttttaaaattttaaattccctatccttatataatttttcccagagcgcacgggcattttcaaaattaattgaagacggtttggctcccaatgttctattcacactgttgttaatgtttgttattattttgtctattacgtcgacccatcgaagagtgtctttctttgtaaaatatctgtacaagcgctcctttattgtccgatttgccctttcaacgactccggcgtgcagatcaggactatacattacatttttgatgatgaatttttcctcaaaatattttttcatttttcctgcttggaattcaagcccactgtcactatatattttcatcgggataattttagacttttcgaacacccgatcaaaagcctcgatcatgtcctcactcttctttgacttggccggtgcactgaagatcattcgactcagcacgtcgatgcagaccaataaatatttataaccgtcgttatgctttttcaactggtcaaatatgcacaaatcgcactgccaattggtatggaagccacttggtatcgtctttagtctcgggaatcttttcctgatgggcttgtgaatcgtgtatgttttctgcttttttaggaatttattaacgtcatcggttgtaattttcgggtcaatctttttgaccgtcattaaaaattttttgaattcccagcanaaacttgccg

SEQ ID NO: 17641 - DNA, 1104 bp, Heterodera glycines
aatagtgacattaggccataaaattttaaaattatgggtttgtttaagaaatcagaacaaattttggtcgctaccccaaaatcagaacatttctgacaaatcagaacagatccgaaccctgatttataaatgcttttctataaattgttaaaatctgatattttaacttttgcctaatttttcagaatttttttgcatttttttcgtgcttttttggcgtttttgtgactttttttggtacttgtgtgttatctgtgggccgattttcaaaaatttttatgtttttcgctataacttttttctttggcatccaaatccaagattgttgttataattcgaaagcttaacatgtttcgaatctaattctattagagtgccacgggaccgggaattttgggcaaacccgggaccgggaccttttcgagttgaaaaaccgggaatttttggctgggaaaaccgggaaaaaaccgggactagtcccggtcccggtcaaaaccgggaccttggtactcagttgtactcagttgtccgctaccaggtcccggtcccgtggcactctaaattctatgtatcacttcgcgattagacaattaccaaaaaaagttatacatgaaaaacatgaaaattgcgaaaaggtcgaaattatgaagttttttcttaataaaattttttccaggctagaaaatcatttcgttttttgtaaggctaatagagcatatgaagagctttcgaatgataccaacaatcttggatttggatgccaaagaaaaaagttattgcgaaaaacataaaaatttttgaaaatctgcttgtttgtaatacattgtaaattgaaaaaatccgcttattgtaatacctggcatttaaaaaaacgcattagtatatttgaaagatggatacatcgattattgtaattacaactcgccttttgtctccttctccccttgctgcttttggtgtttttgttgtcccttcaattcaccgattcaatcaaaattgccttttcagtaatacataacttaaattggaacaaatcctattaatatttgacagtaattataataataatgttacggtaggtacagtaattaaccattgctcatt

SEQ ID NO: 17642 - DNA, 3454 bp, Heterodera glycines
atgtttgtggatcgtttgttcccccttgtgaattctcatattcgctcatctatttgtcgaactttctacatttggtcggtgcctaatcccccataatcattaattcgtatttaaattaattccgtcaacaaatttcaaaatagaggaatgtgcaccgacaaatgcttatgaattcgtttgtgaaagttttttttccaatattttttcacgtcgacgttttgtcccacgatgtttcggctggcgacatttttgggtgtaccgatttaaataggagcaaattgcaaataaacatggggatgcgtatgttcaaaaaaaacaatttttgttttcgaaagggtctaaccatagaattctgaattttccgggggattttttattggtaaattgactcccataaaatggcgaccaccttttttgatgagcatcgaaaatatgcggttggaaaatcagaagaagggcatcaccgtctcgcgttttgtttctccgccgcttcgtttggtcccttcgtcctccgttcgcttttccctgtccttcttctttttcttcttctccttcttccgctttttctccttttcgcgtcctccgttctcttcggctccgccgctttttgctttcttcgcttttcgttcgacttctgttcggcaaattcacagtataacaatggtctttcattatcataattgcagataccatccaatgtcagttcgtccaatgaccgtttgacgcgctttcgctgtcggcgttcgtcggtggttttggcctcggactcaaattgtgtcgcagatgctgagtgggacagaaatgccgtcgttgtgctggtggtgctgctcgtcggttgctccggcaaatcgaagaagcgattggcgttgggaattgggcctaaagaactgtgtcctctaagagattatttacttccattgtcaaggagatttgaattggtatattcattcacttgtcaactcttgcactgacctggtgtcaatttaaatccgaccatttggctggcattcaaattgtttatttctcgtcccattattggcgggtcttcgatcagtttccgaagagaactgaaatatgtttggaactgaattaacaaagcattatgatatgtataaacaaaccattgcgaatccgcctttttgtttatgtgcgaaccggcacaaacatgtggcaaaaacgaggcgaggtcctctcgcggcttcttaacaccacagtagcggttgtacgcaccgctgagatcgaaaagagcgatgagatcgtcgcttcccaacaactgactctgagctaaagcgatgtgggagaataagcaaagaagaaccatttgaatgaatgcgtatgatggaaatactctcataatgcaaatttataattttttatcccaaagttacggggaagttcgggcttcattccataaaaaggagacaccagcgaaagttgagactgactgcctttgagcgaaattttagtgcgcaaaaaaccagaggaaatcccgctagcagcagcagcagcagcagcggcagcggcttgttgttggtccatgtggacagcacacttcggagttcaatgttttccaaaaatttccaattccgtccttattcttttaatctaaatttgaatttacgtgagatgataatgattaggtatttataaaaatcttaattttttaattctctaaaatcggaatttttgtgatacttgatgaaaaaccataaatcatagacaaatgatggcttttgtaaatctacacaattgccggaataagcacaagcatcaatatgggtccgctccagggatgcgcgggatgccgatttcgatttttggactcgggattaatttctgattgtcctcggcatacatcccgagaacggctgtgaagcacaacaaacacaaacaaataatcaaaaaacaaaaaataaaaataaataaatgcgccaaagcaaatttacaaattcctgaatctgcttattgtgtgcaaaatctcgtactttcctgttttgaggccacacccaaaattctattcttatgtgaatttctctgtcgtgaagactgcaaacacagagaagctgatcaatttgagaaattttgatctgcaattattgaaatttgcctcctcactagtgttacgcgcgacttgtttattttgcgcgcccttttgttgactttttaaaattgggtgtggcctcaaaacaggaaagtacccaaaatcttttttaaaccgtcaaagttagccatttcacagtcatctgagtaataatttgtcccattagaactcttttctttttagatttgtctgatttcaaattggattgaaacttgagagtgccgatcttaatcgaattttgaagataatttcagaattcccatatattctttcgtaaaatgccccaaattttggatggaataaagcttgactttcgtgatgttgtgagtttatcttatccattcatttcttaatggaataaatttagttgctaatgcccaaacgttcacagctcgccagtcgttcagaagttgacttgaacagagagttagttagctatactgcaaaattacatttttttcatgccttttagatttgtttttaagaactcgaaagcgacgtacacgggaattccaataattgcatcggtgggatagctcgttccaatgttatcagttttgggctgcttttatagaacatggacacagttggcacttttgaaatggcggaaacactcagccaatccaatttgttcactactggttcgaccccttacttttaacattgtcttcttcatttttagtacacaaacattacagtgttgaggaatggaaggaatttgctaatcgcgtcagaaacaattcgaatgtacagtagtgaatcgttttattttattaagggggcaatttcacatgcatttttagcattggaaattttttgtttaaaaaatcgcattcttttctttgtattgctagataagtacatgtaaagcggattttgccttctttaatttggaaattaatttaaggtgctcaacaatatcgctatttcgtccgggtcgcgttccgatgaccttaccaaaatgcgtgacatttgcgacgccgtgcccgaaataaaattcatttgtctcgacgtggcaaacggttatagctttattttttcatcaacattcccacttttaggctattctgaaactttcgttgactttgtgcgcaaagttcgggaggaattccgcacctccacaatttttgctggcaacgttgtaagttattttttatttggcacttttttgtcccctttttgattggattcaattcgggactttgcgagaaatgatggcttttttttaggttaccaaagaaatggtggaacagctgattctgtcgggtgccgatgtggtcaaagttggcattgggccgggcagtgtgtgcaccacgcgtaaacaggtccaaccaacagcaccgtgcccaacta

SEQ ID NO: 17643 - DNA, 1775 bp, Heterodera glycines
aaacataacgaaattttacgaaatcttgtagcttatagtgaacagtaagggctatcgaatgatatcaagaattaaaaattcagttgcttttcagctaagttataaataattttttatccaaatcataatgatggtttttaagtaacgattccgtcccctattattgggtagttcccttgtttaaagttttttttctgggccacgaaatggcacttctcccccatttgccgtactaaacataaagcttcttattaccctataagctgggcactgtgacgtccggccttggcaccgctcttggccgttaccgtaccacgctagcaagtggtactgctgggactggtggcaatgatattgccagcggcacagcgttcgtcggtccaacacttggccatgcgatggggctgctgatgccacgagggggcgctgcggtgccatcacgcagcggtgcagaaacgccgaattctgcgcacaaagtgtcacagtcgataagtgggcaaattttatttctctatttcaacatacaattaaatgtaatctaaattaataaatatatttatcaaatttcaattaatttctctattggtttggcgcataactattatcattttttttgttaaaaataaaaaatctcaaaaaatattgcaaattagcttaaaatgtttgaaaatgatatttttcaataattaggtttaaaatcagaaaacccgagttttacaatttaaattcaaaccaggctcaagaattttttttctcggcacttttgaaaattggccaaaacttttttgtgccattttgtagaggacaaataaggctattaaaatgacaagaagcaaactaaacacaaaataaccctttggaaaaaccctgctataattatttactgtccgttattattttgaaaaatttggcattttgaaaccccagtccaagaaattgatcattcaccaatctccactgatcagatgaagaagcgtcggatgagctggaagaaagcagcgatagcaatagttcatcttcatccaccagtgatctgttggacacaaaaagttttgtcagtgccaacaatgaatcggatgcaacaacaacaaatgctggagcagcagcctcgggcaatgccaacaacaaaaagcatacggttggcacagtgccaacaacaacatcaccaccaaatgccataacaatgattgacattgaggaggaagaaccactgctagaaaagatggacaaagacggtgtaagaaaggtgccagaaaaaacgggtgcatcccaaaatctcgccaccgaaatctcgctgatacaagatcaataaaaaacttcaaaaatagaaatgcaaaattctagcgattttcgaaaattatgatgaattactaattttttcaaaactttttcagaaaaatcgctagagaaatctttacaaaaattttttcttgaaattttcttataaaaaattatcgaagattttttcttaaaattatcttacaaaaatgtttataagattttaaatttaaaattcggcggcacggttttgttgcggcaatatttcggtcggaaaaatttcgtcccatctccgaaaaactctcttggcatttttgtggaattttgaaaaattgaattttagatagaaagtcaaaagaccagccgcggcagagccaaattgccaaaagcaggacagaatggacgggtcagtatttttttttttggcattttgtattaatttccattaaaaaatatcagttttgcaggccacgaccaagagcaaaatcgagcgggcc

SEQ ID NO: 17644 - DNA, 2235 bp, Heterodera glycines
ttcgtacaataatcaaattttaaaaaaatgatagtgacgcataatttcatcaaaataacaaaaataaagcaaattataaataaataatgagctaatgattatcaaaaataacaatagtaataaccaaaacaataaaaattcattcgagctttcggagaatttgcatcacttcagctgaacttggccaatgaagttttcgacaaactttaaatttgcataacattttattccactcctcaatctttttttttgaagaaaggggttagcccgtcatttttactaaataagaatttttttgtacgaaacgccaaattgaaacgttgtacgaactgccattgtacgaactgctattgacccgatcttctgctgttttgttttaggaatgaatgcggcagttcgctcttttgtccgaatggcactttaccaccgttgtcatgtcttcggtatttacaattcgtttgaaggattttcgactggtcaaataaaagtgagaaatgttctaaaagctttaaaacaactcatctgacatgtgcggctaggaattgtcttggtccgatgtgacgtggtggacaatgcagggcggctccaaattgggcactcagaaacaattgccgcacaaacacatcgaagcggtggccgcccaattggaaaagcacaaaatccacgctcttctgatgatcggaggatttgaagtgcttccggaattcctaatctacggtttctctcactttaggcttaccattcggcgctgattcttttccaaaatcgcagcaaattttctgcttttcgaattcctatttgcgttattccgtgcacaatcagtaataatgtaccgggcacttcactttctcttggtaccatttccaaaataaataaatatttatttttcgtcatttaggatcggacacggctatcaatgccatctgcccaaatggtggacaacattaaacaatccgccaatgggtccaaacggcgtgtttttctcatcgagacgatgggagggcactgcggctatttggccacggtgtcggccatcgccacgggggcggacaatgcgtacattttcgaggagaaattcacggtggacggtgggtaatccgtgaattctttttggtcaattttgtattttacagacattaaagaggacgtcaaagtgatcagtcagaaaatgcaaaagggggtgcaacgttatttgatagtgcagtcggagggcgccagccataattacgacaccacttttgtacaaaagttattcagcgaagagggcaagggagaggcaagtgctattaatgtaattttgttttttgagggcaaccagggcctttccaacggaggctacagtcggtggtgtccccccccccccctcgaaagccgaaaatataattaagaaatgtaccagaatttccttaaaccataaaattgccatttttggcaaatcttttaataaatcacacagtcgttcgttgggtgttttcgacttctattgcgtttgtatgtaaaaaataggataggaaggagttggtgagaaaattttttccaacccccccccccccaaacattgtcaaaattcgaccctccgttcgtcctctgccgcgatttgcccctcaatgggaaaaggaaattttaaaaattttgaagaatgaagacagatttgaaattttaggttaaaaaaattgaattctgagattttaggcgaagaagggaaatgaaaatttcgagaattacgaaaggttggaaactggaaaatttttctaaaacagacgggataaaaacttgtaattttgtctataaatatattttcttattttaaccaggaaaaattatcaaaagccagcattgtggttgcaacggccgatagccttgagaaatacaaagcggtgactaaagaattttctttgcgcacgcaaatgcatgttctgggattcaacaaaaatgttagcttttttaaaagttaaaattagctaataatttgtatttcaagtcgaccggactcctttcaagcattcttgatgggaaagcggaacttaccgaacaacaacaagagatttcccgttcaatcaacgccattacggcggatgaagttctcgtgaaggaattcctggagttgatgaatgaggtcgaaaaaaagaaatgccgccgatccaactccgaaacgccacttgtgacctagacggtattattgggtaatctcgtaagcaagggcgtatctaggcccccccccccccgaaattaaaa

SEQ ID NO: 17645 - DNA, 1920 bp, Heterodera glycines
gggactcaacccaccaatatttcactgggactcaatccaccaacattccaatcactcgggactcaatccaccaacattccaatcaacgggactaaacccaccaacattccaatcattgggactcaatccaccagcattccaatcactggcactcaattctcctacattccaatcattgggactcaatccaccaacattccattcaacgggactcaacccaccagcattccaatcactgggactcaatccaccaacattccaatcactggcactcaattctcctacatttcaatcactgggactcaacccaccaacattccaatcacttggactcaaccctccagcattccaatcactgggactcaatccaccaacattccaatcattgggactcaatccaccaacattccattcaacgggactcaacccaccagcattccaatcactgggactcaatccaccaacattccaatcactggcactcaattctcctacatttcaatcactgggactcaacccaccaacattccaatcaccgggactcaaccctccagcatttcaatcactgggactcaattctcccgaattcaaatcactggactcaatctcatcaatccttcagcaacacaattaccgggactcagttctccgacatttcaatcaccggaactcaacctcagcaacggaatacagaactatttaaaaggaatccagaaattgaaatataacccataaatcaaaacactatggtgtataattattgcccccaccccataaattcaaattaaaactgacctgtttaaaactttccacctaaatttgatccgcaagtgtcacgtcaatatcccaattgcatataaatattccactcgaacacaggcaaaacataagatgtagcatttatattgctttttctatccatcaaaggctttttctttcattttttattactatcataacatgctttttattcaaaacaaatatcaaaaaccaaatcagataagtacaaaaaacttttttaagtaacaaacctttttcattcaaacaaattctaatgcatttttttaaccaaacaattctccattatcgtttacataagcaaaacaaaagctttcacatcaaaatcaaatcaattaacaaaaacataatttagacaaataaataatgataaacagcaaaaccactaattttttcttacacacaaaaatgtgctctttcttttattaaatattttataaaataaaagatgggatataaataaggaaggggtgctagacaaatttactattgtctctcccttccatttcttttctcttatttcttttacttttccacttactctctcttttttcccactccctccctctcccacacacacgcacgcatccagcagactgctgctgcacagcagcacgcgtctgttcactgtatgcccctcccacccgccgctgcccgcgtagaaagacagtcagacagtgcactatttcccacctttccctccctctactttttttcaaattcatttttaacgcaaaattcaaacaaaacgccacactaattcaaaaacggacacatacacacactcaactttattatataggattattcacaattaattaaatattaaccaacgatttatttgataattccatttaacaattaaaaatgcactagcattttggttttaaggtttcattaatttcactaattttttttgtgtttactcaaatattttacagttatcaattttgtgtaagtgcgcagcttaattgtagattatcacttgctgtcttttttattttttaaggttttagtcccaaaaaggggcctccaatttctaagaatttttgtctaaaaaccatattccgttttttgttgtaaaagtgcccgttttttagggttattttcttaacttttcag

SEQ ID NO: 17646 - DNA, 924 bp, Heterodera glycines
  misc_feature (917)..(917): n is a, c, g, or t
tttaattagatatcattcgcaattagattatgagttccttcctaagattgccctctaaagtcttggagtaaaaactcgccttattttaaccactaaagaatcaaatagatttgtttttctagccttacgcaaacatttcgaaatatttcgccggcatttgtggaaattcgacactataaaagtggttttttgttttagaaccttagcgtccgagtaatgaggtacaattaaatcctaatttatgattaaaattgtgcataaaggtcaataaataattttcatgtgggagaccgaaattttttgattgtacaccgtaacccttttaagtccaatggccaaaataggacgataatccttggcaaaattagcctatcagtatttacgaaccttttctgctgctaatcgctacctttaattagatagcattcgcaattagattatgagttcgttattcaaattgccctctaacgtcttggagtaaaaactcgcaatattttatccactaaagaatcaaatagatttgtttttctagccttaagcaaccatttcgaaatatttcgcctgcatttgtggcaatttgacactagaaaagtgattttgttggttttagaaccttagcgtccgagtaatgaggtacaattaaatcctaatttatgattaaaattgtgcataaaggtcaataaataattttcctctgggagaccgaaattttttgattgtcaccgtaaccattttaagtccaatggccaaaataggacgataatccttggcaaaattagcctattagtatttacgaaccttttctgctgctaatcgctacctttaattagatagcattcgcaattagattatgagttcgatattcaaattgccctctaaagtcttggagtaaaaactcgcaatatttttaccactanagaatca

SEQ ID NO: 17647 - DNA, 1112 bp, Heterodera glycines
tgaccaatcgtatccatcgaatttggctccgccccgttcctcctctttttgtggccccgttcccggcccatattcattctgttcgggagagggattggcttagccaatcccccaatctctctccctcctcccactaattatcccgagaccgaactgggagtcccttccccatcccacatttactcatcatttactcataatatataattgtattgtgcgcacattactgaaataaagagcatattcaaatgccgccgctgggatttttggggagggacccgttgcctatttcaccctctaaagtcttggagtaaaaactcgcaatattttaaccactaaagaatcaaatagatttgtttttctagccttacgcaaacatttcgaaatatttcgcaggcatttgtggcaattcgacactataaaagtggttttttggttttagaaccttagcgtccgagtaatgaggtacaattaaatcctaatttatgattaaaattgtgcataaaggtcaataaataattttcctctgggagaccgaaattttttgattgtacaccctaacccttttaagtccaatggccaaaataggacgataatccttggcaaaattagcctattagtatttacgaatcttttctgctgctaatcgctacctttttagatagcattcgcaattagattatgagttcgttattcaaattgccctctaaagtcttggagtaaaaactcgcaatattttaaccactaaagaatcaaatagatttgtttttctagccttacgcaaacatttcgaaatatttcgccggcatttgtggcaattcgacactagaaaagtgattttgttggttttagaaccttagcgtccgagtaatgaggtacaattaaatcctaatttatgattaaaattgtgcataaaggtcaataaataattttcctctgggagaccgaaattttttgattgtacaccctaacccttttaagtccaatggccaaaataggacgataatccttggcaaaattagcctattagtatttacgaaccttttctgctgctaatcgctacctttaattagatagcattcgcaattagattatgagttcgttattcaaat

SEQ ID NO: 17648 - DNA, 1773 bp, Heterodera glycines
taataataataataataataataataataataataatacttataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataagataataataataataataataataataataataataataataataataataataataatatgataataataataataataataataattattattattattattcgcctcgctgggttagaaatttcctcgatgccgtagttgagcacgtcgcatccgtcgtagttgaacagtcccgcaaataatgcatttgttaggttgccaacatcaaacgacgaattggcaaatggttggcgcagattttcggtgtaacctaaaaaaagaggaaaagcatttggaaattaaaaaaaaattaaataaaaatatttaatttgttttttataaaattcaattggcccttttttgtgctttgcccacctttaaataaaagccaatagaagccaatgccaatgatcagaagtgccgagagaaatttggccacgctggtgaccaattgaaagggcgcgaccaccgaacgaagtgagaaaaagttgaggaaaatgatcagccaaacggagcaaagggcgatcagtttgcgaagagcgaacgcagcggccgaattgtgctgatcagaggcgtccatcagcagcgagtcaaggccaaggccctggacaaaatactcggcgaaagtgtccgcctgaatggccgaatagagcggacagatgagcaccgacccggacaccatgaacatgaaggcgagcggacgcctaaaattggacggacaaataaaagacggacaaaagggacacttggccaaaaataatattcaaattaaaaaagtgtaatctgtgctcaaataattttttaaatgagaaaatcagttttgaaggttggcttcgtcttttaatgagcttttttcatttcgaaacatttaattgagcgccacaaactctgaccatttgacgtatgagagataggcaaaatcgctgcccgaccggcgaatgctcgtgccgagttcgatgtaacagaaggcgcccaatgtggtcgcagcagcagcaagcagtgaaatgagcagcgaaagtccaatctgacaaggaaaacggagttaacaaatccaaatgtttattccattgcccgcgacagtttgaattttagtctttaaatgggtttctttgactttttggtttcagttttttcgacttcttatgaaaatttctcccctgagttgctcccacattttctaatttttttgggggggggggaagggtggcatttaatagttttcaaaaataacatccccaaaactcagacaaacccggaaactttgaacaatttgagcactgttctgggcaatttttaatgttgagtcggtctttcactgacaatgaactggcaatgagaccattaaacacctatttaattttccatttcataccgaaggttataagttgtatgcactaaaaatgcctaataactcctaaaatatgcactaaaacccct

SEQ ID NO: 17649 - DNA, 1175 bp, Heterodera glycines
atgacgaaaatgccgatgaagcaaaatggaaatgttttggtctgagaaaatacagagaaactaaaaatagtgactgttttatcatgggaaataagccaaggaaaaagggcggctaatgagggaaatgaacggtaaaagattaaattaagggagaaaaataattaaatttgaaaatgatttgatattggactcgttattaattaatttatgaaactaataaaaatattttttattcttttagcaaaaattttcgatcggacgaaatttgatacataaaataaacggacgatggtaatgagaaaggatttttgtttatttgaatacacagtgatatcgttcaataatgaatttcgaatcggaatttgttacttttttaatttccaaaatattattatatttcgtcatttttaatttgtcccttttttatttttaattattttttttgtctgatgggtgttagtcccgcctcggctgtgtccaccgcgctgaatttgttcacaattctgtccctgccaatgggccaaaaggaattggacacggacatggccaaaattaatacgtaacttaagcaattataagccaaaatcttctgctggtttcagacacatgcatgaattggtgccaaaattatttgtcggttatgacagaaacgcacggccaatttcaaaggatggcaaaccgattgaggtacaaaaaagcaaaaaataaaaataaaatgttaaattgaaatggatataatatccaattaatttggcctatctttctcgaatgagcagagccaattaatgattcatttgcagatacaaagtttgttggtcgtggatcacattgaacaattggtgtgacaattaatttgcccatttttaatttattatgctaaagttaattaagaatgaggaagaacaggcgttgaatttccacggcacattaatgctggttgctcatccaaaataaccgggatgttaaatgagagtcaatcaatcactttttttaaagatgtggcgcgacgaacgattgatttgggaggcggcggattacggccaattaggcagtttggcattcaccggcttcgacgtgacgcgcttttggtcgccagaagtgataatcaaagggatgtgagcactcaaaatgctcatttttgttttcttatttttctaattttcgaacaattccat

SEQ ID NO: 17650 - DNA, 2869 bp, Heterodera glycines
cgggcccgaaccgctgagaggcagggcatccgaggacaattggtgcgaatggacaattgacccaccctcttggggaatggttccctttgtaaatgccatctttgtctgtctcccccctccaaaaggaattatccctccgaaatttccgcgctttctcatcgtcttcacatccccgacatggacaacgcactgattgtgcaagcgctgaccgacaaaagttattttacgcgcaatgatttggacgacgaagcgatgggagacgacggaccattgacgacggaagttgcgagagacaaatccaacgaccaattagtggagaaaggtgctaccaattctcatcttttcgttggggctaattttccccgaaaacccattttcaaggaatgcccctctttcgtcatatcgtactcacttatttgcgcgcccattggcctttggctcccgaggtaaacatttagattaaaaaatctcatttgatttgggctccaagtacaaataagtttattatttataatcagaacgccaaaactttgcaaaacttaaattttcttgggattttcccttgtaaaaatggaagagccgatctcgagttaaaaacttaagtttcataaaataaacttggaatcgttagagggggtcaaaaaactagcctaggcaaaatttcaagaaaatctgacccgaggaaaatttttttgaccctagtgaaaatttcaataaatttaactcttttttagccaagtgcgctatttaaagccaaatcaaataaaacttacaatattctccagaattttctctttaaaatgaatataaaattattatatttggcctattattgtccgagttataagtctggaaaatttcataaaattgtcgatgttgtacgtaaccaacgctttttgaatatgattttttattgacacgaaaacttctattaatgcaaaaataattcttcctttcttctttaaacgaagaaattgaaattaacacacaacataaggaggactcgaacctgagaccccccttttggtgactaacgcacagaccactaagacgaaaaaaccaacttaattgtacttggagcccaaaattgactcgccgtgtagaaatgagaaatttatacatttccgaaaatggattttaacaattttgtggaaaacataagcaatttgtaaattattttcagttcattcgggatcaaaaaatcagatttttaacaatttttttgcagcatgctttttcaaaaaaaattttgaggaatgggcgacgggatgaggtcgaggcggtgccgataagatcgtttttattataaatgcaaaattaaagggaaagcaaacagattgtttttattgaatgaatgctttcaaaccagaaattaaaacagaccctcaaaataaatagtcttccgagcctcgttgaaaactaattttcaccttttgatcgaaaaccccatccgtttagctcttaacaccaatttctctctccggtttcattatggcccctttccaggaattcatcattgccgtggccacccgaatcgcccccacttcggcgctggccgagttggccacccaattaggcctccaccacgtggtcagaaccgcggagtttcctcccactcagcaaacgctccagtcgacactgttggcccttatcggtgccatggacgtggcaaaagcgcgcgacttcgtccgccgttttgtgctgccgcgactgtacgaagtgccgttggaggatgtgctgccgttccggcatcccttcgccgtgttgggcgattatttgcgcaaatggcaaggggtgcggcgaagagacttgcattctgtcttgaatttgatttgtggtttgcttgcaggcaactgacatcgaaccgcgtacaattgggtcgggtgctgttatgacagcaacgcctttttacgaagtcgcgatttacgtggacaaacagcaaattgttggacaatgtgggttttcttagctccatgattcaatgttaaatccgttgattaaagcgggcggtgaattcccttgggttgcgttggatttggccgctcagaatggactgcttcgcctgtggcgagtggctgaccatccgcgcgtgttcccattcaaatttgaggaagtgtacgcgacccgatttgagcaggcccagcagagaaaccatcggctgagcgacgtttgcggagaaaagtgagtgggcgagggagaggcggcaaaaacagagccattggtcgcgatgatgcgaatgaaccttactgtttcagcaccgacttgagtctgtacacgcccgaagaactggccagagacccaattgacatggtcgacatgtgcaaccagtactacacgaagatacggcccgatgtgggcattcccctgcggcgaaggcaacggcataagttctcccgtgggacgatcagtcggctgagtaggcgatttttggtcaagcccaccattttcaatatctgaacacaacccgacacacttttgttgatctgcgacgaatcatgatcattttgctttttgtttgaattttaattaaaaaataaatgagtgaaggaagacagagaaagaaaagaatatattgaatttgaatcgattaattttgtgaaatttttaataattcaaatatttgttcccaattgttctcatttgtccattttgccattccgatgtctccaccaaaacgtgccaaagtgtcagccgatgatgatggggagacaatttccgacgacggggagccgtccacgtccgcgggggcaaagcgaaagcaaaaggcgtcgaaaccacgccagcggaaggcgcacgaggcattcattttgctggtggacgtgggtcgttcgtctgccgaaaactcggcgggggcacagagcgatcacgg

SEQ ID NO: 17651 - DNA, 1410 bp, Heterodera glycines
cagatagattttgcactaaaaatcgtcttttaaaatgaacacaaacaatgtggccgtcgcggtttgtgctcttttttgtgccgttgttaaaggcggtgtcatgcggtcggaaacagcaccactgctaattgccgagggtagaaaaaagcaaatttaatttaatttaatttctgccaaaaacaaccggttttccgaatatctaattaaattaaagttgatggtaatggaaaacgaatttagaaaccaaaaatgttgccatggtggaggcggtgttgccgaaacatcgcgaaacggtaatgaggattcaaatgggcggttaaatgggaggtaaaaaattaaaaatttcataaatggtctgagaatgtgacagcaaaacagcattcaatcgacaccaccggcccaaaattaccttaagattttcaaaatatgacctaaaaatggcaattttcggtgaaaatttgttataaatggtcaaaaattccaataaaatttattttttttagagtgtgcgtaatatgcaaaaggatgagacgcatgtgatgcaaaatggacgcaataggaccaaccatgacgaagtgcactccgtcgacgaggcacacgaccatgtcagtggtgcagtaggcgatgcgcatcatgatgatgtaaatttttattattatggcgatggaattcggtaaatggtctcatgaaaactatattttttggaataaaatttgcaaatctgatttttaactaaagtgaggattgtctatcggccaaatgctgattttgaaaattttcagtagggagcgcttgggaaaaattggagtagagagaaagagagagagagagagaaagaaaaggggagaaggaaagagaaaaagattaagagaggtgaaatggtgaaaatttgtattttatgtaatatatgtattaaaatttttcatgtgcgttaaaatgaatttagacatatgaaattatatattataaatgcttataggtgagcagtgtgaccgaatcggttctgccactgtatacttttttttgcatctgcatttatgcaggtatttttataaaattttaaggacaaaaattaaaacaataagtttattatataaggtatgaaaatttagtattaaaatgactactattattttctgctggccgggttttgatgaaaaatttcaagttcggtgccaaaaacatgattctcatccttgtgctaattgataaatatattttgaaagaattatagttaaagaccaccatttgtccgggttacggggtagtctaccatactctaaagatgaaagaacaccttttgggtgggtgccagtccaaaggagcaccaggtttttgagctgcaagggaacgtggccatttgaggacagatttttcaatatttactaaggtcacaactttgtatcaaat

SEQ ID NO: 17652 - DNA, 1565 bp, Heterodera glycines
cagagtcgtcttcgtatgtttaaatggtgctaggccgaacctaaaaatatcaatgggacgaacctaataaataataaaagatagtgataattattatttaatttattttgcagaatagtaaatcataacttagctaaaacttagccaaatgaatgaaatttggtattgagctatagcactacctatcctcctctattttatataattaaaaaatctacaaaaaatttacaaaatttgtaactaaagaatttcaaaaaaaaattaagactcaataatcttgtccctcttttctatctcaataattctttttgaaatttaaatggataatagactctttgtgttgtctaataatataaagaaattaatggttgtgagcgaaaaagttaccaaaggaattatggatcatatttttatggtcatataaaatgtaagtcatttaaattatgaaaatcgttgcaattaaaaaagtcataccactcttgatataattagatagctcaaagatttctctattattctgttcaaaatcaaaaaaaattattagtttcaaaaaaagtagcattattgattgtgaaaaaaatttgctaggtttttaatataaaagatgaagagggcacgtaaagctttagctcaataccaagtttcattaatttgactgagttttagcgtaattatggtttattattttgcaaataaaatttaaacaataataaatttaaatcttacgcttgtcgaggaggcgggtgaggtgcgagtttgctggacgggtcggttgcgcttcggctgtcggtttgcacacgctccgcgacaatgttgttgagcatagcgaatgggacggggtttccgctcttggaatggaacttgtgagatggacagcccctttagacttagttggactgtcctggtggacttcgggacaatcaagcttagacaactgcaaacaaggaactctgagttcctggaatgttgagaccgtagagaaaaaggaacaccttcggaacaaacacttcttagacaagaagtagtttatttgtcggaatagcacacaatcaaaggatgaaataatgatttttcgagagtgattctaaagggaaatattcgggtttatatatgggatttggacagggagggaaaattctagaacacacctgaaaggaatggaaaatggggtaaaattcgggaatattaatcaaaaaatcacaagggaacattcgagaatcttcttccggtcctccacaggacttcctcatttctttcctccgggcggtcctccgggcggtcctccaagcggtcctccgggctgtcctccgagcgatcctccgggctgtcccccaatttccacgcgttcagtcgatagcggcgacactccgggcggagacgaaagttcacgacgcagaaccgagattttgaggcgcaacgactgcatgaatgctgccgcctggcgatgttccagcgcgtcgcggtcggctctttcctgttcgttggccttcagcacttcgcccaatttgcgcgtccactccacgtacaatggccgattgcgccccctgagcgatgacttcgtcgat

SEQ ID NO: 17653 - DNA, 1236 bp, Heterodera glycines
acgcaccaataacactttataaggtggccgaaagctgcttccaagttgcggacgacgcgaagagacaatcggcggaacacctaaaagtgacgacggatggccccggagtttcacaggcgacgactgccgcccttcgggagaagccaatgcccacggagaagccgcccagtgacgccgaggaggaggagagcagttccgcagcttcatcggacgaggaggaagaggaggacgagtcgtcggttggggtggcagtcgccaaagaaacgcgcgaggatttattcgcgagggttcgcgccaaaattacggtccgtttatgtgagacaagcagtcctaacgatgagcttggaattgcacgtttcagaagcgcaaggaattggccaattccaaacgcagtgtcagtaatttgaggtcacccgttatttgtgtgcttggccacgtggacacgggcaaaacgaaaatgttggacacggtttgagaaggggacaatccgcatgatgcagctatataatgaatgacactttctgcagatccgtcgcagcaatgtgcaggagggcgaagccggcggaatcactcagcaaatgggcgcgacgcgagtgccggggcaagcgatcaaagagcggagcaaaatggtgaagaatgtgagcagtttgatgatgttgcaaaactgaggagcattttcaaaaactcatttttagttttgcgctgattcaatgcaaatccccggctttctgatcattgatacgcctggccacgaaagctttgcgtaggactcatctctcacgggatcatattttaaacaaagaccaaaatttaatcttttgcatttttcggttccccaaattccctttcaaaagatttgattgccttccccttttttggttgtttcatttgcatcactatagaaatatgcgttcccgtggttcctccctctgcgattttgctattctcgtcgtcgacattatgcatgggttggagccccaaacaatcgaatcactgaaactgttgattaaacgacaaacgccttttgttgttgccttaaataaggcctgtttaaaggtccatattcacaaatgggaatgcgttttttaggtggacagattgtacggctacgaatcgaacccgcgcaaagatatttggcaacatttgaagtcgcggccgacgaacgcgctattggaatttaaggaacgattcgacaaaatcgttggagaattttctgagccaggtgccataagagaa

SEQ ID NO: 17654 - DNA, 1472 bp, Heterodera glycines
atgcgcagagactcgcgttttctgaggaactcgagtgcatcgtcatggaggtgaagaagcaaataataagctatcaacgaaatgccagtcattgtttccaggtccgttctttgccaggattaggcacgacgatcgatgtcattctgatcaacggcacactgagagtcaatgacatcatggtactgactggaagtgacggaccaatcgcaacgccaatcagagacttgctgatgccacagccgctaaaagaaatccgagtgaaggcgagtggcagggacaaccccaaggcgtaccctcaaaagggctgaagttattaagaaaactcagaataggcaaaccatttttcatctgtagtaacccccccccccataatcgtaatctttgtcaattttttcccagaatgattatgaacattacaaagagattggaggggcgcagggtgtcaagattttggccaaagggttggagaaagcgattgccggacttccgctttatgttgccacaactgaggaggagttggaggtgttgaagtgagtagacatagcagccaaatcagagggaattcggccgttattttcccttaagggaggacgctgaagttcagcttaagcacgcgctcatggcgattaagaaaaagtcggaaggggtttatgatcagcccaccaacctttagaaaaatgcttgtcatcgacattaagcttttagagacgatagacaagtatcgttagatttggagaacaaagaaaaaagttatagtcaaaaaattggctggggccgaaccgtgcggggccgaactgaggtaaaccgcgtacaaataaacatgcattgacgtggtgcctttataattatcactaaaaatggattaatgttagttttttctgaatttttcattacaaacattaagttcaaacgacgcagaacgaaaacggcgtcaattcgacgacgaacaacaacagaaacaacaacatccgctgctggtgaggaacagcggacggcggtgttggaaattgagtcaacagggcccgtcaaattgaaaattaaatgtaaataatcaaaaatattgttccataaaaaatttgggaatttatttttattgccttttacagtgccatgttggagaagtagcggatgttcaacgagttcgcctggtggtgcccactcatcgcagcaacagaaacagcatttcaatgtgaaacaacaacggtgttgttgggacaggaaaaaagtgcataatgaaataataatgactaatgcaaatcctttgaccctttgtccgtttcggacaaagaaccgacaagggagtaactcacttttagacagatggcatttatccgaccaatttatcgttttgatagattttttaagtagcaaatcttgcttcttcattttgggttttatcgaacgattgattgaaccatttgtttgtccgttctctgagcgcaaattaatggctgcacttcattacccccgtc

SEQ ID NO: 17655 - DNA, 3258 bp, Heterodera glycines
  misc_feature (13)..(13): n is a, c, g, or t
catatttgaaaantcggccgaaataaaaattaatcctccattatttcaacacctaaaaatatctattcgtgtacgtcgttcgctagccaaatgttcaaaaaaattttgtgaaaagatttatatatgaatttttcaggttttcaatacggttaaatagaaaaatcacataaaaaattattattatttaaacaaccaagttgataattttattaaaatttttcaaaatttaatcttgaaatatcggcaggcactaagttcgttctgcaattgttgcaccgaagttcgaatactaaactgcatcacttacattattcgggtccttcttgttcgaattgaacggcaaaccattaatttcaataaaaagttgagaacaattggtccaacgtacaatggagtaaacagtgtcattaatggggggggggagataattaggaaattattaaataattattcgaaattttatgtaattaatttatttttttgtgctattaaaaccattcacgaattttgaagcttcaaagtgtttcctcgaatctgcgttgacagacagcaaattatcaggaagtgatctgatcattttcactatgcttcgaaagaggaacatacatttggcaacctgccaaagaaattaaatgatttgacaaaaaattctgacagttttatgagccatttatgcttaaagagtgatcagccaatgggaatttgaaaaagaaaaaataatttttttcttttttacataaatttttcctttaaacactcaccaaatttttgctttgactaagccatgagcccatacgattgaacagaaaatggttaaacacttggcacacgtgaatttgagcccattttttgtcgaaaggaatggcaccgataatttcaaaaagtaattcatttggaatttttttcaccattttttaaataaattattttggcggagaaaatgccaagtgccagtggttttttgtctgatgatggcatcggcggcattcgcttttacgacacgcctgaaaactgagtcaaatgccaatggctgatatgaagatggcagcagcggcattcattttaactcaaagatatcaaatgccaatggcttatctgacgatggcatcggcggtattaactttgttcccaaagaaacgtctcaaaaaatcctattatataaattttttttcaaattaataataatttataatgaatgactgatataaagccggcacattcgtcatcaaatttacctctggaataacacacagacatttacatttaagcttaaatatttttttaattatttttgtaaattggttcacctatttttattttttacgtaggaattaatgcccgtgttatttctctaattgggccgaaccccctcccccatatttgtaattaattctctctttggataagtcgttggttaaaatagaattttaaattaaattgaataatgaaaaggataattaagcactaaataatttttgaaataaattaggataattttttattcaaagcgatttaaatgaaaaatggcataggcaaaatgtaaaatgaaaagccttttgataaataggaatagaatggatcatttgcaaaagatatggcaattatgtgataatttgtttgggcggtacgattttgatgaatgtttggtgtggaattacaatttaaaaaattaattaattatgcgtatcaaaaacagagataattattgtcaatgaaaaggttattttgtgttttttgctattttcattatttttaaatctgtcaaaaatctcagacaatggcacattttatcctcaaaatttcttgcaccggacgacacacttcactgggccatgtcgccccgcctactcaacgttgtactttgggctgatatgcatgtgtttggcggagatgactggaaaaacattcacattggcaccataagataatacaaaaaatatttattaatgattttgttttaattggtaccattttttaatcgttttcaatgtgagttgtggtaatattttggccttttttgatgagtgccatagaaataaatatttgaatattttaatggattttggcttattcttatttgtcctcctatttgctaatttatgaattgagagatcaataaatagtcattgttttgttgattaaattatttttgaaacaaaaaattacattttccaagttgaaacacttcatcgattgtcgtgctattggcctggcaacaaaaggtgacgattcgcgaacataccagcatcacttcattcgcctgtaaattaccagtgattggataataatattgtatgtacgaaaaacaattttttatttaactgaatcatatttcacaacaaattaaatagttataaccaattttttcggttaaatgcacccttattttggcaaattaagtttttaaactccccttttaatctatgaataataaaaataacttattgcattaaagaaaaacgaactaaaaattttacataatttggcgcgtttgaatcctgcggaatgacaaagcgagtgccaatgtttggggggaaagttcctgtgcttgtatgaatgagaagcgctaaatttggaattgttggattaatattaattttctccaatttttacaaaattcatttaattctttttttaccctcgtaaaatcggccggcttcgtattcctttgctggcgcacccgtttcagcactcctcttttccgcccctatttttaggatgattgtcttcaggcttcgcatcgacgattccgtgtctttggtctgaaaataattttaaaaggttcgtgttatcatttgggagaaaatgcatttttttaatcttagggccggtcccaggttttagagaaaatgccaaaaattttcttcatcgaatgtttttcctttaaatttgagagaataggcaccctccctccatattgcatatcgaagtgatgcactttttgactaaaaataaaatgaaaatgattgaacattgactaagtggtcttaaaaatgaaaattcgagattttaccgcaacatttttgcttaccatcgattgcttcaaatccttgatagggctaattggctgcattttgacggagaaatgctctcactcttttcggcaatggcaaaattttcactcagtcacgcacgtctctcgcactctgacctgtaaatgctttacacttttggcaacacactttttggtaatggcacaactcacggacctactgatggcactttttttgcagatggcactttcactcagtcccgcac

SEQ ID NO: 17656 - DNA, 2446 bp, Heterodera glycines
  misc_feature (95)..(96): n is a, c, g, or t
  misc_feature (2276)..(2276): n is a, c, g, or t
atcgaccggctgtacgagacgtttgtgcaaatgccgtccgttcggcaacaaagtggtggtctgagcggcgactggcggcaacagacacccgtgtnncgagcatgccactcgtgaggaccaagtgggtacgtcgatcaagatgggagcgctcttccgcctgttcaaaaagatcaggtaatttgtcaaatttttgttttttacaaacatacttatgttattagcctaacgatcaacatgcgaaccgcagcgggagaacaatcgttgcgcgattggctacaagaaatcggcaatgggatgcatcgagtgggtacggacagccaaggcttcaccaaccaactgcgcattccgcccgaacttctcgtggacgacctcgaccacacaattcacttctgcttcccagaagcactgtttgacgacccgctggccaacgctgacgcaattgcccacaatgccatcctctgtccaaccaacaacgacgtgcagcacatcaatgaggtagcgcttggcagaatgagcgggtgcggaagggaattcctgtccatcgacgaacctctggagccaaacgaagaaatgcacaatttccgcaccgacttcaacatggaggcggtgcacaatgaaatgccatccggaatgccgccccacaaactgaccattaaagtgaactattttttgttttaatcatttttaaccaattaatccaggtgggtacgcccgtgatgctgatccgcaatttggacgtcacccagggactgtgcaacggaacacgacttcaagtgatgcgcacttcggagaacaacctgttctgccggattctcaccggaccacgagcgggtgcgcagaacatcatcgccattccacaaattcaattcgaatatggccgcgcacgacaccaccgtggactacgcttccgccgtctgcagtttcccgtccgcctttgctttgccatgaccataaacaaggtgaaatacagattatttaaggattgaaatatataagcacaaaaaattaaaggcacaaggacagacgctgcagcggatggcgctcgtactcaacggccggcaatgcttttcgcatggccaagtgtacgtcgccatgtccagggtcacgcagatggacggcatcagggtgtacgcgccgctctgccaaagtgggtacggaacgcacatcgagaacgtggtttaccacgaactgttggacttggagccgcagcagccaaggacaccgattcgtggactgatcgacgtggacaatgacatggacgtggcaataccggacgtgggcacaagagtaccggacgtggacaatgacccggacgtggaacgagataatggaaacgcagcgggtgcgaacgatcaagaaccaaatgatcttgatagttcttttgatgatttttttgattgattattttttaatttattttgctgatttttgctttttttgctttattatcaataaatttttgtctgcaaaattttatgtgtaactcttagtaaacctttagttttaaatcacaccacctttttgctattattcaaacgcttaacgcactcactcggctaattttaaaataattagcttcaactgttcccagctggccccggtgttgaaagcggccccggcgctttcacagggccccttggggccctggttcactctataagggtaaaatgtaacttgaaatgactttttttgaataactctcttcaagttggtcggatcggctccgaacaaaagagcactactattttttaaggattctgcatcgaatggtgaaaaccattttttgaaattttcacgtaaaaaaaagtttcttcagaaaatttttgaaaattttcggaaaattttagaactgttcgcacaaaagggtccatatctcggcggggagtgccgaaaccggcttagcgatgttttggaggataaatgtcgacactcgggcggttcgaatgagctattaagcatctttctagcataaatttaaaattgagttttgctctggacacgaattaaaaatttttggaaaaatttttgcctcaagaattaggggggatacgcagggattctgaggggttgatgggtaattataaaaagatttttacactggaaatacttaaaatatgatgttattacgccctacatgcatttgggcattacatgtcaaattcacattaagatacttgatgcggaatcatgtccagaatccgaaaaaaattttttttagaaagaacaaaagtaatacatcagaaagtcctaaaacagtgtaaaaagatgtttgacgntttaattttggatataacttcaagtctcaccaagatactgcatgtgcatcttggtatgtaaaatagtcaacttttgaaccactcaggaacaactaatgaacaactgatgaacaactcttgcacaaattctgcactactcttgcactaattaaaaattataaataaataaa

SEQ ID NO: 17657 - DNA, 1676 bp, Heterodera glycines
aaaaaaaaatacaactttttttcatcattcactaccctctaaattgccttttattttaaaatgattacacgttaacccttgcaatataagagtaacattattataccactgtcaattaacaaatcacattaaaaattttacgcttataaaccaattttcaacaaataattagaattttttacctcttaatttaagagaaaaaatacaatttttttttcatcaatcaacatgagtaaggtttgcctttattcaaataattacatgccaaaaaaacattgatcaatttaattaataatcctaaagtgtgtgtgtgtcagttaaaacattatcaaaattattgtttaaataaaatagcattcatcaaatgtcaaatgttaacacaaatggaaaaaatcacacatgtctttcagcggtgcgctcagcagttgccgacgagtctgtgactggttcgctgttcttaaacatgaacgaaaattttttttgtttatgtgtaacaattcgtaaacacctcttgcagagcagccgccccaccaagctgaacattaacaccaccacgactctgctccacttgtacaatttccggctgggatggctgtagagaaaataaaaaattagcaaaacataataaatatgatttattgttcaccacagggcgactctccgctgccgactcatttccctgttgttgttgcggcggcagcggtgggggcaacgacaaaaactattttttttttttttttgtaaatgtaaaaaaaaattgacatttgcagtttaatggacccttttattttttgtaatcttataataataaatcgaaaataaatgccggtgatcagttttacccctacaaactaaaaacaatttcttttttatactccacttattttttcgtcaggtcctttaaacggtaaaaaaaaatttgaaaaaacattacatgttgtggtcaatgtatgaagccaggttgagtcccaaacgaaaccacacgccatttgcaatcattctcggtggcaatgttcggcagttgaagaaagagtacgtgtctcctatgcgcagcatggccaacaattcggcctgttggcgccacgctgacgcctcaatccgggccccctccgcgtttccaagtaaaacatttgcaaccggcaattctccagcgggggttgactgtcgctctcgaaaatcaacaacaataaccgacagacgaacagggctgtaatataaaaagcataatttaaaccaaaaaaaaggagtaaattacggaagaacccggttgaaagtgtcgacgcaaccgttgagaaacgcagtgctcgttgttccatcaacacaaaattgtgcaatgtttggcaaatatctctaaaaaatttatttatttttttttttttgcaaaaaaaaaattgtgtatttactccgctttgatattgcgggtggtggtattgcggtggtggtggcataaaagggcgttgcggcacacccgaggcatttgaatgcgcaaaaaattgatgatccaaatttgggttgtgctgtccaactgaaattgccgaataactttgaatttcagttcacaacaattaccaaattgctgtgcagtgccaaattggggatacgggcgaaccgggtgaacgccaattgtctcggctgaacccgccaaaaaattgttgtgctgctgaacacccccagca

SEQ ID NO: 17658 - DNA, 1354 bp, Heterodera glycines
ggcccggtgaattgctgtggtggaatgcctccaaaaaattgcgaatgctgctgcggttgctgtggttgaacactaccagcaacgggcccagtgaattgctgtggcggaatgcctccaaaaaattgcgaatgctgctgcggttgctgtggttgtacactaccagcaccaccaccagcaatgggcccgggaaattgctgtggcggttgcacgcccccgccagcagcaacatgctgtactgatggtggtggcgcagtgaattgatgtgatggcggcggaatggctccaaaaaattgattttgtggtgccagttgagaccacaaaggctgttggatggcaccaaattgttggccacccggttgatttggagtggcatgctgctgatccgagcccgaaaggtttgacattgcactaaatttttaacacataaaaaaatattataaataatgaaagagcaaaattatgaggaaaagaagcagcctaaagaatcaattttcaaaaatgaaaaaggcggaaccattgggagggccaagggtgagaaaatttgccaaaagaagcatcatcttttactgatgaatcatttttattttggaatatataaacattaatatggcgctgagttgaagggtgtgtgaaaaaaaaaaacaaaccgtcttagcaaaaaaaaaataaataaatttaaaacggataagttaaggattaagtaaaaaaccgacattttgtaacttatccgttatgtttaaaaaaaaaagaacccgagtaattcaaaaaaaaaaaaaaactaactgttttttctttcaacattgcgctttcactgatcagccaggcgattgaccaaggcgatccatcccctggggcaaaaaaaaaccgcttcgtctgtttttttctaaaaaacaacaaaattcgttaaggaattaaaaattaatttttaaacctgcaatttgcttgccccgcatgccgtcaacccaaaactgaagggcaattgcccttttccaaatacgggcaattgcccctttccaaaaataaatataccttaataaattaattacaatttactttgaaaaaaatggcggaatttttacaaaaagaaaaaaaaaagagaaagataataattaattatatgaaagtgaagaaaaaaatcgcaggaatttcgcttcaatacaaaaccttttttttttgtaatgtatttaattaggtaattaaccacaaatttgtaaaatcatttaaataattgtttcaatacccttgggtttcaaatcataaattaaatcatattttaaataaaatcaatattaaaatataactaataaatattactatatgttagagacacagaaataatcagcctatacctttt

SEQ ID NO: 17659 - DNA, 3115 bp, Heterodera glycines
  misc_feature (1631)..(1631): n is a, c, g, or t
tctaataatgactaaacttttttatttttaaaattacccacacctttttttgttttcaccgattttaaaatattgactccttttactcgtttttcaatggtttatcaatttcctgattgttgaggctgcgggcaccaagggcaccggaaggcagagtgcccgaatgcgccctgcgttagctgcaaaatggtttaagcaaatttaaaaaaatagtaaaatttttcatcaactgcttgagaattttgttctgaggagagctgctgagactgccgttagtgaccggagggtccagactgcagtgcgggaacagttttgtgttttttgtatttagtttttttaacatttagcttttagtttctagtgcaaaatattaatttttattagaatgggcatgtcccttccacttgcaccaaagtaagggatatgctgccgacatattagcgcatcccgggcccacaccgtgaacctgcacatttgcgggtctggggtaaatttaagcactaattttgtcttttttattcgataattctgggcatgcggaagaagactgcagactgtgaacgtttatgacttcatacagagcattggccagataaccaatatgtgttttatttgttttgaggttcaagagttttttcagttgtttttttaacggcaactttcggcaggcagggcctcgcccaatggaagtgacagaagcgcacaaacagcgcacagccgtaccacccgccaaagccaaacaccgccagcacatttggttgtcaatgctgaacatgaaccgcacgacaaccaagctggtctgttgatcgctcaacggcaacctaacgcacaacagcgcgattggtttggacggttcaatgcggtgacaagcgcacagaagctcgacgacctgttggcacatttggttgtcaatgctgaacatgaaccacacgacaaccaagctggtctgttgatcgctcaacggcaacctaacgcacaacagcgcgattggtttggacggttcaatgcggtgacaagcgcacagaagctcgacgacctgttggacgagttcaccaacgccgtccgacaacaggcgcaagcgactttcacacaaaggcccgctcaacaacaacgacggccaagacagctaccgaaccaacatggcagacgccgcaaccaaatgaatgccgatgatggtccgccatttgatactgtcgccgccaaaagctgtaccgcgcttcacgcgcgagagcgtaccgggagattactgagcaggcgtcatcactgtgccagctctcggctgaagtgcttcatgggcatttcacaaacgtgttcggccccagcccgcctgtcgccgagcaaatgcccaactccgtgccatttcacgagccgcccggcgacaacagcccgttctcagccgactaacaacagtgaagtgcggctcaagcggtgcagtgcagcaacaccgcaccgggacccgacaacatccgctacgcggtgtggaaaaggtttggcccggctgccatatgctcactgacattttcaatgccgtcaaacaacaaaagcacattccaacgagctgggcagctgccgttcaacgacagtgctcattcacaaaaaaggagcccgtcaggacgtgaccaattggcggncaattgcactgtcaaacacgattgtaaagcttcactcagccgtgcgcgcaaaccgggtgggcataatggtctataagcggatagccaggcgcaaaagagctttatgccccgtcgacggttactcggaacagaatttcatgatccagggcattcttcaggatgtcacatgaatgtgccattgcgtggctcgacctgacaaatgcgttcggctccatcccacatgaagtgatcttccgatcactcaaatggtccggtcttgattacccaacagtcaacatcatcagactactatacaccaacaacgcgacccaaatacggcacacaggcggcctcaccgacgacatcaccatccgttgacatatgccgacgacctggtgcttgtgtccaactgcacacaactacagcaattgttgacacaaccggacaaattgctgattgggcccatccggttcaacccgagaaagtgcgcgacttaggtcatcgatgaaaattgcaggattgcccagccgacaacatttaccatccaaggcggacaaccaccagcaatgaacattgaaaacattacgaacatctcggcgttccaaccggctaccaacgagcacaatccgccggccacatcattcagaaaatgtccgaacatgtcgacaacattgaccgatcactgcttgccgcgtggcaaaaatttgatgcagtaaacactttcgtactgccaccaatcgccttccatctcaaaaatggggaaatgcgcaaagccccgctgaatgcgctggacaaaaagatcgtccgtgcggcaaagcggtggctgaacctcccgcagcgtgccggaacagagccgctttacctgaacatgccatgagaggtcttgcactgacgccgctcaacgccctcgccgacctgagccaaattggtcgtggcctgcggctcctcacctctcacgagttggccgaaacaacaatggacttactgtgcaccgtcgttgccaaacatctgcgccgggcaccacgacagcacgaattggccaagtacctcaacggttcaatggacggcgacatgaacaatgggtcgacggacatatcttcgacttggaaaaggctcagaacggcaacgaggcgactacgaacaagagttggcgtcgaatggtcggtcaacgacggctcaatgcaactgctcctgaacgggttccaagaccagccgaaatcagccgagttctgcctgcggtcagctatccgagacttttaccaccgccgattgctgtccaatccagaccaagggaaggcacacagtgtgacaagcgttagtgctgcctcaaatcactttctagcacacggcaacttcacccggttcgctaactggcgcttcatccaccgcgctcgcctcgactgtgccccactcaacggcacgcgacgattcggccaactgaacaacaaaagctgcaggcgctgtggtttcggcaacgaaacactcccacatgtgctctgccactg

SEQ ID NO: 17660 - DNA, 3131 bp, Heterodera glycines
gcaaagacacagtccaaaacattttcgccaagcataaatacgacaaaggcacccgaattggtacaaccgtatccaccgggggcgtttgattacggtagaaaacgccaaacgaaggtgaccatcggtttggattcgcttttctccgtcccgttggagctcgaaccgacgagagcccgacctacgcgctagaagtctccactcgttgctgcagcttcttcaggtgttcgatgccggcacaatggcaacgcaaccgcgcgcaattttggcacgaatgcatgaacagctgagagagttgcgcagagagggcaacgcacaagtgtctgttgtggctaacgcatgcatgatggtgagagagagcgagagagagaggagagagagagagagagagagaaaagggggagagagagggcgagagaaaaggggagagagagagagagagaaaaaagggggagagagagggcgagagaaaaggggagagagagagagagagaaaggggtggaggggagatgttttcttttcattttcttgcagagtttggccgttgcctctggacaacccgagtttctgttcgcctccgttttggccctcctctgcgaatccaaacgttgtgtgccgttcaaccaagttggccgccttctttttacctttcgccctgttgctgattccaatgtttttgagctcgccaacagtacaagccctctgccccgaaactttcattctttggcactttccgtccatcggcgaattgtcggcacaaagtcgggccaaatcagtcgatggatcagcgagccgttggagcagcgaccgattgtgtgcgaattcgacgtcatttacacgggaagtgcgcttattgaggaccgatcagctgaagagggcattcgccggggatgtttagcatctgatggttttgtgagggcgaagtgcgacgacaaaaagccgccctttttttgtttgtgtgaaggtgcctatgtgtatctgctgacggtgtacggcttcttcaaacttggcaccggactgtgcgaaacgcgtgccggcgaagtgatggtgtgcaacgagtcggtccgcttcagtgacggctctgcgctgtacgtgtccaacgggtcgctgtacctgcgccaccggcactctgcgcgcctttgggtgttggacacggaaactttgcgcgaaatcggtccattgtttggaaatgtttcccatttttgattgcttttcaggtgagatcctgctcccgtccgcgctgatcagtcagggccttctcttttctgatgggcgtcagttttgggtcgcctctttggacgaccaatggcatttggcgttcactccgttggacgattcgtttgggcctttgcggggagacaattcgccaaacgaagcggagggcggtgatcgatggacgtcaggcgaaaaagccgcgaggacgacgcaattacgactgatggactgcgaattctgtgcatttggcgaattggaggagacgcacgatcaactattacgctccattcccgaaaagcttcgtggtaattaatgccgaattgaaattcgaattccatttccacgtttggcactttgccctcactttaaggggtcactgccgacctccaacttggccccggcgttgcctttctgttgtctcgttctggcaaagtgtttttcgccatctcttcgtccgattccgactttggtctttgctctaaaactcctttctgttggaatcgcctcgacgtgccggagtcaattgtgtcgatggcattggacagcaacagcaaaacgttggtcctccgttctggcgccgggaatttgtggttggtgggcgaacagcgaacgaaggcattgggcaaatcgccaaaagcgcagcaaaacaaagagtcgtcagcaccgatgataagacgaatcaaagtgccgaacaagtgctgattgacatttggcactcatttggcatcaattaaattttaccaaaggaagaaatgcgtgtccctttctgtcgcgtccgttggcggcggttctttggcctttgtcaccgaaatgggccgcgtctttctgctcggacggcacgtgctgaacaccgctcaacagtcccaagtcggttttggcatttttggtgtgccattcgctttgacttttttttttcggcagatgcctttgctccaattgtcgccaaatgcgaccgctcctcagacggtgcccggcatggacaatattccgctcgcgcaagtcgcactgggcaaaacgcatttggtgggaattgcaaagaacggagcggtgtacgcgacgggactgaacaaccaaaaccaatgcggaaggacaagcgaaggcaaaccgcaaaatgagcaggaaaaggcacttaatttgtgggggggggggaggggaaacgaaaggggtggatgaagagaagagatgaagcattgggaattgggacggacattggcatggcattccaaatgccattcttttgaacttcgctcggtactcagtcgctcctttggcattttctgccaatccgtcctcacttccgccgcccttaggccccttcatttgctgctgatgcaatcgtttcgtccaattcgcaatcggtgtcctcctccacctcgtcctcctgctgtcagttctgctccccctcccaacatttgttcgtcgacgacttggcctttctatgcgtccgttgtggccaatgttccgtgaggggaatcgcgtgtcctttctccaactacaaaaggacggccggcacggcatgcgcttgtgccaaaaacgggccgagttgctgcgttcgttgtggattgtgcagagaatgtgcgcaggcggacaaacggtcgcatgcgacacgcggcaaacaccagccgagtccgaaggcggtgcgactgcagcaccaattcacgggaggacgcggaaaagcacctttggcacgagaggaggaggaattgggcgactcggaaagggtgcgaagagagaagacagcgccgatggcacaatcagcagcaaccgcagagacagccgcaacatccacggggactgccacaagatccgccggagttaccgcaacaacgcgaatctttcctctcgagcgggtgctgctccaaccacagccgaacataaaagtggccactgtcagcgtgggcaacttccacacagtggt

SEQ ID NO: 17661 - DNA, 1290 bp, Heterodera glycines
  misc_feature (1234)..(1234): n is a, c, g, or t
cttctgattttcattatttctcgctttggttcaattccccaccgggataaaatatttttcatatttactttaccattcattattttaaattttcccggcggcgcctatcggcaccgccggctccccttccttcccaaaagtcttggaaaaaacgcgccgcgaaagaagcggtgttgaaagcaacaaaaaaaaaggttaatcaatttacatggcggacccagacccccttgtattgcaaaaaatctgaattttagtgttctttatcctgaatttgaaaaaaaggctggtcaacctgaatatacatatacttctgaaaaattataatgctaaaaaacaagcactcgcgtgaaaattgaataaaaattttgtatttgaaaaattttgtccaaaaatttttacgttggaaaattaccggtttttaccggtaccggtatcggtaccggtggaaaaagttggtaccggtaccggtaccgggttttgcattaccggtcagtaccggtaccggttttttaataattacctattaccgaccaactctagcatttagaatgaagccaaacccttcgaaaacagacatttatagcctttttcgctagaacaatgactattttgttgccaatatgggactaaatttaaaatttttggtaatattaatgctaaatgttatggaattttacttcttcccctggctacgggcctggcaacttgcctgttctaattttggcacgcatatttttggcattcacggcgaattcattcatttttcctgcatcagtgttgtcgctgtccttagccattttttcaaattgcttcgccataaattttgttgttgcgatcagtttattcagtttcgcttccttttcctttaaaatattcacaaaatttaattccttttccgattgttcgtcctcttcttttgtttcggtgtcgaacaattttcaattagcaatgaattttgcttttgtggttcgctgttctcctttgtatctggtttttgttgagatgatgcttcttccgcgtgagaaacctttaaaaaatgtgccgtggctaagttggttagagctttcggtaaaatcaatcttagggccctgatgagggttacacaggttctggtacccggtcgagcccagactcggatacccagttttttaagactcgctacctgaaccaggcttttcttgactcggaaatctggaaccttgtaaatatttttttctggatctacatgctctanagtaggcaacacattttttgttaggaacaacatttagactatttttatatattttt

SEQ ID NO: 17662 - DNA, 2021 bp, Heterodera glycines
  misc_feature (2019)..(2019): n is a, c, g, or t
gacaaatttgcgcctgactcaatttgacccaccgcttttttctttgaagtcctccaatttatcttttgcctcactgatgatctgattaaccaaattactgccactataaaatacatcggtttgaattgtagcaattttttgatataattgctccatggatttgcgggtttccgtgtaactgtcaacgttttgccaaatgtccaccagcccaatttctggcaccaacgtggcgaaatcggtgcgcaattgattaatccatatcaatgcagttggcaatgtgttcgttgattggtcaattgaaattttgttgattttgtccaattcatacataaagtgcgaatttgaggcgtcgaatttgttgttcttttggttagcatcggaaatataatttttgtgaattgcgtacgacaattcgcatctgacattttggcgaatttcgtttgtcaaattattcaaagctctgcttagatttgcactgttttcttaatagttataattggtgctaggtcacttacaaaagtgcaaatttggctgcttcataaaaaagttaaaaaaataaaatcaaaaatctgatatttcctatgatttttttatcaatttttaattataaacatgttaaaatttaattaaattgatgttaaatacacctaatttttgttggatttcgaataaaaataactgtaaaatttcttagtattaactaaatcattagtcagattacttttaaattttttaatattttaaagttcaattacaaatgaaattaaattaaaaatgaactcaaattatataaaaaatggaaatatttgtatccgtttcaacttaagctaaattgcttaggtctaggcctttgcttagactttttttttttttgtaaaatttataaacccatttaagcttcaaaatgatctggctacggatttttttaatattaggtaaactttaatcatttttattcgagtttcaaaaaactcttagaagaatgtgttttaaacatcaatttaattaatttaatatgtttataattaaaaaattgacaaaaaatcatagagaaatcagatttttgatttttgcactttttgtgaagtgaccaaccatgttataatttcattttatattaagggcccagcgggaacgcgattcccgtgggaaaacccgggaatcccgttcccgtatcccttcccgatggggctaagtccatgaaaaaatcgaactcaacaacgaagattctcaatttaataaaaaaaaattttgaacaaattttaaaacgtcaccaccatttattgagtgattttaaaatgaattatttttttttaagtaatgtcaattgatacaaatattttcaagagatttttaatttaaaattattcttaaagtaattttagggtgctaagtccgagaaaatcgaactcaaccgatcccaacctcggtttttaaattctaaaaacaggaattgaatcttgaaatccataaaaaaatttgaataaatttttaaaattcacagtttaataaacaaaccattgaaaacgaatttttttaagtacttctgaatataataaaaatatttgaacaaattaagtaataatgtcgagctcagggtttcgtaaaaacattattttattattgaataccctaaccataagccgaatcaaaatccacgagttttttttttaatttctgaatttaggttgaataattttctaaattgtatgttctcattaaaatcattaattatttgcaaaattatttgaatatttatttattttatttatttttaatatttcctaccatatttggccaaaatttccacttctctgatgtgttttcggcatttcgcatcccaaacaacaacttcattgaattgatttccgttcacttccggatgaagaagaatgatacatgaaagcaaaaatgttaacaaaattttcatctaaaaaggccgataatcagaaaaaaaaactttagttttgtaattttaataaaaattagtgcaattttaattatttaaaaaaaactatntt

SEQ ID NO: 17663 - DNA, 2864 bp, Heterodera glycines
cttttggcaaagtaaatatgaggtgcggaggtgacgaccgaccgccgcaataaattttggcattttcaaaataatttaacgaaaataacgattatagatgctaaaaaagccaaattggtttttaggtgccatatttcaaacaaaataggtattttaaaatgttttacttgctcagatttttattgtgtttttagtgcttttacgaaaaatgctatacacagataaaaatccgaacctattgataattaattggatttattaaacatttatttttttaaaatgccaattttaaatgttttatttttggaaaatgaaaatattttcactttattgtttcaaaaatattttcactttattgtttcatattcttctttttttctccatcaaaattgggtccgtttttcagaattccggaccaaagagtctgctactaaaattggttggtatgaatttttcaaacatgatttattttggcattaattttttaactactctacctacaatttttttagttttcagcagccattttaattttttggctcttaaagtcgctaaagaacaaaacccgaataaaaaattaaattccaataatttttaattcgattttataagcattgcaaaaataattagattttaagaaatttaattatacactttttttttcttttaaatttattaatgacatttcattgaaaagatgtgatgatgaagctaatattaaaaaatggaaatcgattcctgggcttggctcataagaaaggtgctccttcttcgcttggctattaggttaatgatagcctccggcgtcggctgggagcaattaaagccaaatataaaggcccgttttgtgtttcccatatcatttcgccttttctgtcacgcgatttcctgtgaaaattcttaaataaaagaaagacataaacaaaatgccgaaaatggactaaaattttacaattttattattttaaatgtctatttaaagcacctcaaatttttaaaaatatttgaccaatatttttttgtttaattgttccttttatcacattataattaattaatttaaatcaattatccgttaattaaaatcctttttttatttgtcttaaaacgatttgcttggatactttctgaattttcttacagaattaagttaaacctgttaaaaaacttaacttacttttacatttaaatttgattaattcttgaaaatttaaatatttttattttattttattttaaaattttatttaaaatgtcccattgggtttggcacaatgtgtggcaggtgagcagcgccgggtgggccgagtgcgactactgcttgaactacgacgcgcgcagctgttgcctggtgtttctgcccattgggttggcactcctctttttcgtgtggctgttttctcaggtgaaataatttcaaatttttgtttagagaaaaatttttctaagattttttttcaaagagaatttgctaattagcaatttttatttttaatcaattttttattttaacctattttcatataaattataataacatatatttttatataattaaaatttttgttgcctagtttttctgcaagggaatcaaaaaaaatatatttttttgttattttccagtttaattaaataaaaaatatattgaaacaaaataaataaatacatacgatttcgaacaaaaaatattgttcattatgaatttaatttagaaaaaatgctagaacatatataaaagcccttaatatcctatattattattctcgcccggatttttaaacacatttaggtaattaaacctcaaaaattcttaaatttagcatgaaattatcataaaaaagcaaattatcacaaaaataaaaaacccaataaatttcagcgatttttcgaaaattagaaatttaaaaaacttttagagccttagatttattgcaaatttattgatttagtagatggaaaaaaatttagactcagttgacccccccgccgcccatgtggggggggggcttgtctgtgttgaaaaagtttggtgattagaagctgtaaccaagttcgaaatgcagttttcatgtttccttttgtttgccttagggcgtaagattttttaaattatatttattttttaatttaagaagggccatttcgcggttggcctcgtcattgtccaactgttggctatcattttgcttggcatcgccctttttctgctgttcatggcctttcatcggtgtttgcgccggcttaaggcacgcaaaaagtgctgtacaaaacaacagcaacaaacagttgaagaagcataagaaactaatcaataaatggccaaagaaaaatcgataattaatctttgatcagctcagtaaattatccgatgaatgaaacagacaagccgtgaagaggaaagaaaatcgaagacaatgtccatttttgaaattggaaaatttatataaaatatatttttcttttacaatatatcttttttattttttccttttttttgactaaattaaacagatgctttatgtacatttatttataaatatttgtcattgaaaataaaggcgatccctaattgattaattaagattcacttattacattttttttattattattttcatttgtataattttcaggtcgttaattaagaaaaaaagaaatagagagggggggggggcgggtataataaaatacggtattaaaaattaacctttttttcatgctacgcgcgcccctttctcttttacaatagattctatagtttcccaaatattgattatgtttaaaaattttacaaaaagggctctcgaataaagcaagaaattatttttttgtaatacaagcaagggtggtttacccaaattaca

SEQ ID NO: 17664 - DNA, 1709 bp, Heterodera glycines
cattctgatgttgaattgtcgatttaatcgctatgtgttgtctctcaattatgtttgctctaccataataaacgataaagcctcttctgtgacaaacagtgaaaatgaattgccatttttttgtagggcttatatttttaagttataagaattgccataaagagactaggctcaaaaaacccaaaaaaaatttcttgtctaagaaaattgaattttcgtgatgaattttcgagaaaatctggtatattgccgatttttcatttgaaaaatcataaaaacatgtttctagtggttttcggggttgttgatcacgaatctgaccatcattttgtgcaattccgaatccaggagccgaattcgagcaaaaagtcaaatgttaaaatgttcgaataaaggggctgtgataattgaatcgcgcgccactcaccgcaaaagaaatgaaatcattccaaccccaaggcggcgtttcattgttaaaaactttttttccatcgaattcttccttaaaatcccccacaccgctcttttgagagataattcgaaatgttgccgaacattcgcggctcaaatttctatcttaaagcaaattaaagattaattaagttcagattttagcgtattttcttagcgtcattctgggagtcgaccttcaaaaggtttaacaattaaaacaatttttaattttagtttttcatcactcaatcgaaaacttttgagaatgaaaaactgacaatgagcatgaccttggaaaatctttggataaaaaaacacttcaaattgtacgttaaatttatttattattagtagggctataaattatatgcttttgcatattttttctgcgcatatgctatgaagaaaggggttcaaaaatagcatttctacgttaaaattttttgatttggtgaaggtttttaatgcatataaaagcatattttggagcttttagagaataaatacatattcaccattttcaaggttttagagcatattttagtcatttttggcaaattttcataagaaaaatgcaataaaaacgaaaaatacaccccccaaggatcgacttttgggaataaaaaaatacatacttaaaaacgaaaattttgagctttttgcaagaaattttgaaaaaaatttgtttatataaaaatataatttgttttggtatattataaaaattttaaaaaattcgcaatttcatatataaatttgaacaccaaatattttatgcgcatattcggcaatttttagtgcatacaactttaaccctattgattaaataattattttcaatagagctattaattacaccaagttatagacaaaataatttgtaattctttatataattttataagcaaacctttttcagtaaagtcgcaccaaagataaaagctcaaccatttctcagtgctttcatttttcgttataagtgccaatattttccatggcactccctttatatacacagtttcacttttacttccacttccgtagatttctcgcgcaaattcggataatttttcaatttccatcgaaactgtgccgttggatttgtttggatcggaaacgaatttctccgcttttggctcatccataatgacatcaatggccaatgtcactttgtcctcttctttgttgtaaaatccttggctcgtgtccaacaattccttaatttggatggatttatttggagatgcaaaaatttg

SEQ ID NO: 17665 - DNA, 1175 bp, Heterodera glycines
  misc_feature (1154)..(1154): n is a, c, g, or t
ggataattaattagaaattaattcattatgaaatggttcatagaagagttctgtctgggccgggggcctttttgaattaaaaaggaaagagacaaacgataaacgatttatttgtcgttagtatatgtcgtttaggaagattttttaattaaaacataaacaattgttgtttaacattaaatatagcaaaacacacaaggaaaaattaaaaaaatatattaaaatttcaaatttgaacttagtaaagagttaaaaaaaattacacaataaattgtaagtattttaaataggaatgttataattaaattatttggcattttaatttagtaattttttaagtttaaactaaaacaattaattgattctctaaaactagccataaaaatataatccattactagagctcggataaaaaggcaccaaaaatcgcgaaaaaggcactataataggcaccaaaaaattgaaaaaaggcatgaaaaggcacaaaaaaggcatgaaaaaaggcattttaaaaaattttctaaggttttttagggagcaaaacacgtaaacttaaccaaaaacttaattttggtcatttaaatggttattaaatattttataatgtttttcgaataaggaaaatttttaaaccgagaattttttatcaagaaaaaaaaaatgaattttggcgatcaatttttgagaaaatttttcaattcttaggggtgtattttctgaaattttttcaattcttagggatgttttttctgaaaatttttcaagtcatttcttaaaggtgtattttcccgattttattctatttttgatggaattttcggaaaaaaacgtcaaaaaggcaccaaaacggcaaaatgccaaaaaaggcatttaaggcacgaaaatcacgaaaaaggcaaaaaaaggcataataaaagtcaacgtagaagcctcaaaccaagtggaaaatgcgttttttatgcttaatatatcgaaactagtgcgcagaaaaaaaggcatatgcctcaaaatccgagctctttcattaccaacgctttttgtaaattcctcttttggcatgagtggaaaacgaatgttgaacaatgtcgggccaagcatttcgcgccgattttcagcagaacattcgatgccattttgacggcactgttcgtcgncccaacgaagtgactaaattt

SEQ ID NO: 17666 - DNA, 3005 bp, Heterodera glycines
  misc_feature (19)..(19): n is a, c, g, or t
gtgggaggtgaagaagagnattaagggacagagggaatcgcccccagaatacatggatgacaatgagaaagggacgaggcattggccgatcattgatagaataaatcaacttttgaggatgatcgtcaccaaccaccgcaacccatcagcacatgtctcatcagtttgatccgtttcgaataaatatctccacattatgtgtttatagatcaaaatctgcagaagcaggaagtcaaaattattctgcggtttgctggaagacaactttttgatcatttatcggggcaatgattaaaagataactctcgttaagccgaacagtcgcaaattgaatctgcgtagagagagagagagcaattattattttaatagccgttgaatattaaaaatatttttcaaaatcaaaacaccagacaaatatgcgacaataattgcttttgttgaaaaaagatctatttaattggaatcgcattaaacgtgttaaaatttaattaaattgataataattattttccgttttgtgtggattttcaaatgaggtgggaaattgtagttgcaccgcctgttccaaatcgaattcacaacattacaatcgttgaaactttcaggaaaattcaactaaaatgttattgaccctgactaatttttgcatcgaaaaataaggcggcgagaaagccataaaacaaggtgtggcgagttggccccggcgagttgagcacagcgagttggccgctgcgagttggacgtgaagtgaattgactatggcgagttggacggttcccaaattccttggattccccccccccgtccccgtccgtccggctgcgacgattttatctctgtctctttccctctctccctctctcttttccgcgttgtctctctgttcgcttcctcttcttgtagttcatctgctgatcactgatcaccgctcgttccctctcagttcgatcaatccccccaaatttactggttctcttccctctccttatttgtgttatcccttcgcttttgtacctctcttagccccactttccgatggtttcactgacgttcagcagtgtaaagtgccgcctttctttacagcgagaaaacgtcgaaatgaccaaatgcttaaggggggggggtggggaagagtgatccaaaatattcggcaggtgtcgatgttcttccaatggtttgagtaagggcttttttaggggggggggcaaatcgatggtttggcgaggatcaaagggagcgatgagtgatttgaactgaaaatttgcattcgttcacgacaaattcagcctttttccgaattcgttttaataaatttaagaaaatcccttttttgtctcatttcattttttaattaacgaaaagtaacgaggaaaattgaccacaattcgttttgccaattgtccctttgtcctaatttcggcccttttgaaaatttgcgattattttatttccatcgctttacgtatttgtacatgccgaacagggaatattaattttgtttgttgatcacttatcataaaaatatgcaaattgaccatcaaagggaaggacagccaaaatgtttatgggaaattgggaagtgccgggggcaaaaaggggggggggggaggggagggagagcattcgttgtcgggaaaagcatttggtcgaattgaacgctgatcaaatccaaatttaaattcacatttaataaatttaaatactgattaatttttaatgaactgttttaaaatcaaataccttttggcactttaatatcaacaaaaaacattcatttatctttaaatcgtttatacaaaattctgtaataaaattaatttttctgttttacgctttttctaatcaaatcatcggtcgtcggcgttttgtgtgtcattccgtgaccaccgatgccctcccgccgcccccttcccctcgttgtccacaattcattttccgccgcttgcccctggcaaacattcggcaaatttttggggcgaaggtccttgagatcgaattcaattaatccccccccccccccttcaaatgtccaatgttccggaagaaaactgcgcaaaaaaggatgaaagttggggagggggaaatgaccaccgattgctttggggagggggggggggcgcaatcgtaaagttggacaaatccaacgaattttggacagtttcgtgcattgcttgtccctttttatgaccgaggcagtcaaatcgctttttggccatccgtcgcccgcgccttttgtcgaaactttttaacagaattattattatttttttgtcataaaatacttctccgatcattctctgccggtcatttcctccgattaacttctgatcaatgcctttcttccaccctttttgtgatcaatgcctttctcttctgatcagtgcctttctcttctgatcagtgcctttctcttctgatcagtgcctttctcttctgatcagtgcctttctcttctgatcagtgcctttcccttctgatcagtgcctttctcttctgatcagtgccgttctcttctgatcagtgcctttctcttctgatcagtgccgttctcttctgatcagtgcctttctcctaatctcccccctcctaacatttcttccaattaacctcgtcagagagagcggcacttttttgtgcctcggcagtgacccgccccttctttaattgcaattccatcttcgccttcccccgtgctattgtgcctcctcgcgccgtgcgatccgacacttttcccgcctcccccgcccctccgagtccctacaaaatcatttctccctccccatccccatgaaggtcagcagcctcagtcggtcggtccgtcgccccccccccccccggggatgtcttctcgtcttctccctcattcttcgccaatgtcttcttcttttcttcttcctcctcctcctcccctcaccttctccgattttcatcactttgactgaattgtgctgctgaagttgcgaccattcaaatgccaactcaattttcccaatgttctcaat

SEQ ID NO: 17667 - DNA, 2864 bp, Heterodera glycines
  misc_feature (948)..(951): n is a, c, g, or t
  misc_feature (954)..(955): n is a, c, g, or t
  misc_feature (960)..(960): n is a, c, g, or t
  misc_feature (963)..(966): n is a, c, g, or t
  misc_feature (972)..(974): n is a, c, g, or t
  misc_feature (976)..(976): n is a, c, g, or t
  misc_feature (985)..(986): n is a, c, g, or t
  misc_feature (993)..(993): n is a, c, g, or t
  misc_feature (1005)..(1006): n is a, c, g, or t
  misc_feature (1012)..(1015): n is a, c, g, or t
  misc_feature (1018)..(1018): n is a, c, g, or t
  misc_feature (1028)..(1031): n is a, c, g, or t
  misc_feature (1033)..(1033): n is a, c, g, or t
  misc_feature (1040)..(1042): n is a, c, g, or t
  misc_feature (1044)..(1047): n is a, c, g, or t
  misc_feature (1049)..(1053): n is a, c, g, or t
  misc_feature (1057)..(1057): n is a, c, g, or t
  misc_feature (1059)..(1059): n is a, c, g, or t
  misc_feature (1070)..(1072): n is a, c, g, or t
  misc_feature (1085)..(1085): n is a, c, g, or t
  misc_feature (1088)..(1088): n is a, c, g, or t
  misc_feature (1091)..(1092): n is a, c, g, or t
  misc_feature (1099)..(1099): n is a, c, g, or t
  misc_feature (1101)..(1102): n is a, c, g, or t
  misc_feature (1105)..(1105): n is a, c, g, or t
  misc_feature (1110)..(1111): n is a, c, g, or t
  misc_feature (1116)..(1116): n is a, c, g, or t
  misc_feature (1120)..(1120): n is a, c, g, or t
  misc_feature (1122)..(1122): n is a, c, g, or t
  misc_feature (1125)..(1127): n is a, c, g, or t
  misc_feature (1136)..(1138): n is a, c, g, or t
  misc_feature (1141)..(1141): n is a, c, g, or t
  misc_feature (1145)..(1145): n is a, c, g, or t
  misc_feature (1148)..(1148): n is a, c, g, or t
  misc_feature (1153)..(1154): n is a, c, g, or t
  misc_feature (1156)..(1156): n is a, c, g, or t
  misc_feature (1159)..(1160): n is a, c, g, or t
  misc_feature (1166)..(1166): n is a, c, g, or t
  misc_feature (1171)..(1171): n is a, c, g, or t
  misc_feature (1176)..(1177): n is a, c, g, or t
  misc_feature (1202)..(1202): n is a, c, g, or t
  misc_feature (1221)..(1221): n is a, c, g, or t
  misc_feature (1229)..(1229): n is a, c, g, or t
  misc_feature (1244)..(1244): n is a, c, g, or t
  misc_feature (2807)..(2808): n is a, c, g, or t
tttatcaatattttaataaacattttggcattttgaacccccgcattttttagttcaaaatcttttcacaaacaggctaacatccaccaaatttctccggcagcacctgtcggcaccgcctgacttttttaggtaataaacttcgaaaatcgcccattttgtaaatagtttcacccaaaaatgctggaatgatgaaaaacattatggttgacaattgttttttcagtaatatgcattagcagaggtgccagatgaaaattttcaaatcagcatttatgctaacaaaaaaaaatcagaatttagggtcaaaaatcagcattttgaaaaaatttattccaaatgcaaaaagtcaattaatttgttttttttgcggttttttccaataaaaattttgggaacaagggaaaaaattttgaaaatttgagtgcaattggttaactcattttcaccaaaatgaccaatttttgcgattatagcccttttttaagaacaaaaataagttttatgggctaataggcgtcaccgggggaaaaattagaagaacttaaggcttatatggcgttttaaaaatgtgcttatttttgacccttttacaaaaatgcaaaataaaatacattttcaattttttatttctccaagtttctcattttgaattaatcttttcttgtatatttcgggattttttgtaaatataaattctcactccagtgatgtcacgatgcgcgcgaactttaaatacatatgtttatgtttctaatttggcaaacgagcaaaaaatagcgctaacacacattcatcattcattcattttacgcggatcaaaaaccaggcaaaagcgtaaacgagctttaaatgttattgaactaagctaatttcaagatgggttttgaagttatgccacaaatttaaattttcacaatctttcacagttttctttatcaaattctnnnnctnnatggnctnnnncagctnnntnccgggctgnnatgttcngggttgggtcgnnccgttnnnntcnggcttttttnnnncnttttttnnngnnnntnnnnnttgngnttttttggttnnntttgtttgcgtcnttntcnntttgccncnnttngccgnngggcnttgncntgnnnttgcgtttnnnccngtgntcntggcnncnttnncctttncgcgnttctnntccccctcccccctttttcgctttntccgtcctttcccccttcnttgtcccntcgtccgctggctgntcggtccgattgcgatttgatttagcgacgggcgatcatcgtcagtcagtcggcgatgtcgcattatcatttttgcaaattttttcccttccgtttcgcgccccgggagaaggacgccgtccccttcctccccccctccctcgacgcctcgcgtgtccgcgctgcaaaatgcgcgaagttagcgagccgattgtatgctgcgatggggtggatgtgcaaactcgtttccgccaccgcctccaccctctcccccgcttcctccacatatctttcctccctccccgccctttctccgcccgtccaactttttttaatgggcctttctttaatcattggaatttgcccgatcaaaattcaaattgtcatcgatactatttttgtaattgaacgcggagattatgcgccgccgttcgatgtttgtgatttggtttgactgctactgattcatcttccgtcccgttcagaacagcagtagagggaaataactaatctttgtgcttttgcgggaacgcatccgttcacagtgatctctctctctctctctctctctctctcactctcgctctcgctctctctctctcgctctctctctctcgctctctctctctctgatcactcactcttcgttctaatcattcacttgtcgaggacactccatcgtcttttttgcgggtttaatccctacaatgatgttgctgatcgccatcacatcatcgttttcatcaatcgttatgtgcttcttgtgcaactgtcgctggtactgcgcgttgcgatcaccgggcgacggaagttgcgatcggtgaaaaaatgtgtaccaccgctacaaattagtggtaattactttacacacactctctctctctccgcccaattgccaaatgtttcccaaatgtttccggtgttttctgctgacggcgttcctcttttttcactgtgtttaagacgaaaatatgggccaaaaattctcttaaaaaccaattaagaatcagttggagaaaatatcaacccaaaacatgaattgtaatggaaaaaagaaagaaagatttataaaatgacaaagtttgaataaatagaaaatgaaataaaataaaataaaaaatatttaccaaactgaagagaatctcttccttgaaaataatcagttcaaaatgatcgtgatttatcatatatatccgacattggaataacaagaagtgacctgaaagaccatggccaaataatggacttagtttcccccccccccccccccccaaaaaaaacacgggatcaaacagcggcggcattacctcggcttggattggatacggtcccggccgtcgatcttcccttatgcccatgtttatttctaattctcaagtcaagaaaatccctgtgatgtaactaacaatttggtgatctcggtcggacggctcaattagtgcctgaaggcatattttaatgagttgatcggcattctttgcgcaatgcccacaggggattaaaagtgtaattgaccttgctgcccgctgcttcagcgcgtcaatcggatcagaccttctcgaaatgtgcgattcggttagccgnnggggggggacgatctgatcggcgccgcccctcccccgaaatatatcaacatacaat

SEQ ID NO: 17668 - DNA, 714 bp, Heterodera glycines
tgatgggttaacatttcttagagcaaaagaagcaaatggccaacccccccccccccctaaacccgggaagccattctttatgcaaaatgagaaaaacaattcagatgatgaacatttttacccgcaacaacagcagcagcaacaatcgttggcacagctggtggagaaccgcatacagcttggcaccgcgattgatgagggcggtgagaagccgccgccgcagcagcagcagcagcagcacagtcgcgagttggccatggccatcgtcgacccaagcggtggcacgacgacgacaacacccgcaacactaacagtgaaggaggagcagcagccgcagcagatgaacatggagcatcagcagcagacacattttgtagctgctccaacgtcgtcgtcagcagcgggcacagcccaaacgatgcctaacgcagcacaaccgcagcagcagcaacagcaacagatgaactcgttggaaagtccatgcggagggtgtcgagaattgaaacggtaagttaaaaaaaataaattatcttttcaaaattattttatgagaaatggaaaagttggattttgtgaatgtgactaatttggaacgttttcacatgtaattgcgtaatacatttaatgccttaagtgagaattgaaaatggcgaatgaaattgttgcgcacatttgtgggaaagtggcaaaaacgagctgtcactttagtgaata

SEQ ID NO: 17669 - DNA, 2901 bp, Heterodera glycines
aaaaataatcgataagcaccaaaacccgaccccgaaattcgaattaattctaagatataggaatattacttcgtacaatagttgaataaataaaaattcatttaaattaatgaaattgaatttttctgaaataattgatggtcttttatttttcttccattatttcgcaatctgcacgtgactttacaatttcgcaatatgggaccaaattaggtcacctgtcaatcaaaatttttttattttgcattttccctatcgatttcgcaatctacacgtgacttttttttgttgcatatttcgcaatagacacgtgactttctgccattgcatcgaaaatttatcgtttgtcaacgaaatattcctcaatgtcaatgaaaaacaatcacgtgccaggtgtcagctgacacgagccattctgcggccactataaaagccgcccaaattcacttctccattcagttcaaccaaaagttggattttgctaaaataaaattgtgcgctcttatttaaatatattaaatttaatttaaaaaatgacttcaaaacgcaacggaaatacggaacaagccgggccgtcgaccaaaaaatgggattttagatcaatcgggtaagtaatttttaataatatatttaagagacaattttaatcaataatttttcaggaacaattttactgaagaaatggaaaattataaattaattgacgaacggtcgacgatttgcgaaaaatttggattcacgaagaacattacggaatttcggatcaattcggatgtgagacgccctgacgaagcgatgagggacgcaatcgacacaatgattaaggcggcttttaagactacggaagaaaggatgaagcggaaagtgcggatgtttggagtggcaataacgggtgccgggcttgcttccccggtttgggtaccgtacagggcgtacccgcagaacaatgcggatgttattatgcaggagattaataagttggggcagagcggggacggagatgaaaataagaaaacgcttttgttgtcggagcctattatgatgaaaattacttgcgtcacactgcccagtggagaagggccgaggaatgtacataaatttgatttcggatttaaggaacaccaacggataatgtaagtttttgagaaaaaaaagaaaaaaggaaaatagaaaaaaagaaaaaattataattatttattaagtatttcgaatgtggataaattttgtttgttttacgcactggcgtcgtcgatgaattatttaattatggaccgttttgcatttaatcgatttatgaacaatattatgagacagagggacgcagctactgagcttttacgtaattgtggaattgatattaacgaatatagctatggagtggagcacttatcgagggttcagaattatttggtgggttctaaaattttggaaaagtgataaattaatggattttcaggatgagatttaccctggaaagtaccgagtggtggcatttgaaaagtcagctgatccacggaaatcaatccgtgttttgtggaagggccctataggacgtgaaaatgtagtgccgatatttttggagaatggtcactgggatggtctgaagaattacgtctgcttttttaatcgtgggagaaaattctgtaaggctggggctttagagttgccgctgtccctttacaatttaatcgttttttcgagttttaacaattactctttttctctaattctctcctctctcctatagtgaatgcgcatctctctgcccaggggggggggcccacatttctgtcctaatactactgagggcgtatggaagtacgaacagttgcgccagttttgcctggagctcagcgggttggccgtacttttacaggttttgttttttgacttattgcgaaacaatttcatcagagatgttttttggattttaaccatgtgaattatcaaccccttccccaaataggagcagtgtcaccccgaaagttgcacacaaatgaccgcgactgagcagtggatttgtgagtcttccttattgattttctgtctcaaaatagttagttgagcttggcttaggcctgggtttttccaggttatgtacgaaaaatcttaatttccaggaaaatacttaagaatttgctctttttattgttgcggtttagtcggttttacgcgtcctatgaatgaccatactcagtttcttaggccataacttttttctttcttgactaaggcctccattcttggtatcaaatgaatgcttaaactcttggtaatcttatgtataactaaattctgagctaaaggcaataaacaaaaaattatacttgaatatactcgaaaaagttgaatttcgttttctcattgtaatttcttttataatgccagtatttgttcttttctttgcatttatcgaactttaagctttcgtttcataccaagaatcatgcattgatcaagtatgaggaatgcataaatccgactagaaccattgttactttttaaaacaaatttcaaaaatcaaggcccgggccatgccatgcgttgatttttcctggacctggatttttgtccatgtccaacatgggattcagatctaggcccgggggcttttttcaaaatgtcaaactctattattatccttccacttttcatttcttattttgtcaaaagttttgtgcgcggcgcacaaaaacccgaaggagtgcagtgccattgactacacgcggcacactttggagggggccgcctctctgctgaacagcaaccgctacttccccagcagagccaccatcaaaaagtcgtccatcgccaaaattggatcggtgtgccgacgactctaccgaatcttctcccacgcctattgccatcatcgccagatttttgactcatttgaggtgg

SEQ ID NO: 17670 - DNA, 1696 bp, Heterodera glycines
tatatgagaaatgtttttacgacagatgttcagaaaaactattaattaaaggaagtgaaagcagacagagaacatttcccatgcgttttgggcgacattaaaagtctgaaaatttttggtctttgaacatttatctgtttggatgaagcggcttttgccaaattaattttatacggaacaaattttgcattcggtttaattacccaagtttgagatcgcaaaaaacaacaaatttctttcctaattaatcgaaatgaagcgaaccaacgcatcaaacatcactccacctcgcgccaaacgtgcaatgccacctgcactggacctggaccaaaacactgccacactcgaagagcaagaacgccaacgcaccctggtcttcattggcctcccggaaagcaacgccatccgcccatcggagcgtgttcaggaagacagggaagccgccacaaaaatcctggaccatcttgaagttgaggccgaaccaaccgccgtctttcgactcggccggttcgacccccagcgaacaacacctcgcccgctcaaggtggtcatgccgacgcccacacaccaacatgtggcactcggaggatggaagtacgagcgtgctcggctccgttcccaacagaacctgacccgtctgttcgtccgtccggcgctgtccaaagaacaactcaaagaggaatacgaagcgcgtctccgaaaacgccaacaaaacccagctccgatggcaccggcaactcagctcccacagacaaatgccccgactcccgttgtcgaagatggaccaaaccagaagaagaccagtgatgacattcccaaacaaccggaggtttttgacgaaacaatcctcgtctgttatgaagcactaaactcatttccacccaccgacaaaattgttcaccaaattcaatcgctcaaaaaacaataccctcatcttttcaacaaatagttctaccagacctccaacaatttcttcaaataaaaatatccctcaaaatttccctaaaaattttacccaaaaaaaaaaaaaaaatttttttttcctcttttacaacccctaaaaaaacaacaacaattttccctttgttggaggtctgacttttctaatttctgcttcttcattcaaaatttcaattatcttttatcactacctttcatttcacctcatttccgccaaaagtataagtggcacatgcccttcttttggttatttttatttttgaataaataaataaaaaaaaataaaaaaaaaataaaaattggccaaaaaaagtgaaaaaattttcaaaattgtactcttttaaactagcgccgaatttttaaataaggttgaaaaaagcagagaaaaggtgaaaaaatgtgttgttaagagattggaatttcgaaaaatgctcgcaaaagaaaaaaaagagagcttttttctgtacacattgaagttgatgaaccaacagtggcccagtgaccgacaaaacactatgtgttcaagccagcacagtgtttgacaaaaaagctcattacgccaattttttcttcaaataatatttctcgtctcctttaccttctctcattgcttctctctttcttttctattcattttacccctctctccctacttcttcctcctccttcttcttctctctctctctccctccatttctctctccctttacctcttgtaatctcatctctctatcct

SEQ ID NO: 17671 - DNA, 3129 bp, Heterodera glycines
tttgggtatttgcacaaaaatgcgagcgcccttccatatcaaaccggacgcacagcccattttctgccggcctcggccagttacacatgcagccaaagcagctgtcgacgacgaactcgaccgtttgctcgcttgtggcgccataaaatctgtggacttcagcaaatgggcggcgccgattgtggtcgttaagaagaaatgtggcaatgtgcgggtttgtattgattttgcaaccgggcttaataacagtctggaactaaaccgccacccgctcccacgcattgatgatatttttgcctcgctggagggttgcacaatttttagtcaaattgatttccgcgaaacatacctccaagtcgaattggacgaagagtcaaaggagctggtgggcataaacacacatcgcggtctttttcagtatcaacgcttgccattcggagtcaaaagtgcgccaagcatttttcaaaaattgatggacgaactcaccgctggccttcacggagtgttcgggtatttggacgattttatcgtgggcacgcccactttggaggagcacgatgctctcctaaaacttttctttggtcgcctccaagactgggggctccgtgttcatttaaataaatgcaaatttctttgtccccaaattaagtttctgggcacatcgtttctgccgaaggaattcatcccgatccggcccggtcagcagcaattgagtcaatgccaccaccgcatgacttacaaactctccgatcgttcttaggtgcactaaattattacggacgcttcattaagcaaatgcgtgaactccgtgctcctctcgacgaattgctcaagaaagacgttccgtggcattgggaggaaaaacagcaaactgcgtttgaacaggcaaaatcgatcatgcagtccgacatgctcctcacgcactatgatccgtcaaaaccgatcatcgtcgcagcggacgcaagcaaagatggaatcggatgcacgataagtcacaaatttccggatcagtcagaaaaggtggtcgaacatgcctcccgttctctctctccagcagagcagaactactcccaaattgaaaaagaggccctttcactaatttttgccgttcaaaaatttcacagaatgatttatggacgacgcttcacactgttgaccgatcataagccgctcatcgccattttcagttcgaagaatgggatcccaatctacgcggcgtctcgacttcaaagatgggctctcattttggctaattacgattttgaaataaaatatatctcaacgaattgttttgggcaggtagacgttctctcgcggcttgtggcaaaacaacgcgagacggtggaggcggaagaacgagtgatcgccagcgtcgacaaaacttcacttccaatttcagatgattcagcgctcgatgaatctgaaacggccgctgtcgaatacatcttcatggccaacattgatcagctgcccgtcaccgcggatgaagtcgccgagcacactcaattggacactacgctcaggaaagttttcgatttttgccgtaatggatggcccaagaaatcgcctagtgatttgtctgcctttttcactcataggcacaaactttccgaagtgaatggttgcctccttttcggggaacgtgtcgtcattccggcagctttgcgtcagcgaattttggccgctcttcatttcactcacccgggaatcgttcgcatgagggcattggcacaacaacatgtctactggccccgcatggaccttgacattgaacgttgggttcgccactgcatcgactgtgcgatggcggcaaaaacaccaacaaaaactacactctctccatggcctcgaacaaataaggtctatgagcgcattcatatggattttgcaggcccatgttctgacggcaatctctacctcatcatcgtggacgcattcactaaatggcccgagacttttcaagtgaaaagcacttctgcggacaatgtcatcgttcaactcgagtggctcttttcgcgatacggttttccacgtgaaatcgttaccgacaatgggccaccctttcattcgaaagatttttcccatttttgcaggattaaaggtatcaagcaaacatttagtccgcctaatcacccacagagcaatgggcaagccgagcgttttgttgacattttcaaaaggcaaatgaagaagtgttcacacggagacaaaaagtggatcaccaattccctgttagcctaccgcaacacaccaaatgctgcactgaaaggacaaacaccagctgaacttttccttggccgttcacctcgaacacaactgtcactgctcaagcctgacatttcttgctcaaatcgcaatcaaaatgactacacaaacaacatgccgaagcaattcgatcgcaaacatggtgctcgccaccgaacatttgcaattggtgacgatgtgctcatcatcaactaccgtaacaacaaaaagtcttggctacagggtaaagttgtctcaggttctggtgttatttggaaaattaaagtccccgtccttggtaacgtcattgtgcgtaggcacactaaccaaatgcgtaattttttccaattccccaaaaaagtcaaaatggaaatggacccggcacacagcatggttctcctggtcttgttcaaaagcgccacgttcgtttcgctgatgaagtggatcaaaacggtgccattgctcgagaccaacaacaaatcgccgatgtcgccgacaaacaaatcgaagtccggcgttccaaccgtcaacggcgttcaacaaagaaattggatttagacacttcaaaaccgcgttatgattacatttaatgatcgttttactttcgcctacccattttttttaaaccaattcaaatttaaaaggggaggtgtagagtacattgtaaatattcaaatttacgccattttcggattactgtaattccactctttttcctttctctcgctttcataaatacccatctcttttcactcatcaattgacttcgcttttcattattcaattcccttctcatcgctcgtcttctactccgactttttatttatttacttctgacaaataaacttatttaattttaagttgtgtccacttttggacataaca

SEQ ID NO: 17672 - DNA, 2882 bp, Heterodera glycines
taaccatataaaatatcatttttttaatatgtgctttcgcgctcgaatttcgctcttgaaaacccctcattttttttttttgaaaatttgtatcaatattttaagataaatattttttattcgcatcgcatttttgaccctttaaaattcaaattttataccggacactgttcagaatgtgttgcacaagtacagccacagtattgccgatttgtgtgcctttgttcgcacttggcaacaacggctcaaccatttgttgggtttgctgcaaaagtcggacggtctctgtggccttgagatgatgaacgtgttgtttggccagtggacattccagtgctgcatcaacgactggcgttacaggtttcatcaaaatccagacattttttggtctgacggtgcggaaagacgacaaaaatttttgaaattttttttacgaaattgtcatggaaaagtactacaaattttttcaaaaattggccatcgatcggctttgatattcccctgaagacaaaaactacaaaatttcaatcttgggggtccgaatttctaataaaaatttaaaaatcggtttccttactccgaaaaaaagaagtttttctagttcctaaaattgccgagtttgccgcataaaattatgccaatacatattgctcttccgagctaaaaaaatggaaatttggattttcctatactcaagtctccatggctgaaaaatcgtgtcaaaaaacgaaaaatttatttttatttttttaaatttcagaacgattgagactgcgctgcttgccggctccagcgcaatgcaccaactgctggtcagttggctgctcgacgccaaactggcacccgcggcactcacccggtggttcattcggcccaaatttgtgccatcatccgacgacccaaatgagtcccaactgcaacgcccgcgccattcattcaacaactccgtgctgtccgccgcccagctgacaatgaacggcagcgcgaacgcgctcaacatgagcatcgccgccaacaccaccaccaactatcaaaatgaattgtgcctttttgaagcgccgccgccgacggcggatgccgtcatcatggcatctgcaacaacaatgactagaaacagcgcttccttttttggcacaaccaccgctggcagcgatgcggcaagcattggcaccggcacgggcacatttgttgtcgctgctgctggtgctgttgttgaggacagaaatggatgggcttcacagcagcagcagttgattttgtctgtccagcttgacactgacgtattgccagcaccgttttacggctgcgaggagcttctcaacatggtcagttatttgattttgattatttgcgatccgccattttctgagtgagtcccctcccgtgcgaaggttttaaaaaagtttaccaaaactctaagaaattttcagcaaaaaatttttttattgtctaacatttaactaaaaaaattttactttaagtctgaaaatgggtcaattacgcagacaaaaattttctcggtttaaaaaaaataatttttatttttaagatcatggatattggacgaaaggtatgtcagataaataatatattttttaattccttggtcttactgatgactcgttgagagttttattttttgaaaaaatgacgaaacaattcaaattttttgtgtttttcaaaaacaacctattgttattatttggaaacgaataattgctcttaattaccccacccacgccggtacaattaagtccaattaaggtgcactttctcaaaatgttgcgtcccgcccatgccaacaatgagcagcaacaatcgctttgtgcccaactgcccaccaatgtttggtgcactccgtccgccatcggtcgcatggccaccattttgcgccaaatgcacgcggtggtcagcgaggaaatgggccgggaattgatgggacggcaacggttgatggaccatctgtgcctggtccatggctacttcttcatgttgcgcggcgattttgcctccgcacttgagcacatcctcttgtaagacaaggcatcaaaaaaaaaatttaatttgaaaaaaaaaaaattttttttaggttcacctcgaaaacattaaacaaaaaatttttttgtaaattaaaaaaattatgtaccccacaccagtgatgccaacccgaaacccgaggtttttctcaacccgaacccgaaattttttgagtgccgacccgaaacccgaaatttttctcaacccgcggcatcactgccccacacagctataatgtgctttttcaagcaaacaaattgtgtttttcaatgcctttttctttgagttatacgggtgctaaacaatttttttcaccgtcaaaagcacggactctccgatggcttatttttttttgtttgaaaaaaattttccaaatttttaaaattaattttaactgttaaaggaattttgtttcctcgaaaaaagcaaatatcatatcgtgtcccgacatttgcggtccagacatttgcggccccgaatttgcggcccgacatttgcgcctttgtccaaaatctggttcaaaactaagttttttcaatcactgatcgcataaatagctttaaataagcgattaaaagtgattgtacatgatcatttgatcttcaaaaaaatgttgaaaaaataataaaattttcaaacaaaaaattattgatcataatgaaccataaaaccgtgttttcttaattttaatgcttattaggctatcaggggttgaaaaaattcaactttgagtccgattttggacataggcgcaaatgtcggggctcctatcatattattgataaaattcttaaaatgttgacttgggcaacacattaatccaagatttaaaattcatttttttt

SEQ ID NO: 17673 - DNA, 1836 bp, Heterodera glycines
actcgctctgatcaaccagtgccccctccgtgatcaatcgcaacccttcgcagccaatttgagcgtccactatctgaccaatgatcggttgcgcgcccggccgacggcttagcgtctgtctgagcattcgcgcagtagcggcagcgccatgttggcgcgtttccgtctgctgttgttgttgttcaccggctcgcgccggacgacttctccatggcgccgtagaagccggcatatagcgctgcgccgagtaggcaagcggcggcgccggcggtggtggcattggcgcggcgccggccgctgtcacggcgtcacgctcgcctcggccgtcgcgcaagaacagcgagatttgtggctggctgctgctttggcgcgactgctgcaccacctggcgcgtcttgaagccgaacggcgactttggctgcatttccatcgcggcacgaagcggcgcgcccgcggcgatgacgtcattgaacgagggacggacgctgggcggaggatagtatttctataatgggagaaggaagaatggcatttgattgaaaaagtttggcacactgttggcactttgggtggcattgattcgaaaagtactttggtcgagaattcaatgatcaatcagttttgatcattcgtcaatgaccgaatttgaaaaaataaaataaaaatgcggtagcctaacttgccggagatcagtttcctcgaaattgcaattccaaaattaaaattgtgacaaacatgaacttttaatattagggcaccaaatcaaacgaaaaatatattttttttgaaattaaaagaaaaaaaataaaaatggtaaaaattttcgtaaataaaatattttaaaattttgattaacgaaaatttatttgatacacgagatttgcgcctatatcaaaaatcgggttcaaacttaagtttttttcaatacttgatagtctaaacagcattatataagtgatacatagaaagtgactttgtctgatcatttgaatttagtattttttttttttgaaaaaacattaattattcaacaaccgaattaatgctcctaataaacaaaaatactgtgttttcttaatttttaatactctttagtgtttagataaaattttttatttgccattatattaaaccaatccattaagacattgtccaaaagaagaaattggtgaggtaccataatttgcttacggtaccagccgatactgtaaaaatcggatgaacaaaaaaaaagactgaccgggatggtgcggctgattcgaatgcgcgggcacgcgccgggccgcaattggtacggggtcggcaccgggaacggaaaattgggctgtccctgcagaaagccgatttgccggaggcgaaatgtctggaaaaaaatggggccgggggattaaaatggcacaaattgccccaggcaatgccgaattcaatctcactcaccaacatgccgacacattgacggcactcttctgtccggcactctaatgtatgtgcagactgaaagaaaatggcaaaaaaaaaattgaaatttttaaaatgagagtttttgaaaaaaatttatcccatgaattttcatcattcgatagatagcccgacgtgttttttataagcgcatcaatttttaataagaatttgggaaaatccgagttgaaattattcatgaaaattttggcaaagctaccgggcctttttagtaggggccaatttagtgcggcgcattttgacacttaataacttttcttacaaacgaccaaattccacaaattaaacaagcctcaagaaagttaaggccagaaatgtttgaactaccattgattttcgaggacttcatgccataat

SEQ ID NO: 17674 - DNA, 1163 bp, Heterodera glycines
  misc_feature (31)..(31): n is a, c, g, or t
  misc_feature (1153)..(1153): n is a, c, g, or t
acaaataaagttttattgaatagtgattacnagaagccccgattcgaaagtgaactgcgtagtgttgcaacaaagcaagctgctataaaaatataataaatctcaattaatttaaattttttaaatttatagatttttatattactttgaaactacaaatatttatttgttaaatttaaagaattgtaatttaatatttaatttaatccattttgtgtagtatcagtttaccaaattaattttgaaatacaaataatgttgtacctcttaaagaattattttcaaacaatttataactactttttttgcatttttttaacatttttgcgtttttaaaaactatttttgtagattttggcgattttttatgacttttttagtcgtaaattaaaaactttacattctgatataaattgcgttaaataataatttatcaaatacattaaatttataataattcttaatataataattatagggcgtaattttgaatatttagcgtacactatctaacctaataaattaaatggataataatttcaatgaaaacatgaaaaaatatatatataatatttaagttaaagaaagtcgtagtatataagcgacatatacttatatataaaattagaagaaaacaattctatagccagcgtgaattatgactcattgtattatgtaaacgggaacatgtaaataatgatgaaacaaaattatttatacgagaaaatttaaaattttatcaaaaatttaaggaatatattaaatttacaataacataaatttaaataattaatattataaaatgggaagtaacataatgcagggccattaatagagagctaccattaaatgtatcagaagataattttaaaataaactgccaaataaactgtcctttttgatgttacagaaagtgaagtgaataaaaattgaaacataaatttaagattaaaacaaaaaaaatcaaaaaattattcgatagaataagaagatttaaaaagagaagataaacgaagaaattaatttcatttcacaaatgctataaatatacgttaaaattaaagtaattaaaatctaaattaaaaaagaaaaaatacttagactatttgaaaactattttaatagtaattatcccgtcacatgaccggctcanaaatttaact

SEQ ID NO: 17675 - DNA, 1815 bp, Heterodera glycines
  misc_feature (199)..(199): n is a, c, g, or t
cgatgatttgaaattcctttatataaaatttggttacacctaataaaaataaataaataaataagtttcttatgaataaatggtaaatttcgtatgatttaaacatataattaagtaaaatttttgggccggtcaaattcaaatggttgtactcgttcgatgaaacggctgtctggttgggcccttccggtggcacatntaaaagaatgcaagacggtcatggcgctgaaaacactggctgtttgtgcaagaccaaaaacgatgattttgaattgaaaaatttatgaagcctataaatattttgatcaaatgctaataaaaactgtctgctgcataataatcaaattagaaaagtctacagaaactgttaatctaaacacggcataaaagcttagtaaaaaggtaaaatttaatttatcaaaataataatgaatcacaataacactttttattgatataaacggtataaatataaattgtataagcataaaaaaacatataattaaaattaaattgcaaaatgctaccggaatggaaaatttcaccgcaaataaattgcaacctacaatggtaacggaaacaatggcactatcaagtgaatctaactatttttttacattcaatgaataaattttaaatttctagctcggaagtaaaataaaataaaataaatgtttcattatttggaaaatataaatttaactaattaaaagactttaaaattgttgctaaaaaaagaaaaaatttaaccctaatattaaacttataaaatttacaacaattgtaaggatgtcttttcatagccaatatttttaatcattttaaaaaaaatcaactatataatgaatgatattttaatttcctagtttaataataaataaaaactttgaatttcaattcaataattatgcattatttcataatttttattcaatagaataaacaaaaaattcttaaaaataccaaattttatgagtgagaaaagataaatgtagagtactcaatttttttattacaaattttcaataaaagaaacagaataaactatagaaaagaaaaatctctaacttattttttgaatatatttgaaataagaaataactaaatgatcatagaagcaaaagttaaatgatcaaaatgagaagcaaagaataataaatatatggaagtaagttgataataaaaatttaaagtcaagtaactgatgtgatgaaaataaaagaaataattaattcaataataaaatagcatcaatttaataatcaaacatagtcataatttataaaactattagatttaaaagctgtagaatggaactaaaacctatagacattaaaagtttaaaaaattaaaagaaaaaaaaaaattaaatttttgcttctgagtaaattgaataattaaataacttaattggtgcaaattgttttattgagagaaaattaataaacaagaataaataaaattaattatgcataaagctgaagtaaatatgttggaaataatcttagtggtagtaattgaattggtcgggccagagatcatgtcgggaaattccgtcaaaatatttactatttctacttatatttatttataaacgaaactaaattgaattaattaaagaataaatttttggattcaaagttcaaattatcttttttgcattatttataataagtatttgtccaggtctcgcaattcaggagtgtcgcgaatagcgaatagcgcgtaaatttaaaacaataatattatgaaaatgaataaatagtagcaaagtgagtactagaaaatttaaaatattaattttaaattaaaaaa

SEQ ID NO: 17676 - DNA, 2084 bp, Heterodera glycines
  misc_feature (1969)..(1970): n is a, c, g, or t
  misc_feature (2008)..(2008): n is a, c, g, or t
  misc_feature (2010)..(2010): n is a, c, g, or t
  misc_feature (2056)..(2057): n is a, c, g, or t
tatcagggctgggcgtagctggattttcaattacggaatccgtaatccgtaattagggttattttctcagttacggaattccgtaatccgtaatgatgggggtccaaaaaccccgtaatttcccgtaattcgtacttttaaaaatgttatttttttttaaaataattttcaaaattttattaaaaaacacagtagtccttttaaaagcatattaaaaagactggacgtgtccggcagtgcggatagacctggtctaggaaaattttgaagatttgagtgcaatttgtaaaagattttgctaaaaaacaattcaacagagagcttccaatattaatagacttatttttgaagcataaaaaagggaactgattctgcccgtttggccaataatttatgcagaaagagagggtgggcggtaaagatgggttgggtccaaatggggacaatatcgctacacctttatggggtgtgccttcaaaacaggaaagtaccaaaatttgtgggtctgccgtccggaactttattaatacattaatgtttttcgttttctttcccacctaggcctcatggccgttcatcattccatccgcaaaagtcctccctcctaccttttcaaattaccgatttttatgacttttccaaatttgcgaaaaaaagaaaagaaattttgcgtgaattgcttttgagcccttttctgctataaaaaccgtgaagttcttgtgtttttttgttgccattgaagtggaaaattccgaaaaattgcgttatttaatgagtttttcttattttctttgggatttcattgacatacgacgacacgcaattcccattttttttcattatagtccatgtgccatttagtgcaaacaatttgctaaatagtaaagctaattagtaaaatcttaatttttcccactaataacttgtaattaaaaaaatttatttatatagaaatattaattgaaatgattaaattaaatttttggaaccccaggccttctggccgtccatcagttcgtacacaaatgtccccctgtttttttgacattttcccggttttgtcttagttacccatcactcacatctcatacacaattttgctttaaacatagtgctcgaagactttactaaataaaattaaatcataaaattttaattttttctactttcataaattgaaaatgaggttttgcgaatttatatacttatgaaaattaaaacaaaaaatttttttataaatgcattttgaaataccgttttccaaaaaaatagatatcaaaatcaattttcaaaattttgcactacttttggatttaatatgaatttgtgggccaaacgcattctgtggcatttttaatttgtttataaatttaattaacttctaaataaaacaaaaaataaattattaattccaaattagccgttgaatttaagggaacaatttatttgattaaatcctttttaaaaattatagtaactaacctaaaaagtaaagaaccaaatttctttgttaatttttcaattaatgaattgccatacttgggcatagatgtttgtcggtgtcggtagaccaaagggtaatcaaactgtctagcagttgtgaattgcggaatatgatacgcatcatgaagttgaatgataccacctgcaaacattgaaaaatcaaaatttatgtttttattcatttaatttaattaggttacctgttttggcgttcttgatacaagttatgcgagtaaattgacacccggatataaaccatcaatggtgtctgtgtcctacaccaattcttcattaaaataatttcaaatgaaaaatgtctaaatgttcgtaaattgtttgctgattgttgtgcttgctacacattgagttgaatcaggtggatgctccaatgacccaattagtattaatcgtaaaaagcaaaataaaaatttgactaattttgaagagcattttcccattgtagaannagtaaaatctaaaaaagatttcaaaaaattaaattcananttatattaattaacattaaaaaataatttgtatttcatattaattnnagaaaaaaaattacattaacacattaa

SEQ ID NO: 17677 - DNA, 3690 bp, Heterodera glycines
catatgtttggggtgtaatttttaaaaatttccccccccccgaactttaggggtgtatttttcgcttttttgcattctcttgtgaaaatttgccaaaaatggccaaaatatggactaaaaacgccaaaatgtcgaaatattgatttatccccgaaaacccccaaaatatggatttatatggactaaaaaccttccaccaaatcgaaaataacgcaaaaatgttatttttaagcccctttcttcatagcatatgcgcagaaaaaatatgttaatccatataatttgcaaccctaattatagatagttaaaaaactagaaaaaacagaatttcttttaaaaaatgcaataaaaaatgatttttctttgactcgatgacattttttggcgacatggtcaaaaatttcaaaaattttacacaaaataattctgtcgaaaaataatccccccttctccatttatcccccaatctctaattatccccccccctttctgaagaggttgaaaaataatcccccatgggggataattagagcaaatacggtactcgtgggtttcctataaagaaaatatgattcctcatagttttttttaaattgatacatattttatcattttttaaatgaaatcctaccaattgagcttaataatcgcaaaaaccaacctttttttgttgaaaatctgttaacaaattgcacccaaatttttaaattttccccccggcggcgcctatcgtctaccgcccggacccttctttcccaaaagttttttgaaaaagcgctccgaaaaaaaagtgatgtgaaaatcaaatctgaatttctattaatattcgatgatttagtccaaaaatgattaattgtttgaaataattgaagaaaatttgtttgaaaattttcattaatttaatttattaaataaaaaaccaaataattttgtattattttcacttgatataaattaaaatttgaattttttttttaatttttaaaatttttttgaatttttaaaatttcccggttggtcccggttcccggtttttcttgcggtcccggtcccgaaaaaaaatcgaggtcccggtcccggtcccggcttctcaggtcccggcaagtcccggtcccggttttggcaaaaattcccggtcccgtggcactctatttctaagtgaaaaatgttgatttgccattctctactcctaggccgctctatctaaccaaaatgctaaaattggtactttttataatgattctataagactaaatttattttataccattttaacaaaaattgttcgcatttgcaaattttgtgttttttgatatgttagagacatgaaaatagtacgccaaaatgagagaaaaagaaatagttttttaaacagctgtaattataaataattctgggcttcaaatatttttcattatacccaaagtttgttcataattttcttctctatcgatatgcaaaatttggtgtagatttaacatagggaacaaaagctacacatagaaaagtaaatgttgttctttacattattaagaatgaagagacagtacataaaactgagagaaataaagataaaaagtaaaggtgacagaacgccaaattttttttataattgtccataaaatttatttatcgccgttttttttcttttttaccatccatgaagtttattaaaaaaaaattttttttgaaatctgtacacagataatacataagtaccaaaaattataaatgccttttttcatgcctttttcgggattttcgtgcctttttttcaattttggtgcctattttagtgcctttttcgcgattttttggtgcctttttttgcgagctctattcattacatttaactttttttcctaacgttaaattgcataccgatagagaaaatatacctatgtgtaatgagtgtatacaggcatttattaacctaattaacatgcaatacttttaaggaatctcacccaatataatttgtaaacacttaaaactatcattctcctgagttagtatgtattatttattgccatcaaaagaacagtacatatttacaatacacgaaaattggttgtgagaaagcagtaaatgaacaattgcaaatgggaatctgtacatggacattaaattggaagtgagtcatacatatatatgccaagggatcatcaatatatggacatgggcgagaacgagggcacaaatgggaatctgagcatcaaattgcatcgcgtcctcaatttggcgggaagaatgtgacgtcgtggctcaggtcctccgcgattgttagtgctgctccggtgttcatttgattgtggtagcgcggcaccgagaacacagtgacaagacgttcgtcggcgaaatattcaatgccctcatgcaccagctgaaaaaatgggaaacttttgaagaaaataaatctgtccaccctgcctacctcatgcgcccgaattatgtagttgaggttgagcagctcgcagatccggaagaccacgtcctcgccaaagacgacgccggccccgcgcgggctcggctccacaccgcggatgtcgagcattggatcggcccacagaagatccatctccaacgacgggctcggcagggtgagcagcgggcggcgtaattcgttgagctgctgcaagctggtgatcctgtcagaaatgccgccatgcatgcctgaaatgaagagaaaaattaatttgagcaatgaaacaacaagtcgatctcacacagaatcctgtccccgatcaggcccacgtacggcatccaggcaaaagtttggttgaacatgtcgaagagccgtcgagtgtccgcttggtggtagcgctgctcgatctccgagtagaagccatatctaaaacaaggctgaattagtgccatccgttgccaattaaacgttgctcgactcacaactctgttgatgttactgcactcgtggttcccgcgcaacagcgtcacactctccggatatttgaccttaaaaaatgagattactgccccgtaattctttgcctttccaaattcaccttataacagaagaggagcaccaccgtttccagcgattgggggcctctgtccacgtagtcaccgaggaagaggtattttttctccggcggggggcccagcgtcgagaagatccgcagcaggtccgtgaattggccatggatgtcgccgcagacgttgacgggcggttgaatcctgacgagtgtctgctgctgccggaagacgtccatcgtggcatcgcaaagctggcgtaagtcgtgctccgtcacctgtaaaaagggaagggaagaataatgacgattttgaaaagcaaaaaacaattacatctaagggaaattgcccgtaagtggagtttctgactctgtagataaggccgtccacttgaaggctgaagggcactgccatcgcgcgttgctagcagccgtccgtccgttatgaaatgtgtccttaacgttgaaaagaccgccttatatactcaattttcggcttattattttctaatttttcggtcgcataaatttcgttataaatagcagcaaaaaacaaactcacagagccatttttgcaactttgccatttcatcagcccttccgtcgcttccctcatcttcgacactgctcatcgcaattgctcaatgtccctgctcaaaaaaacaccgttgttctgcgtagccgaatgcgcaatattcct

SEQ ID NO: 17678 - DNA, 2174 bp, Heterodera glycines
tatatttgagtctaatgacgttttttcatcttgtataggatcgcctcggctacccatactcttcactatgttcataagcgctgtattcggtttccggaaccatgaccattttctttgtgtgcttcattatgctgttattttttcaagcaaatgttgggctaaaacgctgagaacaggcacaagaatagcaccaagggcaattccgctcccttgttgaagtttttgccgagctgagttctcactgcgagcgcgtgctatggccctgtaatagtccgcgtattgtgacaaccgtcgcttctggcttgaatttaaacgaaaattaaattttaaaatatttgcgcaaatttccacaagggcaagtatttgttctgctgatgctccctgtagtagctcgttttttcgtttatcagacctagtggccgcaagctttttaaaaaaatctgtattttccctaacgtaaggactaaattgatacattttggattttttctacattcatgtctttatatagacaatgcggttagtgtaatacgttattcgctcggtaaatagatttctctgcgttcgtccgggaatattttgctagtaagacgttcattttcctgtgcattaggatgcatatttataaccaggtagctaaacggttgacttgttgcatcgttatatgactccataaaataatttaagcgctttggaaacaattgagatccgactgtccgtacctgaagttgcccggatgggttacgtgtcagcacaagatagtgactgttcgcccttgctgtccgaatatttcgcccatacaggctctgagttacgaaaattacgtttacgttccaattatgcgaaccgcgtgtaaacaaaagatccaaaaaatcattgttcatattcagcatcaggtcgtccagcacaagtaggagaggtttaggtttactattaatcaatgcctgatctggaatcccattatgggtttctattccacgtttcatcagatcgatgaccgaatcgttcatttcagaataacaatataaaactttttcgggaggtgggttaatcagttcattatggtgtttcaacaacctcatcagccaatgggttttaccacttccagtggcgcccgataatataagagtgaagggggcgttaaacattttttaaagttcaatttttctaattgtaacttatttatatagtgtttgtcctcaattttgtatgggacatatgccgcacattttgggcacatccaacatttttctgcccaagggaggtgtacggtgccaaaatgcaatagactttgtgtcctacatcttttacaaatttcataatgacatgggcagtaatgacaacattttacttgatgaatacaaattttgttcatttttaataatttgtaacaaattgaaaaaaaaaacagaattgtttaaatagtgtaaatatgtaggggcagttattcgggtttcatgatgtattcgagccattgtgttaaatcagccgaactgccagataattctactgtttccttctgcgaccactctgttgtcaatttggctgttttaaacagagtctgcgggtcggactcggatatttttgtaggtggtggagatttctcacatgacaaatcgttttcaaaagtttgaggggctcgttggtataaacgatgacgatttttcttgtgggaaatcttcatcaggcggttcgatttttggttgtatgagcggttgttctcgttccatttgttggtccggcggtggtaaaggttcacgctccaattctttatcaaccgataattgtatatttttatccatgagtgtttatgtaatgggtacaattatttaactattaattgtatatctcttaaaacgagctgcttatatagtgacgataggggcggggtccggatcctttaataggacatgggcaggggtctggaccctttaataggacaatgggcaggggtctgagggtacttaataaacagggggtaagggggtctggacgacccctgtccgttgattatatgcagaaatgctttaaattacaggggcaggggtccccagatccctgcaatagggttgtagggggcaggggtcccagaccgctgcccatgtgataggttgcaggggcaggggtcccatgtaataggttgtaggggcaggggtcccagaccgctgcctatg

SEQ ID NO: 17679 - DNA, 2759 bp, Heterodera glycines
  misc_feature (77)..(77): n is a, c, g, or t
  misc_feature (128)..(128): n is a, c, g, or t
  misc_feature (2699)..(2699): n is a, c, g, or t
ccccccccccccccaaaaaaaaaaactaaattaatgaacagaaatcggattaggatgctcaataaatgcaaaattcncaaagataattatttctttattcctttcgctagcatattgcgttaaaattngtaaaaaaatttcctacggaaaacggcaaaagtgttgaatctaaacagctaattttagaaaaaatcgaaccaaaaaatggcaaaaaaggtttatttttggcaataagcagctaaaaattcctgctttttctccctaatgataaaactttaaaataagtttggcgattcgacttcgctgctcaaaataaagtttttatgggtctaaaataagaacattttgaaaaattaattaataaagaccgagaatggtcggttagttgctcaaatgttcataaacataatactaagaaaaacaaaaatagttgcaaaatttgtcctaaataaaaattcttcgaagaaaatggggttttattaaatatatttatactaaaaatctcatccctgctcatgagcaaaaaaggaaaaataacctttttgggcagtttttttctcattgttttgttcttgcgcttccgtttctgtcgaatagtttttttgcttgggccacttaagatttgctgattttattttgtcatgcaactaaaattaaatggtaaatgaatacttgaatgtgttctcctcgcatcaatcgatgcaaggagaacaattttgtattagtggtaaaataggagtcgcttttttcaaggtcgctttggcggggaaaaatttttgtggggcggctggcaggtgaaagaatggagtgaagctactgatgaggagggaaaggatggagggggggggggtgaggggtgggagggaattttggaacggagcaatcggccacatacactactcatctcgtgttctcaattatttacattagtgtttccagttgcaccttaaagataagtgataccacaaatatatttttactaaatattcgttatgctaccaaattaatgactcaattttatgcaatatgttttgtaatttacgccccaaaaaatccgaagcctattgtgagcacaataaaaagtatactttatatattacaaaagttttaataagtttcgtacaatttctgttaataaattgtataagtaatacacatttttattttattgataataatttgggaatttaaaaagaggaatttttggaaataaaattttgttcataatagttattatttgcaacaaatgtcctcatctatctttgatataattgaatatttagataattaaaaataacatatttaattttgaataactaaaaaattaatcttaaagcaataatagatgaaagatatgacattttcaccaaggaataggtaataaaattgtaaaatgtttctttgaattagagaaaaattaatgtgcaaatataacttaaaataagccaataatttattatattataaaagatagaaaaactcatttatacacttaaatctatcgagttgagtaataagtcctgtagttaaattagaagattaatatttttacataaacattgtcaatcaatatctatccttatatttcgaagcccattcttttctctgtctaatacactttgaccagcaaatccaatttactattatcaaaaatagcgattaacaaaaatgggtccccaatttaacaaaattcagcaatccgggataatcttaaaaattctttttcaacaaaaacgatgttattcgctgttttatttactttcattccctaaaagtcaaaccttgaacattataatttattattaacaaaataaaatattaatattttggttagcaatagcatcaataaaataaggtataaaaagcaaaatccttcagtttaagtaaaaaattatttaaaaactaaatttattttttaattcaacataaaatttttaaggagaaaggaaaaacattaataactgaacaatctttcactgatctcatttgcttttttatatcttctcatatgaagaaaattaaaagaatattaaataaaataaaataaaaacgtcaaatccatcaacctcaagcttttcaatacgaaaatgaactcaaaagccaagagattcgagcatgaccgagaaacgattgtttcatatacatgataatgccttttacgcaattatttatttaatattaattaatttaaaaatttttaatctctttttaatacacatatgagaaaaagcctgggttatggtttttaaactggattaaatctgaatacagacaagccagagtggcacgctcaaacgatatttgacaagaaataattataaaattctatgttgatcatttgaaattcaaaatcaattgcacccaaaaatataccacctaaaaataataagaaataaacttaagattctatgattttcataaaatttattaataccaaaattaacaaaatatattaataaaattgtactaaaaacaaattgaataaagaaagtaaataattttgttttcaaatgattaaccctaatataaaactaataaaacacaaaggcgctagtttaataaaataaatttaattaaaatttatatttgaaacaatgctgccaatagtcaaaattatttcttcattgcgttgcacaacaatgagtttaaagcaacgatacattaggtaatacataatctgcattaatatatactctatngaaagctaaacttaccacaaatataggatgaaaatcccctaagagacatgttgattaaaa

SEQ ID NO: 17680 - DNA, 1758 bp, Heterodera glycines
  misc_feature (24)..(24): n is a, c, g, or t
acatttgagtcccgggcccatacntcgtcgggggttggtttagcgaaaaattgcctaagagcaaatttgtagagcttttaagctctatcgaacggtgggatatatgcccggaaaatttcaaaaattttcgagctaggccacctagaaattttcggaaatttttttttggttgaaaatgggggtgaaaatttttttcctgggttattttgaggtgctgagcacgaatatgatgtttgttttacgtttcagaatttttggaattttttaaaaattctttattttttggcaattttttggccctcgggattttggcctaatatttgaaaattcatatctggcctaaggtttgaccaattttgattaaataaagcattaaaaatggagaaaaatcaggagaattttatgggttttatttagattctctatcatgaatctaaaaaaagttattccggaagttctggaaaaattcgaattttcagaaaaaaattctgaactcggttctgaaagatgtattggaaaagtaaaataatacaaaaatccgcaattttttgctctattttataaattttattttagctttttatcacttttttgaaaaaagttatagaaataaaagtgattttgggaatcgggaccaaaggggtgagtgtaggatttttgagtgaaaaaattttttcatcaaaaaccttcaaaaaacatgtctttagggccaatttaggccgctgatcacgaatacgtgatcagattttacttttgacatcgttaagacctcagaatccctgtgtgattggggattctgaggcatcattttgaggggggagggggcaggttcgaagccgggcggtgtacattatttttctaccatttttttcgtgtttttcaatttttattcatttaaaatattttttgagttaataaataaaaaattatatttaaattaatttttttttaatgaataaattttataagtttaaatgaattatttttttaattgatagaatttcatgtattttttaaattaaatttgttaaaaaatattttcattttaatttaatgaatttactaattactgttgtacctcttccaatcactgttgtacctcttctaatcattgttgtacctcttttaatcacttttgtacctcaaaatttaaataacgggcgctaagcgcccgtccaaggccgcgaagcggcctaacaagctaaaaaacgggcgcgaagcgcccgtatgagttcaacgaatttaaaaaacgggcgcgaagcgcccgactgaggccgcgaagcggcctcaatagcccaacaaatttagaaacgggcgcgaagcgcccgtctgaggcctcgaagctgccttaatagcccaacaaatttagaaacgggcgcgaagcgcccgtctgaggccgcgaagcggccttaatagcccaacaaatttagaaacgagcgcgaagcgcccgactgaggccgcgaagcggcctaacaagctaaaaaacgggcgcgaatcgcccgtatgagttcaatggatttaaaaaacgggcgcgaagcgcccgtctgaaccaacaaaatttaaataactggcgcgaagcgcccgtcttgagcctcgaataacctatagcttatctaggtagcgaagctcccaaagcgcgaattttagaattttttaacagttcgcaaatatttgtgcaaatttttgcgccacagaactttggtcgaatattcgcaaattcatatctagcctaagggttgaccaattttacaggaataa

SEQ ID NO: 17681 - DNA, 2541 bp, Heterodera glycines
ggctggcacaaataattcccttccccccccccgctctcgttcgttcgttcggcggcttctcaaaaacaattttcaattagctgacgcgacggctggcacaattctcttctcccgtttttgtcatttctttacgaattatgaatatattttctagaaaatgaaaaaatttctttttttgacaattataattctgttgctatcaaatactcatagttcgaacaaacagagacatcggaaacaaagggcagtttcggctttagctcgtttgacagtggctttatcacgtataggcacctacattaaagcccacccgtacattaccgcctcgacaattttgatggaaatgggctcagtttccctcaacatttatttgctaatacaagaaataaaaggttaaaaatctttattttttgaaaaatataattattttagcttgcgaagagaaacagatcttaaaggactttttcccatttgtgctcactctgaattcttatgaattcagtgtgaatgttgatgactacaaccctggatatatttttggaaaaataaataccgaaatagggcgaccagtggaagagatttgttttgcaggtcagccacaaaaaattaattcgttaaaaaattcatttaaagcaccgaacaaagtcacccgaaagataagaaaccgaaaagatgacctcggcattttgttgctgtacgcaattagacagcaaagtcggctggaactttttgaatgtccttgacggatttctgttcccgttggcccttgggaaaggcactttaaataaaaattagaaaaaggtctactgtagttaaaaaatgtattgtggtttgtctattgtgttgtggttagtatgggctcaaaattctgcgcctcctcgcggtgagtccggaaacagagttaatttttaaaatattaattaatttttttgcaatggaattaactctggctaaagcagacgtaattttgtctaattttgtggcttagaattaaatttttaaatttttttttgttttattgaaatccccaaatgtcgggtccctaaatgtcgggttgccaaatgtccgtggttttcttaagtgtcttttgctcaaatgtcgttcggtccccaaatgtcgggtccccaaatgtcgggatccccaaatgtcggatccccaaaagtcgggtccccaaatgtcgggatccccaaatgtcgggatccctaagtgtcggatccccaaaagtcgggtccccaaatgtcgggatccccaaaagtcgggtccccaagttgcaaatccccaaaagtcgggtagccatgagaaaacagtggcaatgcgcgaaacgcaaattaatttaactgcaattagagtgaacagcaaaaatgaataccgaaatattaaagaaaatataaaaattggcgaatgttttgacatttccatccctcagcaggaaaataataaaacgaaaaaaatcacttttcaatttacaatttatgtcaaaccattagaaaatgagtaccaaccgccggcggatgaccacgacgaaaacccatccgatgaggggccgtatgaaaaccgaattttagacatcaaaatggacgacattcggacaatggtccgacgcaacaactttgtgatccatgagcctaatccgtcaatggtgtacacgttcaatttgggcaaaatcgatccgccagggtttttgtggaaacgcaaaatttttgttttgccggagaatgatttgagcaattaccatgcttttttgtatgccgttgcctacagaaatcaacggattcaggacaatttgaatagtaaaatttgcacgaaactgttgggatatgcgccatttgtgaaaattgacaaagaaattgcgcccacctttgaaacggatgacaaaagggtggaagtaaattttaaaatcccgaaaaattagtggccaataaatgggaagacactaaattaaatggatatttattgtttttaaaaaaataaaataaaaatagtcgcaaagttattaattaaaagaagagtaagtgaaacattttttcaccttcaataattttttgtgcataaatttctttgactaaaataggtatttacactaaaatattaaaggaaataaactaaacatttattcatttttataatttcagctaaataatgaataccaattaacaataccaattgatgcgagcaatctgttcaaacattacatttttggcttcaatttggttatttattcctatgaaaaggtcaatcattatttatataagcattgaaagcggccggcaaccagaaggaattagctaaacaattcgttaaatttggttcttaaggattttgcgtgaaagatttttctttacaaccaaaacacataattagtgccaagatttttagttgaaaacaaaaatccataaagtccttcaaaatcgttgcaaaaaaaactttttgaatattaaaatattgtttcaatttattacttgcttttatttcataaaataaattttttaaatttttattaaaaaaacccattttactcttaagacaactattatgataaaa

SEQ ID NO: 17682 - DNA, 1521 bp, Heterodera glycines
  misc_feature (1451)..(1451): n is a, c, g, or t
ttgacgggtttaatttcaatatcaacgagttttttttatagttattatccccgacaagcatttggtcaggcattttcgttccccgacgattggggctaaatacaaaatattttgtttatgtttgataattcaaataaattattattaaaaaatgattttctgaaaaattactgacggtaatgaatcccacaaatttatatagaaaaagtaacaaaaataaaaaactacaaattacaaaaatgcaaaaaaggtcataacaataatatagtagttgcacatccatttatagtccataatgctttgatagcattactaattgttcctccattaccaataatttctcacattttgtctccaatttcagtgtttttgaatcaaaatattcacccaaaaatgcatccaattgggcttcattaataaatccgcccaacaaagcctgaaaaattaattatagaacaaatacaaacataattttccgtataattttttaaaattaaaaaaaattgaaaaaaatttgtatggttaaaaggctttttagaaggtcagttgaatattaattatatatgtatatagatttattattagttcatttttattaaaaataatttttttttttgcaaaaaatagcctaataaaattttttttttatttcttcttattttattaatatgtaaaaaataatttttcaaaattactttataaagcacaattaatttgggcgcatccgtgccaaaaacgataaaagcgcgcataattggcgcaattaacggaaactcaggcccatatttggcgatcagaagtgatttttgctcaagttctgcccatttttctttgtctcccggttccatctgatcgttggcaattcgtcgcaccaaaaattcaaaaaatgcgcaaaaattctcctcatttttactttcttcagggttatccaacggttgaccaattaattgggttaattgggcatttaattggcgatcaaattgattggatattaattggcactccgttggattaaacgcatcaatttcgggctcaatgttagccgaaaaatgaaactcatttttggcttcatcaaagattggattttcacgaaaaagcagctggccaaacacaaggccgatgaagcgaagctgttcaccggcaatctccggtggtaataacttgaatttaaaattaaaattatgctctttttaatttataaaattcattggtggtgtttcatttaaggggttaaaaagaaaaagctggaatttctaatctttataataattaaagaaatatatgtatttaaatatattagcatttgattttttaatatttaaatatttaaataattgataaattaagaaaatgggataactgatttaagattgaaaaatgaaaattgattctcttttattaaaaataattacaaataacaacgataaaattgaattttatatattttttanatagaattattttaaaaataccgaagtattcacaaatgaattttctaataatcaaaaaaggcatttaatt

SEQ ID NO: 17683 - DNA, 1485 bp, Heterodera glycines
gcttcattctcaaaatttaaaatgatttaatcagtcaaaaaaatgctcgaaatcaaattaggtttaaatttggttttttttatataattctgaaatcaagaaaagtgttattattattttttttatttgtgaaggttctccaaaattccttaataaaagtgtaatctgcttagaaattttaaatttttttttgctgcattatttccccaaaatttttttgttgaggagggccgggccggctgtggacagcaggcgccgcccaccaatttttttagcatattttcattaaaaaaattctttaaattgccaaacttatgccaatttatcaaaatttaaaagattctgaggattttccccaaaagcctcaaaaatcctcaaaatttctcaaaaagccacaaaaatcctcaaatcctcattttccaaaaaaatcctcattgacctatcaaaaagtcacaaaatgaggataaatcctcagatctggcaaccctgtttttaacgcaaaaacaaaaccaaaacatttccatttttcaaatcattttttaacgcaaaacaaaaacaaaacgccacatattgcgaccgatgtgggtaaaatgaagaatattttaccaaaccaaatcccataattgctggacgttaattgcgggttttaaactgtatgtgaaatcctgcaagggtaccaaatttcgtcctcaaaatttttaaagtaaaaattttttctcatttttgttatgatatcttaaatcattcaaacaacagttctgtctatattatttaatgctattatgttgggtaaccatcaacaattaactattgccagtgcaaatgcgtttttgcttcaaaatggtatgtccgttattttagtatagatatcacttaattgatcgatttaggacttaaactgagaaaacatcagattgaaggcatcaaaacacttttatcatggcacaaagagggccatggcggaattcttgcagatgaaatgggccttgggaagacatgtcaagcaattgttgtgggagctattctagcggaccaaatcggcaaaaggatgcgcatgttggtgatttgtcctctttctgtgattagccattgggagaccgaagtgagcaggtaagcatatgatgaaatgatcgagttttgtttcctgttatatattacaccgtccatttaattttctcgtgtagattttcttgtgatcgcttaacagctttccgttaccacggtgacaaccgaaagtccctcgagaaaatgagccactggaatgtgcttttgacaactttcgaaatttttttgaatgatcatcggaatctgcctttcaagagttgggacattgttgttttcgacgaggtttgtttctataactgtcatatattgagctaaactgaacatttattcattataaggcccatcggctgaagaacagtgaatctctgacgcaccaggcactgtccaactgtaaattcgactggcttttgatgatgacgg

SEQ ID NO: 17684 - DNA, 1585 bp, Heterodera glycines
ttcgttgctttaccaaatgctttcgccccttagggaaacggccgtcgaccgtccgccgaatttcgacccccgaggcactgtcccacaccaaacgcaacaacagtcccttctccagccgcagctttctgccggctcttccatcaccggaacgacgattgtgtcgcccagcgaatccacttgcattttcggcgtcaacgacccccgcggcactcagtcggagggcgacggcagcgaatttggcacttggctaagcgcgtcgcatttgggaacgccccaaatggcgaagtcagttgattttaatgggttgacgagagggatctcgaaggagtacctatatttttgtcctttaatgaatgccattggtttctgtccaacagagtgccgccgtctcagtcccaattcgttgcgtcccaacagcgaatgccttccgtcgcaaagcaaaacggccaaccgcagtcacaaatgctgcattttccgatggaagtacgcgttcaacagagcggtgacgcgcaacagtcgcaggaggccggcgaagtgagtcgaaggtcagagcggtggtcgcgtgaggagttttaccccccggcggggagtgagcgaatgccgggggcaccttttcacaaagtgacaaaggagaactatgtgatcgaacaggtgcactcggtaatgatgcaattaagcgtaattaacataaagcaggtggtcgagtcgggccccaaattggttaccacgacgcgcattgtttaccctccggcacagcaacaacccctgggggcacagcctcaaacgcaacaaataccacggcaacaacaaaatcagccaaagggacaatggcaagcgaaaccggaacaacagcaacaacaacaacagcgaaaaatacaaccacagcaggacggacaagcgcaacagcagcagcagcgacaaccgccgccgcaagtgccgttcaaaacgcagcatcagaaaatggcacaacccacgcaacccccgcaacggcaggaacaatatgcggtgcaacagcagccacaacaacatgaacaatatccgatgcagcagcaaccaaaacaacagcaacaagcgcaacaatattcgattcaaccgcaactacaacaacctgttcagcaagtgcagaaacctcaaaattttgccaaacaacatcaatacgttcatcagcaagtgcaatttcaacagccgcagccgcaacaacaatatgaacatccacaacacgcaacagaacgggaacaacatcaacaagcgcaacaatatgtgatgaagcaacagcagcagacacagcaaaagcagccccagagagtgcaaattgttggacaaatgcaactcggacaaattgaacaacaacagcaaaggggcggaggaggacaacaaccagagcaacaacaaaagcaagcagtagtaggacaacaacaacagcagaaggagaatggccaagccaaacagcagccgaagcagggacaatttggacaagaagaagagcagcagtacaacaagcaaaagagcaacagaaatggaacaacagcacagcaaatgaacaaccctatcagatccatgtacaaaaaacacaacaacaaacaca

SEQ ID NO: 17685 - DNA, 1134 bp, Heterodera glycines
  misc_feature (78)..(78): n is a, c, g, or t
tcagtcagtccggagagacagaagcatcgaaagcatgtgatggtgaccagccgtgggtaccgacaaaacgcgagttgnaaccagaaaaagtaccaggtgggggcagcagaccaaaggggggcgggtcaatcagagggaaatggcatttaaaatagaaacggaaaatggcatttcaaatggggaggattagaatggcatttgtgccgcttcgccacttcgttcacccgtccccccttttttaaggacttccgtaattacgcagaaccgttgtacgtctgtcccgactttccggccgatggctccgtttgccaattcgacgattcgcagcaaaagtcccccgagcataaatactattaccaacacttccaaccccagcaacgcgttcaccagtatttttcgccttcctctgtcaaatgggactcagtttatgaggtttaatagtgaaaatggcacatcaaagaatggcattttcttcaggacgaattccccgacggacagcccccgccatttgcgcatggaccgggcagtccgtacgaatatttgctgtaccaccaaaaagtgaatttggaccgacgacgcgccgaaagtgaacaacgccggaggcaccacaggtgggagagggggcggggtgctttttaaaatggaaagaaaatgccgtcaaagtccggtgccgggagcggcggagcacggctacaaattcggcggcatggactttgtggaccacatcgagttcaacccgtgctcggacgttggcgaaccgtttgacgagcgacagtcgcgtcgcgaccttcacacgggcccaccacggcggagaggcgacttttacgggttggactacacgacgatgttgccggacggacagtggcgacagcccactgaatgggaagcggaggacgcgcagaattaccacggctaccaggcattgccgccgcggaagaacttccgcctgtgcgggcgatacaccgcggacccggacgcaccactgaacatgtgagaaaggcggaaggggaggcggaaagaataaaaccctgttcagagcggaagcggacggactggacgagctgaactcggattatttggtaaacaaaatggaaaaaggaaaagcggacattcccttccccaaggtgggcaaca

SEQ ID NO: 17686 - DNA, 2174 bp, Heterodera glycines
ttttttttgcttcttgctttccgtcttcttttcctctttctctgcgggcgcgtttctccttcttgccagcaggcttttgctcctcattttcctttttctctgtttcctggctttctgacttcttttcctccttctgtgcggcgcgcttctccttcttaccagcaggcttttgctcctcattctcctttttctctgcttccttgctttctgacttcttttcctccttctctgcggcgcgcttctccttcttaccagcaggcttctgctcctcattctcctttttctctgcttccttgctttctgacttcttttcctccttctctgcggcgcgcttctccttcttgccagcaggcttttgctcctcattctcttttttctctgcttctttgttttccgtcttcttttcctctttctctgcagcgcgcttctccttctttcccttgggcttttcttctcctttcttttctcctccttctttctgctcctctgcctctgcaccgcgtttttcctttttgtccttcggcttttcttcctctttctcctccgctttcaccgcttgcttctcctctttgccgggttgcgcttttgccgctttttcattgtctgcctctcggcgcacaattggcccatcgtttttcgggtctaaataaattcaattataaatttaaattataaagcattaattcttccacttacatgcttcgatgatcagcgcacagaacgccaacgagagcagcaaaattagtgggaaattcatttttcaaaataaaatatttattttctgcttttagaaaggacgggggaatggatttttaaaaaataaagtagacgacgaaacaattaaatggttgcttttcgctccgcacttttgcgcttaaatagcccgatcggtgcgttgtttttgtcgcgcgtcgatcggtccggtgcttgatcaaaaaatgaccttttccgtcacaaacaccaccaatttagtcgcgccatcgtgcaggcgctggctgcaattggttgggttgcttggttatagtaatggttgtgatcggttgcatcagtcttacgctccgctgccccccgcctctccccgaattcccccccccccatttcctgataacccaccaacaccaccaccacctccgccaccatcataatcagagtgtgttgttgacgctggtggtggtggtggtggtttttgtgggtatcggtccgttgcttagcgccagtcgccactgatcgcccgtccgtctgtcaccacacaacagcggggctggcggcgccgcgccaccaacaaaattttgatcgccctccaccaacccagctctccccgacgcaaaataccagcattaaaaactctgctaccagccactgactgctatcgctgtccgatcactctcgatcatatctgagttcccccgtccttcccccccccccgggagcctccagcgctccgcgtccgcaatgacacgccgatcagtcagtcggtgataatcaaacccaactctttccctcggctattttggtaattaattcaatttttattaattgatccgcaatatttttgacaaattttttgcttgaatccggcaactttactgatccagaaagggtttttagagtgtaaatgcgggcggttgcctctgttggctttgctcgcctttttcgcctgctcccccacaaatattcgtccgatccctcctccgtccgtccgtctctcctcccgcccttcgcaaatccttccgctcccttcggcatccgcttctccttcgcctttgtccgcttcttccctcggtcgaatccaaacttcccggatgtatttgctcctcgtcctaaccccgtcttttccccgtttttctccgttcggaattaacccgttggggcctttcttttacgctcctcgcatttcgttgtctttgctttccatctgctcccaaatacaacgctcaaaattaacagcctaaaggtgaaagagcggcgaattttgtcaacaaatttaaaaataataccgggccacgaaaatcgttcagcacagtttcaattgagtctcgcgcaggttcaaaagggactcggacggaaagggctcgaacgtaccaaaacagcattaacaatggcgttttctatgatacaagattcgtttttagatgtaaaaaaaaggggctataattaccccgtcctcgtcgttt

SEQ ID NO: 17687 - DNA, 1519 bp, Heterodera glycines
  misc_feature (1397)..(1397): n is a, c, g, or t
  misc_feature (1407)..(1407): n is a, c, g, or t
  misc_feature (1417)..(1418): n is a, c, g, or t
  misc_feature (1452)..(1452): n is a, c, g, or t
  misc_feature (1482)..(1482): n is a, c, g, or t
ccccccccccccccctctctcctcccctccatccccctctcccttagtaagggctcccgctgccacgctttctcgcccaatcagtttcgcccaccgagacattcgctgaccagcaccaaccaaattattcactccgcgcgatcaatcgcatcgcactaaaaatggagccgaagcaacataaagaacattgccatcaattaactaattaattggttaattaatatttttatggaagtgctggtacacgcccaatttcttcagcagctgatgctctattcgtttcgcaaatctcatgaaaaattcacacaattttatgtgggattgggtgatgaatttgaaatatttgtgtgaataatgatgtttttcgaccaatgtttattatttatttgttggttttggagcggtgtgacactgaaaacggactgactgacagatcactctgattactcccatgtcgacctcgacacagcaacattattcatccattaattcattcattcatcccattcattcgagaatttgttctcgaatttatgggggtgaaatgcaacataaaatgcgcacaactggttgaaaactattgggggggggggaaggaataataattggtcgataggaatggaagaaaaaatgtatgcaaattgtggttgtttgagcaaattaagagaaaaagaaaaattatgatgaagaaaataaaaatgattataattttattactttttaaagtgggaaataaattattaaataagcaatatgatgcagaatgataaaaatatttattaaaattttgaaattattaaaaacctttaaatttttgatttaaagtttcaataaaattttaaataaatgctattccatttccttttgaaaaaggtaagaagcttgatgttggttaaagctaaaaaattagggagaagaaaaattttaaaatgtaatcattttttaaataaagtattaaacgcaaataaacaaagaaaaatgggtacaaattttaaaataaataaatttataattaataatataataacaataataaactgattcttttcgcgagcatttctttcttattgataatttcaaattttgtgcaccattttcatttttaattgatgggccagtgatttatcagcaattggggcatcgttctgctaattgataaaaatttgccaaactgaaaaaatagaattaaaaaaataaggaatttgcacaaattataacatttaaattttgtaaagatttattttatttggtagtgaaatagcaagttgattaaaactcattaaaaaaataagacttttcattaattaacaaaattgggtaaatataaaattcaaaaaaaataaataaattgtccatatttccaaatatttatcttttgctttttactttgagtttanaatgggccanaattgcactnncaaatcgattagggtgtctttatatgtttttttnaagattatttttatttcgagaaattctgtntacatttttttttactttttatgaaaattccctataa

SEQ ID NO: 17688 - DNA, 2599 bp, Heterodera glycines
aaaagagagaatttttaaatttgagattttcaacataagggggcaccctcgacaatattaccgggctcgcaaatcgaaattggtcaaaatgacccaaataccgcgaataagacgctatttaaaaatggacaaaaataaatttgatttccaaaatcacaaatgtgaaaataaaaaatttattctctacatgattacaatgaatgggaagaaatagacattctataaaattaaatgttttgatgattcgttgcggattgcaacaccgacaaagggtgggtgaccattcactatcaaatgaaacaaatcatttaatgggggacggacttttcggcacggcactctctcccacactttgctcacaatcagtccttctttaggcgagttgttgtcatccgatagataatataaaacagaaaacaattatttatgaaaaaaaagcaaaggaattgttgtcttgcacataaaatgtcaaattttatgttagggccgccccaaccgaccgaatccttcgcgggttccatgctgagcaatccgacgacaatgaaaacaatggcaatgataagaacaacggaaaggccggcgataatgccaaacattggggcgaaattgggggaggaaaactgtggagaaaagagggacaatcactgttaggaaacgtttttgacaattctttggtcaatttccaaaatcaaaaacttcgaatacccgaattttaaaaatcataatttataaatttgttagaagtattttcaataacaaaaaatataaaatttgattcacgtcgaataagccaattttttaaatagattttacatttgattttcagatttcgaaccaaaaaaaagctgaaaacgaaccagtcaaaagctaatgagcaaaaatggaatcataattttaccgaccgctcattgaaattaatccccgggctcactgccctcccccctctctgatgacttaccatgtgaacgttcagccctttcctggccatttccaatcttttgttgtctcgttgggcttcttcattttgtgtaccttctggcgggtcagcgccaaaaacttctcaaaattggaaattttgtttaaaaatgacggatttgggggggggggggaagaaacgcaccaaaagcgaagaaaagcagcaaaagttgaacagtgagggagaaacggagaagcattgcaaaaagaaagaagggattgaacgaataaaaaattaaagggaaaagaaaaagtaaaaatggaacaaaaaccaaaagtgagtggaaaagggtgtcacatttgtttaaataattgtttatccaatgttcaaacagtgcgttttcttttctaattttgttgctttcgtctccgtttcgcttcaccaaatgcccctctgaatgccgctgagtcctcctctgtccgcaatgtctctgaaacagtgccgactgacacggaatttgttgagtttgccacgccgcttggaagtgaattggcacatttggatgatcagaacggggtgcgcacgacgcggcatattatccatccgttcctgaaaattgggtttaattgctccaaaaattgcaataatctccgcccccatgccaatattcattttccctcggggataacctgaaactcgtcgattatcacacgtggcaaaatgttgttcgtcttcatggccttgtagcgcattctgtgcaaattaagttttggaatttcattgttatgaaaatatgaaacattaaatggggggggggggggattagcagtgaaatttgtgaaggaaagaaaagtaaaattaataaaaaatcaccttatttttccattattaattttttggaacgtttattttcttttttgcgcttcatttagcttatttttttaaataatagcaaaaatgttgggcttttataaaatggaaatttacggtccaaaaattttttaaatcaaataagcatttttggtattgttactgttttgtaaaaatttaaagtttcataagaatggccaggaaagatcggtttttgagtattttgtcacaaaacatttttttaaatggtttcaattttaatttttaatagaaatgtgctcggaatttttttattttatttaaaatgaaagaaattatggtccaaaaatcgtacggcaacatttccattggcaattttacctcattgggccccactcggccaccaatcggcgccgtttgatgtccgcgagttgccgccaatggggccaaaatgtcatgcgatggccctccttccaccacgctctctccacgtaataggggtatttgtcataactgacaattggcaggccaattttagtatatttgtcgcgctttcattaccccaattccctcaaagtttcgctgttgtaatcgtagcgcttccgttcggcctgcagcggctcctccgtttcgtccgaggcggacggaaattcggccgccgcgccctcgagggacgggggcggagggccacccgaggcggaggaagaagcctttaaacatgggacagtttcgtggtttaaagcgtcatttccattaaattaaaaaaacaagaatgcaattacatacaaacgcacggcaacagaagacccaaacgcagtccgacaaaagtaaagg

SEQ ID NO: 17689 - DNA, 1006 bp, Heterodera glycines
ttcagtgcttctttttgttactgtcatggcctctgctgttcattgcgcactttctttgaactctttccaccattttttgaccttttcgtctccgtccgccttaacaattaccgactgaaaagggaaattaaaattaaaagtcacagctaaaacaaacaataaacacctttgtgacgctgcagtcccacagggaaaggccctcccttttggcaaaatccctcagggcgacgaagtcggcctctaaaattggggggagtgacgaaaagccgctaattagccaatacccgaatcgaaatttgaatagaaagtgccattgtcactggaaaaccgtttcctctcctgttcccaaaggtaaatctgaacaagtgccgaagaaaatgtgttaaaaaggcaatgaaactgacctgttcaacgacagtaacgggcacagaagaatcggactgacaaaattaaaggggggggggggggaaatgccaaataaatggaaaaggaaaagcaccaattgcgaattgttccgagctgacggcggctgtcgaatatttgtcgacaaatattgggtaatttgtcgggcggtgattccggtctaaacaaagagatgccgaattgtaatttaaggatgattaaggcaatagcgaagttcgaatagtgccaaatgacctgaaaagcgcgtctgaccgcgtcgcgggagagaacgccttaaaaagtaaaagggcgaagaacaatcagtgaatggcactgatcaaaagaaaggcacactgaccaatggcaatgtcttggaaacggtaaagaagttcggtgaatgtggacagaatggccaattggagggtcgaatttgtgtacgcgtacactctgaattactctgattttgttttccgatggtcaatcgtcacatcccattttgtccagccctctccctgccccattcgcgccctccccccaaattttccatttgcttttttgaaaattggttttttcggaaggggggggggggtggcccccccccccc

SEQ ID NO: 17690 - DNA, 1490 bp, Heterodera glycines
atttgttgcgtgtgaatttgtaagtggagaattgcgcaaagcgacgccattttggccggcattttcctctaaggcttcagctgaggcggcaacggaaagctgagtcatcagaggagtgagcagaaaccaactgaaaagggaagaaagtgaccatcggacaatgagtcattcttcgacggtccattccttttgctgatttttgcctcacccgtccttccgtttgcgtatgaaaatcagtcccaattcgcgcagagtcacaacgaatgcctgcacaatttcgggccaattcgggtcgagcctcagcggttgggcaagcgctatttttaatattaaaaataaaatggccaattggatcagttctaattaaataccatcgtcgccattgatgcaaagcgtgagccgtagcagaaagtccaaaacgggaaacacttcttcgccctttgaagcgatgaagcgcatgtaatggatcagataggcccaaatttgttcggagcggcccaaaagcaaaaattggaagccaatcgaagagatttcgggctctttggctcctcaaaagcggacaatgttttgaaaggctttttggaggaatcggcgcacttccgcgcaccaatccgatgaattggaaaaggtccttcgtcgtctccgaaacgcttttctccgccgcttcgctcggcagtgccaaatagcacagaatgctctcccatcgctccacacttttgcccattaagtctttggtcgctttgcgcgctttttcctcgtccaaatggtgcattttgaggttggacaattccaaagggttggccaaaaggctggagacgtaattcatgcggaaatcaagctgaggcaatttttaaatttaagtgaaattcaagtggaaagatgacacattaatttgaaagtcgccgttcgaattgccttccaaaatgcgcagtcggaaaaggagctgaacggcgctggacatggccaaatggaagcgactccgagtccacgaacgccaatcgctaaaggaacattcaaaaaaggacaattttaaacaaaatgacgacaattatggagataaattttaaagcaaagcacgtggttgcctggatttgtggaacatcagctgaagcacagattgttgggcaaaggcgggcaaaagacggaaaatggcgacgacgcacggacgcgactcaaacaattcttagggggggggggggcaaattgggagagaaaatgcgaatgatcaccacaacaacctacaattcgcaccttatatagtaaacacattcaactcaaacggaattggcccggagagaaatgaacccaaaagggaaccagggaagaaaacttggtaatcattaacatcattggtcccatataaaaaaggcaaaaaaggtcgtttttttcgattctaaaaagtgctcgggggtaatcgagggcgttgatcactaatccgacatcaaattgtcatataaatcatcaaatctatgatttttcatcaagtgatt

SEQ ID NO: 17691 - DNA, 1044 bp, Heterodera glycines
  misc_feature (980)..(980): n is a, c, g, or t
  misc_feature (1004)..(1005): n is a, c, g, or t
  misc_feature (1033)..(1033): n is a, c, g, or t
agcagttcactgctgctgctggtgatatccattgacgtcagcaaatttcgtttccgtaatttatgcgctaaattaatttaatattaatgattttaaaaaatgaattctcacaaaatttaccgccacaaggactgatcaaaaggaagaaaatgatcggcacgatggaggacagaaggagaaggaaaggcgcgggatttgagtggttaaaccgcgccatttgagccgaatttggaaaagggacaaaagcatggcaaaagtggggaaaaggcacgacaaaatgccatcaatcagtgccaaagaagcttcaatcaataaaatttaataggtagaagaattgttcaaattattgagtccagggaattttgcaaattaaataattattaaattcaaatttaatcgaaaatatttaaataattaattgaataagcgctgatcgttgcgaaagtgaacacagaaaacgacattgagtaactgctccaaaatgttgtggaccaacgaaagaaaactgcgcatttgaggagatgagcaaaagcagacgattttggaaagtgggggagaagagaacaaatattgggcttaaatgggaagcatgagagaagagaagcggacgaattgacgaacgaacgaacgaacgcactccatttgcaattgatggaccaaattggggggggggattaatgggtgggcgaatgaagaaaagtcggacaaatcttgaaaaaactaatttcaagaaagtaaatagaattttaaaaatattaaattgagaaggtatgaaacttaatatcattttatataaaatttaaaatcccccgcggcgacggagttttttggtacggcgaagttttgcatttttttcaaatttgagtcattcaaatttaataggcttttttattttgatctaaaattgtttacccagaagcaggaaagaaatgggccaatcaacaaccaactttggacacgtcaaatggacaaaccatcanaaatggatggcgtaatcggagcgnngaaatgccatgcccaaaatgccatgccnacattatcata

SEQ ID NO: 17692 - DNA, 1045 bp, Heterodera glycines
  misc_feature (79)..(79): n is a, c, g, or t
caaaaaaaaattttttcagctaaactttgtaagttttttttggtttaaacaaaaaacgaacataaattatgcgccaacntaataatttcttaaaatttgtttttaaactaaaagtgtataagaattcctgactttttaagtgttgccaattttatttgttggaacttattttttaatcgcattgaataaacaaaccgatagcttctaaatgataaattgtaaaactttacaaaatgcagctcatcgtcagacagttaagcagattaaacgagtttgcggagagctgtattatactgtataggaaagtgctttcatttaaaattgaataacattatgccaattatcgcgtagttttaaatttttggcttgaaaaatttatctttttgaatttgaatttaatgctgatttgtagggcttccttttttaggcaattgcacacttgataggcataggataagcccgaaaaacatattttccgcttggtttggggtgtctacgatgacttttataatgcctatttttgcctatttcggggtttttgtgcctaaagcgcctattttacgaaaatggcggtacgaaaacgtccctgaccggtaaattgtataactagtaaaaaaagtttttcagtacttctatagcaacacctatttgttagggggaggatttcatggtatattttcgatttttttttaatttagtcataaaaagtgtttatgtaattttacacaccgagtcaattttgaggggacacacgcgtttcggcgccgcgcgtttcggcgccagcgcagtttttggactataacttttttctttgtcaaccaaatcaaacattgttggtatcattcgaaagctgtaaatgtcctctattagcctgcaaaattttgaaaaattatgtaaaggttcaaaaaaattatggccagaacaacttaaaaaaccagattttccaacttttatggccataaatttgttcaaaattgatgaaattttttggaattatgcaagataaaagagaatctgaagggctttcgaatgatagcaacaattt

SEQ ID NO: 17693 - DNA, 948 bp, Heterodera glycines
caactccaaattcgaagcctcaaatggaggccatttttgaagtaaattttaaattaattatgctttttttttctaaaacaatataaaaaataataaataaaatttaattaaccatttatttttcatcattaattttttagataaaacaattagttaggacctcggataacagaacgccgaaatacacaaacgaattccagcagggatgaaatattatttaaaatgaatgatatttttattttaaatttaacatcttctccataaaaattgggaaatattttaaatttgctctaaaattcaatttcaaatctaagcgtttggttttgttgtttgtttatccattatataaacacaggatgaccaagtgtcctgatttttagatttatcctgaattttcagattgtcctgaattttgaggtctctggtaaaagtataaaaaggcgatatttttgtaacaaaattcattaaaaatcccgaaaaaattttccccggcggcgcctatctacaccaccggcccccacaaactctcaatttttcttaaaaaattgacttaaaagtacaaaaattagccattttttagactaattgcattaaaattttcataatttccctcgcgcgaaaaacccggtaatttttggggtctaaatctgaattttagtgtttttatcctgaatttgaaaaaaacaaaaacttggtcaccctatataaacagcataacaataactgatcagcgtgatttgttgatcgatcacaaatatttagatttgttcaaactcagcgacgtaacgcaaatagctcgtctctgtggtttgtagaactgaaatttaaaaaggaagacatacttttggctgactcattaaattataaaataatcataatttttttaattgattgcatcgtttaaaacacttttagatgactcattaaatttaaaatttatttacatcg

SEQ ID NO: 17694 - DNA, 1376 bp, Heterodera glycines
gattaagcgtattttttcaaattcgaaaactttaactattcgaaatactttcactacttttaaataattttaaaaaattaagttaattttggggccttggcggtgccgataggcgccgcaagggggaggggaaattaccaatttcggtcctatgatttacacctacgaatttgcatcaaaaatttaataaaatgaacgaattttttgaaaaattgtcaatttaaatgggaggctccgtccgaaaacggataaattttcaaattgtttttattttaaaaattttgggagaacagaaaaaagatttttttgctattactagataatcaggttggcatgagaaaaaactttctgcaataataaaatatgtttgaacccatcagatttgaactcataatgtcttcgcaatgaaaatacatacctaaatgggcgcctcgaaatcatcaatattattcacaacaaaataaaaattgtataattaggagataatccgcgacagttaaaattagagtgccacgggaccgggaattttgggcaagcccgggaccgggaccttttcgggttgaaaaaccgggaatttttggctgggaaaaccgggaaaaacccgggactagtcccggtcccggtcaaaaccgggaccttggtactcagttgtactcagttgtccgctaccaggtcccggtcccgtggcactctagttaaaattgacaacaaaagatatttttggagactttgtatttaaattcaaattttctactacggtaccttaattttgtaaatgtaattaccgaattacctaatttgttgacgattaaaataaattgatgggctaacaattatataaaaaggaatcgcattatttgccataaatgggcttatcggataatcattagagtccggatttttaagcacaaaaaatgacacttaattaatatacaaaataagaatggatctagaaattcagaaaaacccgaagaattgaaaaattttatcagaaattcttccccttcgaaatatttaaattattgaatttcggttttcaattgaaataaccaaaattatagcgttttttgttgtcttttttgtccaaatatcttataaaaaataaaaataaatattatttgcctttttaatgcttattcgaggatttttgagcctattaaggcctattatactatttttctgcttttttaggtggctgtttttttatggaaattctttgttcttgatttaagaatccataggtttttttaaagttatcctaaatttttaatagaatttttttcatttaaaaaaaaatattcactgaataattaattaggaatttttattacaaacggtaatttattaatttttttaaatgggaagagaatttgctt

SEQ ID NO: 17695 - DNA, 2250 bp, Heterodera glycines
agcagaaggatgattgctgtccttgcacatttcttttgtttgcctttgttttccatccaaaaaataatttgcatttggcgaaagatttgtttatgttttttttgtttatgcatttatcgtcttctgagtttttagggatttgttgatcacgattgtccctttttattatatgacctttctcccaacattggcaacaaaaatatttgagtataaaaatggttgggtgcacaatttatgttgcatattttccaccttgactttttagcatatattttgtttgcataattttgcgattttatgtgtatataatttgcaccgtattcatgcgccttccacccccttgcacagtatgccaacccacaaaataatgtactgtatctgtatgacttttttttttactgcctttcaattgaaattcaattaataatttggttgattaaattgtcttcaattgaaatttataattgattccacattttctaatttcgaataattttgtgccgcaattccttcctctgataatttccgcagtttcccaatctctgataaaaggtgccgcattttcgaatgcctaataatatgatactgcgattccttcccatggtaatttccgcagtttcccattctctgataagcgattcctttgcctgataatttccgcagtttcccaatctctgataaaagttgccgcattttctaattccgaataatttgatgccgcgattccttcccctgatcatttccgcaatttccaatctctgctaaaaagtgccgcattttccaattttgtgtatttgattatgtcgttccctatgcctgataaaacagggccataatccctaaatcgttcacaatttaaacttttcccattcaccctttcgcgcatttgcttttctaattggcctatcactgatttagtgccattgtcatttctaatttttatcccatccattgtttgtctttatgcatttcaattttacaagtatactttaatcacatcatccctttattttgttagattaacaaaatggatcctaaatcgaaaaaagaggagaaagccggttcagtggcgggtgctcgagaggatgctcgagagtcgcttcaactgcgcgcggagcagcacattgaactccactcatacagagatgcgacggacgtcaattaccagcgaatggtaatttgatcatttttataaattggtcaaaagtgtacggtatctctgattattttttgtccattttttagtgcctggacagcgaggcatcagccggcgtgccgccgaaggaattgccaaggcggcacggtaagcaaaaaaataaataaataaaatatatttatagtgaacataattattcactagggcttgaacttttatatttaacacacctaatagctcaaaaaagcattttaccttttctttcaatcatgctcagtttttggcacctaaatttttaatgatgctcaaaaaacaaatttttgcatttttgattttttaatgattttttttatttctacggaaaattttgaaaattttgcttttttctttcaggtccctgatcaaggccttggagctgcgcagcgcgtacatgacccgcattggcacacacttcccgacgacgacgcgcaatttcgtggacggtaagaccatcacaaattaattattggcttaaaatattttgggtttttcagcaaaatacccggacgaattgcgcaagcagaagctgaagagcaaaaaacatgtaagcgatagggggggggggtttattttgccatgctttatttatttactccattaagccgacacaatgtacccactcgaaatgtcagcggaacattggggcgagcaagtgccgacttacgagcagcaattccaattgcgccgcgccaacggaattgtaagaaaaagatttggaaaaaataaataaaaatcaaaattggtttaggtggaagtgacgcacggggaagaggggcgaattgtgccagaattggagaagtattacttgtcccgcgaccaattttattcgtgtgttttggaccataatttgttagctttaggtaaattgtgtcccctccatttagggattacacgtggatgaacgatttgttggccgatgggccaatgaaaaccttttgcttcaagcggctctctctcctgaactcgcgattctccatgcatgttttgctcaatgagcaggtgagaaacatcaaaataattaaataatgccctgggggtgggacaattttctagca

SEQ ID NO: 17696 - DNA, 3092 bp, Heterodera glycines
  misc_feature (60)..(61): n is a, c, g, or t
  misc_feature (2944)..(2944): n is a, c, g, or t
tcgtgctgaaatgcacaaattgtgaaattaatttgcataataataaaacaagccatgtannaagcacctcacaaaaaagaggagaaccattgagcagcgtcaaatggtctgaaaatgggaaaaaagtaatggcaattagcaaaacaattgggtataattaattgagtgtttatggccaaatgacccccttcctccaccgcaaatgagcgtcggctcagctccgccttatgcttcgctccagtcggcatcacaaacacgtctctgatctgcatcatggcaatctgggaacaacgggagaaaagaaaatcacacagtattcgcacaactctaatgaacggacacaaaaaacccaaattttttaaatttcctctaatttctaaacaaatgcaaattgctcacaatggtcacaatttcgctggagcactcaaattcaactgaaatggtgaataaaaatatgaccaaaaatcagaaataaattgaataaaattatcgctgacccgaggcgatcagtgccttcgcgtgcattggggacaacggaagttcggccatgagcaaaccaagcggattcaccagcagaccgtcctcgtcgatggccttcagcgcaaagagcaattgcaaagcgtgaaccatggccatggaagagggacgagaaaggtaatggaatctgagcagaaagaggggggaatgggggacaaaaagcgggaaataagaggagtaaacattgctacggttctcccaatattagcattaacaatgttgatttttattacagtcccgcttcgtctagtgaatgaatgaatatccgagcgtaatttctttaatttctcgattttgcatttaaatttgtactttcgtccgcccacctgagcacattctgaactccaagcgccttcatccgaagcaccaccgaggagagatcgcagcgctgaatttcgggcggtgtcgcgctgcgcaagcgtcgaaattcgctttcagcgtaaaggcggtaacatttgccgggccgtacgcgtccagcacgaccggcacgctgttcagctaaaagaatgtcgggtgttggcaagggatgggagtgaatggcaaaaacggttagaaaaatgatcgaaaatggaaaattcaaataaaagacgatttgactgaccggaagactttgagcaggggacgatcatcagtgtttccatgccgagtttggggctgaacacgcgcattttgacgaaaccgcagtcgatcactgtgccataaaaatcggaatgacttaaatagtggcaaaaatctatttcacaatgttttgtccgcaaaaaccgtacagattccccacaaaaataccgtagcaaacgcctgcgattgtcaccgacgtttccgcaatgtttgtcgtgattatcgcctttctgctctgatagggggcggaatcgaacgcgcggaactgttcacgggcaggcaaacctaacaaaggcggaaaggaggaggggaagaggccaagttcagtcaatcagtgccaatttgactgcccatcccaccgatcagtcggacggacatccaaaactcacaactcaattcaattcatctattcttatactgatcagcttttggtttctctctgatcagtcaattattgatcgtttgtttttttcatttcactgattgcccctctgatcggtcggacactttcgcacctccgtaaagcggcaccaccaacaatttgtccttgtctttgctcatcgttttggccgcgtggcgcaacaaatcgcacgccttctccacttcgtcttggcccgtaagaaaagccaaaatgtcgcctgggggctcctcgtcatgcaaacgcagcacagtctcgactgtcgtctgcacatagtcgggaacaccactgaaaaagtcgtggagagagttaagcaaaagaaaaaaaacaatggcaaaagaggaaaataaaacggagtcattttaaagtttaaaacaactgtgcagtaagtcataaatcaattccaaaactaattgtgagcaaaacgtacacttttgtgtagaaagtggtgaccgggaacatccgaccttcgacagaaattattgtggccgtatttttgtccggcttttgctgtgggttgtcgttgagttcgaaaaagtcgcggaaaagctgaagcaaaaaaaaagtgatcatcgacgaagagaaattgattctttcaaagccaaattgctgattgtttcgtccgaatttgtctttttccgctttttacctcggcttcgatggtggccgaggaaatgatcacgcggagatcgtcgcgaatggcgacgattttgcgcaggaagccgatgatcaggtctgtgttcactgaccgttcgtgcgcctcgtcgacgatgaccacggagtacgcctgcagcaacgggtcgctcatcagctcacgtaacagaattccatctgtgacaaactgaagaagaggcaagaaatggcatggacagattgggaacaaacaatcggacccgttcaaaaattgccatggcatgccaaacacaccttaatgtgagtgcgtgccgaaatgcactcgtcaaatcggaccgaatagcccacagcgtctcccagccgacacatcatttcgtccgccacgcgactcgccagcgaaatggcggccacccgtcgcggctgagtgatgcaaattctccgcccattttcggcccaaccgaactcagtcaaatactgaaaaaaacagtagacgaccacgcaaaagtgatcagagaataggccatgtttctgtttgtttgttatttcttcaattacttgtggcaattgcgtgcttttgcctgatccggtttcacctgaaattgaaaggatttgtgggtttaaagaagaactacggaataaaaaccgaattgctaacggttttcacttttcaattctaagttatttggcatcggacaaacaaataaacgccatttggttagttcccaagaaaatccattnggctcaattgctgctttgatgacttgtaattgctcgccaaacaatttttgcgtgttttagacattcttaaaagtagaggtgcgcaacggagaaatccccggaaggaagtctcatttcgacttttccgcttggattggctcaccgacga

SEQ ID NO: 17697 - DNA, 3291 bp, Heterodera glycines
  misc_feature (121)..(121): n is a, c, g, or t
gtaaagtacataagctttttctttgtcctcatgcttttgtttctgcttccatcgcctcctatacccttgccactttggtgatttcggccacacagagcagcaaattgccctcgctaacacnccattgctgcccgtgtcgttgttggtgttgtggttggccaagtccaactgctgctgctgctgcgtcggtttagccctcaaccattggaccatgtggcgccaaaacgctatcggtgccatgggaacaaaacacccgcagaccatcgccgcaaaaatggacatgccgaaggagttgcagcggataaataagccgaggcggagaggattggcaattaaaactagaaatatttttaaattgacttttcttgcattaaaataattttttgttcgaattccgacatgcattaatcatagagatttgaccaaaattctctgaaactgtttccattttaatgtcggcagcaattttcatcggcggttcgagcccgccatggggcagttattttgactagtgatagtccaattaagatatgtcgaatttgcaacctcccaatcttttaaaaattcatggctcactccagcaaaaattatcagcaaaacgtaccgcggcacacttgacaacatcccctctctcaacaattccaacgaaacgacaacaatttttggacggcgcagcgcaattggacatcgcagcactgctaaccagcattgaagtgtctgaacccgttcgtgcagtcatttgccaactggatgcacttctcaagctcgcggtggacatgcttcatgagacgtcgacccaggacactcgcgcggtactggaggaggaccggagagaacattcggtcgttctgatgggcgtgctggaatcggacagttgcctttcctctacacggcgcgcgattgctgaccaacagcaggtgttggacattctggacgtttgtgaaatcgaggcaatgccgaccaaggttttcccggatgggccaaagaaaggaaggaagacccagacttctcaaagtggaaatgccaacccgaaagatgacacaatcatttctccgcaataaaaaccgacttaaaaactccaaatttcaagctgtctctgtccgtccgtctctctctcctgaacaactcaaggagcggcataatttgatcaattgtttgcagacagcccgcgcccaatttcctaatcacaatttcattgtttatgctggacacatcattccccgaaacgatgtctctgtttttcgtgatgaccctggtaattattcttgtttttgccataaatccaattcataaaatcttgcgggaaccacccatactgaaatttcaaaaaattttacaaacgtaaattccggtaccgcaagatttttcaaaagtcctcataaggttaataaatgtatacaaggtgctttagttaatataaggtctatctataacaaatgtgaacaaatagaaacaatttttgaatccttaaatttagactttatctgttttactgaaacctggggtaagaatgaaaaccaatttccttttcattcaaattttcttcaaaatcataccatttcttacactaatagattgaataagcgtggaggcggcatagcttttgtcgctaaaaaatatttgggtgtgaaatactaatattgcaatttcaaaattacaattcactaaatttgattcttatttatcgacctccttctactatttaaaaaataccaaaaatctttttaaattccttgacctttacatttcagaaaactgttgtatacttggggattttaaccttggaactaaagatttaactataaaaaataaaaaacctttccctttaagtaattttggtaatttattttgtgatttctttaataaatataatttgacatcctgcattaatgaacccactagggagcaatccttcctagatttaatcctttcaacaaaaactgacttaataaatgcggtagaagtaaaaggtggacttttagatacagatcatctaacaattctttttgatttttgtgttttaaagcaaaatgcaaccaagaaacaaattgttcttaggaaacacactaaataatattcctgaaacttttttatctattaagtccgccaaaaacttttacccaccgcatttattggcttcaattagggaaaaagcacggctatataagctaatgaaagaaaatagaggaaaatatgaacctttatataaaagtatctccttacatattaagactcaaataagaaatattcaatcccgtaaagaaaataaaatactatccggtgataagaatagattattttcgtatcttagaaaatactttaagccagtagaggatccaccagttattcagtataatactttgtttgtttcagactcaacttctaaagcggaaatttttgcaaaaattttttccgaaaactttactgtaaataattattctcttgattttgatacttctttttcttctccaacaataaacgacgttgaatttaatattatttctgttggtaaagttcttaaaactttacctaacagaaataacacatcaccggacggtattacctttagactgttaaaaaattgttctctttcgtttactccttttgttactgaaattttcagactctcccttgatacagggaagcttcccactatatggaaacaatcgattattatccccttgcataaacaaggggaaaaaagtaaccccatgaactataggccaattgccttaacttgttctttatgcaaaattatggaaaaatttattgtttgggctatttccgattttcttttaaagaacaatttattctccgaacatcaatttggatttataaagggcagatcaaccacaacacaactaatttcaacccttgaaaattggtatgatggtatttataataataaaaatatcgattgtgtctatatagattttaggaaagcatttgacgtaatcccccataatttacttttatataaggttcataaaattggtattaggggtaaaatcctaaattggatatctgactttctttcgaaccgtacctttagggttcgggttgataatactctctcttctgagtataaaatgagctctggcgttccccggggttctgttcttgggcctcttttgtttctgatatatattaatgatttacctgaattaattcctaaacaaatttctataaaattatatgcggatgatgtcaaattatattccgtgcgtaaaacaaaaaatgatagaattgctatgcaccgtgctttaaatattcttcttctgattggtctaa

SEQ ID NO: 17698 - DNA, 1789 bp, Heterodera glycines
tttatttaatataataataacaatctaactaaatttactatattttaaaaagccaatgcccaagtaaacttttcgaaaataaaattaattaaacaataaaaaccaattagcacgataaaaaaagatatcagatcacactgcgtactaattcagaacggtttacgagatttttcatctgctacaataaacacaaaatttttttttgtcatctatggaaagatagtaaataaaataaaattctatctatgcaaaaataatttttctcctcaaaaatctaatcaagttttttatgcattcttattttgaatgtaaacaaccgttgtttaatattttaatataagcctaaaaaaagattattattaaaatgcaatgcaaatttaaaaaattaaataaaaactcaaataaaacctttgaaaaggacatattctaattaaaaggcatttagaaaaaaaccatcaaactctttacaaaatgttcggtccgagggatttgtttaagtccaattaaatatttatttattggagaaggaaaagaaagtcacaataatttgggggaacaaaatataaatgcaaaaatgaatgaagggaagacactctgagaggggaaagggagcatatttatgggcgaggaaacaacatgaaataaggggaatcgattggattggcattatgtcacggacattcaaatcatcggcggcaatgccccgaacacctccccccttaagcgcggttccgaggttacggtgagaagcgctgcggcggacggcgatttcgctgagggtaccgtcgttgctgtccatggtcaatttgacctccaaaattttcctgttcgccatgcgggtactccaatggcatttccactgggatttccctctgatcctcaacagcaatcggtcttgggatgtcgaaggtttcgaacatcaccgagagctgatcatcggagtcggacgtctttcggggacgaagctggttggcgtggtagcgccctgatcttctatcggcgaatgccacgtcgtaaatcacaccagttcgctttgaaacttggccctgttgccaattttgggaaattcggtggcgggcaaacactttgtttccgatcggaaattcccttaatttggttccaaatcgcttattgaagcgtctcgccatttcaacatctctgtcgatcggttgttaaggtggcggccgcaacaaatccaaagttgtgcgggggttttctgcccaggaacatttagcaggtgttttgctgtttggcaacgagtcattcggggttgtccgatagcttaacaagaaagtttcaatgatttctttgcttggggctccctcccctgtcaattttccaaatgttcttttgaacgtgtccacgaaacgttcggcctgaccgttggacactggattattcggcggtgaaaacaggtgactcacaccgtgggcgggcataaatctagcaaatctcgtggctcgtaaattgggagccatcgtcgtactccaaaatttgcgggatactgcctcgttcgcagcaaatagcaggagcatatcactaccagttagaacactactacgatatatgagcgcacagtatgcgaataccctgtaaggtactaatttcagcgtggacgagcgaagcgaatagctactcaatcgcctgcagtgctacggtcttagcctgtgaggcgactgcgtcacgagagtagggagggggcgaaggcccaccacgaggccgcgaagaggccgagtgagtaccttcggtgcaggaaaattattaaattataaaaaatttctaattgctt

SEQ ID NO: 17699 - DNA, 2688 bp, Heterodera glycines
tggattatacggcgctgaaaacaggtggtgacacccgtgatgggccataaatttagcaaattcgttgttcgtaaattgggtgccatgtcggaccaccaaaatttccgggatgccgtgtcggctgaacaaatatcgaagcttttctattgttgccgctgtcgattttgtggccatttcgaatacctccgggtatttcgaaaaggcatcgacgatgattaaatattccttgccgaaaaatggtccggcatagtcgatgtggactctttgccatggagcagatggtcttggccacggttgaagtttgttttaactggtgcctttgcttccatttgacacggttggcagttttctaccatctgttggatgtcggcgtccatatttggccaataggcataatttctcgccaactgcttcattcttttgattcccgggtgtcccttgtggaatgaatgaagagttttctgccgaagtttttcggggatgacaactcggttggcgtacatcaggcaatttctcgtgatgcaaagctgttctttgatccgatgaaaaagctttatttcggcactttcgtctccgacgttccttggccaaccattcgtcaaaatttcttgactttttgaatggttttgtcggcttcagcagctgcgacaatttccttaaatttaattggcagtgcttcaattgatccgatcaaaatgtcgtcaatttccgaatctgatcggagagatgcaatcactcgatcttcgtcgctttttccctttgcgatcagccttgaaagcacatcggcttgaccaaaatcattggtgctgatgtactcaatgctgaaatcgtatgcgaggaggatcagcgaccagcggagaagtcggttggcactgcactggcgcactccctttttgcttccgaaaatggcaagaagtggcttatggtcggttagcaacgtgaattttcgtccatagatcattttatggaatttttgcacggcgaaaatcagtgccaatccttctttctcgatttgagaatagtttttctcagccggtgttagagctgatgaagcatgtgcaattgcctttattgttccgtcgggaaatttgtgggagattaccgctccaatcccgagttcggatgcatctgctgcaaccacgatttcttttgttggatcgtaatgcgtcagcagaagatcggatgacaaaatttccttaattttgtcgaatgcctgtttgcatttctcactccacttccattcgctgtcctgcttcagcagatcgtctagcggttttcgtacaaaacgcatgtttttgacgaattgctggtagtggttcaccattccgaggtaggaacgcagcgatggcacatctgtgggtgcgggcatttcgctaattgctgagattttctccgggtccggtctccgtccgtttctgtcgatgatttgtccgagatatttgatctcttctcggaaaaacgaacacttttccaatttgatccggaatccccattcttggaatttttccaaaactttcttcaagtgatcagcgtgctctttggcgcttttgcttacgatgatcacatcatccaagtaagctgtggcgaattcaaattctgccaaaatttggtccattaccgattggaagatggctggcgctcattttacgccaaaatgaagtctcttaacttcataattgccacggtgtgttgaaatcgagcagattttcctcgattcattatccaattcgatttggagatatgcatccctgaggtcgatttgcgaaaaatattttcctccatttaaggttgcgaaaatatcctcaagtagcggaagtgggtgttggtggtcttgaagggcattgttcagaccggttgaatagtctatgcataggcgtgcgcttccgtcggcctttttcaccgccaaaatcggagctgcccattcggtgtattcaactttcccaatcacacccattttctcccatcgctccaattctccatcaatcgcttcttgagcgttgtatgggactgggcgaacctttctgtagaccggtgcggcgtccgctttcaaagtcagatgcgccttaaatttcatacaacggcccaattcgtttttgaaaatttcggggaatgacgctttgagatggtcgatgtgcgctttgactgtcaaattttgtgacggtttttgagcttttgtaaaacctcttgtctcgtctccaactcggcacagatttactggcgcattaattttggccttgagttcgttcaggagtccaaaagcgtccatcatttgcacacttagcaaatttagcgatcccctttttgccacataatattcgcttttgatgcaaatatcgcggaatttgaaattggcgactccctttccgatgaatttgacttgtgttccatcgaacatgcatccactttcggtgcatttgcggagtcgggggctgccgatgacttcatgtgatagttcatcgatcacaattatttcagccccgctgtcgagtacgaatttgatgtctttgccatctaccgccacgtcggttttgaaaagcgaagcggagtttactttcatggccattccaattcgtaaatttccaattttcctttttggaattggcaatttgtttctccgtctccattcctgcactttgtcgcattggcattccgaaatgtccattttgggagcatttttggcactttgct

SEQ ID NO: 17700 - DNA, 1076 bp, Heterodera glycines
cccccccccccccccccccccctccagagcacgacatatatttcaacaaaaaatttgaaaaattgactagagaaatcgtacgctaacggatgacctaatggaaaaaaatccccgaaggagagaatttaattaaatccattccttcgggggtccgtgccgggtgccgcggggtaagcagtgctggtttcgtttcatcacggcccccatccttttgactagtcagccagcgttgcttaacttgtcagatcggacgggtacgcatgtttccacttttccaagcaccccaccgaaagttgaacgaaataaccaaaatataaggaaaaatttaaaaaattttttattctttagccttattcataatataagcctaagaggaccttgttaacatgtaaataaaattaggtgcgtttcagagcattttctgaaaaaaatatttatgaattaatttttcaaaaaattggaaaagtacgcaaaattgcaatgtctaaaatttttaaagaaacattatgggacagttaaataattatatgaataagcattcttctcagctgttaccctgcaaaacctggtgcgcttctgagcactactcgaaaaatgagtaaattaattttcactaaaaagttaagcctaaactttttggcctgtttaaagaggaattaaaaattttaaaaaattttattcatcttcctttttgatagaaaaagcatcagagagcctaaaatagcttgtaaataaaatttggtgcgtttcagagcactttctgaaaaaaataattatgaattaattttgcaaaaaattggaaaagtacgcaaaattgcaatgtctaaaatttttaaagaaacattatgggacagttaaataattatatgaataagcattattctcagctgttaccctgcaaaacctggtgcgcttctgagcactactcgaaaaatgagtaaattaattttcactaaaaagttaagcctaaactttttggcctgtttaaagaggaattaaaaattttaaaaaattttattcatcttcctttttgatagaaaaagcatcagagagccttatttaacatgttaatagaa

SEQ ID NO: 17701 - DNA, 2276 bp, Heterodera glycines
tttgaggctatactttatggcctatgtcacagaaaactctgaaattgaaaatttcaattttattttccattattcttaaatatttcaccattgcccaaaatatgacgggaaaaagacgcctgtaatcaaaggaatactgaaaacatttaagaatttcaatgataaaacgaaattcagcactgaaaaaggcgtctctttgcaatggcaaatccgaaaaaaacaccgaatgttttgtgagtgttgaggaagttttttttgaagtagcaaaagccattcacattcattgccttcacttacaaaggctatcaaaggaataaggaggaatcgaaaagggaaaattggacaaattaaactctatggatgattaaaagactttaaatatttacgtggtccaattttgccaaaaaaagaaaaaggtaatttatggttattcaggtacaaacggataagcagggttatctttggggaagttgtggttatttgtactcccgacggatgacgggaaagtgaatataaaaatccgagagggccttctttggtgtgttcatgactcggcaacactttcttcgcccttcggcagttcttccccgctgttcggcaccacaattgtccttatttcggccgtgccctcccctcgggcgtcgtcgtcgtccgtctgtgtctccatgtccgtctcggacactctctcttcattcggcttccttttcagttcgagcaaatgttcgcattggttctttttgctggggttttcttgctccctttccgcgagaagtcggtcgagcagaggtcgtgccaagtgaatgccgctggggatggagttgcagtcgtcgaacccttcctctttgagcagcagcgtcagtgtgtcggcgtcgttaatttcatgcgctgactcagtgaaaatttctaaatttgaattaaagcgggaaattaaacgccctcgtcccacctctgactcgtttttcgattttcatcagccacttttgttcaaattctacaagagaatggtcaatcttcggcgcagcatcgaatataacgacgatcatggtcatgttgtctctggatcccttcgacaaacacacgtccaacacttggttagaagccattttgtggtcatccgtaacggaaagtcgagaacgcacaagcgcacaaaggtcttcgttggcaagaacgtcgtaaatgccatcacaggcgaggaccaaaaactcatcatcttcctaaagggaagccaacataaatggtgccctcccttcgccttttttttgccgactttgtctcgcggaacgatgtaaatatcgggctcaggagaaacaagttgttcagtgacacaaaggccagggactgatttgtactcgaagtcgcccaatgccctcgaaacggcgaggctgccattcactcgctgaatcatcaccgaaccgccggcctatggccaagtaaaactggaaaattcctttgaattggctggcaattaccttaatgattctttcgcgttccttttcaaggtaaggcttgtggtcttccgtgctaaagatggtgttgcttcttcggcttaacaatccacgcgaatcgccttaaaaatggagattcattttttcacccaaaattataacgccaaaacgagtggctaaaccgattctgaaacccgtttagactcatttcgaaccccgaaccagaattgaaacaataaatcgaaaactcaatttacaaaaaattgacatttaagcaaaaaagcgattcaaatatatgaaaattttgatgatgattattatgcatttgcattttattatgggaccagtaaagccaaggattatcacccaaataactttagtatttccaaaaaatggggttgaataccatcgttactaccacacttttttttgctctggttaaatcttattgtgaatctccacactcaaaaaggaaacgaacccaaattagcaaagaagatgtaatccggggtcagaatggcacatattgccgttgtgccgcttctctccctctctccgcctccctgcaactcgccaagtgaggagtccaactccaagaagcccatgcgaattccgtcttggataagcgacttggccttttccgtgattttagggccattggtcttaagttcttccttcacctaaacggcaaaaaaaacaattggtccttcgacacattttatttattactgcttgaaattctgctgtgtttagcagtgtttggagcagattctgtgcggagtgaaaggcaacgttgttgccagcgtgtccatcgaaaacagcaaaaaatga

SEQ ID NO: 17702 - DNA, 1512 bp, Heterodera glycines
tttatttttctttaattattccattttcatttcccgtctacgaacacttttttcacttcgcctttacaattgtggcttaaattgccaaagtttttccattcacggtattcaactttcacagttacagtacgacaatttttgtttgctccaataatgcaaccgtccaaaagtgcgagaattccttaaccgtttttttaatttttaaaattaaaaattcattttaaattttttacgctctttgtttggtggctttttcggctctttttctggctcattgtcatagaaatggacctttaaatgaacaaataaatttgaatttaataaaagctttgtatcaattaccatggcacaatgttttaaattgtcaaaatatttgtttccacaggttggcctctgtaaaaagttaattttcaaataaaaaaaacaaattaaatttacgaatgccatttcttgcaaatcctttagacaaattaggcgctttcgattgattgtgccaaaaacgacgccaaatttttcatttggcatttttcctttgtactgaatcaaacaattagtaaatgtattcgaatatgctttttatgcttaatttgacatttgctgctttttgtgcgtaattttgcgttttttgaaaaatgttttaacaaaaaatgccatataaaattaaaagactttaataaatacattttaagtatttctttatcgcctcattttatcttcaccaaaattttttgattttttatatttttaagaaaatttgaaattaattttgttcataattaaaaagaaaaattgtgattttctcccgctcactttgacgcaagccattttgacgtaaaatgttctatcatatttttatttgtcccccaattaaataatcttttatgattttaaatggtttaatagttcctttagcttacaaagtttccaaaaatttcgctgtgacaaaaaataattatggccaaaaaagctcgaaaaactgtatttttctgatcattttggcgcctcgtgccatatcttatttccgatgttaatttatacagcttttatgcttatttagtccgtacattgttcattaattattttaacttgacctaccgtacatgcacagtactcttcccgcggtgccatgccattgctcgcttttgtccccttataacacccataacatccgtcattttttgcattttcttcgctcagttcgttgtcctcaaacagcgacgagccgagccatggcggacgcagatgccgtgggatgaagcccttctgcttgaccactgtcgagagaaggcactgttcgtgaaagggagtgccatcgatcggacggcacaattcctcggcattaaatgctaaataaaaataatattttataataatttgtaattttatttatttttctatgaaatacaccatttttgtctgatgttttctgatcgatagaatctcctgattcaaattggatgatagtaaataaaagaacagccaataaatggaccatttaatgaattccaattt

SEQ ID NO: 17703 - DNA, 1392 bp, Heterodera glycines
  misc_feature (1361)..(1361): n is a, c, g, or t
gggagggggcgggggtccggcagggccggtatgcgccgccgggaaaaattttgtaatttttaatgcaatttattaacccttttgttcaaaaaaaacattaaattttgtgattttgaaccatttttttaatatggattttaggggccaccggaaatttgtaattttacaaatcggaaattttaatcaaaaatagtttttactcataagaaaattacatttaaagaattcgtcaaattgaaatgtgaaggcgttcgaatgataccaaaatcgttagatttggttgaaaacaaaaaaagttatagcccaacaggctggcgccaaaacgaccaagtccactaagacatttcgcaaaaatattagtaaatttttcaaatttgacgcagtttcactgataaaaatgatattttttaatttttccatcctttttcagacatttcgtcgaaaataatgattaaaaaataatacagtaaatacaggtgtttaacgcctgtatcttgtacctgaattccaaaaatggactgtacttgtattttctccgaatggtgtctaaaatattctcgaaatcacagagaccccaaaaacaaaaaatatttttttattttttttttatttagccaatttctgctatgtaggaaaatgagtttgttcaaatgtacaatataatgaaggatcaatcatcttgtcgaggcaaattttttattgcttttggcgagtgaatgattatgattagggctgggaatttaattcaaattactttttttgctgattctaaataaccttaaatggacttaaaagtattctacacttgtttgaaccttctaacatgcattttttttttttgactttttatactttttgagatttttatgccttatgggatttaaaaaatagccaaaaagtaaaaaaaaaacgccaaaaaaagcacaaaaagtcctaaaaaattagacaaagcttaaaaaatcccatttttagcattttaatgaatagcattttataaatagaaaccggattatcaggtatacgcctttatttttttgcttacttgccacttcctaatacattcgcacgaaaaaaagtttttaacttagtttgcagcttcttgtttaactttttggtgccttttttacactttttcgtgcttttcttggctttttgtgacttttttgctattttttcatgacttttttttggcattacctttatttttcggaatttcttagctaaactcaaattttgccttgaaaattttttatatcggcttccgtgtgccaacaagcgccgcagggaagaattgattttttattgaaacgtgtaatttttatataatttatattaatttttacatttatttttctatgaanttattcaatcttttttttagtgaaaatatat

SEQ ID NO: 17704 - DNA, 3576 bp, Heterodera glycines
  misc_feature (895)..(895): n is a, c, g, or t
  misc_feature (898)..(898): n is a, c, g, or t
  misc_feature (902)..(902): n is a, c, g, or t
  misc_feature (915)..(915): n is a, c, g, or t
  misc_feature (917)..(917): n is a, c, g, or t
  misc_feature (922)..(923): n is a, c, g, or t
  misc_feature (927)..(927): n is a, c, g, or t
  misc_feature (931)..(931): n is a, c, g, or t
  misc_feature (933)..(933): n is a, c, g, or t
  misc_feature (939)..(939): n is a, c, g, or t
  misc_feature (946)..(946): n is a, c, g, or t
  misc_feature (949)..(949): n is a, c, g, or t
  misc_feature (951)..(951): n is a, c, g, or t
  misc_feature (955)..(955): n is a, c, g, or t
  misc_feature (959)..(959): n is a, c, g, or t
  misc_feature (970)..(971): n is a, c, g, or t
  misc_feature (973)..(974): n is a, c, g, or t
  misc_feature (983)..(984): n is a, c, g, or t
  misc_feature (986)..(988): n is a, c, g, or t
  misc_feature (992)..(992): n is a, c, g, or t
  misc_feature (1000)..(1001): n is a, c, g, or t
  misc_feature (1047)..(1047): n is a, c, g, or t
  misc_feature (1051)..(1052): n is a, c, g, or t
  misc_feature (1056)..(1058): n is a, c, g, or t
  misc_feature (1061)..(1061): n is a, c, g, or t
  misc_feature (1070)..(1072): n is a, c, g, or t
  misc_feature (1075)..(1076): n is a, c, g, or t
  misc_feature (1079)..(1079): n is a, c, g, or t
  misc_feature (1081)..(1081): n is a, c, g, or t
  misc_feature (1087)..(1087): n is a, c, g, or t
  misc_feature (1103)..(1103): n is a, c, g, or t
  misc_feature (1106)..(1106): n is a, c, g, or t
  misc_feature (1118)..(1119): n is a, c, g, or t
  misc_feature (1127)..(1127): n is a, c, g, or t
  misc_feature (1129)..(1129): n is a, c, g, or t
  misc_feature (1143)..(1143): n is a, c, g, or t
  misc_feature (1146)..(1146): n is a, c, g, or t
  misc_feature (1148)..(1149): n is a, c, g, or t
  misc_feature (1152)..(1152): n is a, c, g, or t
  misc_feature (1156)..(1157): n is a, c, g, or t
  misc_feature (1163)..(1165): n is a, c, g, or t
  misc_feature (1170)..(1170): n is a, c, g, or t
  misc_feature (1177)..(1177): n is a, c, g, or t
  misc_feature (1180)..(1180): n is a, c, g, or t
tttttattaatatttcataattttattgctgattcttttaaactgttaaaccatttttaatttttttttttcttttattaccattaatattttatttttgatttttttaaataaaaataatttaaatttaaaataataattaaatctatttgtaagtattttacccttcaaatggtgccgcatatttgtgctcgtcactgtcgtacgccaattgcgcaggtggccgaggccgcccgcgcggaccgctggagccgagactgtccccgccggcgctcaaatagcctaaaaatgattaaatataattaaattgattaaatttaatttgtaattaaaatagattgaaaacaaaatcacaattaactgaattaaatttgtgtgtatttaccgtccaaatttcgacttaacggtcggctgtcataacgtcgtcctgttgccaccaatttagcctcataatcaaccaaatccatctccttgggaatggatggaataattaaaatttaattttcaaaactttaattttaatttatttattttcaaaatttaaaattgtttaattttatttccaaaattcatttttttaaatttggatttaatttattttatctttaaaattcaaaaatttaattttatttaatttatttccaaaatttaaattcaaaaattttaatttatttccaaatatgccatcataaaacaaatatctgacttcttgtgttaatcgggcacttccttctccgccacttttttcacgttcaaattcactttcctttaataaaaataaaaataataaatacatttaaattttaaaatttcaaattctaccgtatccggccaccgttgctgccgtacaccttaaaatttgtttcaaatttatacaaaaatttctaaacagtgngtnaagnaaaccttggtggnantctgnnaaantgtngnttttgntgttttnggnangtgnaatntgttgttgtgnnannttttgatgnntnnnaatnggaatggnntgaaaaaatttaaaaaatttttaaaaattattttttttaatttggncaanngttnnngtngaggtgaannngtnngantnggagtngttgtggaattgtgangantggagatgatgnntgtggaananaattgtggagttgntgntnnggntgtnngtgaannnatttnggttggnagnagtggagtcatgctaattgggaggataagaatgttaacaaattcaaaattaaaaaatcgaaatttgaaaaacaaataaatcatttaaaaatttcgtatttttcggggaatttgcttggatcaaaaaggtcgaaatacgaccagaccacataatccagaccagtcggacgtgaattgaatcgtaattttaatagcagaaatttagaccatcgaatggcggccgatgaaacccctgatcaatcgaaattcagtggaaatgcagaaagccaaatcagccaaaaaaaaaacaaaaaaccccggccaatcgaattctggtagctgaaaaccggtctatcaatcgattagccaaaattcaagcgcacatattcagatcagtcggatatgaataataattctaatggccaaagaatcaatcgaattttgcggccaataaaatcaaatcagtcgcaatccgacagcgaaagttcagaaagccaaatgagcaaaaaagcccgatcaaaccgaattccggtacctaaaaatcgatcaatctgtcgatcgattagccaaaattcaaacacacataattcagatcggttggctggctgagcaatcgctatattctgatcagtgaattcaatatattaaacgatcagtcaatcgatcgatcagtccaaatgtcacagattcccggatcagtcccaaaagtcctccaccagctactcaccaatgatgtcctttttcgtggcgatgctgtcacggaaaacgaactgcttgtgtccatctgctgtaaggaatcacttggcacaataatgttgctggtgctcggctgctgttgttgttccggcatcggtagcagggaattattcctttaaaaaaattaaaatttcaaaaaaagtttctaaaaatttcaacggcgccacctcggctgcgtctgctgtggcactccgccatggtaaaaattgtcgtcaatgtactgcttggactgctcaggttcctcatcaacagcagcttcttctacattctccacaaaatatttggcataatcgatggctaaaaaattgtgtgcaaatttcaaaaaaaaaaaaacttttacgactcactttggcgatatgtttttgctggcgatggcggactttgcataaagcggggatggaactgttcaatacatgcagctgcatctgctgctgtgaaaacacaatttttatttaaaatttcgaataaaaaattaatttttaaatggtcaagtacagtgtttcaacctaatcttactgtagcaaggctttccgtatctattttttattataattttttgtaataagccacatattgcaatgcaaatggaattcgacgctaccgtatcacgctttacaagcatattcacgcccaatataccgtattcaaaattatttcaccacattcccactcattgtcctcccccagccccgtgacttacccgtgggtactgtatgttcttcgccttcacttatagtgccaccatcgtactcctcctcgacctctgcctcttcctcatacggtatcccgctcccgctaccgtagtaatggctgtgcctgcccacagtatgtcgatgatcactttggtccaccatcatctcctcttgttcacaatagaactgggaatgggatgatttaaaaaattatttattttttatttttttcaacatttaaaacggatttaatttaattgaaattttggctaaaacaatttttaatcttaaaatattattataaattcgtttttttaaataaatttaaattaattatcaaaaaatttaaataaataaattaaataattttttattaaaaataattatttttgaacactaaatttattcttaaaataatgatttttcaaaaataatagaaaataatattttaaaaataaattattttcctttttgctttaaaatttaattaaaaataaattatttaaattaaaatttaatataataaataatttaataatttaattaaaaatattttttttcaaccctaaaattattcagaaaatgacgaaatttaaaaaattccccccacaaaatctgataaaacagaaaaaacaatttcaaatttgtcatttcctccgcggcaatgaaaaaattgccgccactgacggcacaaaatttgcggtgaaattgaagcggccagcaaataaatatttggtggccccgggtgcagcaggaaagtgggtggagggagtaaatgatctcccgagggcattattggtgctttttaagagagttaagatgggccaaaattttgcatttttgggatttgagacaaaaaaaaagtcggtcataggggagaaaatttgaatttttattgcatatatgtatgaaatatcttggaaacaataattttattaaataaaaattatattttacttgtccatctctt

SEQ ID NO: 17705 - DNA, 1482 bp, Heterodera glycines
  misc_feature (1441)..(1441): n is a, c, g, or t
  misc_feature (1450)..(1451): n is a, c, g, or t
tattgttgtccattttcctgcagttgatcaacttcgacatggcctccgtccgttggattggccctccggcggtgtccacgcgcgcgcgccccgtccacgtgtacgccatggtgtggaccacgacgccgtggacattgcccatgaacaacgcggtggcggtgaacagagccgtggaacactatgcattggtggactttcccaaggaccgaaggtgggcgccaaacccatgagagcggttcgcttcccctcccttgaatttttttaagaagattttcagtaatagaaatttttcaaaaaatttcaagaagtaattcatcataaaattttgaaaattgctacataacatagccgaggcaaaaattttcaaagtaagaaatttttcaagaaaaaatctttaaaaaaatttttcttagaaaattcgtagaaaaaaaatttctaaaattttacagcgattttttcaaaaatttttgaaaaacaataattcatcattaaattttgtaaaaaaatcgccggttttttgaattttttttcttcgacttttctcagaaattttttttaataagattctaagcttaaatttattttttaaaattattcccggctctgtttcggcggctgtgttttgtcctgttaaaaaactatgtttttttttaaaaatgtaattttcatgcagattccgcatcattcgcgacctgtacattgtggcagttgaaatggtgccgcacattgccgccgaatttggccatgaaattgccgtgctcggcacagtgtccggcgcgcagctggcggacagcggactgttctacagcaacgcgtgggccaacaacatacaggcgctgcccgtcctcgccgcgccgttcgtcagcccatccgccggcacggggctggtccatgtggcgtatgcgcatggccaagacgattttgaggcaataattttctcattattcggcggggaatggaggaaaattcaagcccctcccctcgaaattgaaaaatgaaagaatttttaacgagacttggaaaattttttgaaaaagaaccgtttttcttaaccgttgggcccaaaacccttaatttttctttaaaaattagaaaaagcgctccgaaaagcggtatgaaaaaagggtctctgtcggtgaaaagtcatttttaccaatatccgctcaaaaatctcactccaaacttttttcaaaatacccctggcaacactttttttttacttttctccctctctctaccgtccagcttggtcgaacgcaggagggcaagcagtacattcagtgctttgtggacgagcggggccgctacacgcgcgagatgggccacgaactgtgctggaaggaagtgctgggcgacggacagcgggccgcgctgaagcgcttacagttcagtacgctcgctataagaatttcgactaaatttcttgcatttttaaaattgngccaaattnnatgacgatttttttaatggttagtcgaattc

SEQ ID NO: 17706 - DNA, 1773 bp, Heterodera glycines
  misc_feature (30)..(30): n is a, c, g, or t
cggacagcggactgttctacagcaacgcgntgggccaacaacatacaggcgctgcccgtcctcgccgcgccgttcgtcagcccatccgccggcacggggctggtccatgtggcgtatgcgcatggccaagacgattttgaggcaataattttctcattattcggcggggaatggaggaaaattcaagccccccccccctcgaaattgaaaaatgaaagaatttttaacgaaactgaaaatttttgaaaaagtaaaccgtttttcttaaccgttgggcccaaaacccttaattttctttaaaaattagaaaagcgatatgcaaaaaagaaaaaagggtctctgtcggtgaaaagtcttttttaccaatatccgctcaaaaatctcactccaaacttttttcaaaatgcccctggcaacactttttttttttacctttctccctctctctaccgtccagcttggtcgaacgcaggagggcaagcagtacattcagtgctttgtggacgagcggggccgctacacgcgcgagatgggccacgaactgtgctggaaggaagtgctgggcgacggacagcgggccgcgctgaagcgcttacagttcagtacgctcgctataagaatttcgactaaatttcttgcatttttaaaatttgggccaaaatttatgaccgatttttttaatgtttagtcgaattctgaggcacaaaatttctgctgggttgaaattgtcacgtaatttttaaacagtttaaaaaataaattcgctgtttttcagattcgacgttttgcatcagtccgaatatgtgcactcttacccttacgattggcgaaccaaccaggttatcaatgaactaacaataagtgagcattgatggctgagattttactttggcatatcgattatatatatatatatatatataccggtctgaaaattggcacaaattttatacaaaaaaaaacaaacaaacaaaaatcaaatgttaaggcgttcaagtttttcattggtgacctttttagaaacaaaaataaaaaatgcaaatttttatgatttcctcggccagagcggtactgtttaaaaaaaagtaaaacaaaaaaataagggacagcttttgtcggagcagggtcgtcccccccccccccccccccgaaattttttaaattttcaaactttacttcttccccagcccgtcatcatccgttgctgcccccagtggttcatcgacgtgaaggaggtgaacaagcggtgcctcgctgccaccgaaggcgatgcgccggcggtgcaaatcgcgtcgggatgccaaggtgtgttttgtttttgttggctgttgttgttgtggcaccgtgtgaaagaacaattttatttgcagaaatatttttcaaatttaatttattttcaaaatgatgtattaaaatgacaaaaagattccaataaaaagactcggttaatcaattgactctcattcaactaaaaaaaagaaattaaaaaaaaacgtttttttcgaccgattttttaatataattttttatttattttttttatttttcgaccgattttttaatataattttttatatttacttattccccacgaacataggtggacaagggggctgcactacatttcccttaaaaaaatcgacttttttaagaaaattttaaaagataaattttatatagaattaatgtttttttcaaaattttccaaaaaaaatcgctagaaaatttttcaaaggtttttacatttttttttctaaaaatttcaaacaataa

SEQ ID NO: 17707 - DNA, 1133 bp, Heterodera glycines
aataagcgccagattatcccaaacactccaacttaaaatcctcccaccaagcatttttcgctcccgcttcttcccgcaaagttacaggccaccaaagacggacaaaaaaattttcgggccgtttcagcgccgctggcgctcaactggccgccggaccgaaaaatccttatttttcccagatgcgcctcaaaaatttgcttaaatgatgtcacggtttcaggcccctccgggcaaaccgtaaggacttataattttttaagacgagttccaccttttctttatatatagtagaaactagggtgcccagttggctatggtgtgcatgcgtggcttggtaatatattgctctcatttgttattttaaaacatacaaaacattatcaattgagttctgttgctgtggggaaagcgcttcgcgctcagggacgcggcttcgccgcgtcgctttttgcgctaaaaaaattaataaattgtagtttttatgttttttttcttttaaaatgattgcacgtaattgccgaaaaaattcgagaccaatttccgaatgttgaccgactaattgcaaaacgaaagccgtctttgtcaaagcgtcttaccgagtcaaaaaatttggaaatgtatctcatatgcaatttcaaccaataaatttgaagaaattttacattcaattttgaaaaatttatgtccatatttcgcgatttttgccattttatgtccatattttgcgatttttggtccatattttatggccatatttcgcgattttatatccatatttttggactccctaaaaatgagggtcagacggtgcttcgccgccagggaaatgtttataatttaattgaatctttatcctcatcctatataataaagttgagtgtttgtatgtatgtatgtgtccgtgtttgaatttgtgtggtgttatgaaatgtttttgcgttaaaaatgtatttgaaaaaagtagagcgagggaaaggtgggaaaatagtgcactgtctgattgtctgtctacgcgggcagcggcgggtgagaggggcatacagtgaacagacgcgtgctgctgtgcagcagcagtctgctggatgcgtgcgtgtgagtgggagagggagggagtgggaaaaaagagagagtaa

SEQ ID NO: 17708 - DNA, 1105 bp, Heterodera glycines
  misc_feature (1089)..(1091): n is a, c, g, or t
ttgagtcccgttgattaaatgatggtggattggcgcagaaaattgtgggggggggcgaaggccccagtacgaggccgcgaagcggccgagcgagtacctttggcgcagaaaattggtgtaaggggagagggggggggggttgggagaccgcaggccccatacgaggccgcgaagcggccgagccctccccaactgttcaacaaaaaatgctaaagaaatttgctgaggttgagtcccggcgattggaatgttggtgggttgagtcccagtgattgaatgctggtggattgagtcctgttgattggaatgttggtggattgagtcccagtgattgaaatgcaggagaattgagtcccagtgattgaaatgcaggagaattgagtcccagtgattggaatgctgttgggttgagtcccagtgattggaatgctggtgggttgagtcccagtgattggaatgctggtgggttgagtcccagtgattggaatgctggtgggttgagtcccagtgattggaatgctgttgggttgagtcccagtgattggaatgctgttgggttgagtcccagtgattggaatgctgttgggttgagtcccagtgattgaaatgcaggagaattgagtcccagtgattgaaatgcaagagaattgagtcccagtgtttggaatgccggagaattgagtcacattgtttggaatgccggagatttgagtcccagagattgaaatgctggtgggttgagtcccagcgattggaaagtctgataattgagtctcagagattgaaatgctggtgggttgagtcccagtgattgaaatgctggtgggttgagtcccagtgtttagaatgccggagatttgagtccattgtttggaatgccgaagatttgagtcccagagattgaaatgctggtgggttgagtcccagtgtttagaatgccggagatttgagtccattgtttggaatgccgaagatttgagtcccagagattgaaatgctggtgggttgagtcccagtgtttagaatgccggagatttgagtccattgtttggaatgcaagaagatttgagtccccagagattgaaatgnnnctggtgggttgagt

SEQ ID NO: 17709 - DNA, 1892 bp, Heterodera glycines
  misc_feature (138)..(138): n is a, c, g, or t
  misc_feature (1808)..(1808): n is a, c, g, or t
tgatcattcggtaattgagagattggatgaccccactggggtgactaaaatcattaaaaatctttatggaaaatattaaaattaaaaacttctaaaaaggccagaaaaaacaggtttttccgtggaacaactactcgnatgtacttgattggcgaaccaacgtcgtgtttaaaaacccggaaaacattttttgtaaatccgctctcatccattcccgaatttgttccttcatttgttcaaacaacttcaatttaaaacgggggtcaaggacagttgcaaagatcaaagatctaaaaaaaaactttttttgaaattttttacttcttaagcaacttgttgttttcggttttttccttgtctattaattggtccaacttcccaataattgcgattcgaatgtcaaatgtgtctaaattgaaaataaataccatttgcggatagaacaaaaaccggtgtttggatttccctccatgaatttttttttaattccgaaataatatggcattatcattccaattgtggctgttcttgactgtaattcatttgacgcatcgttaattatttttatatttgctcaatttggtcccattcgatattgctaatgattggaatgccttttcctttgttgtttctctttgcttcatccgatgtcataaatacttgaacggcagctttgcattgtaagaaacgattaagcatttgaaacatcgaattccatcgtacttctgtgtcctaaaatactgaaaaattacgctttaaacattgatgcagaccctttgtaggattaagaccggcatgtcaagtttctcctgaagttccacaaacaaagttctttggaccgacgatttcctaatttttcgaacaattgtcttaactttttcgagtgttactgattcatcgaatccaatagcatttagcccggccttaatattacagttaatgatcgaaaaaaagaaaaggcaccttcaccgctaaatttattttgtgaagaaaacacgaataactggaaactccaaaatgatcacatgcaaaaatcatatttgagccagcatcccgaagaaccaaatgtatttttgcttgcggtatttaaaattgttcaagccttttttgcacatattctgaaataactgtgccagttttatgcttttccttgattgggatggctcccaaaacgacaaaagcgggttgtttttcaacagtaatgaaatgagcggttagtgctgaagaaaataattgcgaaatgttttaaaataaaaaatacccaataatgaatgcgaattttcttttgaactccataaatcggtcgtcagcgaaataaattcgactgcttttaaatcattttttattctcgaaaacattcgatcaaaaatttcaggcagcacattactgcaataatacctgcgactccttaaatttaatttttcaactaaaattttttgtataattttattacttaatttgaaattgagattgtgccttctgcataagtcttttgaatcccgccttttcgactgtaagaaatggtaaaccgtcaacacaaatgtattccattattgttttttccatgtcctttgccctgtgagctgatggatcccattctgctgaaatcagtgaacaaaatttttttttaaaccttttgctcactaaaagctttcttaatgggcgttgtgctgaattttgtttttttgcttggcacgggacctataattgatttttttatatttgggtactataaagcttcgtaccattgctttcagtgttcatttgtctccctttcgttcaaaatgaccaatttcggttgagaattngtgtgtttctcattttttccttcttttacgtaaagcttcgtccttttgcttgtaatggtcagggtgtttcaatttttaatgacg

SEQ ID NO: 17710 - DNA, 737 bp, Heterodera glycines
gagagagatgagatgagagaggaataaagagagagagagataagagaagagaaataatgggaggagagagagagagagggaaaataatggggagagagtgagagaaagataagagaagagaaataatgggaggagagagagagagaaagagggaaaataatggggagagagtgagagagagatgagagaattgcttataagcaccaaccattattttcaattgacagaaattaattttaataaaaattcctcatatttcaaggtcaaattgagaacgaatgtgcgccaatttcgccgcgtgttttccctcgactcggacatggcacgtcccccccccctcgccgcttttccccttttcatccccctccccctctcccccttaggcttacattcgatggactccaaccaacaaaaagccacataaagcgcgaagtttgtcacagatttaattccgactgatttgtgcttttcagttgctattgaggccatcaaagaagtgcgtgttgggtggaattcggaacttttgcgcattactgaggcgggcattgcggccgaaattcaggcaattacttcctaattgaaatatcccgttctctcctccttctttctctctctctctctctctttctctctcttgctcttccttttccttaatccgccccctccgtcgctttaggaggaatgcgcattttccatcatacacggcgacgaatacgaatgttggatctcattgcgct

SEQ ID NO: 17711 - DNA, 1838 bp, Heterodera glycines
  misc_feature (30)..(30): n is a, c, g, or t
ggctcaaaatcgaaaatattcagcactttnttggacaactctagttaacaaaaacaaacaaattttcaaaaattttcccggcggcgcctatcggcaccgccggacccctttctcctgaaaagtctttagaaaaagcgcgccgagaaaaaaagatggtttgaaaaagaaaaaagtaatcagaaatttttgatcatttttttgaataagattcacttttttcaaattgccggatccgaaaccggtttccggattgggaaaattttaaattttcacatgttaatatttgtaaaaaccggcaaaatttcatttattaatatagaaattcgatgcaccagaaatgtcgccgccaaaaagacataatgttgccgacaaaataaaaaattttaaaattttcaagatattaaagcatacaaaaatatttatgataaaaaataaataaataaatataaacaaataaaactttattatggaaattataaaaaattttgactatatggcataaggtaaaaatttaaaaaccccgaaccccgacccgagcaatttggtcgaccccgaccccgaacgattttgttaaccccgaccccgaacttgctgaccccgacaaccccgaaccccgacttttctaaccccgacgttcgggggtgcaaccctagtttttacgatattttttttttttctttgccttgttcaattaatacatacgtgaataacatttatttgttcttttcgtttataattgtcatatcatttcccctcctccccctctccgtctcccttttcagccttcgtctcgtccactcccatccctcttctctctaccgcaattttcttcttcgggtcactcccaacgcccaacgcgtcgattcctccaatttgaatcctcaagagttttggaacttcggcttttccctcgtcgcgcttaattaccaaacgccaggtctgatgatggatcttcaggaggtgcgccgagtcgaattaatggcattcaaaaaatgccaaaaaatgaaaattaagggcaaatttcttgcaaacggaggctgtggttatgtgctgaagccggccattatgtgtagtgatcagaacgaattgatcagtgacaaaacgaacggcgatgaaaatgcggaagaacagacggcggaggggcggcggagagtgccggcgcagccacaaattctgcacctgaaagtgttgtcggcgcagcaattgccgcgaccgagggcatccaccgccaaaggggacacggggctggtcagttgcagaagcgaagcattcctttggttcatctccacctttcccccttaggaccctttcgtcgttttggaagtgttcggtgtgccggccgattgtgcggaagagcgaagcaaaaccgtacgcaacgacagcttcaacccgagctttgacgagagcttccaattcgccatttctgtgcccgaacttgcgcttgtccgctttttggttttggacgacgattttattggcgacgatgtgagtaattggagaggggcagaggcaatcagaagcaacaaaacgcattaattaatgtgtaattaattgactgcagttcatcggccaatacacaattccgttcgactgtctgcagagcgggtatcggcacattccgttgctgaacaacgagggcgacccgctggagggcagcacccttttcgtgcacattgccatcaccaacagaaggggcggcggagtgcgtaaaaaaactcgaaattggacggcggaatttgagaatgaatgtgccatcccattcagaagccgaagaagcggggcctttcggtgaagcgcaaaatgagccgagttcagacgggcatgaaaagtgtggcatc

SEQ ID NO: 17712 - DNA, 2236 bp, Heterodera glycines
ttttcctcaaaaacttcatcattttctgtttcattgtccccaaattgcattgtctcatgctcatgtccattttccatccaaatgtccggatcactcacatcctccatctctaagagttctattctgcctctcagtatgtcaatttcctttgttagattcgtttctgtggactcaattttcgtttttaatgcacttactaagagttttcctttttccttttcctcatttattttcaccgttaatccatttatttccatttttacattttccacacggtcttcccattccatttttgatttttcgaattcttcctccaatttaatgaatttctcttccagaacaaaatcattaatttcttcgctagcacttagctcatccatcgatctctccaaatgtccaaattgggaactcgtacttgtagcatttacgttcaattcatttccgacttgccgaaattggctgcaaacagcagcttcaaacgatcgcagtcgtttcagcaaattccgaaataatttattttcctccgttgtgaaaaattcctcggcaaaatccgatcctttgtcctttcgtattttcggtcctattcgcagctgaaccaaacgaacaaaagcagtcgacaagcaattcggcacaagcacttcatcaacacaaagtacatcagcagcaacgttcagcaacatgtcatcgccaatccaacagaaattaggagccgctctaaaaatcatcaatcgcatcagaaccgcagctgaactcacgattttggccgatgctacagcaagcaacctcgaaaacgcactgaacttcgaagcgcaattggagaaagtgcaaaaagaagccaaatcattggaaatctttatcgacgacgtccgagaatcgctctcagcatggacggaccttttacgcaaactctcagcagtcgaacgcgaagctggagaaaccgagttcagcaactacagcaaaaaagagaaaatcaacgagaaagtggatgacgcagcactcaaattgcgcgatttacgggacctcatcggcacactcacaatcaaagcaaggctcttccgcaacaaatttgaattggaagaaagaacagcacaagcaaaccacgccaaagcaatgcaacaaaccgcaaccatgccacaacaaacgcaaccgtcaaccatgccgttttatcaatttcaaccaattcaattggacaagttttctggcaataaacgacaatggccggaattctatgaatcgttcaaatctgcaactggcactcacgcactcagcaaagcagaaaagtttaacatcttgcgcaacttacttaccggagaagcaaaacaacttgtggctggctttcgtcttgaagaccaaaactacgatgtggcattgcaacttctcaaggacacctacggagctcccgaggaacacattcgagcacttcactttgaactggccaacttgaacacatgcaaaaatctgcgcgacactaaagaatttctgctgcatctcgaacgacttacgcgggaactcgacaacgcaggcgaggacatcgaaggcccgccaacttatcttatgttggaaaagaaacttacgccgcctttcctccgaacaattctcaacaaaaaaggagaggatcccgagcattggaacacaacaaaattccgcggcgtgctcagcgaagcagtcaggaaagaatcacaaattcaagaggttatgagcgaatacgggcatcatcagcaacggccaacaaaaccattcaacaccggaccgagattccgggatcgcgcacccttcaatcagacgagggaaaggtcattcattgccgcaacaatcgacgacaaaaacaaacgttttgggaaacaaccgatgccactaaaacccgcaacaagtggtcaacgaacaacaacgcaaccgcagtcacaattcaaacccaagttcaatcaaatggatcgcacagcacaagcgcgtcctcagcagaaggacagcaaacaacaatcgccaccaagtccatgtgtgttctgcaacggcaaccactggaataacgaatgccgaaagttcggcacaactcaacaacgagctgaaatcatcagaagcaaaggcttgtgcttcaaatgccttcgctcaacacatcgttctttcgagtgtccgagaccgaacaaatgcttcaaatgcggacaacttcatccaaccgcattatgccgcaacggcagcagaagggcaaaccaaatggtcaacacaacatacaaaccaccaa

SEQ ID NO: 17713 - DNA, 1816 bp, Heterodera glycines
ggcacttttgcgtcatttggaaaagccgacgtgttccggtgtgagttgcgtgcgcggattggatacaggtggaaatagccgacttttttaggcccggtaatacccgaactcggtatttgcccaaatgatgctaacaaataagaaaagcagtcccaatttaaaattcaattaaaaagtcgtaaagcagtcccaatttaaaattacaattaaaaagtcgtaaagcagtcccaatttaaaattacaattaaaaagtcgtaattttttgcaaaattaaccaaattctttataaaattaaaattgattttaatttaaatttatcatgcttttatcctgtatttttaccaggaaaaaacgtcgccagccgaaacgtcgccggacaaattttggaccatcactttttcctttatcagggcaaaaagagttcgaaaaactaggtttttgagttcttccttgccataacttttttgaagcttatcgaaaattattgaaattttgcaaactaaaaacatagagctatcgaataacaccaatactgcttaattttattgacaatgaacaaagttatggtccaaaaagtcttccagcgacgttttggggtgcacccgttttcggatctacgtcagttcggccccagcgggttttcgcttataactttttactttgtcatctaaatgaaacattgttggtatcatttgaaagctgtaaatttcctctattagtctgcaaaactttgaaaatttttttaaaggttcaaaaaaatggcctgaagaactcaaaaaaccagattttccaacttttttggccataaatttgttcaaaattgacgaaatttattttttggaattttgcaggctattagaggatatgaagagctctcgaatgttaccaagattatcagatttcgttgaaaatgaaaaaagttataagcgaaaacctgctgggggcgaactgacgggttccgaaaaaaatatataaattaaataattttataaatctctccgtctgtcagttttttgcataaaaatttttcttttagattagacttagtcatcggattcagatgtactcatttctggtttgacttataattaaggcatccaaaaatatgcatataaaatcgcaaaatatcttccaaattcagttaatgaaaattgaagaaaattgagttaaaaatcgaaaatttttcttttttttgcatatttttggcataaattctaattcatttaaaaagataggtaaatatttttcctttatttttggctatgaaaaacggaagcaaagccagttttcctattagccaaattcaaatgtttttacaactggggatggaaagggattgacggcacactctactcatcttttataacccatcaattccgatgcaaaagtcccaaaaaaccaaaaacaatcaaattaaatgtattcaaacgaaaaaagcaacataaatatgagatgcaaaattaaatccaatcttttctcaatacattcactttttcttcctgttgtgtccgcaaggaacaacagaattaaatttattttagaaagacaaatgataacaaataaaataagtgaacaaataaataaataaaagatgacgacggagtcagaggaaggcaaaaatggaaggagcaaaacagaaataatttagaactgaaaatgatgataaaaaataataaaataataatgaatgaaacaaaacagcgggggagaatattgactgaagaatatggcgaccaaaaacaacaggaacatcactgttactgtatggcgctaattcaaattaattaaaatccaacatcaacatccatctccaaca

SEQ ID NO: 17714 - DNA, 1244 bp, Heterodera glycines
  misc_feature (106)..(106): n is a, c, g, or t
aatgaagtgaaaaatgcataaatattttctatctgttcggatcaatcatttcataatgagagatataattgggtgaaagggcataaatcaacccaaaaaaataagntgaaaagatatttatttataaatactgatcactgacatatctgtcactgacaaaattttccgggagccataaaatgcttcgtcagcatcattacccattgtcatttccaactcaattgcttttgtcatttcgttttgttccatatgctaacacatatttccttgctttaaaaaaatatttagcaatctgttttaaatatgaaatattccagaaataattctgtaactattattaattattatttaaacgaattcgaactccatctttactcaccggctcatcactcaagttagtgttcgataaagtgcttgaatgaaattataattaaaattagcacaaattaattgtttattgaatcaaaaaacaaacatttaatttctgagccaaagctcgtttattccctaagaactacaaacaaattttataaaacaaaatgttgaaagtaattaatttaaattttttcagaattctctgttgaaatgaattcaaaaactgctgaaaacccaaaggtttcttttgatttttacacgaattttactaagaccatttagacttcgtcgctggtaatgcgtttacatccgtgtgcaaaatccggcggctacaaaattgttcaatcggtaattttatttacagttaattgcttaaaaacattttaggtaaatgggtggccgaatggcaagagcaagataataaataggcggaaaaagagtgcaattggaaccgaaaacatcgagccaaatggaggcgcaaatcggtaaaataaaatgaataaatttatcttctttaaagaaagttatcccaccatagataaggaaatgcttacatatataaggcatttattagttaaaaataaagcaaaatataggcataattagttaataacgaataaagatagaatatttaattatttaaacaaaggcgttcaagcctcgatcgtcttataaattaaacatagtcatggtaatatgtttagatgtttacgaccacatgcctttcaatgaaattttgattgaaaagtttagacgattgtaaatgatcaaaaattgtggattttgtagcatttctatgggcttcgggtagtatcattcagtagccaaaatttgcttgacatcgaattagacatggaacatggaataga

SEQ ID NO: 17715 - DNA, 1466 bp, Heterodera glycines
aaagtggtgcagaaggaaacgcatggaccaaatgtgagaaaagcggaaatttttttttgtttttgaaaatttcgatttcatcaattatttctcttgcgtcttctagccactctgttaaatgacgttcgtcatgtttcatgttatcaaaaaggccttcttcaatggctctttgatctgctgcaagtccaatcatataattacgccattcctcattcctttcctcaataaaatttattgaacgtttaaacttcacaagtgatttcttcagtaattcaatgccctctggcgttctttcttgagcgtctacgattggtctcacttcgaccaatcggtctctcaaatttttccatgatggatttatgcgcattcgaattaatctcgacattttagtcgtggcaccaatttattgactctctctttgagtgcaataataattagatttaaataatatattttctgatcactgacgcctcacaaaagagaatttcttggataaataggtttattacaaaaggcgtacagaaatgacaaagtgactacaatttataggcaaaaatgatcacagaatttagagggaacaaaaggttaaattataaaaacggaaaaatgacaaaggacagtaaataagagtgattaataaaattattcataagacaaaagattaaatccaaatttataaaattaacaaatgtcaaattagtaatttcacgagcgaattattttggtcgtgacactccggggggcagcgacaagtcgttctgtggctcatcatcgtttgcaccaatttccagttttgcaatagtaggcgatttctgccaatccggacgcgatgccaaagagaagcattgccaattcagggttagaatttcgcagttgtgtcgcaagttggtgaacggtgtctgaagcattggcggcggatgatgatgcggaggcagatgctgaggttgatggaattgatgctgcatggcattgttgtcgtccttcttgccattttgccgacgcaaacccgaagttgggtcgggttcctctgcgcccatagtagccacctcgtccttgcatggcaaacattgggcccgtgccacgctgctcttccttcaatgctgttccaagcagttgcccagcaactgtggcgagttgcgaaactaacaacggatttgcctgtaccaagccctcaattcctgattccatcgatagattattttgtgccccgcttgtcgttggctgacactcattcaatttgcgcttttttgtcccttgattcgtttggtttgccggcacttcgtccatttccgtctcttcggcaataatactttcggggaaactttggttttgcctttccattgccattgtttgacacaccaaaagaaagaacatagcaaaactcaaccacttcacagtgcccttaagcattaaaccgccattcacattggcttgtcccttgacttttatgtgcaatcgcccatcag

SEQ ID NO: 17716 - DNA, 920 bp, Heterodera glycines
tcatcaattttttttctatttcctttagtgctttcgttgccaatttgagtttcaagctcaatttcccttccaatccaaaattcatggaacatatcataaatgtcaattatgccttccaaaactaagccaaaaattgggtaaaatttttcatttgaaatcaatccaggacctgcattccaataaccaaatttgtcaactttgttaatttgtcggtttaattctttaaccgaatttgctcctcaccgaaagccattcccataggcgtttccatcacaatttcccattcccaacgatttttaatcaaattgcccatatttttcgcacacagtttgctccacattcgccctcctcgttcggaaattcgtgccacttcgtccctgattcttttgagacaacgaaagttgtctctcatcattcttggcacgttgtcgggcttcgaattgaacaattctgcggcgaaaacaaccaattcaatttctcgttcggccattaaaataatgagtaaatgtattaaaataatttttaaaattaaaataatttttaaattatgtggaattttgaaatgaatgtgtaaaaatttaattttattctgctttttatacagatttagtgcttttaagctttggtcttttttcatattcaatttaaatcttacaatattatctttattctttggtctacattttttattttcatatattatataaaaggaattaatcataattaagtgttcttttagctgatcttttaaataatgatctttgttaagcactttaatcctgtatgaataatttgcaaatttatttgcttctttattaaattcaacacaaaataattaaaaggaaaaaatgaataataaatatatttctgttaattaataagggccctctcgaaatcggcgaaaatttaaaaataaaaat

SEQ ID NO: 17717 - DNA, 2222 bp, Heterodera glycines
agaaaatgacaaccattgatcaagaaattgaattcattaaaaaagaaattgttaaaagatggaaaaaagaaagaaaaataattaaagaagcagatgatctggtatcacattttaattacatttctttttttgctaaaatgtatatgatcgaagcatttactgctccagggattcatctgctatatgaaaaatttttggaatacctgagaaaaattaggttattatatcaacaaatttcaaaagaatataaaaatatttcaaaagttgtcagtgaaattgagttctgtgttaatgaaaaagacataaaaaaatgtcaaaagtgtgaaaattcttcaaaacagagcattttaatttgtcttgaataccagaaaaatttcagaagtctatcttctgaaatggaccaaataatgctaaaaatccaatcaactgcgagagaatatttaaatacccccaaaaaaccgattaaaattccgaaagaaacattttatactccttttgtcagacctattcgtaatgagatatattatacaaggtttaaaaattaaataaataaaaattgttaaattttattttcaaaaattaatttgataaaaaacatcatcaaataaatattatcaattaatgccgaacaaagtgtaaatcatttgtgtgaaaaatagtgttaacggaagacggttagacactcacataattggaaaacgttcgcgggggcgtcgtgcgctcggctgtcagaaaaaattgtgaacgaaatgggggggggggtcattttacatatgtgggtgcaaaaattttttctaatttttttcaattttgtttgtctttttttctctgttttctctcatttctccatgctctctttgtttgggtggtcaaaaagggggtcaagaataccccccccccttatactactattgtgtatatgtattatagaataattttctcatgaaatttctttgttcttgtagttttttaattcaatgactatattttagttttataaattattatattgtcattcttttatttataatttatattattagcattaggattttaataaatgattttcaatcaaagaaaaaaagactaagtaaatacatatttatattattcgagaaagagaatagaataaattatatttatattttgaaaactctttttggcaattaaattttggactatatttttaatgacgttttttggcaaataaatgggataaatttaaaatactaacaacatatgtaatatttttacaaaggcagaaatgggtaataaataatattaataaataatatgcaaataaaataaaaagggtatttaattttagaattttaataacagtttcaattttaaatagtttcatttttttattgaaaaaacccattcacatacaaccctgggatgttaaatagtcgcaaatcattgatcattcgggcagctgattatattacaaataattgaaaaaagaatgtaataattcaatttaaaaataaaatatatcgatagttaattattaattaaaatcttaataaatttcatttcttttgaaaataaaactatttttagtccatccttacgcctttgcgccgggagagtgaggaactggttcaaagtaatgaatcacaaaaaataaaggtatataaaagcatataagtgaattgaaaaaattttggatcaacgcaagaaaaataaaagagaacataaagcccactggagcaacagtactgcaagcgaaatttagaaaaagctaccgctaccggttattgtaattcgcatttttaaacaagaattttaaagtctcagaaattgaacacagcatgcgttgttttgcatgtactgcatttgtgagcgtgaacaaggaagtgaaaaatgaaggcattggatggatcaaaaatcaattaaggagttactgccggcttgacccattttttagtgcagattgctaccatttgcttgtggacacagtgctatataatattgtaagaaaagcatttatttatttatgattttgctacaagttggagaagctttctttgaatgagctgaaaccgacggcgatctgtaagcaatatggtttgtgtagtgaagatcaaggaaattcaacggtcaaattgttgcatgcaagtctgggaccattggaggcaccacgttccaagactcaccattctgtaaccaaatgatggacccattatgccaccgggaacacttgaagacctagctga

SEQ ID NO: 17718 - DNA, 942 bp, Heterodera glycines
  misc_feature (32)..(32): n is a, c, g, or t
  misc_feature (38)..(38): n is a, c, g, or t
taaaatagggttgcgtccccgaaccccgcccnccgacnccgaaccccgacatttttggccattttcggggaaaaccccgaccccgaaccccgacgcttcataccccgacaaccccgaaccccgacccttaaccccgatcggggtcggggttaaatatacacccctaagaatggcgttttcgtgggagaaaatgcaaaaaagttagacgaaatttgaatttttttaaccatttgccaaatttttattaaataaagaaaatttgctcaattttggacatttggaatgtggtgtagaggttattgcatcacattgacattactttctgtcctgagttcgataccgtttgacgttttcttctttaattattttctttgtgacaaattgttttttttaaattaaatactcatagaaatcgaccaatcttggcatattttgacaaaatagatatcgaagaaaaacaaaaatttaccgaaattcataaatttttttggtgaaaaatcttagaaaatagagcttaattccaaaatatagcgctgcctatcggcatcacagggcccaaaaagtcataaaccttattaaaaaaattggctcaaaatcgcaaaaatttagcatattttggacaaaatctgttaacagatctaaccaaattttcaaaattttcccggcggcgcctatcggcaccgccggacgccgtaccctttctccttaagtctttagaaaagagcgacgtgaaaaaagatgttttggaaaacaaaaaggtaataaaaaattttaaaatttcaagaaaaaaaaaattctatacaaaatttctgataaaaaagaaataaaaaaatataaaaacaatacaaatattattatggaaattaataaatattatttccgaaaaaatatttaaaaaattttcagcgaaagatcggcattttcgcaggacgagttgaggaa

SEQ ID NO: 17719 - DNA, 1487 bp, Heterodera glycines
aataattaaaaattctttagctatgcgagttcgtcaacaccaaacttaatcagtagcatccaaatttcctcaacgtttttattgcatttttgttaacaaattttccaaaaaatggcgaaatatgcaaataaaagtcccgatttttatacgcaaacacaaaaaagaaagttttcctgctatttagagcatggagaagccaggaaaaaaatgcatttgcatgttttttgcatccctgattattatagttaatgaaatcaaaaatgaacaaaaaattttctttccctcacaaaatgtcattattaggaatgtattacctagtccgacccacaattcaggatgacatttcggcggcggggtttgacgggttgcgcagcgtcatggtcagggtatagcccgaatgtcccctaaattttggggtcggggacgggttcgggggccctaccctactatagagacaaaacaactataattttgtgattccgtatggtcctcttgtacgggatttgagccgggccataaaattgcaacaagaccaaaaaccctgtttacccataccccgtttcgggtctatctcattaatcagccctgtctggtcagggtttattcaaatttctgtcaattgtagataaaatttagagtcgcagccggagagtgcgtccccttttttcgtcactttttgagtttcgttttcgtgtttcgttttcgtccgtcaaaaaattttcgtttcgttttcgtatttaaaaattttaaattttcgtttcgttttcgttttcgtcagacggaatttggacgaaaaagacgaaaatacttacacccttaagaatgatttttttggaaaaaataagtcatctcgtagctacataccacatttctttacaaaattcattgaaaattccaaaattcttcccggcggcgcctgtcggcaccgccggcctccaaaattcccctaaaattttcaaagtctgctcttaaaattgccaattttcagcgaaaatatgctaaaaacgtcaaaaattcaatttttcagttgagagccctgaatttaattaatttcattttttccagcctctcccatgggtacagccggacgccaatcctctaagaactttcaaaataaaaaaaacaaaaaaaaaataatgattttctagtgcaaaatcttgcgcatgaaattcttttaaatgtcaaaaaattcaccaccgatgcctatcggaatcgaccgatctttaactttaagactttataaaaattaatttactagagctacatcagcttttccacctactaggatcttcattcccttagtttgaggatacaatttaaaaactctatgtttttaattgtggattaaattagttcaaaaaatgttcgtgtttttcgtttcgtttcgtacgaaaacgattattttttcgttttcgtgtttcgttttcgtccaagaaaaaattttcgattcgttttcgagttttaaaatttttaattttcgtttcgtt

SEQ ID NO: 17720 - DNA, 1341 bp, Heterodera glycines
atagaatttaatcaatttaaaaaaattgaacaaatcatcattaatttttacatgctttttacagacactcagaataactgaatgacaaggtttaattaacaaaaaagataattttcttaaggtgaattgtattgtttataatatgggtattttattctcggtttaattgctttctttgtttatcttcgttagattaagcaaacctgtttttaagctatttaaaatttcatttgttaaagtattaaataaacctcatttatagtcttattattcattttcgggaatgtatttttgctatactaaataggttggtcttgacattttttatagtttaatttttttctaaaccaatttttcataaattactattgattgtaaattttcttaagcaatttcgtcttctatcaaagtaagcgaaattaaagggaaaaaaataatctaaattgttcaatttaattttaaaatttcaaatttaaatcaatttaaataatgaaaatttttattcttaagattatataacatttaatttgattatttttatggaataaataaaaaataatgttgcagaagctcaaccgtgtgtaattaaattctgaaatgcgacttttggaaaatttgtttttgaaagagttaaatataattgcttaatattaagattaattagaataataattaaatcattttttaaattggaataggtaagaaatatgtacaaaaaaccaaaaacatgcaccaaaatgtaaataaatttttaaatggttagttctaaaaaatgagaaatttgggatttttggggcatttaataaaattaaaattttaattaatgttattatctataataaaaatattattttccaaagatatgcttttattttatagccttgttctatatatttaaaattgcgttaagtagttttaaaatttaggccggcggttttgacagaaacacattttatagtatctttaacataatttttaaaattgttttgttagaattttatataatgtgaacatgaaaattcttatggtttgtatcaattagttttatttaaaattgaatcttattttgtaatttcttcaaattaatataaccttgcattatgcaaatagtgaatttaatgcattgatagattaatgcttttaaattaattctatatttttatttcaaaatttcgataaatttatctattgctcattgtctttagggttcttgtgcatttaattccattccatggcaaaaaaaaccatttttctttaataatctacataatagaaaataaaaaattacatttattgtttaattccttttttctgggtttaggaattttatgtgtctcttgc

SEQ ID NO: 17721 - DNA, 1848 bp, Heterodera glycines
atttttatgttcgaagcccaaaaataagcactaaataatcacgtaatgctgaaataagcacaaatttttagaaataagcacacttgggaactctgttttaaatagatgcttttatttattttaatacaccgattctaattatattatgctaatgaatttttatttctcgttcttttaaattattttttcattgaaataacaagctgtctatttcttttctaatggttttcatttttgctttgtttatctcgtaataatttttcataatactgatatatattttttttgttttttttttgtttgatgaacttatcatagggttttttattaacaaaatctctttttgtgtaaaattgatgataactcgagtagtcttttggttctggagagtgacgctggatcaattttatctgctacatgatattttttaaagacataaatattcattcaattttttcaaataataatatcaatttgttttttgaagattttatatcgaattctgctgttaatacattttaatgtcattttttaaaattgtttacaatttcacttaaaacttgaagtgcagaaacaaaaacaattaatttattatttttttcctttttaagatttaaaaatttctatgtgtttcttgtataatttatattattgtagaaaaaatagaattattatttaaaatttttcacatttcgtttatctttcgttgtaaatttttgaatttatttggaaaatttttgaatcatttggtttatacagaactttctattttaaacattatatagtcactacaagttgatttttttactgtatatgcaaatcaatttatatttcctgatcaaaacgtcggttcttttgatcatttagctcttaataatagatttccataaatttttgatgataggagccgcgccgcttgtggacttttgaaaattgtgctttgttaacagagttatttagctaaattggtttaaaagcgagatttttcagttattcataaattcatagggatttcaaataaatcacataaatggaaagaaattacaatttatcgttgaaaaattaatttttctaatttatttaaatgtttcaaaaactcaaaatttcaagctttaaaaacatacggaaactttaaataaaatggtttaaaaatgtaattttccaagttattttaaacaatctcatttaaaactatatctaaccccgaccaatttatttgatgaaataaataaacttaaaaaaggtaaaaaaatgggagaaagaatcaatgcaaaatgtgaatgaagagaatgaatggtgcgcaattgcagcccattctctgccaaactccgccggagggaacactgaaaatcaatggaatggcttcgcttggggacgccacccgaaaaaacgaagacaaaaaacattcgtttcattaaatactatcacaacgaaaaatgctaaaaatttcaatatagttttattatttttttttgtatcgaataagcacgataaaattcagcatatgaatagtctaaatatcattcattgtctaaaaattagtacataaatcttggaagaatttgaaaaaatgattaatttatgaatagggcgaggatttttagttttttaattattttttctgcgactttattttgacgagaaatgcacgaaaaaacacatttttttgctcggaaaatcttcgttttaacgccactattcatcactaggaatcactattttggagctttggtactaaaaaaaactatttcggaagttggccactaaaatacttttttggcactattttggcgtttccgcactattttggaattttttggaaaatttccccaaaaatggaataaaaaa

SEQ ID NO: 17722 - DNA, 1307 bp, Heterodera glycines
  misc_feature (52)..(52): n is a, c, g, or t
  misc_feature (1263)..(1263): n is a, c, g, or t
ggatttcaaaaatcttttctacaacaaagctcacggcttttggtacgattcnaacatggaaagcggcggcacagtaaacgacgaattgtactacggtagtgcagcgatgccattgttcacgcgatgttatgatgtcatcgatttgggcacggccgagcgaatgatggcgcggatggatcactgggacaacaaggagcacgacaacacacggatcagcaccagcaatcaaccgtttggtgtgccagcgaggtgctttttttgtcggcattatgtcaaatttaaaaaaatcagaaaaatttttccaaaaaaagctgagcattgagcaaaacgaaaaatattttttctaaatattaaatattaaaaaaaactttgaacaaatttttagccaataatgggaaatggaaaaatttagaagaaaatgaaatcgatggaaattaaattgtgctcaaaatggtctaattatttaattttggaagatgataaatttacaaaaataatatttgaatgagaattaaaaaacaaaataaaattacattaaaaaaaattagtgaaattaatttgaaataataaattatatatttgcttgattatgaaaatggcaattttgaatttaaaaaaaaatcagaaatatgtcattcgaaaatgcacataatcttttttttataaatattatgtgtatgttcttttttttgcagtatgataaatgactcatcacatcaatgggattttccaaatgtttttccggtagaatttttatttttatttttctaagcaccaaaaaaactgaaaaacttttcagcccttacaaatgatggttatcgagggtctgcgccgatctggcgttaaaaagtgagttatttattcaaataaattaatttaatgtctatatattgtaaattgaccatggaattgttggacttctatttttcctgcatgcttattgaaattataagcatgtgtaagcagcaatatttttagcttaattagaaactccatatttcaagatttaatcaggtttggccatattttatccatgtttttggcattttatctatacataaaattttcaaatttaagtattttataaatttacgaagctttatctacgttttagtcacaaagacaattatttttttattattttacaaaattttattctatttgtaaaaaaatatattaacttttgtatttcttttgcttttaatcctctatttacacaaaaaacttcaatttttcaaattttttaatgctttctctcattanatagaatgaaggataaagcgaaggcattggcacagaaattggtg

SEQ ID NO: 17723 - DNA, 2198 bp, Heterodera glycines
aaaattgcgggagaaaaatgtgggagaaaatccgcgccggacaccgccgcgcccagccgaggcggagaatacagtgtccaagtgggaaacgttcacaaatcatttactactactctatgtacatcagggataagctctcgagaatcccgaaaatctcgcaaatctttttcgaaaatcggaattcctaactatcactgatgtaagatagatgagaatttcatggcttagagatacatgattagtaaggagttccggttttcacgttgattttcctttttagtttattcaaatttaagtggaggaaattagtgaatttgaaaacttggaacttgaaaactattttaaatccaattgaaaaattttagcgaaatgtgctaggaaaacattgattattataatttatactactgtacatcagggattggcttctgaggccttgaaaaatctcacgaaattcttttttttttttttgaaaatcggaattccgcgccatccctgctgtacatagataagaatttcatggctttgagctagatgataaattaagggttccggttttcacttgcttgttcaaatttaagtgaaggaattagagaatttgaaaagttagaacataaaactgttttaaatccaaaatttaattttttttttttttttgctaaattgtcagaaaaaaatagggttcgagccccgcccccgtcacccccgcacccgccgggggcgggacaggttttttggcctcacccccgtccccgcccccgcgactctgacccccgccatcccccgcccccgcgaccttcgcccccgcgggggcgcgggggcgaaaatacacccctaagaatggcatattcgtgggataaaatgcaaaaattatacaattttgaattttttaaccatctttgacaaaattttatgaaataaagtaaattttgctttaaatttccaatatattttggtttagtggttagtgcttcacaactatcagaattttttattatgggttcaataccggttgacgttttctttttaattatttttatctgattaatacatggtttctttatattcttatttctaagatatgttctgcttcgggggtgtattttcacccaaaaaagggaaatttctgaaaaatttggctaatttctaacaaaattcataaaaaagattttcacggcggcgcctatcggcatcgacggacccttccctcctcgcacattcaccaagtttttttttttttgcaaatatgtgcctcaagaaaaatttgttaaaatctgagttccaattttgcttgagtaaatcattaaaaaaaatttatcggaaaaatctcaatttttggtaaatatctgttataaataaatttaaaattcgcccctattagcacgccggccctccaaaacgtattttttcttaaaaaattatcctaaaatccctaaatttagtctattttaagacaaaatttatgtaatttatgccaaaagaaaatgaatcttaggcgatacagtgactaaaggaatgtgaagccaaacacatcattcattaaaattaattttttctgaaattttttggaattaattcaaagcaaacccccgcccccgcccccgcgggggcggaattttcgtgcccccgtccccgcccccgcgactctgatccccgccatcccccgcccccgcgaaaagccacccccgcccacgggttgcccgtgctgtactggatgagctccaagagcggaatttagtccgtcgatgtgtttagaagggcgcccccgtggttgaacaacgttttcatgcgccaaggattgaccgaacgcagtgcgaacattgaaggtgtttcagcagcattggtccgcgaattgatcgacaccttgatccgcctcttgttcaagcagagtctccatacatttaatgaggacaccagggaagcataatgaggatgaaaatggaaaatatgcgaaatgtgcttgaaaaatcaaaaaaattttgaggatgcgctgcacattaccaccaatgttaccaaatttaaaaagtaaagtaatgattcaatttatacaaaaaaaaaatatagaaaacatttttgtattttctatagatcaatattaaaagttccaattaccaagagttgcctatcagcttcaccggaaaacatccaactttatttttaaacttggtcaaaatttgaattgaaagaattattttttg

SEQ ID NO: 17724 - DNA, 3146 bp, Heterodera glycines
agaaatcaacgtgaaaacgctttcaaaaaactgggaaccctccccaccgaatctgctcacagtcacaaattccacatttcccctctcttttaagtgctaggtacttatcggttttggggcctagatttgattttttttaaacaacaaaggacgcgcagaattttgtgtgagttcctcgggcgctaagatgtcaaaaaaagatggcgcatattcacttgaagaaactttagtcatttagtttggcgcgtagtttttgcaattctgcgcgtccttgtaatattccgttttattttacccgtgttgaaaaggtgcgcctgtgcgtttaggtactgctcccaacggcagtcgtacatcagatcttgcatgacggccgtttggtcgtcggccgggtccttgtagaacatgttgatgtccgggaaccgaaagcgtttcggaaactgaagaaaacagacaacattttggttattgggtttaattcaaatttgcgaagttggttttgtcatggttacgcctttattttataaattccgtaaaaaaattgttggcttttcgatttggagaaaatgcgattttggcatccatttcaatgcgtcattaacaccgaaaccggaccggaatggcttttaagcatttttttgaaaaaatatgtgaatgaattttaggggaacataaccggagaaatgccaaaaatttaggtgtgtgccaattgtcagaccaaatgataatagtcgcgcatgtcattgttgtaacggtcaaccaaaatgtcgtccattttaaaggccggcatataataaaagcccaacgcatcggccaattcctttgcgatcgacgactaaaataaattttttgaaccaagaactcataaattttgaaaggtccacaaaacgcgatgtttaagactgcggaacttatttaggtatggcaaaccgaaattttataaaatcattttatggggagacatcaaatcaattgtttgattgaatttcgaaaaaattgccgtttgaatacccccaaaaaacagacccggcccacgccaatgttgctttcgaaaacgataagtttcgagttgatgtgccagcgcttcagcgttttgtcaagatgttgcatgaattggttgaagctgacgagggaggacagcaaaccaataacaacaacatttaatggttatactagtaatacaatgaatttttttgcaaaaattttacccccattgtttgtagggccaaggctccgggtaatcgtcaggcaattccaggtcaaatttggtcacaattgaccgagactgaatgagatttggcaccaattttttgttgttgagggcactgctggttaagagccttgggtaggaaaagcgaagactgaatacaaatttggaggccattttacctgctaaaaatttgataatgaaagcatttatacataaatgagcaaagagcagaaatccggtgatgtccaatcagccctattagccatgagaaatatgaaaaggagctaaaaaacaaaaatgatttttggtcttataattttggaacagattgtaagtctaaaaatgttgttccagggcctcaaaactcgaaattgaatgtctgaggggaatttgttggctctgttggagttaaccgaccataaaaaacattagaaattctcaatcagattggaggaatataggggaatgaagagaaaataaaccgtattccccattaaaaaaagttggctaaatgagttcagaaatttcagcgtaaattttggaattttcattaaatcgcaaaaaatgatcggcactttttgaatcaaaatatacaaaaagcataaaaatgcattttaatgcattaacaaaaacatttttataaatttccgagagtttgcttaaattttatataaaagaattttttcagaaaactgctcaaaattcaacacaaaaccaggccaaatttgatcgttaaacccctccacaaaatttggaaaaattacacgtgggccaatttaatttttaaaatttttcaattattttcgtaatacaattaatttaaatttgttttctacatttctacatagggggaatataggggaataaagagaaaataaacccttgttagatgattagacaaggtgtggttaatgtttatgcagcagggactcatgcaaatgctcatgaacatagacttagccaaatgaatattcgatgtgagttttgcgatgctttgcattttgttgaagagaaaatacatggtcgtggcaatacctttaaggattgttgtcactatggtaaagtttttgttcgcgagattactgaacaggattttcctgaggaattgagggatttgttcatgaaatttgatgcgagacacgtgaatttctttgacaatattagacatttgaatagcagcgtttcatttgcttcaatgaatccgctgagatatagatacccgaataaccgaggtccgtattgctttcgcatttacggtcagatttatcatagaatgaatttggctctgaatccagaaaatggcgatgatcctgcttatgggcagattttcatcgtagatactgagcatgcaatgagagcactgaggcatgccaatgtcggtattgaccctcaattgctgacaactgcgtatgaagtgattagaaatgtgaatccgtttgctgaagcatatatgatgatgaaagaagaagaagatgaagaagttgatagagcaagaaatgagaacagagagccagccgagatcaagcttttgtttgagaccggaaggcaattggacagacgtttggggtacaatgtacctcgagcgaatgaagttgctgcagtttatgtacctggagctgacggtgaagtacctaatgccaagattgttgtgagagaacgtggaaaggaattgaagattttgaattgtactaattcaatggtaactccaatgacttacccgctgttttatccgcgtggtacgcttggctggcaccctgaaatgaagcatagaaatagtaacagaagagtaacgaggttgcagtatgtgtgttacacattagcaattagagaaagagagtttaacccaattttgtacggtggaaagctctttcaacagtattgtgttgatgaatatgttaagattgaaggagacagaatgaattggataaagtgtaatcag

SEQ ID NO: 17725 - DNA, 1738 bp, Heterodera glycines
  misc_feature (825)..(825): n is a, c, g, or t
  misc_feature (1630)..(1630): n is a, c, g, or t
cccccccccctcgcccattcaccaaactttccccccctaaatgcaccgcaaaaaattgttaaaatctgatttttttgatcccgaatgcactgaaatttacgatttgcttatttcctcccaaaattgttaaattcgataatgaggtgaaaatatatatttgatacatttttgatcgaataaattgtaaaaataactgatttgaagcaattttgcaaaatgtcctgattttcgaccccaaaatctgatttttttggcccaatgtcctgattttgaaaaattttcgatcgcacctctgctctattttgatgagcaattaaaaagagtgacgacgaagctctcttatttgttttgaagtgctgctcgagactcttggtcccggacgggccctgtctcgagccaaagcctttgcttttccaggggtgtggccccctcaatatcgaagcttcattcagcaggattcagtcagtcttgagataagctaactctgatccccggctttgctggctctgatcactttatttgctggtcctgaatctcggattttgacccgagttttgatttcaaatctcgacttttcagagcaacaaattttatgttttccgtcgccttctcacagaatcactattgaaatgatgagtgatgattatgtttgtgctgtgctgctggtgttgtttgacgggggccctctgatcagagcaaaaaacaaaaataaaataaatgacacttttctctgccaaataaatcgagcactgaaatcattaggctgatgatgattgtgaccccaactgctggtgctgatcataggcaaaattattgaatttgttncatcgcttatgcacaaaaatcggaaattactccgttttcttctcttccattattattttgtttaaagtaactaattagtcaatcaattaacatatgtatttcaataactatcaataattaggccaataaaacagtttatgatgcatctgcacctataccaattaatgtaaaactttttttttccttcagtatataaacttttaaaactggaaatttaggaaagattgtattttttattttgtgcataaacaaaaaaattaagaaacatctttattattttttgtttttattaccccatcccattgctattcatttaatactttaacgttttatccattaagaattttagagcattcaaatgtaaaatgttttgccaaaatccgcgtccggtaaatccctccacttccgggattccatcgcttcccttttttaattattgtccatacatttcacattcgtacgtatgcacataatgaagttcatcccggcattttcacccaaccattggtgtctgtttggcctggctgttgtgttggcctctctctgtcggcttcatctccccccgccgcgccccctcccgtggcgtaatccgccggcttttccttccctccctttgtgcttcaaacacaaaaaaaacaatttaaaaattttggcatcataagctccttcctcccaagtcatccttttcaatccctctcattttttcagccccccccccaccaattccatcccaacaaacaaaaaacaactcttggccgaacacgaactcacaccaccaccacgcccaaccacattttttgattgngcggaggaagtgtgatgatgatgatgatgatgatggaattgaatggaaatgggggagaaacaaaaatatttgcgtcctctccccgccgccgctgctacctccaatgtc

SEQ ID NO: 17726 - DNA, 2659 bp, Heterodera glycines
ggatggaatggacacaccacacgcgcgcgcgcgcaaattgacgcttcatatgtgtgcacttttccccgtgccataatgccaaacattcaaagccaatccaatccatcaacagggcaatgtcaccataagaaaaagcaatattcatttttgagtttgggttttctacttctgtatgggtttcatctgatttctctgcccctaattagggttaaaactaatccgctgattagcttcatcaaaacacacatacagaatacactgtgccaatctttcatttaagtatgaaaatttaatccctttttcatttaaaattaattatatgccataaaaatgattaaattaaattaattattttatttttagcatttatttacgcgtaaatacataattaacacaacaaataataccggcggattctaatcgttgtgagaaaaaaaagcgatcgagctcataaaggtgccattgcgcaatggacacgaccacaacaaccggcggcggcggtggcggcggattttttggtgagaaaatgggccaacaaatatttattccctagggaattgtgggacaattgggggattattgagtcattttatgtgagaaaaaaaaaattaatatttgtattccgagtgctgaattttgtaaatgaaaaaaatgatggaaaattaaattttacacatttttgtgttgaaagtatggcactaatttttagttggaattttcaaaatttcaatttcagattttataaatttcaattcgcactggccctgattcatactgtaaaacacaaaagaataaacaataaaacattttaggcttggcaagacttaaaacaaaacctcgcgccatttagtcatacgagaaccaaaaaacaattaaaactttcatataatttattaaattttactgtcaaagttaaccactatcgaaatcgacattttcacacttctaaaacaattagctgaagcataagtgtatttatttggcatgaatcattcttaattaagtatgaatcgggtggcttacaaatcggacccattactaattgggattcgaatcgggttactaatacaaccgggacagtacgaatcgtcaaaaaacggatttttcgggtaatgtaattcggtgcccattcaaaaaacagacaatttgaacaacaattttcggcattcggaccgcgtaagcggggccgaggcggggcatttatagcgcggaaaaagagagatttttccataaaattttgtttgcttacaattttcggtccaattttggtgtccaatttcatcccccccacccctcctttccctccatcatatttacatttgcataatgccgacagacgagcgtctttttagtgccaatttggcgattagccaccaaatggcttctccacccctaccattccccccttacttacccaacagtgcccagcggcaccgcttcagcggcagcaacggcagcggcggcagcggcgccaacagcggcagcaacgccaccggcgacgacgacggcatcgccgcaggcaattcctcatcatcataaccatgaacagcagcagagcaacaaaagcgggggcagcagcagcaggacacgcaagacgagctcaaccgccaatttccttggtgagtaattgaggggggcggggggaacagactgtgggaacggcactcactcactattcggtgggtcggtcggttggtggcactcctttgtccgttgccgtctatttaattccccaattattattattattattattactattaattagcagtaaattttttgagacacacggacttacaagactcaatttatgtatttcaaaaattcataattttaattgattaaaagaatgtcggctatagtcactactacggtcggtcgtttcactgtgaaaaaacatggtaaaaaaaacggtagggggtaggggtccaattccgtctgcccaactctgtctcagcaaagttcaaagagccacaattttttgtttgtttgttaaccaaacttaacaaacatggtatcattcgaaagatggtatcattcggaagcttctaatgttgagaagagatttctaagcttttttttttgtaagtgattaagcagatcacaaaaaagtagtcgcttgaaaaccgcaaaaaggcagaattttccaagttttcatgtctatcttttttaacggttacctatcatttcgtcactgagacataatttttaaaaaatattggctaatttcaattaaattatcttatgaaagtattaaatggtttaaaattttctaaaaattattccttggtaagaataccaccggtggaagccactttttcgaaaatgttttgagattttaaaaagccaaaaaataagttataaggtttttaaaatcgctctgatcatgaatttgactgttgacttaaatgataatgctctgagataacgatggggattttctgctgctgctttctgcataaattcagcaaaaatttgacgcaaattgttctcttggtaaacagagagagattgcgcttaagacttttccctctaatgccttttttctggcgcatttcataatcagcaacgaatattaccatcctgaaaattttaagcatcccttttaacaaatttattgatgaatgcatccgatccccggtcttttgtcgaagttgaa

SEQ ID NO: 17727 - DNA, 1384 bp, Heterodera glycines
taccgtatatgctctaattatagcccagtctctattaatcccgcagtctccaattatcccccagtctacgaggtgtttcccaaatttgaaaaaattaataatttttttggcgaaatgtcttttatttaaaattttgaagatggaatttgggattttttacgatttaaactattaaaaatcataaaatcttacgaaaatattcaaaattagatctaacatagtactttttagggaaaattacttaatatgaatgtaaaaatctataaaaattttcacgccggaccataaaaattcctttattctcaaaaaattgagtcaaaatcgcaaaactttatcattttttttgtgtaagtctgttaacaaatcacacaaaaattttcaaaatttctccggcggtgccttgcttatcggcaccgccggaccccccccccccccttggaccccaaatttaaaaaaaaatgcgccgtaaaaaagaattgaaaagcaaaaaaggccgatttacaggcttgatttaattctaagctaaaattaaaattataaaaattttttcgaatttttaatcaaaatttcaaaaattttgaaaaagtcccggtcccggcgggaccgggtcctaaattgggaccgggagtcccagaaaaacgggagttccggaccccggatcccgccccggtccatttccaagtcccggtcccggccatttcaaaatcccgggctctaatatgtacattgcaattagtatgcgcgcttctgacccgcgttcggtgactcgatttgacgctgttgttaaaattaaaaatttttttgttttgttaatatttatcaaaaaaaacttgtggttggacatattctaagttaattttttgtcaaatgaaaacctttaaatttaagaaaaacgaataaatattgcaaaattcgaattaactatattaaaaatatgttaatatacaactgttttaaaaatttgtattttcaacaaaaaaaaaacacacgaaaattcatttcaaaaattaattttatttttacgcctttttttacatttttgtgcatctttcaagtgctccgtatgctattattgatcactaattccaattccatgtcaattgcgcactgcatttggactgtttacatttctttaggttcgtcattcttattgatcatttctattttgttaaacacaccttctttgctgatcaatttcggcttttgaatttttcatttaaattagctctttttttcttgtacttttgctcctcaatttcgctaattaccctcaatttaattttatcattttcatttcgtcattgcgtttgtttgcctaaattttttcaatcttttcgcaaacatttaaagatctttatttattaccttattacgtatttaatca

SEQ ID NO: 17728 - DNA, 1589 bp, Heterodera glycines
caggtggttgatggtgggaggacaggggagggcaatggtcacgggggaaggacggggtcaacaaattacccaattcccacggggcgcgggggggggcacggggaccaacccctccccaagatgtacaaattcccaaagaaatgctataaaaccctaaaataagcctcattttcccgactatcgtacggcacctaatcgccaaaccaaaagcatgggacgacccctgagggtgtggaaggggcgtgggataacaaatcaggaagtcccaacggaaaggggtgcatggtgtgaaccagggatggcacggaattccgatttccgatatttttgggctaggattccgattttgaaatttttggggcctcgaaatggcatccctggtgtaaacgcaatcgctcaagcagaatcttaattaatgtgtcctccccatgctaaagtcttgagagtctcgacgattgaaaaaatatatatatattaaaaattaataaaacgtaagggagaattttacaattccatttaaatttacacctaatttttgggcaaaaatggaaattaatcgatttttatgcaactattgaaaatctatatttccataaacttacatatttccacgaataatagacaaaaatttcattagcggaagtggataatattccccattcaaattcatgataaaaatatattttaaaagaaattaaattagttttcaaaactcagcacttatttttgttatcttctaattggttcttctaattggttaattaatgaaatcaatgtttgcattagattgcatggtttttgtgttaaaagtgattttaacagaaatgacaaaaatgtaagaactcagaaacaaacaaaaaattttgttcctttctattgcctattaattttttttccaaattaaaataatctttcgttttattaatctgctgatgatcataaataaaccattacacattggcggtgtaatttgacgaaaaaaaatcgcaaatcaaattattattattataatttttgcactttatattaaagatttttttcggcattcgattgaacggtaaattccgcccggggataggaaaataataataatataaactcatacatatatacatatcattgcttaatatatgatcatacttttttttaattttgcagatttcgaattattcaatatggtttacaattagaatcttttacattgaaattgttcaggaaaacagagaacttttgagctatatgtagtattataataaaaagaaaatttaatttgttgactttgctgagggataagattttttatattgtcattttcttacccccgggcggaatttataaaatgtcccaccaatacgtaaaattttttaatttactaattatatacaatttcttattttcctaacttttagaaaaatgtcgaccgccagtcaaaaggtccgaactcgcgaggacgtcatttacggaggtcggcaccagtaacaacgggcacctcaaaaaacaaattgttttcccaccccctccaatttttttttataatcaatcactggctaatatcccacatttttgagtttctccaatttgactctaga

SEQ ID NO: 17729 - DNA, 3550 bp, Heterodera glycines
  misc_feature (1910)..(1910): n is a, c, g, or t
tttggttgaaatatcaaaaaatttaataattacctaaaattttgatttcaaataatattgttacttttaaaaatgcttcacccgtaattgccatttttcgcatcggccattgcagcaccgacaattggcgagaaaactgtgactccgatacaaagcaaaatgaatgcgttggcggagccctcgtccacatgcaaagtaccgaccatcagagggaacagagtgcctaaaatgggatagttattaatttaattgtaaatatgcaaaaattagataaaatttgaagaacaagggtcaaaatgagtactattaatagaaagttgctactcgtcaagaatgaaattttgtccgttcctgatcagaaataaaaaattgccgaccaagttttcgtgggtttgcatgatataggaggtaaattttgagactcagtttggggaggtaccaaatcatgcgataaattgtatatttcgagcttttctgaaacattaaattccttcctaatgattagggggttcagtcagtcctttataattccaaatgcctacttttctgccgattgtggcatttttgcctacttcttgtctattgggtgctttttatgtgcctattttgcgatttttatgcctgcaatttgtatcactattaaatgtatttattaaattacctttaagcgtatgaaaagagagacgttcaaaaaattggacgcccagcaataatgagctggccattgttggtgaactgttcgaatttgttggcgctcgtcgcagcggcttcggcggtgcagctgacccttctaattccgtaatgccttccttacgctgtgaaccggcagaaacctgtaaaagattatttcaaagaaaacatatctcatttcagatgggttttcgtcagtgaaaattcgaaaaacagttactctttctcgaacaaaaactcggtactgacaaggccagactggtgctggtttatagcagggttgccgcggttcgagaaaattgtcggactgagtcgagtaaaatgtcgggttgtgactcgtaaaaagaaatgccggatttcgcgactcgggattaagatggtaaccctggtttcgagtagttgaactccccatcccctcaagcgattaacttttctttatcgtatatggcaaaaaagaacggcgaagtggtgggtattttggaaagtactccttgtacatgtaatatatttacgccaggacattgtgcgtaattgtattgtaagtccaaatctcttaactttttacatctcagatagtttaaaattattaaagttaagaaaatcacactcttctagtttattcggaataataattctgttgttttaataattaataatttaaaaaaaaatttttcatttatcattacaatcacactgcttatgacctctaggattattaaaaaaaactcgattttacattgacgaaaattctggatacgctaattcaatatttttgaaattctgaccaaattgttagccatcgaatgagcagttttttgacgtgaatcgctggagaatttggcgtcctctgttcctatagaggcgattcgattgtccatttcattgtgcaatttatttaattaacctaaccctgcaacaaattaatgcaagaaatgatgtaaaaaaattgaaaattaatttaaaatacaaaattcgaaaattctttgattctcgaaacggcactcggacaaaaacaaagaccaaaataaaataataaattaaaaaaggacaataattttggttgtctttttttataagaattaaaatattatgaacttaaaaaaagtattttaaataaaataaaggtgagaataattcatgggatcaatcataagccgaaagcattttatcgctttttatttctgtcgacctcgattttggatctttctttgcataaaatntaatttcaaaattataaatttaatttaaaaaataaaaatgagctaatgtattagaatttcggatcattattagtccagttcataatttatattcaatgggcaacgaaaggtgcccaaattttaggagacgaacaacagtaaaattgggcttagagaagagcactagtgcaaatgggcggattaacgagacacaaaaatggttggattaaatgcgcttaggggtggataagccccacactaccggtactaattatattttctgtgttttttttctaaaagtgagggtaaatttctcaattgaaatttaagctaaaaatctcgaatatggctatagatggtatgaaaaagcatttcagatggaaaaaaacaaaacaaaaaaactaaatttattaatttgaggaaaattgagacttgtaattgggcacaaatcaagggtggtacgcgaccgcgatttcgcggcgaaaattttttgaaaacttggattatttttctcaaaaaagtttcaaagttctaatttttctccgtctgcgttacaaaacctttaatttgtctttaaaaaagttgtatctaaatcaaaaaataggtgattttttacaaaatcaaatcagtagtataaggcccaatatccggccccaaaatttggccccatcccctccacccttccacatcctttcttctgtttttcaatattccatttcccatcctttctttgcatagttgcaaacggcgtcagttgctgctgccccctaatttgtagtagtatatggcgtcaaaagcgcacggttgcgcacgggtgtttaccgcacaaacccttgcctatgggaggggtgcaaccctttgaaggtgccgcccggacattttcccgcacaatcccaaacctatgggaggggtgcatccccttgaagttgcccgctcacatcctgagcctatgggattttctttgaactctgccgccttgtggatttccccaaattgttgcgggtgttttttttcacccgcgccgcgcagcgccgcgggaaggtcatcaatcatccacctgtcaccaaaagtgacaggtgaaggaaattcaattttttctttgcaaatttaaaattttgaccccaaaccttttgggcggttttattttctcaaatcctgagatttttatgatgggttctctaatcctgaaattaaaaattaatttttgaaaatgtgccaaaacagtgcgggtttttttgcatttcctccccgctcgccccgcgccgcgatgccgccgccgcgaaaaaaaaaatcgataacggaatttggaagaagtgcaaattaattgaaatgactgcaaacaatatcaattataaattggacaataaaattaattatttaaattgtgtttaaaaataaaaatcgaaaatgaataaataaatcgggatgaaaaaccttttcaaaaataggtcacctgccaaccaaaattgattgatgtgtttttatttctcttccattatttcgcaatctgcacctgactttttgttccaattatttcgcagtgtggcccattaattaggtcaactgtcaataaaatgggattgattggtttcttattgaaatttctccaccacctccccagagcccctaaacctcgcgggtttctcgctggtgtttcccgc

SEQ ID NO: 17730 - DNA, 3289 bp, Heterodera glycines
  misc_feature (25)..(25): n is a, c, g, or t
  misc_feature (56)..(56): n is a, c, g, or t
agagatttgagttaaaaaccaaaangagcgcaaaggatgtcattttaaaagtatgncacagaatgaaattatttgtaagtccatgcaacctttatcgctgaagtcgtcaccaaaaatgacctccttaagcaggtggcgggcgaacggagcagtacagaatgcatcgtgcgcagcagcggagaccatccctcgtgtgggaaggcgatcaccacactggcggtggcaaatcctccggggtagtgccaatatttgcacctgacaatgaataagactgtcattttttcgaattttgttgttatttgactactgctgtgctcactcttccattcgcacgtctgggatggaccgattcaatgaagctctgtcgctggccaatgtgttgaaggcgtattcggacatggcacgacgaacctcgggcgagttaagatctgtgacaatggcacgtccatcctcacctgcaataaatgagttttcgtaaatacgtaaacaaagtaagaataaaggatcacaaccttcgccatttgggtcttcggggggcagcaccgccggaatctgttcgaaattgccaatttgtccttcgcgtaaaactgtgttcgagtctcgagcgccgggcagctcatcgtcagagaaactcaatctttttgggtgccgttgaatttcttcgttcgttttaacagccttgaaaatgaaaataaatataattaaacaaaataaaatgggaaaaatgagagagatttcaccagtgaccaattggcctatttgttagttttgtggaaaattaccaatatttcactgttaaagaagaacacaaaagccgccacggaagataagaatatcagaatgagaactgaccttgaaaattttgtgttgattttaatttaggtagaaaagatatttactgtcgtcttaagatacgccgcagttcaaaaaagcgtcttttaaatgacattataattttgaagtgttatgtacaataatcactctttcttcagtaaattccctaaaaaataaaattgttttacatattcagggtgaccaagttttttttttttgctctattccagtttagcgtccaatcagtgaccattctcactttgttaaatcataacttttttcttacttggtcaattcaatccaaacctttttcgtatcattcgaaagctttaagattagggaatttataaatacaagaaaagagcaaataattgcattaagaaaaaaattgcaatgagaaaactcgtaagttcaccatttttcgcgtataatcaagaatattttttgtctgttgcatttatcccagaattttgcaatagaaaacttctgtagacttcaagctttcgaatgatactaaaaatgtttggattgaccacgaaataaaaaagttatgatctaaaaaaacttatgagggtggtctctgattggacgcctaaacattgattggacgcgtacagctatttgaaaaatccggacacttaattatgccttcgcaatttgctctaatataatcagggctctactgcattttacgcgtccaatcgacttttacgcgtccaatcacagtttgcgcgtccaatcgacttttacgcgtccaatcacagtttacgcgtccaatcaaaagtttacgcgtccaatcacagtttgcgcgtccaatcaaaaatttatgtgtccaatcaaaattttcctaattcgaacatccttttgacataaggtaccaaccattgcaaaaagaaataataatttaaatattaaaaacgtaatccgtcattgatcactcacaggacattgaggcaacttggagtgcagtgaaaaatgatcttcgtcatctccacggcactaaccccgagcttttacaatcttatttgtatcagtatatgtttcggagatctaacaataacgaaaaaatttttcagcaaattctcgaagaaatacgtattcaataccctgtctaatcatcttttcgttgtattaatcaaaaagtcttcattttgacatttaagcatttattcggttaccattgtgaaaatggggagaggcaatgatggaaaacagagcgtagaatgaatgattggaaaagggaaaaatgcatcgcttttataccccatcgaatttcactcaaaggcaacaaaaaatttgcatttcttttttttttgtgggctcatagaaaggtataaaaggaaggaacatttggcagttttaaaaacactttcactgttttttgtttttgcattttcggcttccaaccgttagcaatttgtaatactaattttcaacagattaattttacaaatataaataaaattttgctagttccttttcatacaaaaatttcatttagtcaaaattatttgttatggcaccgcccatcagaaaaaagaaaaagttttcctccgacaattgccgactcatttcttctgcagcaattggtgaacataaacagtaacagatgggttcacttgtgacatcatttggaaggcggcggagtgtgcgcgtggccaagaaaatgaataaacgaattttgaggaaaatgtgagccaaattgggccctttatggtatagaaaacttttatagaaacatccaaattaaacattcttggtatcactcgatagccccaagaatcctccattaaaactgaaaatttcgaaaaattttgttttgttgcaaaagaaattatgaccaaaatgtttagaaaacaaattttttgaaatctggtcataacttttttaaacataacgaatttctttgaaattttatagggctaaaggggaaatcttagagctgtcgaatgacaccaagaatgtttaacttggatgttcctagagtaaataatgaatgaatgatacaatgaaagtgcaaattttttgtggtcgtgtaaactccaatagaacccattctgctgttataggtacatagttttgtgcatatttcccacattttggttcattgttttcgggaaatactaaagaaatgttcgaaagtgccaaaaagagggttttcacgtttcagttgggtttgtaacgatgtttggctgcacattttgccctttttggaccatgcacaactcggtctcaaaatggcattgctttcgccccgtttcaatgcgttggtggacaaacatttcgacgagcaaaagcgaattgacaatttggagacgtttcaaaattcacaacaaggacaatggaacaacaccaaaactttctgtgcgtatggaaaacaaaagttttgtggattttcccgctgccgggagcgtccgttgcccgagcaaaatccgatttgaatccctcagattga

SEQ ID NO: 17731 - DNA, 3236 bp, Heterodera glycines
  misc_feature (1216)..(1216): n is a, c, g, or t
ttaaattatttttaaaatccggtctctctaataataatgcaaaatttgcaacaacaacaaaatttcaaaaattaatttgtttcatttttgcctttcctcctcctttgctgttgttgcatttgaatttaaatccttccgccggtggcacggcgcactttggcattttaatgccccaccagtgccgacagcaaacattaacatgcttaaaaggcttattagtctaaggtcacttaagccttattttcctgctgttggcatcattttgccatcagaaatttagtgagaatatgattcactttcactttcgttgtttaactgctgctttggattcaataatttgccactatttaataaatattatagcattttgagaccggcacgattgggtttttcgggttcggtttttattcaatattttttaattttcattttctttataatgctaaaccccacagttattcctaattatgttattaggacaatgttgttttcgataattaactttaccgttggcacaaaatggactttctttttagagaattccattgtcgagagtctttactaaaatgtcttcattttggaatgtgtctgctgttctcatgctgatcacactgatctctttgcttgtcaacagcagtgaagcggtgccgttgccttcaaaaaagtcgtcgtcattgtggtcgaaacttttttcaaagtaaaatttcaaaattttgccgccttggcattttttttaatttggcgtttcattttagcgatcgtgaaagtgctaaaaaattggggagcccttcctcgacatcggctgctggtggtgaattttcagtgcagtcccaaatgtttataccgtatgccaacaacggcaacggtgacttctttctaccgtacccgagtgaaatggacacagtcaaacgcagcaacacggaagaccatttccttgacccatatgatggtggctcatcgtggttgagcctcagcgatccgagccgacttgaatggaacttcaacagactgcgctaatgaggagggcaaagatcaacattagaaatttggactcatcgaattcattttataatttttaatgaaatgttttgaaattttattaaatttgtaaattgtcttgccagaaaaatgtttttttttaatgtattcaatagggatgtcaaaaatatgaaaaaaaaaatcccaaggaaatattaagaaaaactcaaaaatatgntagcaaatatgtaaatttttagtattttaaaaagtaattttgttttcaaaaaaatatttgttattttttcaaaagaaatttctaaaaattttcagaaattctcaaaatattaaaaaaaatatatgaaaatatgtaagaaaaaagttcaaaatatgtaacaaatatgtaaaaaaagcccgtatatgtaaataaaagtcccaaacattcttctgaaaattagcgaatttcaaattgcttcttccaattagaaatgctttttctatcaattttcaagaattttgaaaatacataatctctcatttttggatttttatcttttatttctaaataatttttcattttttcaatttttttttcctccgttattttttttactgctaattccaaattgtttcttccaattcgtaattgctctattgctaactccaattttcttacaaattacggcataattttgtttacattctttttcagaattttttcttttttgtttatattcatttgatgttccaataaatttttgaatattttctattttttcttaatttgtttttgatttgtaagatttgaatttttgaagaccaattttttatccatttttgaattttatttcgatttgttcccattttttttttgctattttacacaatattttcaatttaaaaaaaaattaaaaccatattaaaatacaaataattaattaattctagatgaaaaacttgaaagtataatagaaaaagggaaaagcaaacaaaaaatggaaaatggcaaaaccaaatggatataataataaaaacaatttttaattaaaaaagggaaattggagcgtactttgaacggaaaaagccgtataaaaagaaggacacaacttccaacaaattcaattgaccaactgcacttgaggtgcattcgtctcctccgcctttccccttttttccctgagccgcgcgccccctgccggttccgctccgtcatgccattgaccgcacatcctgagccgcccgatcatgcgccctgacgtgccgtcccttcgtgcccttgaccatcctcgctgtgttaaaattaatatattaatccgaaatatttttacattcctccatttaaattatatatatttttatcataaaaattttttttttctttgaattgaatgcttcatcaaattctctgctttatctagagaatggcaaatcaacatttttattgcctttagcggggtatcaatgtaaatgttgatatttatttaaatcaatttgcattatgccctcaacgttatatcaacgttatttttttaatttttgataattttttaaatttgtttcagagaataataattttagggagagagttaacgtgaaaatgagagagttctgaatttcaattccagtcatacaaaacatttttgatcaaggagggtagagaaaataattccaatagagagccaaatgggaagagagttcacttcccttcttcgctgattcttttggtagtagacgcagattgcttcactatgttctctcttctctcactgtcttaaatctcttcccgtaacgttctcttttgaattaatttttctttgttcttcttcatcaaaaatgcttttgtatgaatggagctgaatttaacaccctctcacttttgtgttatctctctacccattttattttccgccaaaaattaaaagactgtaattttgaaaaaattatcgcaactttaaaaatagcattgatattaacgttgatggcataatgtatgttgataataaataaagatcaactttaatgttgatttattaaaacaatgttcattaaaagaaaaacattgatttgcatttctctagttttatcgcaaaatttcgtctctaaattgtttcttccaattgaaaatgcttctttttttgttgttaattttcagtattttagcaattttattgtcactcatttttgaattttctttcttaatttcccaataaattttcattttttaaattttttctttctccgttattttacagcgaatt

SEQ ID NO: 17732 - DNA, 1679 bp, Heterodera glycines
  misc_feature (9)..(9): n is a, c, g, or t
tcattacanttgtgatattaacgcttttcctgctgtttgtgtcccctttattgcctcgtatgattattttattaataattttttgttattttataaaaatgaccgcggagggttaattaaaaactaaagaattacctctttggccgctaggctaaatagatgttaatgctttgtattattacagatttaataccttttgactttctgaatttgccatttttattttttttgaaattactttattttaattaggtattaatgataattagagttagaattaataataatttgtgttaaattaaatgtcgacctaaattctatgctaaaaattaaaaagatttcctgcttccaaacccataattaaggaattttttaaatttaggaataccaattttaaatattaaaaaaaattcaattaactcaaattttcctgatcatgtcaacaagaaatcatttaggaattgtcaatgatttatcactatttttttaaatttattattttatagacttaatttacccatttttgtaaaaaatagtttctcaaataaatttatatagtaaaaataaaaaaaaaatgcaaaacaatcgttttctaaaatttacgcttttttcagtttgtttttaattccaaataaattttaccattttccatgacaaaaaaaaaacagatttgtggagcaattaatgtgccaattgtgtcataggttaaggcaaacatcccgaaaaactattgttttttgatgatgtcatttatgatttttttttttttcttaattgagcttgataaaagagaaacattacgccatttttttctttttcaatttggccataggaccggaaacagacgataaatgaatggcattatgttgcttttgagacaataataaataaaatgaaacaaggaccatcatcattatggcgcggatttttaggggcgaaaaagtccaaaatagggacctaatttgtaaggggcaaaaaattcgaaaataggggcgaaaataggggcgaaaaagtttttttccatttattttccaataaattcagatgtaattgttacaccactaacccccctcgccccaatttttaagcccaattattattttttgattatcaaaaacgcctacggcaaaacaaattcacttcagcggcggctcaattatttttgcgtgactttgtgttgtaattggcccttctccccatttcatttccgtaatgaaatcggatatttatttcgtcatcataaaataataatttttcgctaaaattcatacatccccactcccagcataacaaaaatgcccagtgttttattctcaaaaatctggcacttctcaagaaaaataattacattttagtccatattttttttttaccaaattttttccaaaaaaattttagacaaagcgaagcaaaacatgatgccggcggcaaagtttagaatagccggaattaaattaaaaaaattcaaattagtttttgccatttgaaattttgaagtcatgactttgtatgttaactaacgataaatagaactcattatttcataaaaatagcattttgccatccttttaaggttttaaatgaatacttagccacaaatcgctaaaaagaaattatttatttaaattttgttaataaattacttaattttattaatttttagtcaaatttcaaatctt

SEQ ID NO: 17733 - DNA, 1208 bp, Heterodera glycines
gaagtttttcaaaaatttttttttaattccaaaaaattttttcatcacaaaattttgggttaaatatcaaaataggcccaaccaacaaccccttttcgataaataaatataatgatttttttaacaatgtattttgcaaatttttataattcttagaatactcacagtttttgagtcaatttaaaaaataaagggaattttggaactccggcggtgccgataggcgccgccgggaaaattttgaaattttagtgacagatttagttcaaaaatgaaaagattttgcgattttaattgttaaatttatattaaatttccgtcgaaaaaaagaataattttgaaaaattagaagaaaagcaagtacttggctgggaactgatccaaaggaaacataatgaaaagagcaaagagcactaccactagaccatgcgtgcgaacgaagggagaaaaacaaaaaattaataaatatatattaatttaagtttatcaaaagcccatcactaagggtgcattttcacattgaaaactcaatctttaggtgtgtatttttcccgaaacttggggtaaaatagccgaagccgaagcacgaagttcgaagctcaaaaacccgaagttttcgaagccgaaatttcgcccagccctgattggaagggcgacataataattactttgtaaatttctcagaacattatatgtaattacgtaccgaaaatggcaatataataatagtttcatactcagtaatttgtgtaatttatggttggcatcattttttggaataaatgtcgcgtgaaaatgaatggctttttcttgcacggcaccgcccgtatattagcagcatttttcaccattttgccatcactcttgaaattgttaatccgttttggcatcattttaatacatagttaactgcttttaggctaattgcatagggttataagaaaaatttttttttaatgcgatttccaaaaaattttcgagtgtaattttttttaaattatgtgtgcttttggaataaaaataatttttggtcagttttgtttttaacatgtttttggcagaacattacctattatgaggcttttgggtggtcaaattatgataatttatgcgatatttactaagaaaaataatcgaacttaaaaaaaatgttcattccctcccccctcacccaatggctctacaagactggttctattaaaaattac

SEQ ID NO: 17734 - DNA, 2728 bp, Heterodera glycines
taagcgactgtgctcagaaagcgattttctaagaccattggagatgagaaaatgattagaaaagcatacattgaaaataaaagtctttgggtttccgtccccattttagcccctaattgtgcttacccggcacaaatgtttcgtcggtgccaattcgcttcctgcccaaataaatcaggtcccaatcaagtcgagtctttgtcaaatcttccattgttttttgaagactaaaattcaattttggcgtttccattcttctcttctcacattaatgtgccattcggcgaaaatcgcacgtcgtcctccaaaacaactgctcgttggtgcccatttctcacgatttcctcccatattttaaaatgactcaaaaaacagccaatttcgccccttttcatcggtcttttgtaataggggtcttcgaatccgggcaaaaaatgaattgctgaaagttcgtgttcagttaaattttgtccatcaactgcttcgaagtgagtgaaatccaagccgacgagatgaagaacttcccgcattttttctaatttttgcggtctccgtcgaaggttaataagataaacttggtcaaaaccaaactgaattaaagaggaataatttaaaagggaattatcaattaccttaatcggcactgggtaccacggctgtaaaacggaagagaccgggaagggcattgggccgacattcgaaacccaatcagccaaaaaagtgccgaactaaaacaattttcattcggcacatgaaaagtgacatacaacggccatttgttcgcttttactcagtgagtttgggctgataaaatagccataattgtgcaaatttgagaagaatatcggaatgttcattgcgtaagcggaaaaggcaaagacatcgattgggtggccattgccgtgataattgacaatgtttccctggtcaaaggtcagataagaagagtccatcttattcaaattgatcaaagttgggccgcttgaatagtaagcctaaaatattagtgggaaaccaaagccttcattagcattaattgccaaaatacccttattttctctgttcgttttgccaacctgtacgttttctctgttctgtccctgcacaaatttctccccgagtaaaccgtgggcattcgattggccaccgaatggagagatgagaaggggcgaaaccaccaatttgtcaagcgaaatcaattggcgaatggagtcgcgcagaaggaaacagtcggtgtccaaaatgagaagaaaagtacaggaattggaccggccaaagagaagagactcctcccgccaattatcgaatttgtctttgtgcaaaatcagtcgataaaaaccgcgagggaatttttccatccatctgaaaattaaaaaagaaaagttatggactttagcagaacgaactccgaaattaaaattggtttttcttcaaagaaaagaatgtgcatccgatcctaaaaacaattgacaattagtaaatgcgtaaatgtatttcaaattccgataaacgcacctttggccagcgaaaatcctccaccatgcccataaaataggacagcacatgcttatggtcattgatttttatggtgacacataatcgcgggtataaatgccggtaatcgccctctcctggaggaaatcccgactcgaaaatgcctaattagcaagggaaaaaatggctttaatttcactgagaatggaaagcttactttgggaaacaaattgtaaaaggaaaagaaatgaaagaaagcgcaaatcagacataaaacagtgaagaatagcgtcaaaatctgcagaaggaggagattattattttgttttaattagatccaaaaaaaaaatcctcaaaaggtcattttctgtcttcattgccccttagcttaaatgcaaaccaaaaaatcccagttttcccttcctcctatttttaaaaattcaggcaatatcatacacaaaagtgaactatctgtaaattagcgaataaaatgaatattccaaattctatcgagatgggcgtttttccctttgttcaacaaactgatttatgcgactccgaggtttacttttatcgttcatttattaattgttaattgataatatttgacatttacctattcaggaaattgtggagacgtccgcttttgggtcggttaaagtgaacattttcgggaattctgagcgttatccaattgttacctttcacgacattgggctgaatgcgatcgccaattttgagaatttctttcaattccaaactttttctaaactgacggaacagttttgtgtctacaatataaatgcaccaggacaagaattagacgcaaggaagttgccagaaaagtatggcaatttgggtcgcttattttaatttgttgtcttgtcgcgtttagtttccattatccgacaatggatggtcttgctaacattgttggcgatgtcgtctcacattttgggtaatgtttttataaatgcaattgccctcttttatgatcatattccacgaagtttcaagtcgtttattggcattggagttggtgcaggtgccaatgtattgcttcgtttctgctgtgcgttttccacattagcaactaattacaatttaaatcccctgcattttctccattccagatgagtcatcagaatctgttggatgccctccttctgatcaacgccacctcccaaaaggcggagggatagaatgggcctaccgaaagagtgcgtttcggttg

SEQ ID NO: 17735 - DNA, 3632 bp, Heterodera glycines
  misc_feature (2836)..(2836): n is a, c, g, or t
  misc_feature (2948)..(2948): n is a, c, g, or t
cagaaaaatgtgattggcattttgtgtaatagcgactttgaatcaaaaatggataagagtctccaaaaattgcaaaatgaattatgtgactcatcgaaaaatgaaaattttcaaaatacgatggaaatatttcaaacgacaaaaattgaaaagaaaacatttgacaaaagccaaatggacacagccttggcaaaagatcaaactctcaattacaacaataagggaatgttttcagaacttgtcaatttttcaagcaaacttcttaaaattaatgaaaaattaattgaaggtaaaatttaatatttttgaaaaaaaacaattaatcgtttcataattagtgccaacttggtcagttccgacaaaattccttctaagtttggcacaaatgtccttcataagacttaaaaaattcattgctacaattaaagtgacaaaacaattcaaaattttattttttaaataatactaataaaaaaacacatgcagcaccgaaagatgctaaactctgaccagggcttgacgcaattacggattacggatttgtgatatttttttgctccttttggattttttagagatgatttctttgcaagctttttttaaaaccaacaattttttctatgtttaaagtattacccatagtcttttctttgtatttgtagtattatttaggatagataccccataatttgggttttccaaaataggggacgtcctttttcgtcgcctcgtctaattttttccccattttcgttttttgaaaattcttatcgatattgaaatgaaatcccgggcatgaggatatttctaaatatggtctcgattgcttatttttggtcgaattttattaaatttttttgctcggttcaactcccacatacagcaggaatatttttttgagttttaaaaatgtcttatccaatataattttttcgaaattatttaacaaattctccaaaattgatgatttttttgacaaaatctgttaataagtcgcatcacaatcttcggaaaaatttcacgccggcaaaattattattttcttatataaaattacaaatttgttatccccgtttccccggcttacgaagcaccgttgtcgggaatcgccgattaaatttgcaaataaaataaaattgttgatttattatctaatcagttgcgtttttcagctaaaaagcttgccgtgttccatcaaaaaccaaaggatttactcggcagaagaacaaagcgtgccgacgacaatgcaattaagggctgcatctcgtcagtgcttttaacattaatctctgctccatattttggttattattcatttcaatatgcccacgagggcaatgtccaaattgaatacactgaatgttataagcatttgttctcctatcgctgttacccagcccattcttcggttgtcacggagattgttgaatggacaattatatttgccattggactgatacttgcactgctgttttgttcttgtgcccgtggatgatcgtcatactgtatgattacgtttatgattatggatgcaaattatatggaaatccattttttcaggactatgggaggcctgaaacgtatgaaaaacatgtttttgggctttgaggcttctaggatggattcctttattccatatttttccatatttcgcgattcatgtccatatttccacatttgtccatgttttggcattatgtccatatttcgcgattttatatccatttttttgcatcccttttcatgaccatgtgctacagttttttattctaccaatgttttatttgattcaagtttgtgatttttgctacattgtaaaatttttgagggaatttcggtccatcggtgctaatagcgcctccggagaaaaatttgggggggtttaacaaatttacaaagaaaatttactttatagaaattctttatgtatttttcataacgaaaaatcaaaagcttaaaattacccaatttgtatttgaaattgaacccttctgtttaaggctttctctgttctatgcttctttctttatcaatttgcaagcatggctgtctttattatggacaaaaaaaactcacaaaaattgtcattttttagaaattttgtaaatttataaaaaatatgaatattttttggagtaaggggacctgaacaatttctaagcaattttgactgaatataatttttgacaccatttctattgttattttcacatctcgcagatcttttccgcaaaaagcaagtgatggttgtcccacattgtaagctgcataagcatcgagtaaattatccaaagtttctggaaatactcaccaaatgatgggctcaagaattgaatttacttttttataaatttttccaaaaatttttatgattttcgtaataatacttgtttacctccaataaaatataaatttacttctgtgttctcaattaatccttggattatctggtgacggattgtctattgttcaattgtccactgacggattgtccgggcaccgtttcagtcttgattctattgcactttccaaattttggcttttcctttgggatgtaagatgtgtttttgagtaaattgggtaaaaaaacacaaaatgccaatatattggtaatgaatttccgccctttttcataaacttactggtttagtttaaaaaatcctctattaaaacggcccccctttttcaagcggccattttggccattaaggccgaaaacttttcgaattaattttgcggtgttttctctagaattaataaaaaaaaatttgactttctcaagatctgcctcaataaagcaaaaattgaaaattttagatttcattattttcttcanaaattaaaattctagctttattttatttatttatttcttctaaacataaaaattacgaaaatcggaaaaaagcttggaacactcaacgaactttgtgtggtgtcatccttcnccactattaatttgttcgttgtttccattggttccaattttggtatgtgtccatttggaatgaacgcaaacaaacaactgaccgttctttatatattaagaaaacaatttataagtgctttttgggatgggttggaaaacgggacatgaaaattcaatttaatgcagtgacttttccttttctttttttctttgtccaacagtctattactttcatctctgatttctttgcccttgcttccctgtcttcctcattttcccattttccctcacagacaaacagagaagaaaaatagcagtacaaaaagatgaggagaattccgctgacccacaaaatgtccaagccacgaaatgtccaagccacgaaatgtccaagccacgaaatgtcaagccacaaagtgtccaagccacgaaatgtccaagccacgaaatgtccaagccacgaattgtccaagccacgaaatgtccaaaagagtaaaaaaccacgaaatgtccaaaagtctaaaaagctcataaaaacccggaaaacgggtctaatttagggttttcggggtcactgagtaagaaaacgacctttatataacccatttcctaatcctagacccagatataaacataaaatagcaaaaaaaaattcaaggcttcgtcaaagggcgctgatcaaaattcgaacaagttttagggt

SEQ ID NO: 17736 - DNA, 3213 bp, Heterodera glycines
  misc_feature (26)..(26): n is a, c, g, or t
  misc_feature (66)..(66): n is a, c, g, or t
aaaggaagttttgaaaatcgagactnaatttaaaaaataatagaaaaaatttttactagggaaagnccgatagcttacaaattaaaaaatacagaatgataatcgaatcattcaagcaatcaaaaaataaaataaaaattacaatttaaataatcgacattcaaattattaatctaaaatatgccagcgtattaagctaataaaccaaatatatcaagtatgatacgtttcatttggttggttgattaatagtattaattattcaaaaatattattatattttataaaatctacaaggtcaagcaagttttatcaaaattattggaaacaatcattaatttatgactttgttggttgaaaaattgtaagcacttaattataaataaaaaaaatttaaagttcaatatacagctatatcttaaaaataagctacacgtaaacactgaccgaaatattttactttatataattaaagaggacaaactgtgccattgattggaggaccttggtccgaaatcataggtaccttatgggttggacgctcgagtttgacgactgtaataccgcgtcttttgacgcacataaattgatgaaattgaatgtaattaaaaattatgatggagtgaaaagattaagttaaaagggccgatgaggccaaagaatatattttttattgaaagggttttgacccgataatgtcaaacatcaatcatgtgtgaacaagagacttttttataccaaaaaatacattaaattgttgcaaagcagtaaatcgtttcttattaatggttttaaatttcaaaattttaacttaatatctattaatttttttcaaaaaacctcaaaaattcaattagaagctacttagctaaataatggtagcagacgcaatattttagatagtacctagagggtttagacaaatatggcttattcatgcatgggctggtaactcaaaagaatgtgataaaaaaattaaccaaataattagaaaaatgataataaaataaaaacaaaatttgggtgtaagaaattgttttcatatgaaaaaattgaaataatggagtgcattggattctacgaacgatcagaaattaaagattttattacaaaaatgtaaatacttcagaagaatctagctttacccattataaataaaatcaatccaaccaatatggtcaccaccttcaaaaatttgaatttgaaaacttaaatgagtaataaaaaatgagaaaaatttaaaaatatttaccgaaaaaattgaaacataattctacaaattttgttaaaatgaataaaaaaaaaataaacaaaatatgcacccaagaattattaatatattacaacgaaggaagagctttaaaccgataaaaaatgagtatgaatgcgaggaaatgagaaaaaataaaaaataaatcagtctaggaaatatatcaattaaaaacatttttaataaattcttggctcaacctcactgaaaatctaatgattgtaaaagtttttgtctaaaaatataaaaaaaataaaataaaaagcacaccaaggcgacaaaattggtaaaataatttttaaaaagtaagatgaaaagttcacaataccttctatttcttttatatttccctctcgtcatgccgacaggcccacccatgtcccaagcaatttctataaaatgagtgaatttatttacatttttttataaaaatgaaggaactttcctacaataatttaaaaaaagatcaaaatttaccgataacaagtgaacatatttccattgacatttgtaattgcgggtggagaaataaagaaaagattttcgaaaaaatcacttccatattcaatgtacaaagtaaataagacaaacttatcaccgttttgtcagaagcaataaaattcaattaaaaataaactctattagccttttttggccgaattaaaaattaattatttttaatatggaattttttataagcatttaaaattaaaaataacccaaatggaaattttatctgtcaagaattaatatattagaaattaaaagttaaattttaatatatttatatgaattgtttataaataatgcaattattaatctattaaatttgttaaattcataaaagacaaacaacatattaatttatatgagaatttgaaaattatacaaatttaaaattgaaagaaggacagagagacaaggcaatctgcatgctggacgtgattgggctcgcgacaacgagtttaaggctataatctcacatttacaagttaaaatgaattttttgattgaaacaaaataaatgggtaatttattgttgtcccccaatttaaataccaataattaaaaaaaaatcctgaaatagtgattaaatagagcaaagttaggactatagaaataattggaaaaattttaattcctacaaattggatattggagaggcgaggctaaaaatgggctccaaaaaccgctttgtaagaccacgaagtaacaaaattttttttaaatgatcatgaaaattctgaaaacaattaagttaggtaaatctgccactctgaaaccgaatatggcctttactgctccaacttcatgcatggagttgaagaaatacaagctcaactagcaaagatatgtctgatttaagtcttcggattcaactggtatatttgtagaaaaagacttcttttttttggtatatcagtttggtttttgaccataaaaaattcgagaaaattagtgggaaaatttccaattttggcatggtcagaaaaaaggctgaaaaaatcgatcaacaaaagaaaaagtgaaacgatggtatgaattgaaagaaaagacaatgacaaaaaaaaagaattattaaaataagtacagaaattagggtttatgaatttttgaatttggcagaaaaaatttgtgcggaaacttatgttacaccctaagtaaattcctgaagcaaaaaaaatatatttttaaggcttatgttaattagtttattaaataaacaaatcaatgttttaatattcccttagaagcaatggaccaatattgctgaaactgcgcaatttaaagcaccaaagcatttcaaatatgttctaatctatcatttacgggcttataacagtcacattttaattttaacattttgtttcgtttttaagataagaaatcataaaggctcaaaaagtactcaagaatagagcgtaacaaacattaaaggaaaa

SEQ ID NO: 17737 - DNA, 1451 bp, Heterodera glycines
  misc_feature (1339)..(1339): n is a, c, g, or t
  misc_feature (1433)..(1433): n is a, c, g, or t
ctccttcgaattatattttgtattaatgagcagtactatacaaggtagaataattatgaatatatttttttccatttcttaggccaagtttcaaagctcgaagaagcactaaggaagctggacaaagagaaggcaaaggcaaaatgaagaaaattgacttgccaaaaagcagatgcaacttgtgtttttattttcaacggcgtgttggagttgtgaaataaatcagatactgtatccatttgcaatttggacaacccttttctatacaaaaaactgggtttacggtcatacagcgaccgccatcgcctttatagaaagtggccataaaatcagttcgtttaaagagagaactgcactttattctcatattagccgtcagatccccgacttagcttcaaaacaggtaaagccacacattctctatcattatgaattttgatcgcctcacttcccggcaattcatggccgtaaaatgcgtttgaatttcacaacttttgccatcacatgcaacttgtgtttttattttcaacggcgtgttggcgttgtgaaataaatcagatactgtatccatttgcaatttggacaacccttttctatacaaaaaactgggtttacggtcatacagcgaccgccatcgcctttatagaaagtggccataaaatcagttcgtttaaagagagaactgcactttattctcatattagccgtcagatccccgacttagcttcaaaacagttaaagccacacattctctatcattatgaattttgatcgcctcacttcccggcaattcatggccgtaaaatgcgtttgaatttcacaacttttgccatcacatgcaacttgtgtttttattttcaacggcgtgttggcgttgtgaaataaatcagatactgtatccatttgcaatttggacaacccttttctatacaaaaaactgggtttacggtcatacagcgaccgccatcgcctttatagaaagtggccataaaatcagttcgtttaaagagcgaactgcactttattctcatattagccgtcagatccccgacttagcttcaaaacaggtaaagccacacattctctatcattatgaattttgatcgcctcacttcccggcaattcatggccgtaaaatgcgtttgaatttcacaacttttgccatcacatgcaacttgtgtttttattttcaacggcgtgttggcgttgtgaaataaatcagatactgtatccatttgcaatttggacaacccttttctatacaaaaaactggggtttacggtcatacagcgaccgccatcgcctttatagaaagtggccataaaatcagttcgtttanagagagaactgcactttattctcatattagccgtcagatccccgacttagcttcaaacaggtaaagccacacattctctatcattatgaatttntgatcgcctcacttcccg

SEQ ID NO: 17738 - DNA, 2615 bp, Heterodera glycines
aaaagggggcactttaatgttttgtggatcgatcgttacggttttactaatgtaaaattgtattttcaataattaaagtacattttgtatggtcgggtgtctctccggtctgcctcagctgctgggcgcgcacggttgggcgccagcatgtttttccaataaaactataacttttttctttgtcaaccaaatccagcattgttggtatcattcgaaagcttaatgtctttagaatctttttctaagcaattgcttcgcgattagacaattactaaaaaagttatacatgaaaatcgcgaaaaagtcgaaattttggttgtttcttaataaattttttcaagtctttcgctctctctccgctaatcattcggccctttcttatcactcactttccctcccttttttgtttttaatattttcactgatatttttatttattgtgtcgatgccaaagtttttcgtcgaatgaccaaaaatcaatggaatttttttatttctcaaaaatgttgagtgatacatttgaataaactgtgcaattttgaagagtttgaagctcctccccctcccccctaaaatgctgccaactcccaaaatgttagtcatcgtggcgttggtcagcttctgctccaattggcaatttggctatcaggcaaattcaaaatttaaataaaataattaaaacaattattaaatgctatttgaaatagccttgcaattattgaccaattaattaattggtcaataattgacccattccttctttgcctgtccacagatcacttacattaacactgcccattggtccttttacgctttggcggacgaagtttatcaaaatgaatcggtgacaataattaaacactttcaaattttaattgcctttttccttttttgcctttctctgcgcatttgccacaaagcgaatggaatttgctgtggagtttcattttggcctcattttacggcggcactttgctcggttttgttgttgttagtgggcatttgttcaatttccattcaattagtgtttataatagccatttccttttttgatttgatcaattcctttttatgtgccccgtttgattcgttttgccggcggtgttcgcaatgctttgcttctctcttcgctacccgcaattttcggctgtgccgttcaattggcggtgcgtttgtccgcgagtaaattttgccaaaattcgaattggttttaacccgtccccaatttgagctttgcccactctttgctttctgctctccgtcggccgtcttctcgtcggtgttcaggcgggctgttcgctgtgtctgctgcccctttttatcattgaaacggcgccatttaatcaccggccctttctctcatctcttcaggcacggacggaagaacacttctgatcattctcactcagttgctgatcagtctgagttgatcacagcaatcactcactgatcactcacatttgatcattttcagctgatcctctgatactttcacattgatcaaaaaccctcaaactttttaaggtcgttttccaatcattggccactttgatcggactttcggttggctctgatcatttgttgtcgttgggcgagcacaaaattgaatggcttcaggtccgactttttcaataaatttttttatttgttcaattattttatcatttttaattcatttgattccaattttgagatcataggccttgctcccacaatgtttttcgccatttttctgctgtggttgcccgacacgccctttcgcctgttggaaatgtgccaaaaacttttggactttgacgacggggcggacgaagacgtcgaattgagtgtgccttttgttacatatgtattatctcaaagattttgacagaattcgtactgtcctccctgttttacttcggcacaatcgtcgtcttcggcgccattcgttccgaagcatttgagcggtggtccctctcgccggaagggcgcaaaggacggcaaaaatgggcggacaattggaagggtggtgaatctccgcgcttttccctcaacccccccccccccccgtaggacttttggtcggcatttttgccgcagtttcctttgcttttactgccgatgatctgatcgattcgtattctgccgactttttctacgtaattccaaaattaaatccaaaaaagtttttattttaattttcgaatttcagcgcttttccttctcgcccaaggcgaacgcggaatttttaaccgccgggctcggcctcttgctatttttcaccagcattttgggcgctttccttgtcattagcaaattcgtttgctcagcttccctaatttgttgcaattaggccgatcgcttcgggcgccgtcgtctgctaatttccggccttttgggcacagccgtttcaaatgccatcgctgcgtttggcgcgtcgaccaattcgacttcgaccgttaaattagacaaagattgatcattttatgcatttcatcaggattatttctgtgtcaggtcgccattggcttcgccctcaccaaaactttcattggcttcggcgccggtgcccccgcgtggtttctcacctccgagttggtctccccactttttgtggcccaggggcaggccattag

SEQ ID NO: 17739 - DNA, 2058 bp, Heterodera glycines
taatagagcatgttaagagctttcgaatgataccaccctttgatagatttggataacaaataaaaaagctatagtggacaagcatgctcggggccgaaccgtgggggccgaactgagcggttccgtcagtgatttttttttgtttttttttaaatattagtggccaaaagttggaaaaattccatttttgttaaatttataaaaataaactcaattacataatatgtgaattgaaaattgttcattttagtttgatgacataaaggaattgttcttcagcactttggacgattacattgaaatttttcggataaaaaatcgacaaaatttggacaaaaattgccaacgaggggcttcaattgaattggaaaaaactgtgcgcgaattaatggggtaaaatttggggtttttaaaaaatgattaattaattcatctttttaaagggaatatccgacggtggcgaacacgaagaaaatgcgcaaaattgcacaacgcatttttgttaatttgatttgaaaattgccaatgaatggccataaaaaatttatcgaaaaaatggtcatttaattttaaaataaaatcgaataattctaataaaaatctcaaaatggctaatattaaaatgctaaaaataaaatcgaataataataattaataatattaattaattttgggaaaaataaaacgaattacaaggcataataattcccaaaataaaatttgcattaatttggtttttttattccaaagagaaaaccattttgacacctctttcagggcaaaaaataaacaaaaaacaataaatgcataattaaatagccaaaatgcagctgcgaaattcacatttgaattgaacaatgattgactgaagaagaaggcgatttgaattgaatttcaaatgtttaaggaattaattttgaaaaagagagaattcataaaaatgaaataataatatgataattataataataataataataataataatatcttttgagtattttgacgcagaagaacaaacaaaagctgacgagaaaaaattgaaggaaaacaatttgcttcttttttaataacaaaaacaaaagccgggagaacacacacacaatgagatttggcaaatcaaatcattaaaattgattagactcataatcacagtgatgataaaattaattaattaattaattgattgattaattagcccggcgacggcggcattcccgtgggtggcgaggcagtgctgctggacacaatggacaccaattcttcgggcttcaacaatgccaacacggaaaatgccgcgaaaaggaaggtggtgccgagcaggtcgcccaccgctgtcagatagggaattgcggcattgtcagggttctgaaaagtgggggtgggaggggaaatccaatcaaaaatggcatcaatgaataatgccatttatggcgggaaaagatgacacactgacctggcgccatagccacatcaacggcaccaaccattggcacaaaagcagcaaaatggcaacctgtgtgaattatttttgaatgaatttgactcatttatatatttattgcaatataaaagtattatttttttacccttatttctttccagagctgatccttttttttttgttataggccaagcgaaaattttaaaatgtttgccgagctatttttcaaaaaaaaaaaaaatgttggaaaattgagggccaaatggtgtgcccccgacagtagagaggcgccgacataaaatttggtaaattttaaaggaaaatttgttttaaaatccccctaccccccctctctactttaaagtcccatgtttcttgacaatgcatgggagtaggaagatgtgtatgtgggtggatcaaaaagggatacaaatattgttaaaaacctacccccaaaaattgaaatttccgaaaatttggcgttattattgttttttttgtcggcgcaaaaaacacctgcgccagcgcagcgctgagataaagtgcggtgaagagtgggccctgcacaacgtagacaccactttggggatgaagcacaaaaatgacccaatgaa

SEQ ID NO: 17740 - DNA, 1056 bp, Heterodera glycines
  misc_feature (1033)..(1033): n is a, c, g, or t
attaattagtaggggtgtttttaagtcatggataaacgttaaaaatttttttgaaaaatctttgaaaattttctagcgattttttaaaatttgaaaaactttgtaattcatcataaatttttaaaaattcgttaattttttccaattcttaaaaattattttttttactgaaaatttctttaatttttttttaattaaaattttctgaagtttcgaggaggaaggatttgctctcccttccgctcttttaagtaccgaatcgggcgaaaaaaatgccctcgaaatggagcagaaacggcccatggtccactcatttggcaatatgccaagctgtgcagtgcggtgataaaatgtggacagtttggaggcggccactgcggccaaattgccaccaacgccttaatggtggatgagttgaggaaaaaggcgtaataatttataattaaaaaataataataaaatttaatactgttttatataaatggacggattggttttttttttaaatttggttggattttgtcgtaaatttgtgcctaaaaatgcccaatgttttttttgtttttttttcatttcgggagaggaaattaaccattttaaagtgtgtctaaaatttttaaatttattgtatgatgatgcactacaatattaataaatgaatgattgacaaatgacgtgccattcatcaccggctgataaagggccatttgccgaaaattgcgaattgccctttccaacacaaagccgccactgctgctgatcatccttttggaacaacaaaatcaatttatcaaaaaaataaaataaataccaaaaatattcaaaaatggaaaaatttaatttaattagaggttttgaaaaaacaaagattttttgaaaaatttatttaaggaaaacagacttttatttaaaattataaaaaaacgaaaaattcttttgaaagttttttatttcttaccgaaaaaaccattaaaaaactaaaaatttttcattttttttcgagtggttatgaaaagttatgcagccgaatganatgtctgtctcaacagaacacaa

SEQ ID NO: 17741 - DNA, 1277 bp, Heterodera glycines
  misc_feature (1223)..(1223): n is a, c, g, or t
aaaataaaaattcaataaaagttacaaaaatggaatgtatttgagctagctcaaataaagacacaaaatgataattaattaactcaataacgcgcccatttaaatttcggttcagcttatttgtttaatattcttatatccttattgttaacttatttaaaaaggaattgccaaataaaaaaataaaacgaacaaatattattcaatttgtatttaaaatataaaaatattatatcttgggttgaaaacgaatataggacgtcaataaagaatggatttatagatgttattataataataggaaaaaatgcaatatattttgtaatgtaagaataactagtaagccgcgatgcttaaaaataactatttttcgaatttattatttgaaattctttgtgattaatttttgattacccttattgttgaataattttactctctacgctgcggagtaatttcttctctacgctgcggagtaatttcatctcaacgcaagcggaggcatttcatctctagggctggattagcgatctcagtaaaaatgagttttgaacgtaatatttctatttttagtttgaatatggcacattttgtatttaaatttggcgcttttattgattttttggattttaattaagcgccattattacatttttgtgttgattttttagcgccaatatttttaaatatgaattgggtacccatttattttttatttggcgccattatttattttttggctccgcacattttttcatttttatttggcaccattattgattttttggctcagcccatttttgcattttatttggcaacattattgattttttaggcgcccctttttgtatttttttatttggcgccattattgattttttggctccgcccatttttgcatttttatatttggcgccattattgattttttggcaccgcccattttttgcatttttatatttggcgccattatttgattttttggctccgcccatttttgcatttttatttggcgccattattgtttttttggcaccgcccatttttgcattttatttggcgccactattggattttttgggcgcccctttttgtattttttatttggcgccattattgattttttggctccgcacattttttcatttttatttgccgccattattgattttttggctccgcacatttttgcatttttatttgacgccattattgatttttgngcgcccatttttgtatttttatttttcgccgttaatgattttttaggcgcccct

SEQ ID NO: 17742 - DNA, 2134 bp, Heterodera glycines
  misc_feature (2114)..(2114): n is a, c, g, or t
ccgcccattttttgcatttttatatttctgtgccattattgattttttggctccgcccatttttgcatttttatttggcgccattattggtttttggcaccgcccatttttgcatttttatatttggcgccattattgattttttggcaccgcccattttttgcatttttatatttggcgccattattgattttttggcaccgcccattttttgcatttttatatttggcgccattattgattttttggctccgcccatttttgcatttttatttggcgccattattggtttttggcaccgcccatttttgcattttatttggcgccactattgattttttgggcgcccctttttgtattttttatttggcgccattattgattttttggctccgcacattttttcatttttatttgccgccattattgattttttggctccgcacatttttgcatttttatttgacgccattattgatttttgggcgcccatttttgtatttttatttttcgccgttaatgattttttaggcgcccctttttgtatttttttatttggcgccattattgattttttggctcagcccatttttgcattttatttggcaccattattgattttttggctccgcccattttccctggcacatccaaaatgaaaaaaaatgatggcacggtgtcattgtcgcccccaaagaacccacctcaaattgttcctgacagatggaacatattttttgtgaaatgttttcttacacttcaatggtggaaaaaatttctgcaatttgggcatggcttagtcccggcggcggtgttcgagccatgggtctgggggcaaggccgaggaagaggaagagagtggacggtttcgcctcacctcaatttttggacccataaatatttatttatttatttcaaattaacaaatttaaaaaaaatcggaaattttttatcgattttaatcacattttaattttgtggctaaaaaggagggcaaatactattaaaaaaatgatgaaattggatttatgacaaaacttagtgaataaaaaaatcccgcataatttaaatatttaaaagtattttcaccattgcataatgttgttgttgacgacggcgatcctgcgcagcgttttcccatacccatggcatttttcgaactgaaataatcaaaatattattcacaatgaaaaataggtgaattaaatttaaaataattaaatcaatttaaaataattaaattaaattaaaataattaaataatgatgccaaaaggttatatattggaagaaaatgaacaatgcctctcgcccccgcccctcccaaaatcggcgatcaaattaattagccaaatacaaaaaattattttgctagcaaagagcccaggccaaaaatgccgaaaatttaatgtccaaaaatttggaagcaaagccactattttggcgtttagtcattatttttgccactatttggcatttttttgaaaaatttcccaaaaaatgcaataaaaacgaaaaatacaccttaagaattggaaaattttctcaaaaaattcttccccaaatttttttttcttgctcaatatttgctaacaaaatattggaaggaaatattcctcattagtgactgcaaacagtgaataaaattgtttgccttaattttaaattaaaaaacagctatttaaaaaattacacccctaaatttggaactttttcgccactattttggcattatttggccattatttagataattatttcggggttttttgccactaaaaattcgccctattgataataatgatctgtttaatcaacctaatgaagaataaacttatgattaaaaaaatattcgaataacaaatttatttaactcttttttaagcattttcaatcaacttatttatttagtttattttattttttaacttcctttaatttttatttcattgtaaccggatttagcaatttaaattgttttgtttttcttttggtttaagttataatattgtactacgcgcatttaattgcaacctcttctcggttgatttgtttattgtttttcataattataattctttaaaatgttgcataataattctacccattgtaganttgtatcgattgactctaga

SEQ ID NO: 17743 - DNA, 2579 bp, Heterodera glycines
cgccgaaagtttttcggaattttaggaatttttaattaattttattaagaaaattgtacaaatttaaaaattttcaagagtccccaattccccgagttagtgtcggggggtcgggggataaaaagtcggaggtagggggctcggggtcggggagcaaccctattataaacccccaaaataactgctaaaatggaaatgagataaatattttaaaaatcaaaaatgtagtcaagtaaataaataaataaattttgaatatgaatttttgataaaattttccatttctcaggggtgtatttttcgtttttattgcatttttgttaataatttttttcaaaatagcagaaaatattttacaaaaaattcttcaaaatgaaaaagagcacaaaaaaagcaataaatttattattattaacaggttatatcgctccaatttgattcggttttttttcggtttttgaaaaaagtcggtcggttttttcggttttttgattatttcggtcggtcggtttcggtataaaaaccgaaaaaaaccgaaaccgaaaaaaaccgaaaaactcaaaaatttctcggtcgggttttttcggttaaaaaccgaaaccgaaaaataccgaaaaaaaccgaaaaaaaccgaccagtccgatctctagttttaattaccctttgtttttaatttgggaaatactgagcaaacattaaaagtagggctaaaagagcacaaatgaacagtgatttgaaattgtccaatcgaataacaataagtgacaacattaaaccaaatcgatcaccgctcattttgttccttgtctaataatcgatcattcgtccaacaaaaaccaaattagagaagtgataatagcaaagtgattgggcttcagtcaattccctcccctccgacacatccaaaaacatttggactgatttgggcttgaaacggccaaaagtccaatttggcctttcatttcactttgtccgttcgttcattcgaattcgtcgtcccccctttttttgtctgatgggattatccgaccccttccctaatttgccttccattttccttaattaccttttcgcttcgcttcgtccactttattttcattccttgctttatcatttaatgattgccttcctccccatttttgttgaatctttttctgtttttattctgtgatcgccgatgaaacatcgccgtcgcttgggggttttgccgggttaaaaagtgcccaaggggagaggctgcggaggcggtgggctgacccattggtgacggtggcatcgaaaaacgatttggcgctggcgccccagggaatggccgacgatggcaaatccaagtgggcttagagaaaaggcattgattttggaaatacaacaaatcagtggcatttcgtatcgacagacgctcttaccagccgacccggaggaaacggcggagagcaaagaggagacattggcacaacttctgaagagacacctgcgaaatttggtcggccggtgtcggcctatgcatttggcaaaaaaaaatggttgtcttcggcactttcccttttcaggtgcatttctttgtcgaggattggttcatctccggaatgctcggcttcatcaccgccgctatttcaatctccgtggacgttggctatgaatatttgaatcactgtagtctctttgcgctgtctctgctcaccttctctccttcttgtctcttttcaatttctcttttatttgtttctgatcactttttatgtccgtctgaattagtacagaaatatagaattcaataaatcattatacaaaaacaacggacatcacgcttggtacatctcgagcttcctttgcattgccttcctaaaaaagaagcaaagtgatttcaggatatgcacagtttaagtgaaaaactccatatttctctgcatacataataaaaagcgtctgtctctctgattttaaggtctgaatcggcccatttatacctgagttatacaaaacgaggaacgaaatgtgcaatgctatattgaattagtacagaaatatagaattcaataaatcattatacaaaaacaacggacatcacgcttggtacatctcgagcttccgttgcattgccttcctaaaaaagaagcaaagtgatttcaggatatgcacagattaagtgaaaaactccatatttctctgcatacataataaaaagcgtctgtctctctgattttaacgtctgaatcggcccatttatacctgagttatacaaaacgaggaacgaaatgtgcaatgatatattgaattagtacagaaatatagaattcaataaatcattatacaaaaacaacggacatcacgcttggtacatctcgagcttccgttgcattgccttcctaaaaaagaagcaaagtgatttcaggatatgcacagattaagtgaaaaactccatatttctctgcatacataataaaaagcgtctgtctctctgattttaaggtctgaatcggcccatttatacctgagttatacaaaacgaggaatgaaatgtgcaatgatatattgaattagtacaagaaatatagaattcaataaatcattatacaaaa

SEQ ID NO: 17744 - DNA, 844 bp, Heterodera glycines
  misc_feature (31)..(31): n is a, c, g, or t
  misc_feature (60)..(60): n is a, c, g, or t
tgtgcaatgatatatgaaattagtacagaantatagaattcaataatcatttatacaaanacaacggacatcacgcttggtacatctcgagcttccgttgcattgccttcctaaaaaagaagcaaagtgatttcaggatatgcacagattaagtgaaaaactccatatttctctgcatacataataaaaagcgtctgtctctctgattttaaggtctgaatcggcccatttatacctgagttatacaaaacgaggaatgaaatgtgcaatgatatattgaattagtacagaaatatagaattcaataaatcattatacaaaaacaacggacatcacgcttggtacatctcgagcttcctttgcattgccttcctaaaaaagaagcaatgtgatttcaggatatgcacagattaagtgaaaaactccatatttctctgcatacataataaaaagcgtctgtctctctgattttaaggtctgaatcggcccatttatacctgagttatacaaaacgaggaacgaaatgtgcaatgatatattgaattagtacagaaatatagaatcaataaatcattatacaaaaacaatggacatcacgcttggtacatctcgagcttcctttgcattgccttcctaaaaaagaagcaaagtgatttcaggatatgcacagattaagtgaaaaactccatatttctctgcatacataataaaaagcgtctgtctctctgattttaaggtctgaatcggcccatttatacctgagttatacaaaacgaggaacgaaatgtgcaatgatatattgaattagtacaaaagtatagaatcaataaatcattatacaaaa

SEQ ID NO: 17745 - DNA, 1772 bp, Heterodera glycines
  misc_feature (11)..(11): n is a, c, g, or t
  misc_feature (1682)..(1682): n is a, c, g, or t
gtttgcatcgnccaggtcacaaattttgaaaaccccccgcccctaattgacaaactacgaattattggctctaatttcctcctttttttacagttggaaatccgtcacgaggactacaagcagcagttgggggacatcaaacaaacttattggattgctgaagtgaaagaggcaaaccctttaaatatttgattacttttatgacaatttttgtgtccaaccttcgaattttgctgggcaacaaaataagggacgaccgaaggaacaaaaaacaaaacaaaaaactgtgccaaattggcatttcgttgtcttcaattagcatcgaataatcttgataatgctgtgtccctttctctttagctcgtcggcttttaccttttgctgcgttacgaaggcatggacgaggagggcgacgaaagggacgacttttgggccaacatcggctcggacgatgtcaaaaacgtcggctattggtaagtttaggcattgttctttatgttccatttttttaaatgtcgctcgaggcaatttttattccaatataaaaattgccaaaaaaaaattagtcgaagagcggcgacttttttttgttcacagaaattatctttaccatttggagaatgcatgcattttccgggaattttagagtctaaatttattttgaccaattttgacaataaactctaggcctgaattcgaacaaaattcgataattcaaaaagtatgaattcagacgaaaaacttaataaaaccaacgcttgataaaaatcatagataaatctaaaattttcaaaacccaaaaacataatcgtgtttagcacgtgtatttttttttacccaaaactcaataaaaaaaaattttttagctaaattttcctgattgtgagggtattaccatgtttttaaaccgtctcgagacttgaccaaatactgcccgtttgtttgaccttgtcattccctttttgcatttggcagttccaaacacgacaattgcgagctgttgccgccgcggaaaatcgctggccgcaagacggactggcgcgaatacattgtgaccaaactgaatgactgcaaaactttgactggcaaatgggtgcgcgagcggcaactgtcgctggtcgaaggacggtttaaggtgggcaaaaaatgggcaacccaaaaaaaaaactatgggattattttttggatttgaataaatcgttttgattttttttgaataatttcgggtgcgtaaaagccaaaaagtgaaatgaaaaatgtgcggttgtaaatgttgtaataaagtctgattttattttgctatttttagctctttttttttgttaatgatgaaaaattttgtagggcccaaggctcctcatcttaaaaattagttagctctatgagaatcataacgcatcatcaaccagttaatccgtaaagaaataaatgaaatttcaaaaaaaaaaccgacagattggcacccgtctcgaactcctcgaccgcctttactcctcccgcgtgcgcccggcgcgcgtcatcgaacagttggggcggcgcatttgtgtgcaggtcggtttcttctgtcaaataatcggtggattattaagtgggcaagtggacgcaaacagggaaaacggacgtctttctaacaaaaagattttttttcttgaaaaaatttctcggcggggaaacgatgcggngggcggggaacccggcgggtgggaaccgagctgatctcggggcagacacggtcccgggatttccgcttggagaggtactgacgacttttt

SEQ ID NO: 17746 - DNA, 558 bp, Heterodera glycines
gttttattaataggttccaagtatatcggtacgaaggcgtttcaccgatttctgtttagtgtgttttttcttccgacctgctggggtgtttgctggtcaggaaatcgtgtggtcccacccttgattgtagtttatttataccttttttcgctttaccaaatgcaccaccttctcttacatcctttctctttgtgtatcgtttaaagtcgatccctctgacctttttgggcatttatgttgttggctgctttctctagcaaatttttgagctcccgtttttccgcatctctcgcaagcgactctttgaggtccgaactctccaaatttcacccaaaagtctctcattaacagacgggctcgtctgggccagggacgtatccaggatttgggcttggggggggggggggggggtaccgatccgaaaagtcaattcttaggggtgtatttttgaaaattcttcgcccgattcttaggggtgtattttttaaaatttttcgcccgattcttagggggtgtattttttaaaatttttcgcccgaattcttagggggtgtattt

SEQ ID NO: 17747 - DNA, 1795 bp, Heterodera glycines
tccgtgttgagcatgtgaaaccgtccggctcccggcttgagtttctgcagcgatgcaaagcgaatgacttgcagaagaagcagcacaaggagggcaacgcaccgtttgtggcgctgaagcggaagccgaaggagccccggggggcgcacttggtcaaagtgaagagcaccaaagttgagcggctggctcccgtcaaattcgaaattgtcgcttgaggcattatgggggcaaacgaatgcacgagcacagaaaaccaaccgacaattgttatttttaatttgttgatccgtttcgtgttaaagaaaaagttttgaaaattgaatgtccatgtcgaaaattgagtgtttatagtaagcttgatggatgtcgtagccctagttagcggccaattttgcgaagttggactaaatccacctgccatctctcaattttattacacatttctttctttacgatgaaaaaaaacctaattcccacttttttgtctggcccggttaaatccaacttatggccatgccaattaattgttttaaaaaaataaaagcatttgctaaaaatattcatataaaattcaccgggaatcaataagatggctagtttttagcagcacatttttattgagagcgcaacaaatttttcaaaaaaagcgataattgccgaatttagcaaaacgaattaaaatgacagacaaagttgaagaatggaacattcatcatcatcagctgggcccgaatttaaataccataaaaatagggccaaatatgcaaataaaataagtatttttatggatcaaaaggcatcattaaaaaatctgggctctaattgtcagtcaacagaattataattcgttggaaatcattttgatttgtttaatctgcacgacgtgatgatcgcatgcaaaaaactactgttgtcacacaggcactgatggcatggcaattgaaaaaatatacggacgaagccggcactttgaacgggccgaacttgtggacaatgcccaactttctcattgctttagccgtgtgagtgttttttagtaaaataatcaaacgggacgacaaaaaacaaaacaaatatttttgggccattaaatatgtccggagacaaaatggcgacaacaaacaaacaaaaaattactggccaagtgggggacctttattggcattggagtcccaaagaatctccagccaagcctttttctttaaatttatcagcttctgtgttaaaatttatctttttatgaaaattagggctaattgacggaaatacaaaatttaataaggagctccatcaaaatgaacgaacttggggggtgaaagtcagtaaccttattaatccaaatcaatactcagccatttgactcgcatcgttttttatacacatcattgaaaatccaaaacaaaaaaattaaaaagcatgtcaatccgtccatttgaatgattgtggccctaaagagggccgtttgggatagttttgtttgatgctttctctcctcgcctccgctcactgactttcgccgtgctgcgtcttcttgggcagaaggaccgcctgaatgttcggcaacacaccgccctgcgagatggtgacgcccgagagaagctgaaaaatcacaattttcaaaaaaaaacaaaaatcggctgctgtcggaccttgttcaactcctcgtcgttgcgcacagccaactgcaagtggcgtgggttgatccgcgtcttcttgttgtcccgcgatgcgttgccggccaactcgagcacatccgacgccaggtactccaacaccgctgccagatagacaggcg

SEQ ID NO: 17748 - DNA, 1171 bp, Heterodera glycines
  misc_feature (55)..(55): n is a, c, g, or t
ttttcataaatacatttacaccgaaattttaggaaacccaattatgacgagctcncaacccattatttatgagaaaattgtgcaacaaaatggtagcaaaaacagcgctgaatggtgtctggcctcggaacggcgactgctccaaaaactgatccatcataagccggtggggatcaatcggcacttcaacctcaacttgttggtcatttacatgaacaacattttcgactttgaggaggacattaactttgatgttggtttttgggtttctccctctttttttgtaaacttttatcgacattcttttggattcggagtcgacaaaaatataaggacagaggccgaaaaccaaagggggcggggcggcactttttcggtttgcaaaaaaagaatcaatttagctttttatagctggaccgagacctggatcccggtccaagccatttttcagcaacctgggtttttcctggacattgtccaggaagcccatgtttccatgtccatgcatgaaaaagctggatttcctggactttgttatctttatgtagcgaaaatgttaagcttttttaaaatgctcaaagacaatatttgttcgtctaatggacgcggctgggcaaaacttgaaaatttcaattaatttttctctaaaagttgatgcttttcaaaatttctttggttttcgaccccctttggtttttaaacccaactaattttgccaatccctaaaaatttattatttgccctctaggactatctgagcgaaaaggatgttgaacagttgaagaggcggcgtatggagggcaagcaggacgagcgaaggccaatggcattttcaccgtcctacgcaattcgaccgaccacgaaacaggcaaaaaaaagaccaaaataatagccgaacttatgctaatttgtctgttttaaggttgaagaaaagttgaacgaatacttcgacatggagctgatcggggagaacgagtccccctctgaagaattggaaaagaaagctgtttttgaactgccccaagagtaccaattcaaggaggaaatggtcccacgataaatccatcacatttttggcatttaatacaatttttttacgtaataaccaaatcctttggtttctatcgaaattttctgtaaatgtgtaaaaaaatggcataaaaatacatag

SEQ ID NO: 17749 - DNA, 831 bp, Heterodera glycines
  misc_feature (804)..(804): n is a, c, g, or t
  misc_feature (811)..(811): n is a, c, g, or t
  misc_feature (819)..(819): n is a, c, g, or t
  misc_feature (825)..(825): n is a, c, g, or t
tttcaaatataaaatttagttaaaggttttgctttcttaattttacaatagattcatttatttacaaattattatctttatctatttagaaaaaaataaatatctcgctcctccgtgttctaatcgtttaaaatttattttaaatatacatataaaattaatgattattattattattattttatgatttcgctaaattaaaaagttcgaaagtcactattttcactcgcgtcatcagcaacggcattttatccatgataaatgctaataatcaagcatttaggttattttttgaaccgtaaaaattgtttatattcgatttatttttcaaaattttagctatactcaaaaatttaattttgtgatttgctttgagaaaatacatcctcaaaaagcactcagttttttttcatattattttatgagttctatattttgattcttcgatagaatgctctctttattatttgtttagaatttctgataattttctcgtattaaatgaaccttattttgaggctttttaagtctctaaaaaagtactacttttctattgctaaaaacatcataataaaaattattatgcaacaaaattgttaattacacattgcttttttaatggaaatttcacgttgcattccataatttatcattatcaattatttgttttattttctcactcgattccaacttaattttattacgtcaaattctaaatcttttttaaagttaagttatgattgcaaggatctccatgaatttaatttattactcattttgaaatggttataggacatttgcggnccggacntttgcggnccgganttttgc

SEQ ID NO: 17750 - DNA, 1758 bp, Heterodera glycines
tttatttagaaacattgtcgtttggttccagtcacgtatcaaaaataaataattgttttgtttttatcaaaaataaataatttttttatttaagaaaattaaaatgtttatattgtttatttatttcattatttttatttgtttattattttctaaatttttaattgcataaaatcatcccggacgggacaattcgaagcgtgcctgctccaacagtccgggagctatcatctatacgcgttgcggatgcaatcgcgtgcgttcgccactcgcagtgagtgcgaggagcatggctcgtcggccgcttatttgcattattttactattttaaatgtatccacatttttttaaaaagatcacagaaattgagaacgttgattttgatagtatctgattattctttcgttaggtttttcttatttcaaaatttttaattttgcatgtatcagtttgttcacgataattcatttttggaaacttgaaattgtattttaaatgatttcttataaacatttttccagtttttattattttataatataattatttttcattccagtttttttggttattaattatttaaatttttatttattttctatgcttatacatttgtcatcctaaatctatttatttaattttaaaaaatatttgtttcatatttttgcgcttataacttgagtttttgttttattttatattttatttttatgcaatatcaggcagctttatctatcaataattgcatacttttttttcctacgcctttttacaatcagtatacactgatcaactacagagtatcaggtaaagccatatgatgttcattactattttagtgacggagtcaccaaaatagtgatttctagtaacgaaaagtgacgtccaaatgaaaaaattttaacgcagaaatgcgttttttgagctcctttcttcaaaacaattgagcaaaaaaaagttttttcactaaaagttgctgccctactaatgaattagacaaaaattaattaaattttttattgtatttccttaattttaaacaaattttaattatttgatttataaaattattaatcatctacaataagaaaaaatacgatttgtaaaatttttttttaaatattctaattattgttttatttattattctgataattaattgttcttttaaataaatctcataacttgtaatattgccttggtcattctttatttaaattgaatttttttaagatcttttgttgcttatattattatatttaattttttaaaatttaattttagaatattttttttagtacttgttttttgttttactattttttaaccaccatgttagaggccatgtttgacatggcggcctgacattgtagacatatatttggactttttatttgatttcaattttgcctttccttcgttgatttataaattaacagatttctctaatttaaaatgctttattatttaggtaaataaaaaatctctgccatttcgcaccggcagtgcccgagggtgtaagctcacctccgccagtaaaatttttttctttatttaattaattttctcaaaataaaaatgatttagacgagcaataaaaaaagtcctcaatactttgttgcattttttgaatttatatttttctctgtatttttaataaaccttttctattttttccttttaatcttgacatttacacactgcaatagactctcgctttcggaagttatcgtatcaatatttatttgtaaaaattta

SEQ ID NO: 17751 - DNA, 1867 bp, Heterodera glycines
ctcatatcgagatcggatctcgcgcaacgctgtgctaagttcgcccagttcgcttcgctcttgctcagcaaattggctgacattgagcactttgatctccgacagatcatggtccaacgttttagaagccgattttgctgctgatggctgaccctcgggctaaattaaaaattgaaaatgcctaagtaagaaggcctaattagtgtcaattatcattttccaaattgctttattgtttgcctgtgccgactctttgcgccgttggctttccaatttttccatggctgagtccgccttttgcaccgccatgcgcatttcggccatcagcttctgctcctccgtctgccaattcgcctccattttgaccgcccttttctcctcctcctcctcctctttgttctgctgatgatgctgttccgtctcctttttcgtctcttttttttcttcttttgctgttttttctgttgttttttgatcgggcacctggccaattttgtgaacgcaataaattacataatttgaaggtattttcaattgggccctaataaatgaaatgataattaccaatacgactgattggacaattggcggtcgaatggtcgccttcagttcgaactgcggttgtgtcagaattgagtctgccgatgtggtcgggaattgcgttggagtgcttctacttgcagaggatggcacttcaatgcagaaatggacagagtttaacgagcaaagaccaaagtaataatgaaagcgtcttttcgaaattcagacattgactgattgcttcagtccacgaatttcaccttctccccgttttcgtgctcaccttctccccgttgattgtctgctccaatttcgatggtttgcaccgacactttctgatctgttgatcggtcttcatctgccgtttcttggtgttgttgttgtccttggtccaatttctgatcacgatcacttccacttttggccccaatgttccgcggcgccgggtaaatgctccattcgtttggcaaaatattcacattggtcaacagtttcggtctgatcagcctttgcccctcctgaggctgctttagcaaagttttcagctgatccagcatttcttgacgtgtgcttattgggccctggcattaaaaagacaatgcttttcctctttattgcgcttaattacctcttcattgttttccctctggccaaattgaccccggcgctgcttcctaacttgcttaagcaaaagtgccaattgtctgtcggtgagtcgcctcaacggtcgccgcaatgactcgtgaagagcactctgagactaacaattaatttttaaagattatttgacagggaataccttcgatcgccttggtccattttcagtgtattcaagagccacactttctgtcaattgatcacttgcgtttatcgccgcaactccattcaaaatcccaggcactttgacaggcactgaagggaaatcatagcggttaattagttagttcgtttatagttttgaaaaatagtttattgatgttggcattaaaacgctcttttaaaatgccactgccttttcgttgcctcttggttttggcataatttgctaaatgcccccgccccctccccaccgttatcagacggggcatccaccgatgccaatggctgcgcctctctcgaccccgtgagttcctgctcctcttcgtcgatcgatgctgctggtggaagctcaacagcaccgacaccgaatgggaccgaattggaaaggggccgccagggctcagcgcctttgtataagtgcaccggatgccgacgaatgcttttcccctgctcttcctctccttcgtcggcttctgcccttccgcccgtcgcacttcgttttccccgc

SEQ ID NO: 17752 - DNA, 802 bp, Heterodera glycines
cccccccccccccccccctccgtttggctgaccccccccgggggagatgatcccttcccttccctcaccctttttccatccatcatcattcattcattcattcaatcattctgccgagtttttcagcctaggagtgagaatattcagtgtcttctgcttcgcttcttcccgatgagctgctgctttaagcaacgaccggtcgcgcgccgcttttgccctttttcccatgcgtcgttgaacaaacgctgcagcccctcgggcagacgcgaagccgacgcaacaacagcagaacaacaaattgctcatccccccccccccaatttcgccccctttttcacatccatcggggcatattaagcggataatgaaaaaggaaagggaagggagcagagtcacccacccctctcttcttctcagcaagtcgcactcatcaacgacgcttcctttattttatgagatcattttccgaaaaagcgttgtgagtccgatgaaaggacaatttttgagtttgaatttgagtgtaatggaagtcagttcattgtttcaatgggaaaatcaattttaatcaaaaagaaaaagcgtaaaaattttgcatgaaaaataaggtgcaaattggactcaattttgattaaacaaaagagagaaaatgtatttgattattaaaaggtatttgatctgctcaatttgcagtaattcggccaaaaaatttttgttaatgttaacagcaaaaaaaaaaactttaaaacgcaacatttattaattaataaaattaaaacatttccgtttcaaaattccacaaaat

SEQ ID NO: 17753 - DNA, 2543 bp, Heterodera glycines
  misc_feature (2390)..(2390): n is a, c, g, or t
tgggaattttatgtaacaaaatttgcaaaatatgtaaataaaatatgtataaaaaatgctaaaatatgtatgaaatatgtacaaaaatagccaaatatgtactaaaatatgtaaataaaaatttttttaaatggttattttttggaaaaaattcctaataaagggtgaaacaggcacaaaatgccttaaaaattacctaaattggcttagaatcacttttattattttaaaaattatttttgatatctcattttttgaaaaaaatagattttttagggatacattttaaaaaaatttttttaatttttcacaaaagattttctataatttccaaaaatcctcaaaatatgcaaaaaaaaatgaaaatatatatgaaaaattgcgaaatatatacgaaaaagtccaaaatatatgcatatgtaatatgtagaaaaatcccgaaatatgtaaaaatatgaaaaaaaagtcccaacttttgttcgcaaacacaaaaaagaaagtgtttttcctcctatttagagcatgaagaattcaggaaaaattatgtatttacataaaattcccatccctattaatgatatattttttacatcattttgttatataaacaattctaaaaaatgcttgttaatagattatacagaggacttgaaattctaaaaagaaatttaaattaaatctaattgcttccgaaaaaagttataatttataaagcattgaaaaatatattgaatggaaaaggactatttgttctcataaatcatgggtgtgatcttgttcttatttctaagaaatcttattacctaggagtagagccaattttcctttaaattcttcacaaaaattgaaattttatggcgaaatttcattatttaagtaagaaattttaaactttggcgcaaaattcttctgattttttgagttctattgaagtgaaatatatgatttactaatttattccacaaaattgttaaaattcatacgggaggcgaaaaataatatttaataaatttttgatggaataaattgtaaaaataactgatttgaatcaattttgcaaaatcttcttatttttcacctaaaatcttattttttagccatgatgttcttatagaaaatgtttcgatcagacccctgcattattctaaacgttttaatactgccacaaatttattgtttttattttattttataaaattttaattttggttttttcctttttcaggttcaatttccaatgcaacgaatggaacagatgaaaatggcgagtaccaaaatttttaaattaaatccgagtgaccccttcccaaataattcatgttttttcttctagacagaaaacaggctaaggaaattgccaaggcatttgggatgtatctgaagcaaatggtgccaaatcggaaataatttttaatattgtaaggaagaagctggctgggcggttaaaacgcggaaagcgggggttgataagatccataaaagaaagggcggatgtgcctcggtagcttaatggtagagctgcccacggaaagggtgcatgagtgtgttcgattcccacccgaggtttaacattttgcccatttcttattggtagcaccggatggttgccccaccgcgccagcagcaattaactaatggaccgagggaccggtcccgatgaggatggtactgtaaggaagaagctggctgggcggttaaaacgcggaaagcgggggttgataagatccataaaagaaagggcggatgtgcctcggtagcttaatggtagagctgcccacggaaagggtgcatgagtgggttcgattcccacccgaggtttaacattttgcccatttcttattgtacggaccccggcccagtccctagcaactcaatttactgtaaagttatcgaaagggccggagaatgttaaatttggctgagtttagacaattttatttttatttttcatcggtaatagctcataggttgcggaatataggaaaagcatcagtaaataaataaatataaaatgaattgctttttaatagttaaataagcattttatagatgttgacgttaaaaaccaaaaggaactgtatattcggctgccagacgggagccgacactaacgagcttaagcgagcagggctcgttccagttagctttttcaatttataaataaagtgacaaacttttataattaaaattttcgcattttcatctctcgctgaagattatttgttgaaatttttcaaagtctcaaagactggtgttgcaggggaaatttttgtaatttgagtgtgttttgtaaaaatattttttttttgcaaaatgtcaaaaaaagatgtatatatgtagtgattaaaaataaaataagttgttcctggaaactttcgcatatttatgtngtgtaaaatggggataacatcatactgttttataaaatttactaaatttttatgataaattcaggaactttttccaaaatggaaaaggggtgaaatatttttttaaaatttttttacatttgcaaacttttctttttacatacataccatttt

SEQ ID NO: 17754 - DNA, 2257 bp, Heterodera glycines
ttttaaagaggccaaaaagattgaccgggaaattacgaccgatgacgttaataaattcctagaaaagcagagaccatacacgattcataagcccatcaggaaaagattcccgagactaaagacgataccaagtggcttccataccgattggcagtgcgatttgtgcatatttgaccagttgaaaaagcataacgacggttataaatatttattggtctgcatcgacgtgctgagtcgaatgatcttcagttcaccggccaagtcaaagaagagtgaggacatgatcgaggctttttatcgggtgttcgaaaagtctaaaattatcccgatgaaaatatatagtgacagcggtttagagtttcaggcgggaaaatgaaaaaatattttgaggaaaaattcatcatcaaaaacgtaatgtatagtcctgatctgcacgccggagtcgttgaaagggcaaatcggacaataaaggagcgcttgtacagatattttacaaagaaagacactcttcgatgggtcgacgtaatagataaaatagtctcaaacattaagaacagtgtgaataggacactggggatcaagccgtcttcaattaattttgaaaatgcccgcgctctctgggaaaaattatataaggctagggaatttaaaatttcgaaaaagaacaaatttaaaattggcgatatcgttcgaattaccaaggaaaagggaaaatttgcaaaggggtatctcccaaactttaccgaagaattatttaaaatcgttattgttaattcgacgacacctgattcatacaggattaaagatttggaaggaaatttaataaaaggcatattttataaccaggaattagtgaaaatagatggatgatttttacattgtactaccctcgaacacaccgggaccagggaacagtacatcaaaattcacagtacgactccccgagactttggaattgggcaaaaattggtcagtagctctctcatcaattatttacccctactcattcaccgctctcggtataaatggtcaagagtttattaaagtatgggaaaatgacagcagtgtccccattcaagtttattaccggacatgaattttaaaaccgccgggggattgggaaataaaattaacgaagcattcacacatcattacaaaatcaaaaaacaacgtggaaagagagaagccaaggctgaagaaaccaacgactcaaaaattgatgtcgcaaagagggccgcagaacgcgccgggagagatgtagaaagacaactcaatcatatcaacaatgtctcgagttccatccaaaccaaactaagcacactaagagaagtaaatcctcaaattttagaagagcctgatataaaagtgtggtttgacaaaatggtagagaaggggcccgaaattcaaacataccgaaatgaacttaaatcttttcaagaataagtagataaagccaaaaacacaacattagagcatgtggaaaagaatgacttgaaagaagcaaagaaatcagccgacgtcgcaaagggaatagccaaacaggcaaaaagcaaatattcaacaactctcgaggaatataatgataaatcggaaaagggttatatcggaatagtgaataggcttaatgaggctttgggtgagcatattaaacgtaaagatattggaaatagacacgtatctgaagctgagaaaggaccacaaaaaagagagagactagccaatgaggatgttcaatttcaatatgacagcattaattaaaaatttattgtctatctttccgctgctgtctcccacatagatttgtcaaaacacctcgcctatgtgcttggttttaagaacacaaggctatttcacgcggaagaggcgaattatatgccagatttgacgggaggcgtaaggcagctatacatttatgcaccaaatttaatagaaaacacaattatcgggaaccagatggctccactcttaagaatagttaacgtcgtcaatgacccagggtcgattagtgaagttatatatagcaccgagtactttcatcgtctacagtcgaaacgaatttcagaaaatacaattgaaattcacacaccgtttgacgaattcgttaaatttcactggggaagttgtattctcacattacattttaagaaaagtatattttaaaaaatgacacatgtgtttttcgatcccgagtcggtcgattggtcatcttttttcacttcacaacatgggaggggacagaaacaatactttgtcggaa

SEQ ID NO: 17755 - DNA, 890 bp, Heterodera glycines
ccagtagatatagcgtgcacactttactgcccctacttgacttttttttgctgcaccttttggtgctcaacttttcgctgcccctttttgttttttttctgttttgtgcagctgcgggcctgagcttggggcaggggtggggtggggtgtgggcttgtgcttagcgcacaattttttctgcccctacatgactttttttgttttgggttcagaggacggaggggggggggggtggacctgttcttttctgtgctattttgccaacctttttttctctgcgagggacgtccgttcatcgccgggggggggcgtccgttcatcaccaattctcagcgagtgctgagcaattgattgcttcctcagctcaaccgtttggacatttgggttgttcgcccctccctccctctctgtcccccccccccccctctttcgaatgttgccattctccgccgtttggtctacgacgttgacttcggccaaggagtggcgggggggggggattcgctgctgctgtggaaatgccgagctgatcaacgacggataaggcgctgtgtgtgtacaaggacaagaaaaggtagggggtggagggcagggaaatggtggaaaaacggttgaaacatttggaatttgaataaatgtcatattttgtggtgagatgggcataaagatatgaaaatctcaacgacaccaatttggccaacagcaacaacagcggtcgtccgccggcccgttctcgccacccgccacaaaacgtcatgttcggcgagttggagctgctgctgaacccagcggcggcggtgggggaggaagacattgcgcaacagcgcaacaacaacagtggccacaacaaccaagtgaggaaatggggttaattaatggaaaaattaaaa

SEQ ID NO: 17756 - DNA, 691 bp, Heterodera glycines
gggagaagcacaaaaaaggcttctttgggctttttcaattttaatgcttttttaaattgaaattttcagcgaggtgtcagtggcggcgtgtcgtctttggcggacggaagtgaaatggtgcatgccgttggccagccgctttcactgcgcagcactggcggcattggcattggtggtggacttgaggtggacatttttgtggaaaatgagggaggcggagggcggggagggtaggggggcggggttgacaaagaatcgacagcaacaacaaaaatgggacaacatcctccccctcccatgttttaggctttgccgcgccgtgttcgtgaggcggtcgcgcaagtcaatgctcgccagttgcagcgaatggtgagcacacaacctgaattcgcgacggtcgtgccgccgattgccgagagcggcttttcgaacattcactggctccttttggaatggacgggcgatatgattatgaagtgagttggatggaaaggggtcaaaaacgaaattaaaatttttttttaaaattttgtagccgaattgttgggcttgttgtgttggccggcccattcaccacccaaagtgacatcagcggcttcgacgtgcggctgatttttgaccagcagagcatggaccacgaattggcaatgcacggatggcaagagtgcgtggcgcggatgaacaacatttc

SEQ ID NO: 17757 - DNA, 1983 bp, Heterodera glycines
tttttctatcaaaagggggagatgaataaaatttttaaaaatttttaattcccttttaaacaggacaaaaaagtttaggcttatatttaataaaagtttcatcgaacctagcgccttaaaaatcgatatatctctccaattcttgcaggccttctccattgtaagggactaagttaacgtgaaaaaatgccaacgcttgttgtgtttaaaatatttcgaaattctgactttttcattaattatttattattttgcaaaattaattcataaatattttttagaacgtgctctgaatcgcaccaaatgttaattaaaagttaaataaggctctctgatgctttttctatcaaaagggagatgaataaaatttttaaaaattttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgctttttctatcaaaagggagatgaataaaatttttaaaaatttttaattcctttttaaacaggccaaaaagtttaggcgtatattttaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgctttttctatcaaaagggagatgaataacatctttttaaaatattttccttatattttggttatttcgttctactttcggtggggtgcttggaaaattggaatcatgcgtacccgtccgatctgacaagttaagcaacgctggctgactagtcaaaaggatgggggccgtgatgaaacgaaaccagcactgcttaccccgcggcacccggcacggacccccgaaggaatggaattaattaaattctctccttcggggatttttttccattaggtcgaccgttagctttcgattggtctagtcaaatttttttatttaaaaaaaattaattaaggcactctgatgcttttctatcaaaagggagatgaataaatattttaaaaatgtttaattcctttttaaacaggccaaaaagtttaggcttatattttaaaaagtttcatcgaacttagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgctttttctatcaaaagggagatgaataaaatttttaaaaatttttaattcctttttaaacaggccaaaaagtttaggcttatattttaaaaagtttcatcgaacttagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatatttttttagaacgtgttctgaaacgcaccaaat

SEQ ID NO: 17758 - DNA, 1951 bp, Heterodera glycines
  misc_feature (898)..(898): n is a, c, g, or t
aaacatgattccctctaaaaaaattcattgataaactttaataggttaaatttaaatcttaaaattaaaaaaataaataaaaataaattttatatttaaatcactcttaaacattctttaattaagtttaaaataccataacaaatttgggcattctaatattttagtttaaatttaaaaattaatagtttaaaaataagggattataaattcttggttaaggttgtagattttgccaccttatggggcattccctttttgaaggtcttaccccaattttgatcccttttttaatccttacaattatttttggtacttttgggatcgccaaaccctgtttttgggagtctcaacccatggtactctgaaattaattataaaaatattgaaatttagtaaaaaaaaaaaaaaaaaattttttttaccaattttaatgacaaaaccccatatacaaattgtcacattttgatcatttagctatgccgacgatacatttgcctattttgactcgtcaactttgactgtggcaaatacggaatttccgaacacgacctactgtcgttaccaagactaccggcgcccaccatgctcactgatcagtcagccgatcagtcgccaagtgtggggcgatgcgtttgagactgtctgcgacgacaattacgaattccaagacaaatggtggatcattttggcatttcgtctcgtttttgtgctcatttttgaggtggctcattttttttataaattttaataaattcattttaatttaatgatttaaatttttcaaaagaaaatatttttgttaacagtgtcacttcaattttgaataaatttttaaaataatttttaatgaaaaaatcccctaattatttttttaaatgcatttttcctctttttnagttggtggtcctctcgattaaagcattatttgcttatgtaagtttttgatatttaatctaaaataaattaattgtttgaaaattatttcagttgatccctgacatgccgactaaggtaaaattatctaaaaatttataataaaaaatgacaattattttttgttttactatatttgtatttatttcagattgtcattcaacttcaacggggtagcctaaattaataattttatatttaaataaaaattttaaaaaattctaaatttaagagcgttttttgatgcgccaagcaattctccaacgccgagattcacccgaagaactaaaagcggcagatttggaggaaaaggaattgtcacaattgacaactgataggtgatgaaaaaaaattggcaattttaaaattttgcgaatttgcttaacaaaattcattaaaattccaaaaaaaaaactccctggcggcatttaaaaaatgtaatattggagtgaaatcaattcctgtcactattagtgccgattatctattttggattacaaatacttaatttaaaaccgattttgggcataggcgcaaatgtcgggaacagtgatcatttctatgagaccaaagtttaataatattttagtgaaattttgggtaaataatgggaaacgggaaatcattgtggtgtttttcgttccccacccccctcgccgagaatttttaaaatttttgtcacaaatttttaagtaaataaaagttttcgaacttggctgttgaaaaatttttaaaactaataaagtaatttttgctttttttcccaaggccaaagcttggcggcagttggcacgacattgactcgctggcttatcaagcggatgtttgcgactcacaaaagagccaaccagcggaacaacaacggcggctatcaaatgccggatatgaaggactgttttccagacgtgacgcgcccgcactgtccccccgagcatcatttgttaatgagctgccattaagcatggaggaagctgacaccaatgaaaagatggtgagtttggttttgccgataaat

SEQ ID NO: 17759 - DNA, 1156 bp, Heterodera glycines
cgaaaaaagtttatacaattgaattttttatgtgttttgctacctaaaaagcgttaataaattttttttactattttcgtgcctattttaggatttttctgcctttttaagtgcctatttcgcgattttttgtgcctaaaaatcacatccctatacataatggattatggcttttttgcaaagaaatttaaataaaaattattttactttaatttaagctattattatgagccacccaatttggcaaatcggtctttttaaacgcattaaagaagattcagtcgattgcttggagtgtaagcaaaaaaacgttattaatttttcatcttcatcattttttggtttaaaaatatatttgaatacttttttatactttgaaagacttttttattaatacagaattttttgaaatttcctaaaatccgcaatcctgcgcaggatcctgcagattttaaatgcaggatttgcaggattaatcctgccggatcctgtcctgtaaaaaattttgaattccaatcctgcaacaggatccgcaaatttgaaatttccggtctctagttcatacatattcagcagatggaaaatttcactgcctggtggaatttttttggtagattttatctaaaaaatttaaaatttatttttggacagccttgaattttgaaaattttaaccatatgattatggtatgacatttaagaaattatggaaatgtatgaaaaggtataacagacattgtttttttctttattccattctttgtcacctttcttccacaaatggacttgcctttttttaattgcttgtcaactttctgtccatattttttgtattcaggtactctgtcaatttaatttttcaggttttctaattttctctttattctatcattattgcattttttgagaattctcggtgtaaaaattcaatttaatttaaaattttttttataaaaatagcttttttgaaatatgtgatttacttttttcaatagttaaaagttaacaaaaatatgtccttatattttttgaccttacaaaaatttttaaaattctttagaatttaataaaattttttattttgaattatgaatatttcttaataaatttttatagggaataattaaaaatattttgttaatatagtttaattttga

SEQ ID NO: 17760 - DNA, 1796 bp, Heterodera glycines
gggggggggggaaaccgacaaattaatggtacacacacaccacacagtgtccaccaccaccaccaccggcagcagcagcaacgaattaacgcattttcaggggccaaaaaggggggaggggagggaaagcgaagtgaatggggaggggaaatgaaaagaaaaaggggggaaaggggggggggcaaagaagtgggccaacgaatgccactcattcactcactcactacggtggacgcggcacagggcacagctgagagagttggcacaacgacgcaagacgggggaacaaacactatgggctaaaattaagaaaatgggggaataaaaagtaattaaaaataattaatttaaaaaaataccgaaaagcgacggagaaaaagacaaaaaacagttgttgaaaatatgcaaaaggtagcgaattctaaaaaactgtgctcacaatcggcagcgaaatatgatacagcgggcgaagaactgaagaaaatggcaaaaaataaaataaaatgataaaattaggaaatgcaaaaaaaattattttttattgaaaaaatacaatttttaaagagggataaatcaaaataattaccgaaaatggcaataaattgggaaaatgaaaaggaaggaaataaaaaaggacaaattaaggaagattaaatgagaaagtgtaacacggacagacagataataattaattttttatgaagtgaatacacattaattattagggctgcaaaaaaatgtacaaaaagtgatccaaatatgtacataaatatgtaagaaaaattccaaaatatgtacaaaaaaccccaaatatgtaaataaaatttttttaatggtattttttgggaaagaaattccccgtaaagtatgaaatagccacaaaatgacataaaaattactttttggtatttttaggcaacattttcaaacttattttttctttataaattttcaaaatatgtaaaaaaatgaaaatatgtacaaaaatatttgccgaaattttggattttttttttgaggatttccaaaaatttccataaaaaatactcaaaatatgtaaaaaaatgaaaatatatatgaaaaaaatccaaaatatgtacaaatatgtaagaaaatcccgaaatatgtaaatatgtataaaaaccccgaaatatgtaaaaatatgtaaataaaagtcccggtttttgttcgcaaacacaaaaaagaaactgtttttcctgctatttagagcaaggagaagccaggaaaaaatatatgtatttacataaaattggcagccctaataataactaattaaattaaaaaagaaaatttgatgtgccgttcgtgtcggttggacaaatgtttgttagtcggcatggacccaaccctcgtggaaattgaacaaactccggaactgaaaagcttcattaaatggctttaccaacgtcgtgagtttcttcagaatcatcaaaacagaaattgtgagaaaaatgacaccgacgataaaaaagtaaaattaattaattaatttctgtttaaaatcatccaattattatttaaggaatcagcaattaatcacgaagcaaaatgtgaatcatttgacaaaggcatctcttcttctaaaagtcagttttgtttttgtttttcattttctataataaaatagttttttttgttttgaaaaatcattatttttcctgaaaaggaattgttttttatgattataaaccaatcaatgctatatcgctataagggtttgttttaccaggaaatttaaaattttttatgattttagctttttctttttgactatt

SEQ ID NO: 17761 - DNA, 2082 bp, Heterodera glycines
ggcaagtctacctatacctatatcttttttttaaatcagcttaatttcagctgttgtcagtgctcaaacagaatcgtcggtggagcctcgacggcacattccgaagtgcgccaaagccgtggatgcaggtgttcgtcatcggctgctatgttaacaaccgaatggtggttgcagcgcaagccttgctacctggcaaagcctcgaagtattacacagaagtcattcaacagttgaagcgtgccgttgaacccatccttcccataaaaggcaaaaaaacagcagattatcttcattaataattattttaagtgatgagcgacttcgagattggaatgctgaaagcgatgcgtcatgtcttcccgtcatgcgaacgctcgggctgcagcttccacatggcgcaagcggtgttccgaaaagccagaagcatgggcatttttaatttgttgaacgaagatgacaacgaagcaccggttcaaaggaaatccgttcacaaaacattcaggtgtctttcattagcttatgtgtatttatttgttttttcaatcagatctgttctctctttggcactcattccgccactttacgttcggcgcgctttttgaactattgtcagcgcggcaccgcttggagttcaaggatggctggcgtattttgccaaaacctacattggcactactcaattcgagattgatcgcggggcggaggcatttgaaccgcatgctgatgtcggacactttcttctgcgtcgcactcgaagcacaactcgtaaatgcacctattctgtcatgaaatttatgaaatttttcaattttagcgttcagtatttcccaggcatccataatgacaggcagtggaccaatacaattcggactgcattcgccacaaccttcaactccaaccattccattgtcagaagaaagcagcttgcagcttattccacgctgggaacaagacatcgtctgtcctccacgtttcccgatctcgttttggaatgtatacaccagggctcaaatggcaattgagcgaacgaacaacggcatggaagccgcgcatggacaatttgcaataaaaaatttcatcggaaaacattattttttggtattttcagcgtgagctcaaccatcatccatcattgagtgacttcattgctgcattcacgaaggacatcaacaaacagttggacatcggacgcgcagaacagctccagaaaagcactaaacgacgacaacggtacgtcatcaaagaacaaaatgtggtgcggatccttgacgaggccgactttgaatcggaagaaggattgacaaacgccttgcacctgctcgggatcgtgatgcaaggctttgcggagggacttcacgtccgtggaaattcagagtggtgaagaaactgaggccgatgaaaattgattttaaacattttcatattattgttttttttattgatattttatatattttatgaagatttctttgcttgaagcacttttataataaatttaatatcattatatagttaaaattcaattttcgactagttggcgaaattagttggcgaaacgtcagattttggctgagttggcgaaatgaatgtttttggctgagttggcaaaacgtcaggttggcgagatgtcagttggcgagatgtaaagttggtgagatgtcagttggcaaaatgtctgattttggctgagttggcgaaatgaatgtttatggctgagttggcgaaatgtcagttggcgaaatgtcatatagcccgccaaaagcatggcccaaaaatgaactaattctgtgggttctcttaaaggaagcaaatactgatgaaaacactcgtgcagacctacagcgctggggccgacttcacgcggtgcgcactgtccttggcttaattgccactggcgtttatttatacgcagtaagcaaagaataaaaggagaaaggaactttaaatccgacaacataacataaaatgacatatttttaatgtcaattttgcatattcacaaatttgtgtgcgtacactttcaatcacatttttatatttacactttattacataaaaacattagcgtttacttagcttgtt

SEQ ID NO: 17762 - DNA, 962 bp, Heterodera glycines
aaaaaattttagcttctaaaaaagttattaggaaaaaacctcaaaatttccgacttttttgcaatttcatgttataacttttttggtaattgtctaatcgcgaagcaatagcttagaaatatcttctaaacttgttaagctttcgaataataccaagattattggatttggttaacaaataaaaaagttatagtccgaaaacttgggctggcgccaaaacggcggcgccaaaacgatacagacccgcgaaatgaatgtttttggctgagttggcgaaacgtcaggttggcgagatgtcagttggcgagatgtaaagttggtgagatgtcagttggcaaaatgtcatgtagccgtgacgaaatgttcggccaccaatttttttaatgattttttcgtcaattttttaatttgaattttaagacataatgccatttaatttttgacatgtttaataaatttcctagtttaaaacattttcatcgcaaatttaacccaaaatatatgaaaattttcctggcggcaccttttggcaatgccgacctacaaaaccttaactaaaaattgctaaaacttgagaccggaaatttcaaatttgcggatcccgctgcgggactggaactcaaaattttttgcgggacgggatcccgcgggattaatcccgcattttccaaaaaatgcgggattgcggactgggatcccgcgccggtctctactaaaaacagcgaaatttgttgtcatttaaaaaaaattgttggtacttttgtactttttcactttacgccacctaaaaaaaaatatatttttttaaaatttttctggggttttcggatgcgctgatcacgaatatgacattcatttccacctattcagaagcccggacccgaattcgaacaaaagtcgaaaattaatttttcaccaaaaaggggaaagtattatccaaaacgattcaaatgcacttaatg

SEQ ID NO: 17763 - DNA, 1877 bp, Heterodera glycines
aatgaccattaaatttgatagattaaaaaccataaatggcattttcttttctttttttaaattttgttttttcctaaaaaataaatgccaatttctttccttttattttttaattttgttttttccataaaattcattcactttctcactgaactccgcttaattagcattctgttcttcttgttttcttctttatctgtcctttcacatgataaacaatttttgagaatgcacgtaattagcaaacgcaccggtgaacaatttgaaatgccattcattcggtaatttttcttttatctaaaaattttcgaatttccaaaaactaaggcctgtaacaaaaaaaatgtagttcaaaaagctgccattcaaaatttgtgaatagcccaactaatttatttcaaattccctccctcttctatcttatggtaatcacgtgcttttgccaatttgaagaatttcttttcttttttcaatttaaccattttgtcattcctttttttgaaataaatgtctattaggaaaaagctccattaattcattaaacaataagctttttcatttgtcaaatacttaaattgtgtgggtgggtgggtagtatataatatattctataaatattctgtaggatcagttaacatttactgaaatcaaatttaaatattcatcggcaaaatactacctgcaaaatgtcacctcaatatggtaagtgatagcttatcaaaaagtattttgtaaatgactgtagaagtacagtatccttatacacagtattccgaaaaaaagaacaaatgcataagccaaagctcggaccttttcatttttaatttctgtaaaggctccatcgacttgaaaattgtactttacagtacccattaaaggaaaatcccaattacagccattcatttccaattaccgatttcttatggattgcaaactcattcaaatacaaattttaatatatttgcataatcagatttggtccgtaccgtgtacagcagttgcgccactttatgcttctcacttggcatgctgttcaacgcattcttagtttggctgatcctcaccaaaacgccggcaccgatgttggtctacagcaaattgttgttgaccccatgcatgatggtaaaaacaaagttttcaaattttagtgctctttggtgctttgaacacggtgtatattatgagtaaaaaactgactgattttaagtaggactgcttccgaacttcgggaagagaataatcggagagcgaaattccgcgaaaaaaaaatttgtcggaatggttttcggggagcaataccctcgtcgggggcgaaattttcataaaacgttggaaaaaataaagaaattttctaaatcaaaaaagccttagaaacttgtttcaaactctctcacttatcctttttgaagtgttattgacgttcccgaatcaggccgtgaggaaatctacttttgtgctgttggcttgaggcggactctctcagttcggcccagccaagtttttgatttataacttttttctttgtcaaccaaatccaacaatcttggtatcattggacagctctttacatactctattagtcttacaaaaagcaaaaagattttcaagcctggaaaaaatttattaagaaaaaacttcaaaaatttcggcttttcgcaattttcatgtataacttttttagaaattgtctaattgcaaagcaatatcttaaaaaaagcttctaaacatattaagctttcgaatgatactaaaaaatcgtttgatttggatgacaaagaaaagttatagtcacaaaattggctgaggccgaaccgtgcggggccgaactgaggtaacccagcttcagggtaattgatttactcgactttttcttattt

SEQ ID NO: 17764 - DNA, 2009 bp, Heterodera glycines
  misc_feature (83)..(83): n is a, c, g, or t
gctcggaccttttcatttttaatttctgtaaaggctccatcgacttgaaaattgtactttacagtacccattaaagaaaatcnccattttccgtccttcatttccaattaccgttttcttatcgattgcaaactcatttcaaatacaaattttaatatatttgcataatcagatttggtccgtaccgtgtacagccagttgcgccactttatgcttctcacttggcctgctgttcaacgccattcttagtttggctgatcctcaccaaaaacgccggccaccgaatgttggttctacgagcaaattgttgttgaccccctgccatgatggtaaaaacaaagttttcaaattttagtgttctttggtgctttgaacacggtgtatattatgagtaaaaaactgactgattttaagtaggactgcttccgaacttcgggaaagagaaattaatcgggagaagcgagaattcctgcgaaaaaaaaatttgtcgggatggttttcggggagcgaataccctcgtcggggacgaaattttcgataaaacgtcgaaaaaaaaataaagaaattttctaaatcgaaaagccttagaaacttgtttcaaactctctcacttatcctttttgaagtgttattgacgttcccgaatcaggccgtgaggaaatctacttttgtgctgttggcttgaggcggactctctcagttcggcccagccaagtttttgatctataacttttttctttgtcaagcaaatccaataatcttggtatcattggaaagctctttacatactctattagtcttacaaaaagcaaaaagattttcaagcgtggaaaaaatttattaagaaaaaacttcaaaaatttcggcttttcgcaattttcatgtataacttttttagaaattgtctaatcgcaaagcaatatcttagaaaaagcttctaaacatattaagctttcgaatgatactaaaaaatcgtttgatttggttgacaaagaaaagttatagtcacaaaattggctggggccgaaccgtgcggggccgaactgaggtaaaccagcttcagggtaattgatttactcgactttttcttattttagcagtcttggtcttgataacggcattctctcgttgcttttactctgactattattttcgatttattttctcagctgatcataagaatatgtttaattattttaattctaatgcttttaggacattttcctgtgctttttcacattccttgtccagcccatcccggtaatgaaaattccattgttgtaaaaaacaaattagaaatttcaaaaacacagattgtcgaccatggttaccatgcggtggtacaaaatggcttctttcgtcaaatgtccggcatttacaattataccgtaagctctcacagtacagaaaactctgtagagtcgactttatactgtatataaacgataaatttttatttttcgaatctatcctaatcatccattttgtatttaaccatatcactcctcttaatgttaaaggctaatgttgtctggttccaagtgttattgctgtccgtatgtgccaccactgtacagtttgtgttccgctactacatgatattcaagtacaataatcggcataaattcatatgcgtataaaatatttcgacattgcgaaataagaaaatatttggcatcaaaaatatcatacaatagtgcttttataaccacagtactgttaccgtacacacaacatcacccaattcagtgatggtcatattccgtcacgtctcaagtacattacgggcaccgtactgtcgctgctcctcttcgcccatgtgatgttccactatttctcggactatccgtttgcaaaatacgctgatgagatggcccagttggccatttgggtgcacgaggaggttggcatcaccgacatccgcttctcctcatttacaccggcggtgagtgaaagcgtaccaaatagaaaattagcgagtgaagcgatacggtttttgtataaattta

SEQ ID NO: 17765 - DNA, 1788 bp, Heterodera glycines
gcgttgctgaactgtcgtgccagcaattgctcctcctcgcttcaatgtgtcctcgtcagctactgcaccaccattttcaacgtcgtcatttccaacgtcctgtcgactgcgtggcggatgagcaacagcaacaccaccactaacaccatcaacatcatcgtcagcaacaacaccaccattctcggcatcggcaccactgtgaacagctccgtcaccgcggggtggaagactcagtgggaaaatgtcaaccttaacggaggaaaggaaaatgggcaaatttggaggggcattaaccaaaatgggcaataccaaggagcgaaagcgaacctaggtgagccagggggcagcccctacctaggcgaaagggaaaaaacaaaaaaaatttttttggttggcccgttacgtccctccacccgttttttccaagtatgtgacacatacattgtgcagctactgcggcacccgcacgcatgacgctttttttaaaccgtatggataatttttaaccgaattttccggcatttttttatttcgccacgcatttaaatgttaagccttgaccccacctgcaaaagttttgccggtttggctttcgaactgttgacaaatgacgttgatgacgacgatgtggacgaggaagaagcggtcgattgtgaggcaccggcaaagtcgaaagaaaatggcattttgtcataaaaatttaccggaaaacccgaaaaatatggagcaaaaactaaagacagtgtttgaaaatgtagaaaaaaagacaaaatataaaaataattcgcaacaccaatgttttttaatgtgaaattaaaaaaaaactcgcgtaaaaatgcaaaaaatttatgcaaaattgcgaaaatataaataataaatgctctcatcttccgccgatgagtcgggcacaatttgcacaactcatgccgaagctgcagcagcactggcactgttactgctgttgaacttcaccgagtcggccaatgtttgcagctgtgcccgcctgtacttccagaaattgtgccgaatcgggtcaatccgctccaacacatccaaatactaaaacaatggtaatacatgaacaaaaaaaaaatgataagcagcaggaaaacggggagccaaacttaattccggtttaatttgaaaaaaaactagggatgtaagtgaaaatcggatatttttaggggaggaattttttgaattcaaaaatttttgataggtccgcaaaaatccatgttctagaaattgtttttatatgcattcgtattgttggtatttcaatgaatgaatatctctactatctactcaattctccactccaaaatgagtagattttatgtgtacttaaaattaattaaaaaaaaatttttttttttgcgattaacgcccttttggcacgaaaaataacaaaataataatttattaataaaattccaacttcgccacttttttgtgccatttctgtcaattgttgctcatttgcaaccgcattttcgcgcattttgtccgcaattttgtcgatgagaaattggaacagatgggacgagttgcacggcggctgacgagccaacagttcgtcacagcagtgcacaatttcgggacggtcagtgcccaacggttcattgatcagaatgctgaaaaaattttggcatagaccatttatgtacctatttagttttcaatttttttccattccatccgtttaaaaccaatttttcgtgtggcattttgttttttggctctgaagccaccccccccccaaaaaaatgtcagaaacaatcgaacaaa

SEQ ID NO: 17766 - DNA, 1674 bp, Heterodera glycines
ttgcaaaacccatctcctgctcgctgaacaggtcgaaccgctggaccacccattgtcttaaaacaggaaaaaaaaatgccaaaatcatggaatagctcgtcctcacacagcacatcaaaaaatattggaatttttacttttcggcacccttttttattgcatttttaattgtcctacaaaaaatggacctgtgttgccatgcgtggtaattcttcggctcgtcatgcaattgctgggcaatgaatggcagttcagcagcgtaaatgcccgactcgtccaccaatgttttacgattgtgcctaaaagcggcaattttagtgagacaattacgaaagaaagttcttcgaacttaaaacggaccaatttggcaatattttagagttaaaaacgaatcaaaacttggtaaaaaacaaaattgacaaaacttggcattcctttgggtttaaaatgggctagttggtagttttctatcatttcattgtaattatccggctaaaaatgggtaaatttggtattttcctgattaaacgaatcgatttggtatatttggggtttaaaaaaacggaccatggtaattaccaggacttgaaaaagaggataacttggtaattttttggatttaaaaacggaccaaacttggtagttcttcggattttcaatgatgatctcctcacagtagcgcagttcttcgctcacatccttgttcaaagcgcgcagaatggcacggcgatataaccgaaaaaaggaaattttgcaaaaaaaaaaaaatacaatattttggaaaatccaattttcttaccaaactgaataatttgcggggttttgtgcaatgcatgtctgtgtgagttcgagtgtccgctcactgagctcattggcattcattacggcacgcaaatacgcaaaggcatcgtcaactaaatcaaaaaaaattttcgcaaatttatttttattggcacggacattcctcgctggtggcaattcggacaacggcattctcctcagcactgttgtaaattggggtcacgtctcgccattctggcctgtctcggtagagcagcggaatataaccaacggaagaggaattcattccgcgttaaaattttcagatttgtaaacggtcgaaaaattgttttttttattattattaaccatttttaggcacatattttatgaaattttcaatagaaccatagtttcaacacagtccaaatccatcattttgttggttgacttttttgcaaggaaaaatttttttaaattaagttatttggcatttcattttggcgccttgtttatttttcaaacaaaaataaaacagcaactaataatttgatgatcaatttggccatttaacagaataattttaaatgatcgggatctttatccaatccaatttattcataggcacgagattatagcagatttacataaagagacacacaacaatacatacaaaaaaaaaaagaaaatttttgaaaattatatatgagcacggcaaaaatcacaattcatcatcgtccacgacgttgtttctccggcttaaaaaaggccatgtacacgccgatgaatgcgaggaagaacacggaaatgcacgcgacgacaatgtaattgccaaatccgccgaccaatgccgcgcgcgtcggagcgtagaacgaggcgcccagcgacagctct

SEQ ID NO: 17767 - DNA, 1216 bp, Heterodera glycines
ttgtgtactgaaatgacccttttctttttgctcttttctcttcaatccctattctcaatcgtattgacttagtcggaaaacattccgaatcagtgtgatattttaattggtcagtctgatcattgtcatcccaatccgaatgatcagagattgtgccttttgagctgacaatgaatatgccgttcctgtgtgcaaatcagtccgatcagtttcagatcagaatgtgccctcctctttttcggttgatcggactgtttgctgtcatttccggtgattgttcgtctgtttgctccccccccccacccacctgttcgttgtttcggtcccatccttcgctggccaaccaaatgattcgctttttcatttgtgtccgtttcccttttctcatctcttccgtttcctttccttcgattgtttcgtccgattctgtcagtttcatttgcattgccacctgcgtaattcacttgaataagtccaacttttcctctaaatttgcctgttgcagaagcggtgcgatgtattcggtgccgacgaaaagggcgacgacgcgggcgccctcttttttgtccgattggagcctaattaattggagggagggaattttgttttttaattaatcagtttagcagcggggcataaataactcaatgtgccgttttctttttttattgcgcaatttcggcctatttttaacccccccctcccccaatttcgcaattgctttgtttggccccatttttgctgctgatttgagcatccatcgctcacttcttcaccaaattggcgattgagtcgcgcaatgattcgggcttcatcgacactctctcctcaatggctatgcaaatgttcgcccttcgcgcctcctttttgaacgcatccgcccccaattcgccgtattcatccgccgaataaaccttcaaaaaggcaaaaaatagaagcaatttagaagataaaactcggagtgacactgaccagcgaaaggtaagtccagctgaaatgcacggcgatgtcaatcatcgcccgtgcctggtaattgtcactgggcaccgttctgaaattccctttggcacagttcgctaattaattgcgttatgctcgagagcgtcggcgtcgagtcgaaaagagtttcgctttttttttgcaatttagagccgcgattagactttcgcttcgagcataatttgccaagatttacctcgcaaaatactcaaaccga

SEQ ID NO: 17768 - DNA, 2103 bp, Heterodera glycines
  misc_feature (44)..(46): n is a, c, g, or t
  misc_feature (52)..(52): n is a, c, g, or t
  misc_feature (56)..(56): n is a, c, g, or t
  misc_feature (60)..(60): n is a, c, g, or t
  misc_feature (65)..(65): n is a, c, g, or t
  misc_feature (68)..(68): n is a, c, g, or t
  misc_feature (83)..(84): n is a, c, g, or t
  misc_feature (88)..(88): n is a, c, g, or t
  misc_feature (99)..(100): n is a, c, g, or t
  misc_feature (106)..(107): n is a, c, g, or t
  misc_feature (110)..(110): n is a, c, g, or t
  misc_feature (117)..(117): n is a, c, g, or t
  misc_feature (119)..(119): n is a, c, g, or t
  misc_feature (121)..(121): n is a, c, g, or t
  misc_feature (124)..(124): n is a, c, g, or t
  misc_feature (132)..(132): n is a, c, g, or t
  misc_feature (134)..(134): n is a, c, g, or t
  misc_feature (142)..(143): n is a, c, g, or t
  misc_feature (149)..(150): n is a, c, g, or t
  misc_feature (157)..(157): n is a, c, g, or t
  misc_feature (160)..(164): n is a, c, g, or t
  misc_feature (172)..(172): n is a, c, g, or t
  misc_feature (183)..(184): n is a, c, g, or t
  misc_feature (192)..(193): n is a, c, g, or t
  misc_feature (196)..(196): n is a, c, g, or t
  misc_feature (205)..(205): n is a, c, g, or t
  misc_feature (211)..(212): n is a, c, g, or t
  misc_feature (228)..(228): n is a, c, g, or t
  misc_feature (237)..(239): n is a, c, g, or t
  misc_feature (252)..(252): n is a, c, g, or t
  misc_feature (282)..(282): n is a, c, g, or t
  misc_feature (288)..(288): n is a, c, g, or t
  misc_feature (303)..(303): n is a, c, g, or t
  misc_feature (305)..(305): n is a, c, g, or t
  misc_feature (309)..(309): n is a, c, g, or t
  misc_feature (312)..(312): n is a, c, g, or t
  misc_feature (319)..(319): n is a, c, g, or t
  misc_feature (326)..(326): n is a, c, g, or t
  misc_feature (329)..(330): n is a, c, g, or t
  misc_feature (332)..(332): n is a, c, g, or t
  misc_feature (336)..(336): n is a, c, g, or t
  misc_feature (345)..(346): n is a, c, g, or t
  misc_feature (348)..(348): n is a, c, g, or t
  misc_feature (353)..(354): n is a, c, g, or t
  misc_feature (358)..(360): n is a, c, g, or t
  misc_feature (368)..(369): n is a, c, g, or t
  misc_feature (373)..(373): n is a, c, g, or t
  misc_feature (376)..(377): n is a, c, g, or t
  misc_feature (380)..(381): n is a, c, g, or t
  misc_feature (385)..(386): n is a, c, g, or t
  misc_feature (388)..(388): n is a, c, g, or t
  misc_feature (391)..(391): n is a, c, g, or t
  misc_feature (400)..(400): n is a, c, g, or t
  misc_feature (406)..(406): n is a, c, g, or t
  misc_feature (411)..(411): n is a, c, g, or t
  misc_feature (421)..(423): n is a, c, g, or t
  misc_feature (427)..(435): n is a, c, g, or t
  misc_feature (440)..(442): n is a, c, g, or t
  misc_feature (453)..(453): n is a, c, g, or t
  misc_feature (459)..(461): n is a, c, g, or t
  misc_feature (465)..(466): n is a, c, g, or t
  misc_feature (473)..(473): n is a, c, g, or t
  misc_feature (476)..(478): n is a, c, g, or t
  misc_feature (485)..(487): n is a, c, g, or t
  misc_feature (491)..(491): n is a, c, g, or t
  misc_feature (499)..(499): n is a, c, g, or t
  misc_feature (502)..(502): n is a, c, g, or t
  misc_feature (511)..(515): n is a, c, g, or t
  misc_feature (517)..(517): n is a, c, g, or t
  misc_feature (521)..(521): n is a, c, g, or t
  misc_feature (526)..(526): n is a, c, g, or t
  misc_feature (532)..(534): n is a, c, g, or t
  misc_feature (536)..(536): n is a, c, g, or t
  misc_feature (539)..(539): n is a, c, g, or t
  misc_feature (543)..(544): n is a, c, g, or t
  misc_feature (552)..(557): n is a, c, g, or t
  misc_feature (565)..(566): n is a, c, g, or t
  misc_feature (570)..(572): n is a, c, g, or t
  misc_feature (580)..(581): n is a, c, g, or t
  misc_feature (589)..(589): n is a, c, g, or t
cccaatttcgaattgctttgtttggtcccatttttgctggcgannngagcanccancgcncactncgncaccaatttggcganngagncgcgcaagganncgggcnncancgacacncncnccncaagggcnangcaaaggnncgcccnncgcgccnccnnnnngaacgcanccgcccccaanncgccgaanncanccgccgaanaaaccnncaaaaaggcaaaaaanagaagcaannnagaagaaaaaacncggagggacaccgaccagcgaaagggaagnccagcngaaaggcacggcgangncaancancgcccgngccgggnaanngncacngggcaccgnncngaaanncccnnnggcacagnncgcnaannaanngcgnnangcncgagagcgncggcgncgagncgaaaagagnnncgcnnnnnnnnngcaannnagagccgcganaagacnnncgcnncgagcanaannngccaaannnaccncgcaaaanacncaaaccgannnnngncgcnaaggnccgcannngngcnggcnncaaaggannnnnncagcaaanngaannngagaggcnnaagcgaanccaaaagttgttctgattacctggactgacttggacaattcgaaacagtcgaagcaaattggcaatctttaaaaggaagaaacagttacagtaagaaccgttcgagggtcagtcggacctgtacagtaacggatgagtaactcgcgcccaccaccgccaccacactcttttttgggctcgggtgccgcagcgtcggctgtctaccgtctgcgcagctgtaatcagttagttcggatgagccgatcatttcacggacgaagtcgagcgattggttaagcgcataggcggggtttgaacatgaatcgaggatcaaagcaccctgaccaagtcaagtgggcaattcggatcagaaaacaagtccgatcactcaccaatttatagccgcgtaggaagtcggtctgtgcgttgatcatgtccaaagcgtagaggaaggcctccactcgatggacgcccctgaaaactgggcatcactttgccaattcttggccacccctctctgtccggtcccgctcctccaagtcgacaacattctcgactgacctcgtctcgaatatttctccgcagggcgaagtgccaccgcccttcgcgtgaacggggaatactccgccgattatcaaatccccggggattctcagctggcgcatgttctccgtcggttgtcccccgaaaacgcccccggcaccgtccactgcttttgccaacatatgaacatgggtcaaagtgcgaagtgtcatcgttatcaaagagaacattttgagcaactaatgatggggtggccgacaaaagtcaaagcactttttagaataaaaaattcaattaaaactcattaagttaataaacccaaaaacaaataagtgaaataattggcccagtgctaattggttatatttgctttttaaaattggtttttattttcactcttcagcatttgcttctgagcatcttaagctttgctttatgaagagtttgaactggcaacagatgcaaaacataagtcataaattaatgccatcattaaaaaagttcaaaagaaattaatttgtaagcattgaattggacgaggcacacatttaaacttttttacgattggcagaaagtcatttgttagtatcgcttatgggaaaagcggtgggaaggaaatgaaatgaattattcggtggagacaaagccgagagagagagagagagaaagagtcggtggcgtgggattgtcctttgccctgccaagctcaatcccattaagaatgagcataatgtgcggtttgaagggggttattacataaaaaaacattagtaaatggggggggggagaaggaatcggatggagggagtcaattggcggggtttttaattcaaattttaaaaacgaatgatttctgtaattcattagtctcttccattcgctaattgccatttccttaattgtctcacgtttatgttgaagctgaaattgcccaattcccatgggaataatcaaaaaaaacattaataatcaaagtttagcttttcggcaga

SEQ ID NO: 17769 - DNA, 1009 bp, Heterodera glycines
tgatcagacaaatgtgtcaattccaatagatgtgatcaatgaaagtgccaattcactgatcagtccattagttatgccaattgcacacagttctgcagctgatcaagcccatccaccattgtcagaaggtacaaccaataccaatttgacaagcgataaaagtgatcagacaggcccagaaacaccaaacagtcaacggaaacggtcaagacagcgaaagcaaagctcaagcaatatccagcggactgaatttttaggatttgcatcaacagaaacggaaatagcagttatcaaacaaaaagatcaaagaaatgatcaaccaaggaatcaaagaaatgatcaaccgagtgatcaaagaaatgatcaaccgagtgatcaaagaaatgatcaatcgagtgatcaaagaaatgatcaatcgagtgatcaaagaaattatgaattcaatgagcaacaaagttatcagatgcttggactttatgatcatgatgatcaaaatattgaaccaatgtttgttgacacaaatgcaccacaaatgatcgatacaagcgacttcgatcaaattgctcaactggctggtgacgatttgatgttcccccatccgatggaggtgtatgacgagccgaacaatgccgaagaacaatttgtgatgatcccggtcggaaacagcacacaacaaattgcagcagaaagtgttggcaaaacaaaaagcaattcaaaaagtgggcacggaaaaagccgtcaaagtgctgatcagagcatgcgcgactatgcttctccatcaattcaacagaagcaaaaagcgggtcggccaaaaaagccgaaaattgacgagaaaatggaaaaggccaaatcaaaaatgggagtggaagaagcgctgatcaaaccggcaaagcacaaatcaaaaatgacaatgggaaagaccactgatgagaaataaatcaataatgattacggaaaggaccacgatgaaaaccaatcaatggtgaaagtgagagatcaatgatgaaaa

SEQ ID NO: 17770 - DNA, 935 bp, Heterodera glycines
aaactttagatttaatagaaaaaaacaaaaataaataaggactttaaattcaaaataaataaattatcaaaattgaacaccctggaaaattagacaaaatgtcataattaacaattacccaaacacctgtaaaaatagttaatgtgttcattttcttttgtccaagtccaattttctggaactgccgaactttttttccaacttttgaaatattacaaaatatttttctttttatttgaccaactaaaaatattctttaacgatttttcacttgttacacatttggggtgtaacaaaagttttgtcccccgaacattttttctttttaaaaatcatatctcctttattttttcatatatttaaataattccttttttattgtgtatcctttgctgccttttctttaattttatcttttatctccatcgttaaacttttctattctctgtcaattttttcacccttttttcccgactatgccaaaattgtaaattagaaaactaaagtttctcgaattttttaagcttaaaaacgaaatctgaataacaataaacgaagtttttctgtacaatttagaccagtagaatccgaatatggtcttaaatctggcctatctttgctacctgagcttgtactgcttcaacttcatgcatgaagttggagctgtacaggctcagggggaattaagagatgaaatctatagccatactcgatctcagcgtggtcgatttacccagtttaattaaattcggaatttccaagaccacttttaaaacattttgttacttggtggtcttgaaaaatgccgtttttggagaccactttcagactcggtcctccaaaaattcaatttttatgaaacaaaattttatattttactaacttttctctatttaatcactattaataggaaactcaataatgataataatgcg

SEQ ID NO: 17771 - DNA, 1102 bp, Heterodera glycines
  misc_feature (52)..(52): n is a, c, g, or t
ttttttcgaccataaggcttttaattgtcgccaccgccttttttgtgtcccnttattctttcccatgcaaataaaatgaattatttatgaaaataattttcgaatcaaagtctattcattggagtcaaaatgcggtatttattattttcaatttctgatttttatagttatttgttttaatatgattttgtttcaatttttatacaattatttttaattcaaaagattacttcatttcatttttgcattaataatcatgtccctgttagactgtaaatatgagttagagaaaatgaaacaattgccgagcatttgatgcctgtataaatttcgattaataagtatatcttcgatttgtaataagtgttgattttctttaagtcgattttctcactacttaattttattcaattatagataaagcctcccattattttcaaatatatatcatataatttttttagtttatatagaatttcgaaaattattttaaatttgtaatatttcatttaaatttgcaacttggacctagcctttcattacctttaatgaatatggtatattattattttctaaataatttttttatatttatttatttaatatttttttaatttccatatttttttatttattgtataactaagcctcgaattcccgtagattaatttattaaaaatgcggtcgttcaaaactgacatctgttgtccgtttgctccgattttttgagggtctatgaagcaatattttaaattctataaaattatttaagcataattttttttattaattttcttgttgttagatgaaacattattttaaaattaattttattttttttatttgattttatacatttattttaaaaggaacaattaatttttaacttgtcatatgttttattttctgctattagagcaaacaattattgatctttttcattattattgacaatgaaataaatataatgtaattaaattttttttgtttatttcattaactaatttaaaaatatgctaaaattttttcctgtaattaggtttcattactgttactctaatttcttataattacttttttcgtattcattaaagcaatttta

SEQ ID NO: 17772 - DNA, 1742 bp, Heterodera glycines
  misc_feature (92)..(92): n is a, c, g, or t
tgtaagggatggcccaccctaaaacaattttcattttcctcagcagtcggactttccactttccattatcgcttttcttatctctttcatcnccgccccttttccgttcccttcacacttttcctttccccagcgatcagtcagtcgtcggagtcattggatttacaatcgatcaattaattcacccttctcatatcgtccgtccatggaatatttcgatcacatattttatccggagaataaattagtcttttaacatcgaggcaatttgggggatttaacatcgatcccagggcccgggattcatcctcccaaatcgtcctccccatttattcggaagcggtgagtcgtctgggggacccacacgcctccctcactgtatttagtttgttttttttaattttataaattttttaaacagaatttcttttaataaatccatgtagcttgtgacccttttttccgcacgtcgattcgaactgcaaacgtttgttcattttagcgtaacaaaataacttaaaacatttttttaattttaaataattttttcttattttaatgttcattttaaaatagttttatttattaaagaattttgaaaggataacttatttttaaattatcttcattgcttctgtttatttatttttataatttgttattaaaaatatattcagcgtaaatatatttaatttcaaaactaataaggtcataaagtgcaaaattcgatttcttggactggaagttgtttgtgagctcgaccaggtgtgagtgttttgatgaattgcagatcattgtcgattgtcttttttaaaatttatatttaaaaaaaagttcatttttttctttgaatatttaaaagttttaaaaaatatatttaattaacacctaaattgcttaaatactttaataattttcttatatttatattttagaaaattttatgtataaattaacatttgattattgttaataaaattattggacttttatcttgccgcaagaagcagcaacacagctcggtcaagcactaaaattggctatttccgcgctcgtaaaaattatttaaatatttattgtattattaaaaagaattaagagggtcctgacggtatcgacgtggcaaaaatgctttattggagtagttcatttattaaaatactcgttttatattttcatccattattaccattttttggtttatatattcattaaaagatattttgaatttcttcatttttaaattattttattcttaattttttttataaaatttaattttcaagcgataacatttaaaagtagaaatcgacattttgaaaaatgcctggacctggacctggatttcctggacaaaaatccaggaaaatccaggtccaggaaaaatccaggctcctcgagacctggatccaggcctggacctggatttttttaaactcattttaaaaatcaaaaaaatgtttgaaaaattcaattaattgcttgggaacatctaaaaatatctaatttacaataataatttgcttttaaatatatttaatcattttttgaaaactttaaaaaatatcggtcacttgaaataataaattctaaaattttgtccaggaaaatccaggatatttcctattttgcctggacctggattttttttcacatttgaccatggacctgcaaaaatagtagaaattcctaactgtataaattttattatatgctaaaacaaacttacatttttatatacc

SEQ ID NO: 17773 - DNA, 2888 bp, Heterodera glycines
  misc_feature (212)..(212): n is a, c, g, or t
aaaacatgacgtaactttgctaaagacaatataattttacatccttggtactattcgatagcccagctttttctctattagcctggaaaacttcaaataaattataaaatttaacacaagttatgcagaaatagtacttgttttcatacaaatttttttatcgaaaaattcgctaaaatggcggattttatgaaatgcctaacaccgccccnaaggacaattggacagtgggcatttggacagtagagtagattttcttttttttgtcgatttatatatatttctttttttatggcgtatattcctattttataatcaatcatttatcgctggaatttaaattcttctgaaaattgaatagttaataattttttacgagaaatacattagttaaaacgaaactttttgaaacagattttatcaaaattttacaatgccctccggaaccacccctttttcacttccgatatttataccagtccttatggcaataaaaaaaagatataataatatattttctaaaattgtcattgattttgttggtataggcaataattttgatatatttctttttaattgtttaattgattgttttttatttcgtgaatatttttcgcatttatttttccttttcctacaaccacagcaattgtattaagtatttatttcaatttttatttaacaaataattgtaaaaaatataatgaattgcttttcgcttctattcgttttggctgcaataattgttcattttaaaaaaggtattgcaataaaaatttgtatgcccaatggtaaccctataagtgaccaacttgagcttcggctggaaaggcgacatgaagtttgggcaccgggaagtttgggcaccaggaagtttgggcaccagaaatttgggcaccgggaagtttgggcaccagagggagggatttcaaaaaaataaaacaatataaatatataaaatgttatataaatcattaaaatttagtaaatttaacaacccttgtgctcaaaaatttctatgttcttgaaaattaaaaagtttttatatggaaacctggcattcttattatttagtcaattcttacggttgtttaaacgtagaattaaacatgtactggttatggacttagaccctgaataccgtcttagttgggcccgaaatgacaagagacccgtctaatactatttaaatttataaattttaaatcttgaacatactgagccttgtaatgatacaaataatacatatatatgtaaggcattttatagaatgaatggtaatcagtttagcaaaataagcatgcttaatcgagtgaatattcgttaaaaaaactttctattcgtaacttgattaaatttactatgcttttaaaattagaatggatgcaatttataaacaattaaaaataattttatttttaaaatcctaaatttagtgtccaaacttccccggtgcccaaaatttctggtgggcaaacatttcgggtgggccaacatctccccccccccccccccctttttgagtattagtgcctattttctaggcttttatttttagcgcctaaaaagcctaaaaaattttgaaagaggctatttttgcctattttggcgttttgccgaaaatttgttaacaaaaatgcaataaaaagaaaaaaaatacacccctaagaatcgatttttttgaattttaaaaatacatccctaagcagagattcaaaaatttctgaaaataaatcccctaagaaattaaaattttctcaaaaatcgtctttaaaaatttttttggacaattttttgaatttaaaaaataatgtaactcaatactgaactgacttatttttttaccatttgaataaaattttttcattttacacccctaaatttgagactttttagagcctattttccattttttggagcctattttgggggttttttagagcctaaagcctacctattttagcggtttttagtgcctataaattggagccctagtcatgtcaatttctgcatattttttctgatttaagcaaatttgaatttaaataaaaaatgcccaattttttaaatttttaaacataaaataaccaaaatttttgagttttccatttcaaggacagatactttcaatgtttcccttttcaaggacccatccaatgcgtctcatcgtacctttgctggctctgttcttctggaaaggcgcagtttagtgctgattgctggccatgcctatcaaatgttgcacggcattgatgaagtgtgtcgctaacagaaataaaaaattaattaaattttataaaattatgtcatttttaaaatttattttagcgaaaaactgatcaaattgggacaattggtggtgcttcattgttaaatcgaaatttgttgtccaatccatcaatcaattggcaagagcttattagggaaacgaggtgggggcagagaaaaactaattattttaaaccctcattttttcaaaatcaaaaattttatcccacccccaaattaaaagctttacataaaaatatatttttttgaaattatcaacattttttgctggctttttaaaaaaaagaaaatgccgccgaaagaaaattttttttgaaaatatacatgaatttgtttaggaattaaaaaatcaccaaaaaaatgttacacctttagaaattagaatttttatggaaatatagagaattaggaaccctgtataaaaattatttttaaattattattattttttgtttgctagggtgtcgctgaccattcgcaatgtgccaatgacaaagcgtttgccgtcgatgctgaaaaacaaattgtttggtggtgcgggaaatcgttcgaataaatgatctttttcttgaatgttttgtttcttataatttattctt

SEQ ID NO: 17774 - DNA, 1391 bp, Heterodera glycines
ctagtgcatttctcattgtgaatgtcttcatatttaaactcattcacatgattgtaaatgcgctggtttgaccatggaattgtgcgctaattaactaattacccaattagcatttcctaattcggcgtaattcaccagcgttttgatttgacatcaaaagccactcatcagaatattaagatactgtcatcatcaggccttctttttatgtaagaaaaatcgcgaaaataaaaatgacctaaatagacttagaatcaacttttctaattgttgatatctcatttagcttcaaagggctttcgatttttcatttttagtctaaatatgtttttaaatgatcttttattgaagcaacgatgactttcagttcgtttccgtgtatcaaaaaagttttgaacaaaactgaaatttgaaacatttgaattttcgactttttcttcaaaatctggtctgggcttcgcaattgattgaaatggatgccggattcctgatcagctatggcacttttatacgtaaagtaaagggtggacagaaaatcggagatgggtcgaaaaatttaaacattaaaaatggataatttatacaaattcgaatataaatgtgattttttgaaaatattggattttggctttttgtttggtccgtgatttcgggtgcttaaaatgaatatcaaattcatgaatcgatctgtgacccaaacagctcagtccttttttattgtctgacctttttgagggactctagactataagtctgccctaaggcccccaaacctttgcttttcatctttcgacccctattacttttatatcagcgtttaacatttattctgttttatatacaaattgtacatacattaatttaaaaggctcattagaacaacacaatggacaaggacaaattatgtcgtatatacagcgatcgtttttcactccgtcttagaggtgttgccactccagtacgagatgttgtcctgcaacagtcccatgatcgtgacggactccgcgcaaatactctcgcccgttgtctgcgcatcggaagtcgcgtcgtcataagcctaaaaaaaattcgagcggttaaacttgaaatacaaattttctgttcatcaccagttgggcagtttggcaagcatcggctggtgatttctgcacttcgaattggagaatggcaaagttcagcgccacggtgagacgaatcggatgcattggccggagtttgttcttggcgaggtcgaacgcttcttggtacgcttgctttgccttctctgcaacacctgaaaattgaccaattgttgatccaccgtttgttcaatggcttcggtccgtcccatacattcacaaggtgtgtctcagcccaagggccatacgacggatgattggaaggggggggtg

SEQ ID NO: 17775 - DNA, 1682 bp, Heterodera glycines
ccctagtgatcagcgatcccgaaaatcactgcctgaaaaatcaattttggttgattatttcgtgcaaatctcaaaatttttgtgtttcgttcattttttgccatttttatacgtccgatttatttaccaatttagacattatttttcacaaaatgcatttgatcactgataaattatgatcgatcgatcattcttaattaatccatttcttcttctgcggctgatcactttttttgttgttttgtccgtcactaattgtcagcagaagacgccacttttgtgatgctttgtcccgtttcttctgccggtggcggagacaatggccttaattaagcgcaatttgaattatttaaacaaaattaaatgcctttttttaattgctcacccaatgcaattagtgccagcaaaaagccaaaagtacacattgttacaattgttgtcccaatttccgtctttccaatgaaccgccgcggactccccaataattttacaacgcttcattatccaactgttgtcccattcattttccttttctttggtcaatgtcagcttttcctttgtccattcgttaagaaattcaaatggcactatttgcattgactgcacacgaacagaaaaatgaatttggtaactgacggaagaaatggcattggcacggagaaaatgctaaacaattgatttgaaacggcgacattttgttctgctcccccgcccctcgggaccacacctcattgaaattgttgacccaatcagtagtgttcctttgttcgttgtaatttgcgcaacgcaatcgcttgggttggccatcttttctcggagagtgcaaccatttggacaatgcttggccagcagaaattgttgcatttggcccatcaaaatcatcaccaatcgaatcaggcaacaaatcataggaattgattgaaaccaactgattgagatcagtgaaaattgtcggcgaagtgcgacgaagcaaatagtccaaatcatcaccaccggtaaagcgcaagtggcgaatgtttgtcgaaaaaattggccaaatttcacgaattaaaatgtcccaaatccgctggccatccgtggtgtctggtgatggaatccacaaatataaattggtgcctcttttgtcgaaaatttggtgatttgaacgaagaaaagcgatgacggagtgatccatgtacctaaaaatggaatgaatgcttttattgccataaatctctgattccgaattactcaatctgaaggcgcttaaaacggattttgctgggcaacggacgatcgtcgggcaatggaaatgacaaagatttgtcatccatttgtacagacagcttcggttcatgtcctttgtccttgtctattatgatcgttctccaaattgtcaattcgcttttggcatcgaaatgtttgtccaccaacgcattgaaacgtggcgaaagaattgccaatttgaggccgagttgaggacggtcaaaactgggcaaaatgtccatccaaacgtcgttgcaaatccaactgaaatgggaaaacagtttagctaaataatgccgaatttagacttttaaaaatgccttaccgtcggttcatttttggcagcaattagcacaattaggccgagttccgaatgatgtcacacaaatatatagcagaaaaattaatttcgttggaaactttttttataatgagag

SEQ ID NO: 17776 - DNA, 2979 bp, Heterodera glycines
atcatttttagggtttttaattaaattaaaatatttttcttttttaaattttcttttcaattaaattacgtatttaaaaacatcaacaaccacaacaggtgttccaacgttatttggagcttgtccagcaccagcaacgcgtttgctttgccggcgatgaacaccaacagcaaaatgacagtactaatggttacagtaacaacgagccagccgggggtaattttgccatcgcatttcggcacttttttcttgacttttttctggcatacttagaaatttattagctggatttttatcactatgattgaaatttccggtttttgttttacattttggcactttaaagcttcatcattgatagaaaaatctattctattttggcatttttatagagggcattttgtatcctgcataattggaattttggcttaattgatcatagttggacttctcctgttgcttttgccattctggatgaattttcttttcacttaaacattggtatctttggcctaatcattggtcggattttgtttttatttttagcatttttccttggcttaatcatagatgggctcttctcttcccatttcggcactttttggtttaattacacctatcaaatgcatttcctgttccagcttttccgttccattcttttggccaattggcgacagccgcttcttcctccacacccacttccaatggcttttcctctccatccgcggcacaacagcagcagcaacaaccatctccgtttctccagccgtcgcccgccggcctcatggcagccgctgctgcggcagcggctggcaccaacaacgacggcacatttggccacctgttttcgggccagaatatgttgctgaacagtttgatgggccaacaatcggctagcggcggcacagcatcctctacctccatgccgtcgtcgcaaatgggcgatgccgtgccatgctcatcctcctcctcgtcatccgcttcggttccgccctcatccgccggtggcacagcaacgaccggggcggctggcggcacaacaatgggcagtggacgaagggtaattaatttttttaaataaaattccgaaataaaatttgccaattttgtggcaggctaatcgcacacgcttcacggacttccagctgagaacgctgcaacagttctttgacaaacaggcctatccgaaggacgacgacttggagatgctcagcaaaaaaatgggtgagtgattaaattataattctctttgatcactcttgctgatcaatttcaatcctgatcgctctgtccaccggattttttttaaatctgtgatcagttctagttttggttttctaatcaccttttttcttctaatcactgatcatccctcatttttacgcttgaattttcccactcaaaacactttttttctgatcactttcattggacaagtccttcttttcaatactcgttttgcaataagtaatttgcctcttccggtgatcactttatcactcttttattcccactgatcagaaacttttttgtctttctaattaccgatcacgttcacttggctctattgctgatcagtgatcactttttgtcaaaaaccatatcaattcaccattgctttgctttcataacaggtctgtcgccacgcgtgatcgtcgtttggttccaaaatgcgcgccaaaaggcgcgcaaggtgttcgagcagcagccccacctgctaatgcatgccaatctggcagccggcggcggcattgccgggcccaccgatctgccagccgatgatcagcaacagcttcagcagcatggtggcaccaacttcaacccgttcaacaatgccaacaacaacagtagcgtgcagcagcagcaacaacagcaacgctttgtgcgtacgccgtccgccaatttccaatgtgttcgttgcaaattggtgcggcgtttaattatggctaattaactaattaattaccgattggagaagttttaaaaaagcataaaggaaggcattagtagttttctatcaaaaatgataccgaaaaactatttgcgcttgtccattatttgtatatattcatggttttggctgcaaattgatgtaacatttaattagggtcattaattaattaaatgttggaaaaaatcaattaaaaattctgggcggactcacaatttgaatattttgaaaattatcatttttaaggtttttaattaaattaaaatattttttgattttaaattttcttttcaattaaattacgtatttaaaaacaacaacaaccacaacaggtgttccaacgttatttggagcttgtccagcaccagcaacgcgtttgctttgccggcgatgaacaccaacaacagcaaaatgacaacagtaccaatggttacagtaacaacgagccattggtgtcttcatcggcccttttggtggacgaacaaaagcagcagcagtacaacagcaacaacaacatgacgacgacgtcgagcagtaacagtaactacaactgcaacacaaccaccacaaccacaaccagtgcagcaacaacagacgcaacttcttctgcagcaactgccgcaacaatgtatgcaatggagcagagcacgcaggagttactgcgccagctggtggccgcgcattgtcaccagaatttggggccaacgccgggccatggccatggccatggcgatgatgatgaacatgaacatggtgctggagatgaatatcatcatggtgatgaggatgatcaacaccacgaggaggtgtgcaggaaatgatgaattttcttttttacataggcactttttgggttttttgtcggcgaattttgtcccaagatttgggctcgaaatcaggattaacagtgcttccaagttttactgcattgaacggttggcgatttgatatcacgaattttctagattttcaaaatttttagagttaaacaaatttttgaaagggaaattgacctcaggcagcaagct

SEQ ID NO: 17777 - DNA, 1456 bp, Heterodera glycines
  misc_feature (11)..(12): n is a, c, g, or t
tctagagtcanntttttgaaaaatttaaaaaataatgaaacctttataatatgtttttgaaataattaattacctgttgcggtgcagtcagtttttgagcagaaatttcttcctcgcggacattcatcttttctggtggcgttcacattaattgtgtcaaaaatgttaaaaacaatgcccgaccaacactgaagcgctacaattaatttatttcaatgaatattaattatttgcttgagtcaattaaataattaattaaacgcaattaggtgcatttgtaattgtggcacttaccgtttactttttgtgtaaaactcaataaaacaagcaataaataaaaaaatgatgtcattttgttactggattatcatttaattattactgacaagcaattccgaaccaaaaaaatacaaaagtaatcaaatcagaggcatttttagaaattcgtttaaataaaaatttacacaaaaatttaaaaataaatttataatttaactatttaagaaaggaaatggggaaggcaatttctttgttaggataaaattaatgggagaaagcaaatcagaagttaaactaatcaaagttatcacataactggttggtccgtcttattattcattttattgctcgtgctctttcctccaattaactaattgggggggggggggagcatctgctgattggaagagttaatttagttcaattgaccattgactatcaaatcagcatctgtttgatcaattaattaatcatttacgatttttcataagcagggattggattaaatatgataattgcatttttattcgaacattaattttcatttttctctaaatcaagtgcttaaccaattaatgaaatttggagaaaatgcaaaggaataattaaactaaagttaaatatagaaaaacgagaataacctaaaatgaaaattcttccttttcaattcctacttaaattttttatttttcttattgcccgtgatcagcgtttgtctaaaacaaattattttaatggctttttctttcaaaaataattgctttcatgatgaatatctgttgactaagcgattggtttcaaattataattataaattttattagttttagaaggaacagttgcacagttctcagccatcggttgcacattttgccgaagaattaaaattttgaaatgttttgcttaataaaaagggaatgtttaaatacatatagccaaatcataaaaaccgataaatttacagacattaattacacctgaatcgccttagcgaataatttctgaaaaatctaaaattggctaaatctaaaaccatttcaaaataaaaaagcgtaattttttaaatttaattttacatttagaaattgtctttaatgaataataaaattgttgcaatttaccaattctcagcgcgtcctttgcaaaaacacttcgatagcttttgattatgtaaatt

SEQ ID NO: 17778 - DNA, 1682 bp, Heterodera glycines
  misc_feature (23)..(23): n is a, c, g, or t
  misc_feature (93)..(93): n is a, c, g, or t
  misc_feature (706)..(706): n is a, c, g, or t
gaaaaaatttcattaactaatgntcagcagagtgaaaattttttgccaactccaaaatttaataatgataattagaaaaaaggcaccgtaatntaatggcacatgacgggccgttagaactattaagtgatcttttgataacattaatattgcaataaactaattggtgaataaggcaatgaaattctaaaggataaatttaaatgaatttttttaatttaataattggactcggaattttgaaaaaaaagccttggtctgggcctggattacatttttaacccttgacctggcttcctgtacaaaaatccatgaaagtcaaagtcaaggaaaaattgccgagacctggatccaggcctggatctgttttttttaaatttgttttaaaaagcaaacaaatatttgaaaaagcaaataatgcctaggaaaatttcaaagtatcgaattgacagtatatttttaaatctatttaccggatctgtacctggattttttttcatatttaacctgtatatgaagacaaaatcggtaagaaacaattcacccaggcaagccaatcgaaacaacctgtccctcccctcctaccttccttaaaaatgtctgagaaatttcactaaaattcaaagcacgagaggtttttccagaaaactttcaattgctggatttattgaaaaaccaacaaaaagaaaattaatttaaccaattngacaaattgctattgtaaaaagctcaacaacattcaaaatctttgtcttacttaatatgataacatatcgcatgagaatgaatttggtcgagcagactttatgcaggaattttaataaataaataagtgtatatttgaagggccgatatttttaggatgctaaaaacccaaaaatggggcggggccttgggaaattaattatgacaattttttgctgaattttttattttgtatctgtagtagtgggctttattcttatcacatattcctattttatgtctttatgaaaaaaggaaaaccctaaaaatattagccctatttccggcatctcacagcggttgacgacgctcactgcgcggtatggtgcgcgcgaagttgtagcggcacacggggcaattggtgtggtcgtggagccagcggtacaagcagcgatgatggaacggatgggtgcagccgagcatcgtccgcgtgatggcgctcacgtttctcatgcgcgcatcgctcgccccgcatatttttcagcagctaaaatttggaagaactcattttttttttgatttttattaaacttacatttcctgcgcgtccagctgccgccctcctcagcttggcatcgcgcagcttcgccttggcactccgggccctcgccgcgtttgctggagtggtcatgctgaagccaaaaaagtgatggaattggaaagacccagaaaattagaaatgaaatttagaggagaataagcgctgaataaatgtgatgtgaatcgacgaatgggaggggaggagagaattgggaatgtgaagagaaggaaggaaaactgtgagtggaaggaaaagagttgtgatgagtgtggtgagaatgtgcgtacattagcaactcggacatttgagtccgaacatttgagccaaaaacaattaggcgtaattgttttggttcaaatgttcgagacgcaaaagatcgagggagcaaatgtcactt

SEQ ID NO: 17779 - DNA, 2181 bp, Heterodera glycines
gggggcggggttttgatttgaattaactccaaaaaattttacaaaaaattaattttttatgaatgatgtgatggctccacattcctttagtcaatgtatcgcctcaattcaattccttttggcataaattacacagattttgtctaaagaattaccaaattttagagatttttggctaattttttaagaaaaaataggtttttggggggcccgcggtgccgataggccgccaggcagattttgaaatttaagctcgatttctaacagatgtttacaaaaaaaaatataagatttttacgataaatttttgttttttttaatatattaaattatcatgatttactcaagcaaaattggaactcagatttgtaacatattttcttgtggcacatttttccaacaaaaaaaaaacttggtgaatgtgcgagcgtagaggtccggcggtgcagataggcgccgccgggaaaattttttgaaaactgatggatctgttaattgtccaaaaaatgataggtttttgcaatttttagagaatttttttaataagatttacgaatttttgggccctgcgatgccgataggaagcgccaggcgaattttaaaattaaaaaaataaattaaaaaagaaaccatcaacctgaatcgaactcacgacagaaagtaatgtcaaggttgattcactaaccactacaccacactacacaccataaccaataataaattaactttaattcataaaaaatttgtcaaaatggttaaaaaaaatcaaaattgtataaattttttgccttttatccatgaatatgtcattcttaggggtgtattttcaccccctgccccccgcgggggtgaaggtcgcgggggcgggggatggcgggggtcagagtcgcgggggcggggacgggggtgaggccaaaaaacctgtcccgcccccggcgggggcgggggtgacgggggcagggtccgaaccctagaaaaaataatttgtccaacgttaaatgaactaaaaaaacagcattcctttaatttttaaaattatcaaagaatcttattaaatgtataaatttcaagttttctcaggcgtactcctcggcactgccgggttcttgagatttgaaaatttcaagaaaatgccaagtttgcaaaatttggccacttttatcatttctaaaaaattttctcttattttttcttctagtaaaaatattaagtttttcccaatttatatattttttacttctaagaaaatatttataaatcattgttttcaaaaaaaaaatccattttttaaattattttactagaaaaaattctaagaaagttagagaactcaaaaaatttccgcttttttcaaatttttcagaggtagggcaatgatacgcggtaggggaacggtggtggaacgtaatgccgcagacagaagctgcccaatgctctctcttcgccctcgggggttgtcatttatataaccacacacatgttggccccttctcccatttcaccttttctcgactcttaaaaagccctcctgctggggctctcgagaacaacacagcggtggccctgcattaaattgcctcgggcggcaaaatttgccgccggcggttggcgacggttgccaaacaccgccgccacccaccccatttcccccggggcgctttctccgccccggcttccgtcccactccccagccacgcggcttccgcctgtccaaccgcgccgccgcccttccggcgttcatagaagagcgaccgtggccaaaggaccaaaaggccataaaatgtatatttatgctgccacatgccgtacccaacacatacatacatcccacatttgttgttcattcgtccgcaaaatgttttattttttggccaacaaagggcgggcaactcagcgcggtgacatttgagtcccgagctccggcgtgctctgtggatgagttaagcccaaagaaatcggacattgtttcgtacccattgggaaaaattgttggtcggacattttgtcgcattggcatttccgcccccatggaatccatttttttatcaaaatcagacatttcgtccaaccccaaaatggcgaaaatctgagttaactccgcccttttatcccagcaggatttcctcggtaatttcaaaatctattgaaaaaataacgatcacttcatggaaatgaagagat

SEQ ID NO: 17780 - DNA, 1485 bp, Heterodera glycines
ccgacttaaaaccctttaatagactctgtggagggtcacaactccgtcctgccaaatccgtcccagtcatatgaagccataactttttacatttatgaccaaactcaaaaaatttaataccctttatgacgtcctaaagtttggttgggacggaattggcggcacggaattggcccacgccgaataactgtgtcaattagcaattattgaaattggcttgagtcggcttcggcaaagcatggattagcccaaaaaggacctttggatcggcgcgggactccgaatgaaatggaagcaagccaatttttcagaaattaaattgaaatatgaattgttatttcctctaattttgtaaattttatcaatcaacgaaatatttgtaaacataaataaaacaaaaaaaatttttattattgaacaaaggtccattttatcttaaaaatgaaaaaatcttagtttaaaaatttgagcgtttaatttaattttaattcaaaaaattaaataaaagatttcgtgttttttaatttttgtacatatgtagtcaagatttatcattagggttaaaaaaatgccaaatatggacataaaatatggactaaaaaacccaaaaaatggactaaaaagctcaaaaatggccaaatatggaccaaaatatggactaaaaactgccaaaatatatgttttaaaccctaataaattccgaaaacgtgtttgtattcattatttgcttaaacagtacttaaaaatacattaaaaattgccaaaaaatgaattaacattaaaaaatgccaattttttaaaattaaattctagcttcacaatttcaatccaatacatctcaaaaattattttaaaatttccaaaatttcgaagaaattctcttttttaggggtgtattttttaaaaatttcaaaaaagtcgatcattaggggtgtatttttcgtttttttttgcatttttcttattaaaattttcaaaaaatggccaaaatatggactaaaaacgcaaaaacccaaaaatggcgaaatatggatttattcccgaaaacccccaaaatatggatttatatggactaaaaactttcaccaaatcaaaacattttaacgcagaaatgctatttttgagcccttttcttcatagtacatatatgcagaaaaaatatttaaatccatataatttataactctatttatcatgctaaattttatttatttcatatcccacaatttatctagggtctagcggattaggctccaccgtcggggacaggaatttccccgaccaaatttctcggggatgggtgatgaattaaaaaaaaacattgtcggggataaaggtttataaacaataaaaaaatttgctaattgctggtattaaatgatttatcaacaaaaattaattagccacaattttccactcgtcggatggcatccaaattgtgccatttttatattgccgcatttccgctcttcatatgttggtgcg

SEQ ID NO: 17781 - DNA, 2290 bp, Heterodera glycines
ataatgacacccaaatgccttcgtttgaacctcggcttttccattggtcggtcctcctaaatacataaagcacaattcccattcttcccttgaggccatttggtgtttccttcggccaaaagagggccaacccctggggcgacgaaagaaaatcgattgaaaattgggagaggaaaagctgagggaagaagcgggggaggggggggggggtgggcactgcttatttacttatttatgacaatttcatcgcatggcaaaatgaacgtcgtcaaaaaggtatcaaataataatttgatgcaaaaatgggcttggccggagagtagtctgaattgtgttttggtcgactatcgcactcaatgctttgctggcaccggcactgtctcccaaatggatccgtggcgggatcagcccacaaaggcgtcttgtcccaatgccccgtgcccacagcggtcgtcccgaccttttctggtacagcgccgccctctctcgagggctcccctgctagggaatgccatccccggggggacgggggcaatttctcagaccttcccaggaactgaagcacaggcaacagaaagtgccttttggtggttcctcacagtcatcttccagccaagccatgctcatcaagtgaaaaggtgatcttttataaacgaaaagaaaaataatgaaatttaaatgatgggttagaaaagaggaaagaaaaaagagaaataattaatgctttctctgttttctctcatttcttttccctctctcattgctttactgtctctctttatattttcttttctctcgcatagaaagaaagcaaatgaattacgagagaataacgaaaagaaaaaaaaggaaagaagagtagagaaatgaaaatagtgtgtgcattttctcgtttctctttcctctttttaaactcataaaatattttcttatttttctttttcccttataaaaatgattctctttctatctttttccaagtggtgatggcgttgggcgtttgtcggaaccacaaaacagtccaagcgaagtgactggtcattgttctgaggaaagtccctggaccagcggccgaaagggtccgcgcccaaacggcgcgcagtcggacacgaaaaaccccaaaaggggcccttgggtgaccgaaagggccacgatgcctccaggggaagagcccggtcgctttcggaaagggagtgccgatgttcgtcgaagcgcaaagtgatgcgtcataacggaatagggcttacaacgcccgtcaccaccatttttgcatttaattataaaacattaaaagggaaaatgttcacgtaaccctgaagaggcagctgttactcctcttcctttcttcccattccaattgatcgcttgacctgagtgagcttttcctctgatcattccttaatttcccccccccccccctcaaaatgtctcttccgtcgatgttttccgtgggccaatcggaggcaatttgtgagatttgtggtggcacagtcggtcctttggagcaaaaagtgcaaacgcaaaagcgcacgagttagtcgttttcaattgttaatttgaacccagaaaaagcctaccgaattgtttttgaatttgatgaaaatgggaatttgtccgttcctttctttgccattcgtttgttttaccatttttaattacttttctaattcccgcttaatttgttttgttcttttgaagtgcacagagagtgctttaaatgtgccatttgcgacgttccgctgactgtcggcgcctgcgctttggaccattcgctttgtcgctacgtcggcccgctttggttctgcaacactcacatgatgctcgggtcgggcgagaagtatcagaagatgaagcagaaaaggggaggagcgaaatgaggcgagaaaagggaccgaaataatgaaagaaacggaagaaaaagccaccacagagaacaaatgaaataatgatcagagtgaagaaagacacggcaccaaacacgggctcaatcttttcgattaccatttttggaggaaagtcccggttaaaatgcgatgtttaattgattttactgtgattaattaattatattattggaataaatttggaaaacttcgagtttggtgcttcgaacttcagtttcgggtagaaattgggcttaagcttcgccgtcgagtctaagccgagcttctcccttccctgaaatgttcaagtcgaatagcaagcgaagtcgaagccaaccgacgagcagcgataaaacttcggatggactgttaaaacgtttatctgatcacaacatatgtcatttctt

SEQ ID NO: 17782 - DNA, 2141 bp, Heterodera glycines
aaaaaattgatataatttatttagatcttcaaaaagcctttgatcaagtaccgcatgatcttttaatatacaaactcaaaaaaactggaataactggcaacttattaaattggcttcaggattttcttcttggaagaacctttaaagtaagaataaatcaaaaattttcaaatgaatttcctgccaaatcaggagtcccacaagggtcagttctaggacctattttatttttaatttttattaatgatttgcctgaaaaaattccaaaagaaatctcaattaaactttttgcagatgatacaaaaatttaccattgctattcaaatgaatcccaacgtaaagttttagaaacagctctaatttcagtctttaattgggctgaaacatggggcttatatttttcagtaaaaaaatcttccgtcttatatttaggaaaaaataacaaaaaaaataccgtacacaattaaacatgcaactattcctgaatcaaaaattattcgtgatttaggcattttaattgacaacaaactcaaattcaacgaacagttttcaataattctccaaaaagcttatctcaaaagcagaattctttttaaaaaaattaaaaccaagtcaaccaagacttggattacagtttataaaagttttattcgaccccttttagaatacgcaaccgaaatttggaatcctcgaaccaaaaaagaaataaatcgcctggaaaattttcagaaaaactttacaaaaaatgttttcagaaaatgctgtctcccctacatctcatacagcgaaaggctaaaatttctaaaactttccaagcttgaaaccaggagaaaatatcttgatatcataacagcctttaaaattatcaaaaatactactcaccttaacccaaaaaacctttataatttttcaaataggaagatcaccttttcctattttggtaactaaacgaaaaattaccaaaacagagcactcctttactaacagaaccacaaaacatctacaagaaatctgcaaaaattcagatatttcaatatcaaattcattgcccaccttcaagaaaaaagtaaaaagtattttacaagattaatttcaagttggagatctgtcaccatcatgtttcccggactatcattctcttccgaaagtataagcggcctttgtcccttcttttggacttttattacttgaataaataaataaaattccttttctaattcccgcttaatttgttttgttcttttgaagtgcacagagagtgctttaaatgtgccatttgcgacgttccgctgactgtcggcgcctgcgctttggaccattcgctttgtcgttacgtcggcccgctttggttctgcaacactcacatgatgctcgggtcgggcgagaagtatcagaagatgaagcagaaaaggggaggagcgaaatgaggcgagaaaagggaccgaaataatgaaagaaacggaagaaaaagccaccacagagaacaaatgaaataatgatcagagtgaaaaaagacacggcaccaaacacgggctcaatcttttcgattaccatttttggaggaaagtcccggttaaaatgcgctgtttaattgattttactgtgattaattaattatattattggaataaatttggaaaacttcgagtttggtgcttcgaacttcagtttcgggtagaaattgggctttagcttcgccgtcgagtctaagccgagcttctccctttcctgaatgttcaagtcgaatagcaagcgaagtcgaagccaaccgacgagcagcgataaaacttcggatggactgttaaaacgtttatctgatcacaacatatgtcatttctttcgaactgtaattttaaggtcattatactgtacgtaaaagaataataattattattattattttattatttttgattgtactttaatataaaattatcaatgaaaatataataggcaattatttttttaattaaaagcccctttatttttcgtttttctccacccattaatgaatgaccttctttttcagtgcttcgatttgatcgcttaatttatgaatggggtttttattctgtcattccttcgccacgccattggcggggcggggttcgttcgttcattcaaatgcaattaaaaacaat

SEQ ID NO: 17783 - DNA, 2067 bp, Heterodera glycines
accctcttctacacccgtactatatctcttcactctttttccctacctatcatcaaacacctgcactatttctccacacccgaactgcttcgacccctataaataggctcttcccttttgatttggcatttattgaccgtatcattccaatcattcaaaaaacgcgttggtaactcatttttgtcttcttcactttcattttggcctcctcacatgggttctgcactaacaactgcttcaactcgtcgccgttctccattttcttcatcatgccatcaatataggcatttgtcgacttacaataaaagccgaacattacttcaaatgcatgttaaaattgtttggtgaacttatctttgtattttgcacttttccttacattccaaactttctatgaatgcatgggctgccattgctttcattttccaattttcacaaatttcttttaattctccgatggaattttttccaattacctgcggctcattataaaatatagggttcgagccccgtgggcgggggtggcttttcgcgggggcgggggtcagagtcgcgggggcggtggcgggggcacgataattccgcccccgcgggggcgggggcgggggtttgctttgaattagctccaaaaatctcacaaaaaaaatattttttatgaataatttctttggctccacattcttttattcgttgatcgccttgataatatttattttgacataaattgcacagattttgtctaaaaataatcaaatttagcgatttttgggtaattttttaagaaaaaaaggtttttttttggggggggggcggcgtgccgatagaagcgaattttaaatttatttctaacagatattcaaatttgcaaaatatctactaaaatatgtaaataaaagtccaaacttttgtttgcaaacacaaaaaagaaagtgttttcctactgattaggctatggagaagccaggaaaaaatatgtatttacataaaattagcagccctaatcattagggatgcgatttttagttaaatacctaaaattttgcgcatttaatacgtacagataagcacgaaaaaagcattttacacttggttttgggtgtctacgatgacttttataatacctatttttacctttttggagtttttctacctattatacctatttaaggattttcagaaaattccttaacaaaaatgcaataaaatcaaaaaatacacccctaagaattggaaaatttttcccaaaaatttatttgtttttttatgtaacaaaatttttaatttaaaatgtcaatcttttcgcggggacgggggttggcgggggtcagagtcgcgggggcggtggcgggggcacgataattccgcccccgcgggggcgggggcgggggtttgctttgaattagctccaaaaatctcacaaaaaaaatattttttatgaataatttctttggctccacattcttttattcgttgatcgccttgataatatttattttgacataaattgcacagattttgtctaaaaataatcaaatttagcgatttttgggtaattttttaagaaaaaaaggtttttttttgggggggggggcggcgtgccgatagaagcgaattttaaatttatttctaacagatattcaaatttgcaaaatatctactaaaatatgcatataatagtccagaattttgggaactaacattatatagatagtgcttgcctactgtttatgctatggataagctgaaagagcatagtggaagaagataaaattagcagccctaatcattagggatgcgatttttagttaaatacctaaaattttgcgcatttaatacgtacagataagcacgaaaaaagcattttacacttggttttgggtgtctacgatgaattttataatacctatttttacctttttggaagtttttctacaaattataccttatttaaaggattttcagaaaattcctttaaaaaaaatggcaaaaaaatcaaaaaataaacccccttaaaaattgaaagaattttttcccaaaatttaatttgtttttttatggaacaaaatt

SEQ ID NO: 17784 - DNA, 1441 bp, Heterodera glycines
  misc_feature (47)..(47): n is a, c, g, or t
  misc_feature (55)..(58): n is a, c, g, or t
  misc_feature (61)..(61): n is a, c, g, or t
  misc_feature (66)..(67): n is a, c, g, or t
  misc_feature (73)..(74): n is a, c, g, or t
  misc_feature (97)..(97): n is a, c, g, or t
  misc_feature (104)..(107): n is a, c, g, or t
  misc_feature (109)..(109): n is a, c, g, or t
  misc_feature (115)..(115): n is a, c, g, or t
  misc_feature (122)..(122): n is a, c, g, or t
  misc_feature (125)..(127): n is a, c, g, or t
  misc_feature (129)..(132): n is a, c, g, or t
  misc_feature (143)..(144): n is a, c, g, or t
  misc_feature (167)..(167): n is a, c, g, or t
aaatgaataaaataagaatatttccgttttttcaccttttaagtgcncaacccgnnnnaanaaaannaaaaannaatcattaaaagcccaaggacangaaaagnnnnangggagnacggaangannngnnnncaaggacagcnngaaacaattgtctatcaaaatgnaaaaaaagagattttgaaggaatcattcgagccatcataaaaaatattgttacacctttacatattcctttactaaaattttgttccaatgttccacaaaatcttttaaaaatgggtcccagtttccatattcaatccaaatttatataaattataattttttaggaatatttatattgctttaaggaaaaacaaacaaaaaacaataaaagaaatatgcaaattgaaataaaaaatgcgttttaataaaactgctttaacgtttaaatgctaataaaccgaaaaaagctaataaaacttggagaaaaaaatttgtaaaaaaaatggtatgataattaaaaaaaaataattaaaaaaattattcctttttttttgaaagcggtgcttaccaaatttgttctgtcacactttgaaatatatgtacgttttataaaatgagatgagagggaggggagcagcagcagcagaaggggggacgacgataaatcggcgattgtgcggcagagaaaacagagaaaagcacaaggggcagagagcacagagacagcgcctcactttttttctctgcccctccccccgtacgttaaaatgcacgttctattttaatacatttgctattcatcgcggcacacccacacgcacagccagacagacagagacgcgcaaagacagtgtgttcagcaaagagagcggcagacagacagagtaaaattgttctccccacatttaacacacacacacacactgtgttggcaccaaagaaacgagaggaaaaggcataatagtgcacaaaagtggacagctcccgtgagcgcagagaaacagagtgcgaagaaatagtccagtgtatggcatctgttgctgctgtgttctttcgctgcagcgctaaacgcgcgcgcgtgcaaattgcgccaagcaacgcgcgtgcgtgtcgcggacgaccacccaaaatcgaaaaccaactgacaaagagagactgagggagggtatacggtaggcgaaaggaaaggcattcgtggcgaaaaactcactgctgactgaccacagagaaatgggaagcgaagtaaatgtgctgtgatgatgatgatgagtagaaaggattgaagttgttgaataggaggggggagggaggaataaattaaattaattatgccattaattatgtaaacctatgagattttatttggaatctaatttgagcaccaaaatataagtaacttggatatcatcaaatcccgcccaccaaaatgtatgaaaaaagtcccgaagttagt

SEQ ID NO: 17785 - DNA, 1677 bp, Heterodera glycines
tcagggttcgtatcggacaaactccctttccaaggacgggtataccggtttccaaggacataaggggaaaattctattaaattcaaggacatttaaaaattttatcatatgcaatgaaaattattaaattttatccaaatggtttacatttttcaatttttactagggtaggtcgggaccgggaattttggcgaaaaacataaatttcataaatatttaaaccaaatcacatgcaatcaatcagcagcctagaaaatccccgtggcattttttcatgcattttaatacataaagttttttttctcaaaaaaagttcgctctttgattttccttaattggacgtttttaggcaaaccttttaagaaatcattgtggaattgatgaaaaacttagttcttattaatttttttttatcaaaaatatgcaaattcaagttttataattgcattattaaaaaatatgtacttattttttttgatcagtagggctgggaatttaagttaaatgactttttttttgctgactctaaatggccttaaaatgacttaaaaagtgttctaaactttgtttgaagcttcttctatcatgcattttttttgtgacttttttttgacttttttacactttgggatttttatgacttttttgagtttttgcgactttttcgtgatttttttgacttttttgaggcaaaattcgaaatcaccaaagaaaatgccgaaaaatacaaagaaaattccaaaaattaaaatttcgattggtgaaaagacaatgaagcctggatgaaatttttcgtaattattggcagaatcactttttatgcctattttaggtagctttttaaaaaattaagtgtccaaaaatctcatcgaaatgttattctataaatcattaaaaatgggattttttatctttcgctttatctttcaggacttttttgcattttttcatgcttttttgattctttttgtgactttttggctattttttcaggactttattagtcgactttttgaagatttttagtgacttaaattcccagccctattgatcagtgatgtgcttattttggaaaaaatttatttagcttttttgaaaacctactgaatttccagaaaaaaacgaaaaaacttcaaaaaaaattttgtttttcccttgaattttcttaataaaaattttttcgagttttttctcgaaccagttaggtaagtaaaagtttttgattatttttttttctaaaataactaaaaaaatgtgcgcgacgttatgtcccagcgacgtttcggctgtcgacgttttgtcccagcgacgtttcggcggcgacgttttgtcctgctcccaaaaaaagttgcgaaaaattaaggaatattttcctaaaactttcattttcccccaaaaattgcaagaaatcgtttaatgattttattcaacaaaataataatgaaaaatacacaaattcattaaaattctcataaatttttgcactgtctctgcttggcctgttcaaggccaacctctgctgcaattttcataaattccttcgattttttccaaaaagtcgtgcacgaaactgcgaaggatggcctatttgatttctaccgtagtgtttccaatctcttctaccgtatcctcaatttttcgtgacgaaatttgccgctcaatggcgccaaacaaacg

SEQ ID NO: 17786 - DNA, 1282 bp, Heterodera glycines
  misc_feature (60)..(61): n is a, c, g, or t
  misc_feature (67)..(67): n is a, c, g, or t
  misc_feature (74)..(74): n is a, c, g, or t
  misc_feature (101)..(101): n is a, c, g, or t
  misc_feature (107)..(108): n is a, c, g, or t
  misc_feature (114)..(114): n is a, c, g, or t
gcaggtcctggttgaccacagtcaaaccatgacagccgaaagtgaacctataaaaaaatnngaaatncggaaanccgcagagggcaagctttttaatctcncagaanngaagangacattcaaaaaaaaatgaaaggcaaagatcagtcaattttgttgttgttgaaaaattcaaaatcgtcaaacaccaaaaggtttacaaaaatagaacaaatcaagtttatattgtcaaatttttccaaatatgaaaacatcaaaattccttctaatacatatgtgtcctccctaacatataaaatacagtaggtaaaaatctcataccggtaacctaactatgttaaaggcagatggttagtgggagagggcgggtggtgggtgggtagaggtgtgccgtgactgaaaaacccgtgaaccgtgaatcgtgaccgtgagtgaaaaaacacgtgaaattcacggtaaccgtaacagtgaatcacggcaacctctagtgttcggcaggtaatttgcccaagaggaaaacagcagaaataggtaggccagtcaaattatcccgcaaatggcaccccttccaaatgtcatagtatcccggttccaatcaaaaatactgcgacatcctaatgtcctcaatacctccagtcgctcccccctcgcccgcccccgccattccgccaaaacaatcgccgatcgtcgggtggagatggaggttgagatggagacaatgttttttgttatgttgtgtcctggcactgtccaccgacaaggacggcagcgaatgggacggacgagtggacgagcggtgcgcaaacaaaaaaattttggggttgaggtcggcgccgccggagttttggggggccggggggcgagagaattggaaatggacgataggacgggggaaggaggacggaagattgggatgatgaggatgatcggggttgggcggaagggatgaatggtgttggagacgacgatggacaaggggggggggaccatcgacggaagatgagacggaagctcgggcggcaatgtcgagagccgcgacgaggacagagcggtgggtggaagcggtccgtaaaattaatggaattagaattggattggtatggaagagcagcatgtgaagtgtgaaaaatttaaagagggagagggagagagagagagagagagagagagagatgaaatggacgtagggggaggggtagagggtaaagatttttggaaaatttttgttttttaagagggctttctaaaaattttattttattttttaccgagatggcccttc

SEQ ID NO: 17787 - DNA, 1809 bp, Heterodera glycines
gcgagagaattggaaatgaacgatagacggggggaaggaggacggaagattgggatgatgaggatgatcggggttgggcggaagggatgaatggtgttggagacgacgatggacaaggggggggggaccatcgacggaagatgagacggaagctcgggcggcaatgtcgagagccgcgacgaggacagagcggtgggtggaagcggtccgtaaaatgaatggaattagaattggaattggattggtatggaagagcagcatgtgaagtgcgaaaaatttagagagagagagagagagagaggatagagagagagatgaaatggacggagggggaggggtagagggtaaagaatttttggaaaatttttgttttttaagagggcttcctagaaatttttatttaattttttaccgagatggtccttctgtgatatgcgactctctcaaactaatgaagagagctttctttcccctaaagttgggattgaaaggagtgcaaagggcgccctgtgtagctcagtggttagagcattccacggaaaggaagggacgtgggttcgaatcccaccgcaggctgatcttttgcacttacgccatccgccaataataccacacttcgagtttttgttttgggatggattttcaatgggatagggatttaaatttaaaaaaattgtaaactttttatgtattcaaaatgataaagtttttcgtgttttactgaaatcagacatcataagaaaatttaaaaaataaacatgtagaagcatgaattttttaagaaattaattttaattttttgaatgaaaatttttcttaagcataagtgtttaaaaatttatttttttaaattttagatgaagtatttttgaatatagatttttgcataaaaaacttttcatttaaaaacaaaaatttagaatttttgatttaagaaaatatattattagacggtaattacaaatttaattgatcgcctaatttgctaaattaatagcattttaatggacacacttttacccactaaaattccgtcgccgccggcggaggtagcgaactaatggcatgtcaaaaagtgaccttggatgaatgggaatgtgctccaccgatgatgatttatgcacttatgcagttccaagttcgtctgaaacgtacgatcaatcaaaatagtggaaaattaaaaaaaaattcaatttggaaaataaatttgaaattataattattaattaaatttcaagtttttgaaaaaaataattaaaaaaatataaaaattatttctataaagtacaatcaaaaacaatgaaaattaaaaaaattcactttgaaaacaaatttactttatttatttaaattttagggaaaaaattttaaaagtattttttataaatttaaaaaaaaattaaaatttgaaaataaatttaatattatttattaatttataaatttttgggaaaaaaattcaaaatttaaaaatgattttttaaataatttaataaaatcagtcgaaaatttaaaaaaatcaatttatttaaaattatttatttaaattttaagtttttgggaaaaaaaattaaaaaatttaaaaattaataaaaaatgaaaaaacaaatataagaaaattgaaaaagatgtgtaaaattgaaaagtaattaattaaaaaactaaaatattgtagagtttattaattataaatgtattccaaataaatgattgacttttggtttcaaatattttaaatataaatctaagaaaaattttaaaattttctcgtgaagaaaaaaattccaaattttccccatttgtccgatg

SEQ ID NO: 17788 - DNA, 2124 bp, Heterodera glycines
gactgctgcggttttggcgctgctggtgcggctgctgctggtggtgcattctgacaaaagatgttcggatccacacggcccagcgtctcaatacttcggatgatgttctgaaatgggacagaggacacgaattatttggttggaccttctgcaagctgaacctgttgctcttactcggaacgaattgcgatccccccagcctttgcctgctgcggattaggatctgaaaaaatgaatttggttagaatatttgctgaccatgaaccactgggccattttttcgtgcttttttgggttttttgtgactttggcgattttttatgacctttttagtcgattttttgaagatttctagtgacttaaattcaccgccctatcattttccagaaaaccgaccagttgctcacgttcaacaacagcgccattctcaacaacatcgcaccaaaatggcacgccgacgaagaaagaaggagacgcgaaaggtgtcgtacaaggtgcggtttacaacgaaagcaaaatgccaaggaaattgtgtcaatgattccccgtttttccccctcatttcagttgtacgttcgacgggtgctgaaggaagttcatccgggcaaggaaatctcaatgcgtgcgttgaacatcatgaactcgtgagttgcggctgctgctgaaagctcaacaacaaataacattcgttttccccatttttttccagcttcgtcatcgacgccttggatcgcattgcaacggaggcgacgcgcatggcccactacgaccggcgcaagaccgtcacgcttcgcgacatggagttttcgtgccgactgtgcctgcccgacatcatggccaaacatgcgaaccaaaaggcttcggtggggacaaatttatgattagcccgatttgtaaagcacactcataattattttttgaacatgaatcttaacacccgcaattgaattcgaacaaaaaatcgtaaattctcagagcccatggggattgggactcccgcgggattcacggttcagattgcattttttgctcactgggagttttacgtgattcccggtcgcgctcccgtcaatttttcaaatcccaaatgacccaatcgccggagaacggactttcgccttaaaaactcagattcggacacccagttttttttcaaaagtccacaaagaccccctaaaagctcgaattaaaatttcaaacacctttttggcttttactttttattcgatttaatacatacagtaagacagaggcatacaatatgagatatgacatttgtaagcagtcacagcgttgaaaatggaaatcacatatacaatacgaataatatacacacaattacaaagtggcaaaatgcagattttatcggtgaatcaatttctgcctaagtgatcatgccctcggagcggctcgtcatcagttcacacacttgatattgcgaagattggcagcctcggcgtagtcctctccagccaaaacaaaccgcatcgatcatgacgagtgcattcttcggcaacttgaccacttggaagaagctgcgcgcagggtacgtgtccggattgaagtcgaaacgaggacatccatggttacgacctgtagccctccgcagcaggcgctttggacgtggtgatgggacgcatggagggagcagacatttggagaatggtggtttcagaaattaggacgttggttgtttgttcgctgaaaatttgttaattgaaaaaaaattatttgagacgaagaaataaaaacaggtagatagaaaaaatggaaaaaaatgaaaaaagtgcaatatttatacggggataggtatgttatgaaatgtcaaagtcaaaacttgtctgttcttttttttagtataatttttatagaagcatccaaatttaacattcttgctatcattcgatcggtcagggtcattccaagaatttgcaacgccattttgaacttttcattgcgttttgaggccgctttgctaaaggtttgcatggaggcaaaaagttccgactgtttcttgtcgaactcggcgttggaccttgagaaaatgaacaatttaaatgtacaaaattgggatgaaattcttattttttggggggggggggtcagaaattcgcaattttcgac

SEQ ID NO: 17789 - DNA, 3240 bp, Heterodera glycines
  misc_feature (3137)..(3137): n is a, c, g, or t
  misc_feature (3144)..(3144): n is a, c, g, or t
  misc_feature (3205)..(3205): n is a, c, g, or t
  misc_feature (3209)..(3209): n is a, c, g, or t
gctcttccatcatcgtggcagcagacgcgtccaaaatcgtaattggcgcaacgattggccacatttttccggataagtccgagaaagtgatcgaacacgcatcttgtgttttgtcagattcccagcagaattacagccagatcgaaaaagaagcattggctcttgtgttcgcagtgcagaaattccaccgaatgttattcggcaggaaattcaccttatttactgatcacaagcctttgcttgccattttcggttccaaaaagggaattccgatttattccgccagccgattacaacggtgggcgttgatcatggcaaattatgatttcgacatcaaatacacgaatacagcatcatttggacaagcagatgtcctctcaaggctaatagccaattatccaaagcctgaggaagatgtgttgattgccaacatttgcgtcgaaacagactgttatattaacaccattttacagtcgcaaaccgatcatcttccagtcacggcacaagaaattgcggaatcaacaaccaaagatgagacactccagaaaattgttaattttgttatttctggttggccaacgaagtgcagggaacccgaaattgcaccatttcatccgaaaagaaatgaaattttggaaattgggggctgccttctctacaaaagtcgtgttatcgttccaagccaactgcgtggccgaattttaaaggcattgcattttgcacatccgggaattgtgcgaatgaagcccttggcacgccagtatgtatattggccaggaatcgattcggaaattgagagagttgtacggcaatgtgatgaatgccaaggtgcacagaaatgtccgattaaggcaccattggccccatggacagtcaccgacaaagcatttcaacgcgtacacatcgactttgctggaccctgccaagatggatatgtttattttattctggtggacgccttttccaaatggccggaagtctatcaaatgtcttcaattacggccaagtccacagttttcacacttcgttccataatccatcgccttggcattcctgaggaaatagtgtcagataatggcacacaattcaagtctgctgaatttgccgctttttgtaaagaatttggcatcaagcacaccttttcaccgccatttcacccgcagtcaaatggccaagtcgaacgatttgttgacacctttaaaagagcaatgaaaaagtgttcaaaagacgataaaaattggaccgaaaaggtgctgctcgcttacaggacaacgccaaacaatgccattgatggctattctcccgatcaattattcttcggacggaaactccgaacgaaattggcattagtcctcccgcaagagcacaaaaacaattcagagaacattgacaaaattcagcttaacaaaagaaggaaggactactcgaacaacatggcaaaacaattcgatggacggcatggtgtcaaagaaaaagtgtttgtccccgccgattctgtcctccttttgaactataggaaccaaaagacatattggctccacggtacaattgtagagcgagtcaggaactcgcctacataccgagtccatgtaccggttcttggtcgaattgtccatcgacattcgaaccaacttcgtcggaattgtgttttcgaagagaattcgaaacataatcctggtgccggtcaacagccaattccaccagccaacggacaaactcaaaatttggcgcatcaaattgctgatccggtcgatcaacggactgatcaacaagccgcaaatgacccgccgacattggctcttcgacgatcgcagcgtaagccgaagccggtgattcgcttctcgccttccggccgctgaaggagttagaagcttgagaagggaggtgttggagatgttaaattggcgttttgacctttttaattattttcatatctgtactttgttctccacgccccaaccctcctctttgtgtttataaggagaccattcccctcctttttttgactcttccctcattcattcgtttttattattatttgcatttgtccaccgaccgatcaataaatatttttattctttgtgtgttcaattggaggaacacaacagtgttcattgatcatcaacggtgttcactgatcatcactgattacgtatgatcatcagctgattacccccaaacgattcgtccaattaagcaaacccaatcagtcatgatcaatttgcatttttgtgtcgtcatcataatttttctgcatctttttctcctcttctcccatactctctcatcatcgtccatcaatagataaaaacagaattggctgacctctaatgggtgaataaatgaatgttttttttgcatttgtcgtcccctccctgtcttctccccaattcgtcaattcacattttgcctatctattgatcagcagattttaaagccaatatggatggatagttacggagatttgggccaagtgaaatattgtaacattaaaaaaaataatgattattttccaaccccctaggttttttcgagaattttcccgtttttcagtgtattttgatgtgtatcggttaccatgaagaagtgatctgaacaagttgatataaaatacttttgatcagccaaaagttaacttagaggaattttttcagatttttggcttctcaaaaatttaaacctaatttgttagaaattcggggttttcaaataataaataaatttgttttttgcacctgactgttaattaaattgcattaaacttttcattttttctggccaattaggttttccccgtccttcgttccattttcatattgaaaagttttcagttttcgtaaacaaaaattttaaaaaattttggccactgaaattctattttgcaatcatttcagagcatgctccaacaaattcaaagtcagcgtccgatggttgcgaagtttgagcggaatgtggccgggttgagcgaactgtgctccgaggcggatgaacaaaatttgaagcaaattgcggaaaatgtggccgaaagtgagtgggccaaatgagggaatcttaactggacaaacggagtttgtgacctaattaaatgagtgtgattgtcgagattgattaatgtagtcgagtaaaacgcccccttnaaaattnaaaaaaaaaattattttttaattttcaaatttagaaatttttcaaaaaaatcataaaattnttanattcaagaaattttagaaaaatttttctagc

SEQ ID NO: 17790 - DNA, 1196 bp, Heterodera glycines
cttttacggcgccaaaaaagtcattttatataggggcgccaaaacggccgcgccaaagtgaccccgaccctcaaaaacagggttcccaaatgaaaatcttaaaagcttcataatttttttatcaattttaagaatcaatcaaatcaaacattttcattgggctacaaaaaatttaaatccaaaaatcttttttttgaagtacgaattgcatacattaaatagtagggggtcgacccgacttcatacgaacgaagtccagtggagtcgaagggggggggggtggtcggagaccaaaatttacgaagtcctccagtcatgtaaatgccaaattttgcgatttcgggacaattttttgaaaaaaattgaggtttttgtaaaccgccaagaaaaagttttgatttttgagtgaaagttattttcaaattttctataaattttacgaagtcatatttggtaaaaaaaacacgaaatttattaattttcgtaaattttttgagttttctatacgaaattgactaaattttaaagaattttgttaaattatttaaattctcttcgtctttacgaatcacctctctctcttatccctccgtctcttatttgaccgaccgaggatgggaagcgttgactttcgtccggaagtggcgttcctcccccggcgattcatttccgccggcggtgccccccccccccggcgtttttaatccgtcgaatgttttgatggaaaatacacaaagacaataaaatttcctttttatttttcttcagatatacattttgatgagcccttttcaaaattagcaaaatatttttgcttttgaatgggaaaaagggaggggggggggaagaaaggcaattcgaacactgacaatgaaacagaaatatcacgagtggtgggtggggagagggggggggggcaaaacaaaacattggcgacggtcggcgcagccgacgcccgaggggaaatggacttccgtcgatgggtggcggacaacgacccccgcgaatgattttgtgtattcattcactcttttcgtctccaagttatttttgattactattattattgtcgtcagaaactcgattcacgcccgcaaaatgcgggagggaaagggacgcaaagagaaaacgatggacaaattgggggggggggagaaaaatatttagtggaaatttcagtgatttattcataaaat

SEQ ID NO: 17791 - DNA, 1697 bp, Heterodera glycines
  misc_feature (11)..(11): n is a, c, g, or t
  misc_feature (138)..(138): n is a, c, g, or t
aaatcatgatnttgtctaagatattcatcaagaactgattttttttaataatttttatgtaagaaaaacatgtattctggttttcgtagtcgctgatgcgacccagaaaactcccatttttgctgtatttctccattntagtgttgaaaattagcctaagaatgagtaaggtaaggattttatgggcgaaaaatccttaaataagggaacaaaaaaggcaaaataatagtagtgatgaaaaatggcaaattatttgtgcaaattacaatgtactttttattcatttgttataaatgagttcatcttttttgaatgaaacaaatttaaattattccaatgaaagggcaattgaccaatttattcatttttgtttcattcgaaagaatttttttttttttgagacagaaaaaccttttttaattttgatggtgtattttaagaaaattttctaaattcaaattatgaattcaaactaagtgaaaaaattgcaaaaacccataacccgttatttgtaagtgaatggcaacgagaaaaatgcaggaaaaagtctttagattgattagtcaagtttttctctcctattcccactcaaatccaacctcagtccggcaactgcgcttttgctgcattttgctgtgaatgtcggctcaacctccttcccatcctcggctaattgaacgtttattttgcaattgaaaatgagcaattcgcctgtgctgctgccactgtaaaggtaacggtcgaatgggtccaattggaagaaaaagcgctggttggtttcaactgttctctgataattcgccaacaaatgcccaggcattcgcaaatcgaagcattgaatcgagggtttctatacaaaacaatttcataaaacaaaaggaaaaatacctttcggaggccagcaaaaagcaaattcccatcggaagaatattgcaaatgtgtgacagcagaaccatcggaagagccattcaaaaggcaatcgcacgaattcgtaagggtggagtaaaggcccactgaaagccgaaaaaggatacaattagaaagaaaagaaagagagacggggggggggggaattaccagagccattggaagaagcgactgcgaacactccgccaaaagtcgggcacatcgaaagggcagacacaattcccttttgtccgccaaattttcctttgactgtttataaacatttaattggtttcaacttcggatttcaaatgtttaccaaatgttttaatttctcgcgactgtttgccgcttcgttcgcattcgaaaattcgcaaccgattgcgataacctccaaaaatgcactgcccatccaatgaaaaacttagcgaataagcatgttccaattcgtcctaaggagaaaaggtttttgttccatttgctaaattacgatgtaaaaaatccgaaaatcgctgattattcattagtaggagccattaaattttgacactcggaattcggaccgggtcgaatgggccccgccgttgggccccatgggcagtcatttttttggtcgacttttggtttactttcactaaagaaaatttttttttataaaatttaaataaaacaagatttttaaatctttaactttgttacacaaattaaaatgtatttattttcatgtatggttcgaacccagttttatagcgttgaattacgaattttatcggtgttctagaaattatcag

SEQ ID NO: 17792 - DNA, 2411 bp, Heterodera glycines
cggggacctctagagtcattccgttctgcacaatcgaacccgacaaaaaatcagaaacgcagttgaagcggtgaacctctgattgtaagaggcggtaatatggaagtgaatttgaaagatttttttggaatttgcttactcagtccaatgtcatgcaaagaattcatcactcggtcggactcgttcaaccgcatgaacccattgtcaatgtgaatggcatgctaaagccggaaagtcaattgggaggtcttaacgctaaagaatcgccgccagaaaacaaaaaataatcgtttggaatggaaaaatttgtcggaggtttcaaatccgtgccttcaacccttaccactctctctgcgcccaatgctttggtgcacaacgcggcacaaacggtggagtcgacgccgcccgacaccaaaacgagcacttcacccttctctcccaccgcacttcgaatgcgttcctcgcacatttgttcgcgattgcgcagtgtgtaatggcacttcagtgagcaaatccgacgaaggaaattgtcgatgatttgaataccctggtcggtgaggtcggcttctgaaaaagtgcgggttcgaactatttgcaaaatacgtaaatcccttgccaattcccatttaaatatttgttctcttacccggatgaaattgaagaccataaatgcgccgttcagtattttcgatggctgaattctcaagtttttgttgttcattaaccccaattaattaattacccgccacaaattccccgctgaagccaattggttgaaacccatttttggctgacgtttccggtgtcactccgtccccgtgggtgagcagcacaaattggtccggcttcaacgagtggaaaaggtccgactttgggctgacttggatctgagttcgcccatcctcccgccgcggctgcaaactgacggagccaccgaagtgtttgttgattagctaaaatgggaaggattgcaaatatgaaaaaatgcactcaaattctggcaataaatatgaatcatttggaccggacttggaacccgtagcaaatgccgagcagcggaagacgaccaccgagcagttccgggtcgtacacgggcgcattgtccacataaactgaatttggtcctccgctgagaattacggcactaaatttatttttcttgacatttaaatgcgccatgaaagtgttcttatattacctgtatccgttgtggaccagttcattcattgttgtgctgaatgggagcaaatcactgcacacattgcactcgcggacacgacggtcgatgagctaaacgaatcgggaaaaagcaagtcgaaattgtccgaattctccagagaaaaacctttccgtactgcgccccaaagtcgagaatggccacgcgctccgttgtgaattcctttccgcactcttttggctcgttggatgatttatttaattttggagatgcatcgccaattttcggtggcattttaattttttcgcttgtcattgtattctctgtttccatgggttccattaaatatgcaataaattaatagctaaaagacaataagtgaaaaactaatgaattacaaaaatagaaggtgtttatttcgtcactaatcttttaggtgctatttaaaagttgtcttttttgtcaaaattgatgtcggattcgtgatcactgatcagtgacccaaaaaacacaccggggacaaattttcatgatgactagggctgggaatttaagtcaaatgacttttttttgctgactctaaatggccttaaaatgacttaaagtgttctaaactttgtctgaagcctctaacatgcttttttgtgacttttttacactttttgggatttttatgactttttcgagtttttgcgacttttttcgtaatttttttgaatttttgaggcaaaatttgaattttaaccgacatggacgctatagataggggctatatagatcaattcgcatatggatcgaacggcactttattctcatattacccgctcgatgcccgacttaacttcgaaacaggatttgccacgcattgtctatcattatgaattttgatcgcctcacttcccgggaagttcatgggcggaaaatggggttgaatttcgccactcttgccatcatgtgcaaagtgacgcttttattttcaacggtccgttgagagtagtgaaataaatcttatactgtatccatttgcaattgggacaacccttttctataaaaaaaaatgggtttacgtgtatacagtgaccgccatcgactttatagaaagtgaccataaaatcagttcgtttaatgagacaagtgcactatattgtcatatgagacgtccaatccccgacttaaattcagaatatgttaagctacacattctctatcattatgaattttgatcgcctcactt

SEQ ID NO: 17793 - DNA, 964 bp, Heterodera glycines
tggaagatcaatttctttaagagttagaatgttgattattatttactaaaatatcccataaggatagttataaataaatcatcaagataaattttggaaaatttcttaatcaagaattaaatgataaaatgggattttctaaatgacgcctgaaaaatttgaatttttactgatttgttaaatagttattaaaatttcgtattaattaaaatcaattaaagagtttaaagaaatctgaaaaatgttccattccactgaagttaatattttaagcttgtttaatttatttaaataatttatttatttttaatgataaataaatttgtaaaaaagaactaaaaaatagcattttagaaaattttaaccgtaaacttaggtagttcaaaaataaaactttataaaaatgctctgcaataaaaaaaaaattaaaaagtgaaacaaaatgcggtccgcgacgcaatttcacggaatcttgaatgtggtcttggtcaaacgcatgatactaaataaataaattcagtttataaaatactatcattttctataaacctaactaaattcaaagataaatgtaatattaaaaaagttttttttaaattaaaaaattgcaaaaacttattatctataattaaacataaattataatatagtatttaaaatatgataaaacttttttgaaacttttaaatatttgatgcaggcactaaaattaataatatatttaaatatgaaactttaaaattaataaaataacttgtaacaaatataaaaatataataacaatgaaaattaatgctcagtatcgatatacactagcaatcaaactgcaaatgtatctttattagaatgttgaaactatcaaatagtcaaagataaattattttcataattgactttatttttcatcacatcaataagcaaatacttaataataaataaaataatgcgagtgaatattaaaatt

SEQ ID NO: 17794 - DNA, 2045 bp, Heterodera glycines
  misc_feature (1183)..(1183): n is a, c, g, or t
tatcgatatacactagcaatcaagctgcaaatctatcttttttagaatgttgaaactatcaaatagtcaaagataaattattttcataattgactttatttttcatcacatcaataagcaaatacttaataataaacactactaccggccgaaaaaaatacggattaggactacagatccgtgaaaatccgtatacaagtcttgcgcttaatactattattattagggacgccatttttaggcacaaaaaatcgcgaaataggtaccttaaaaggcaaaaaaaaaatcgcaaaataagcattaaataggcacacaaatcccaaaataggcaaaaataggcaaataaatttttttattaacgctttttagttagaaaagcatataaaaacttaataaaactcttaattttgattatttttaattatacatgaagttattaattattttaaattaataccaatctacaaataataggaaaataaaatgtaaacaaaatagactaaaaagaattaataaaataattaaacattttatttgtgcatataaaattgcaactccagcttaattattaaaaaatgtctgaataattttcacctccatttatttcgtgtcttgctattacgatattaatacctttatatcggtgattgctttcatttttaaatggtattttttttgggactttacaaatttagcattgaatattcgacatattttttatattacaaataaataaataaggaattaaaataaaaaattcaaaaatattaaattagtaagtaattattgcaaataaatacttttcaaaattaaaattaattgatggttaaaataaagaaatatgaaaataattaaatttgatcattaaatttaaaaaaaaattagggacacaaatttcataaacatacaataaatctaaaattttagtatttactaattaaaaaactatttaactacgcaagttcgataaatataaattacgataaacaaaatatacaagattatttaatttcaaaactgtataaaatattaaatttagtacatcatgaaatgttgtatgaagctgctgaatgcttattgacaaaagtttttgtctttactgttattttacgacttttaattattaaaatataaattaagaaagttaatatttgatcaaaaataatcatttttacataattcnaatactacacaagcaagataaatattttgctattgttttgtttgtatgaagctgctgaatgcttattgacaaaagtttttgtctttactgttattttaaagactttttcatgtttagaatctgttatgctggtcagttcatatttttggagaaaattttaaagaaaactgaaagtaggatttttgttggattttctatactgaaatgaaatcaatattttaaatttgataaataaaaataatatttttgttaatttatttctattatcatattggcggatttaagaaacgccctggcggatttaagaaacgcccattatggcggatttaagaaacgcccacttggcggatttaagaaacgccctggcggatttaagaaacgccctggcggatttaagaaacgccctggcggatttaagaaacgcccaatgtggcggaatttaagaaacgacacagcacgaattcataatcatatggtatcaaaattaaaacaagcaaaatgcaagaaaattgaatgcctagtaaaaatacaaataaattattgtaacttataggatgacggaaataaatttaaaacaaaataagaaaattaaattttaatatacaaaaaatcttcaagcaaaaaaaagaacttgtgacattgtaaacataaataatagagctttttgaataatataagtataacaattcaattaaataaaaacacggtttcaaaaagaaacttatcaaatagagaatattgtgaaataaaaatgataaaaaatttaatgaacaaacgaagaagaaatttggattaaatgaatggtgatattccggggggggggtgcttcacaaactaaaaatatttactggtgaacaagtct

SEQ ID NO: 17795 - DNA, 2854 bp, Heterodera glycines
  misc_feature (946)..(946): n is a, c, g, or t
attgaaaggtgggagaaaggataaaaggaggggagagaatgatggaagacacatttcagtgaaagccgtggtggaagagacgacgacaaatgaacagggcaaaactgagacaaacgtcgaacagagcgaaaaggaggggccgatgaactgaccgaaagggtccgactgatcggcaggaacgtcatccctgacggggatttgtcacggagaatagaaacaaaaaaagccacttgcatttgcgttgttttattttgttgctacagtaatcacatagttcacctttgtagatgctttactgtactcttttcatttttctctctttctctgtccctctctttcttttctttccgcttttggcttataaattcctttttctctattgcacaaacattgaattcgattgaatatttgccgatttggttgagagagcaaagggacaaacacacaaaatgacgaaagaaacagcggatggacattttcaacatttccatccgtacacttcgacaaattcaattccaatattcaattggcatttaagtggggcaattatttaatcaccgatcagctgaggacaaaatccgatcggattggccgacaaaggtcgacagattgccgatggttgcgcatttttgcccctttttccttcccttttccgttttttccgttctgctgttagctgcgcaaggactcgtctgtcgaaagggtaaagcattacgaaacgaaaggaaagattaagcaaaaagctccctcagagaaggtcagccccgtgggcatgaattctggtgctatgaatgtcgaatgtggccaatacgtgcagcattgtctgaaggcattttgatcggcagggcggaccaaaaaagggaacgaataaaacgaaaggggggggggggggaaagagaggggtgccgaaaagcaaaacgaagtcccgacaaattttatacaaatntaaatctccaattagcaaatcgcaaatcgtccaaaacgcaattcgtccgccctgctgctgttccaacaaaacttttcattagcaacaaaatttgcttaaggtgcgcatgtgggagggaacaatcattcggtcggtaattagtcggcatttcgaatgttcgactgattatgtgcaattcgccgcattttttagggactgcgatccgttggcgttttgtccgcccgacggaagcaaagtgttcaaaaacgcggattatttttgctgtggggggaatgtgtgcaacggaaagcggcgacacattcatcaaatgataattttatttatcttttccatcggacaaattatattctttttatttttatgatgaaaagggaaaataaaatggaaaagaaaggtaattagcacaaaatgagtcaaaacacaacaaaaattaattggtttaattagggaaaattgcaattaatacaaaagaggcaaattaataataacaattgtttatatatatttttttggaaatccacagaagaatgaatgaatgcataatgaatagggatgatgcaatttttaggtttttatctttttttctgagctcccagaaaaggacaaaaacaagtttttttttggtggttgataagctccttttcgagttattggtgcctattttctgttttatttttagagcctaaacctaaaaaaattgaaaaaacttattttaactttttgaagaaagttttcgattttacatccctaaattagaaagtttttcaactattttcccatttttacacttatttttggggtttttagagcctaaaaactaactattttggcagtttttagcacctaaaaattgtatcactaataatgaatgaatgataaatggttgaatttgtcacgggtcatttgggggtggaccccccccccccccctccccctgcccctttatgtgaatgatcgcaaatgtcagcccatccgtctcctcttcctcctccgacggtatcccatcatcttctcttatcattgtcctttcgtccctttcttttccttccgccctctttttggccacttcctcccccactttttctgccttctcccccactttcttccgccaatgctctcatcgtccccaaaggaatttgttgcgcctgtgggagaggtgaaaagattggcaaaaaaacaataattaatttgtcaattgaggcaattaattacccaatctgcaggtgcatgcgtttgtggtcaaatgtatgcaaagtgtcggcacttcggcggcgcacgccgcgcaattagcggaccttttgttggatgccgacatcgtcggccattacaggtcaaagggagcgattagccgagcatctgctgatcaatgatcaaaacacttcgtcaattatactaaagatggcacttcccatttacagtcatggccttaaccgcctttgcatttacattgaggacgtcgcctcgggcgtaaaaggcgacggtcagagaataaaaagggaaaagccaaaaaagaaaagagttttcaggtgaaccgaaggtgctcaagcaggtccatttgaaacagaattgaaatgccaaaacaaaaagcaattacgctgaatttacagaagggtgccaccgcttgggtggacgggtgcgatttgcttggcgccgtcgtcggtaatttctgcacagaattggccataaagttggccaaagagcacggcatcggctgggtggtgtgcaagcggtcgaatcattacggcatttgccaacattatgccaaaaagatagcaaatgccggcttgttggtgagccttgccaattgaatggctgaatgacattgtttactcttttcctaccccttcccatggccacccttccctcccccagggactgtcggtcaccaacaacttcgcccatcatttt

SEQ ID NO: 17796 - DNA, 1045 bp, Heterodera glycines
acaccgccggaattttggacaccaaaggaaaattggacaccgggaaactggacaccaaattcctaaaataaacacaggaatgaagttgaaaaacaaatttgtgtagggtaaatggattaataattaataattatggcacttaaagtagctcaggcattcaacaggccagatgattgatcaatgtgccaaaaaaatgcacgaaaaagggtggagaattggtcaatgtgctaaaattgcataagagaccagcagatcagtcaatattggtcccaaccccgtcgttttcgaattcacattccattttttcgaccgattagacccctggaatttatgtattcaccagctttgaatccatggcatttcgggtcccaaccgccgaaatccccttattcttggacctattggactcattaagacccactcactactaacattcaactaatgcagtcagtgttgacacgtttgccgttttccgcctgcccgccggcaacaccaaaccgtacgtcttcaattggtcgcgcaacgatttgccaccatctttggactttgcactgaaaatttaaattttaaaaatatacatttgttggcattctgtttccataccggcgcagaatgccgccaagaacagatgcattcaaacactcgggcggattgatccgtctgtgagaagttggcatggaaaaattgttatcataaattctcggtaaaataaaccggtggatttcgccaactgtgacacggtatttgggagtggagctgagcaacgacagtcgtcctgagaatagagtatacgatataatgtacagtaagaaagcaccagaggccaaaccctttggccatttctcattgcaagacgagattaaaattttgcagttgtgtaattagtgtcggtactttgccatttgtgcctaatttgtttttacttttttaatgttgaaggtcatgagccttatttgatcctgcaaaatccttttcaaaacatagacgtcacaattcgagaaacaaaaattttgataaatttctgtattataaaacttattttcca

SEQ ID NO: 17797 - DNA, 2126 bp, Heterodera glycines
  misc_feature (2053)..(2053): n is a, c, g, or t
attaattgtcaaggcatcttggccatgggatgaccattgttggatcaatccacccgcctggcacggtgcaaaatgtctccatgggattgatgctgcccggtggcacaatgccaggggagggaatgcccgatgccattccggaatcgctcaacgaagtggacatgtgattgacaccaatcggtgtcggcattgaattgtttggtggcacaatgccaagcaaatgccgtgattggcgagaacctgtgaagtaaaggacaatctgctactgcttacaattttttgtcactagtccaggatagttttgatcaggattttcagtcagattttgatcttaatccattaaggcaaatatttttgctaaatttttaaagattttttcattaagaatttttgaataaaagcgaaaatcctgactgagtatagaattcccgattccgggctctagtacccagttctgttcagggctaacaataaatccccttaactgatcagcactgttagaatcgatcattttctgatcaaaatgggaagaaccaaattatcggaccataaaatttctggacatgcactcactgctgttgttgccaatgttttttaccttttcggatgacgccttcagcgccagtcattgtgccggcaccgccacctcttcgtctggcattgtgccgttttacaccccttccccggcctccgttcattgatggcgaatccgagtccgaactttgctcctaaaatagcataaagcgccttaacaagggcagaaaatcagaatttagaatttcttgaaaacaagatacggtagagtataatgatttgaaaattttaggcgtaaatgatatgggaacaaacatacaataatccaatacagtatattcgtttttacggactttggtaatttctcaaaaattattcaagaatttttgaagcttttagcaaaatgaattgacgatttaagaacgaggttctcaagtacaatttagaccttttgtactacaaatacttaatgtaaagtactttatttgagaactaccgtaatactgacgcattttccgggggcactctaattgtgccgccccctgctcgcgcccaccatattgcaaattttaaattgtatttaatatatatatatatatatatatatattatatatatatatatatatatatatataaatgatttaattattaccccatcactgttgtccatcttcatttccaccgcctcgcgcggcgagtggtggagaaagggtggcaacacgcgcagcaatgttccgccgacggcaccgccaccgttgccggcaccgacgacatcaccaccgctagcggaagtgccctgctgttgttgctggtgtataaacacggtggtgccgttgttgttggcatgttgttgttgttgggatgatgttgcgttctgttgttgttgttgttgttgcaatgtgtgcaccggattcagtgccaccatgtagtcaagcggagactgctgctgatggtgaatgcatgaatgtacaatatacataccagggatgtaaaggaaatccgattccggcattttttagcccggaattcaaacttccggcattattggtgccctggttccgccttccgacatattttggagcccgaaaaccaaccggtttcggccctttttgtgaaattccggctttcggcattttggagcaaatcccgattacctgctcttgaccgtaggcacgtccaacaattgtttgatgttgtgtgccgaggaacattgagggatatccctgaagaagcaactcattacaactttatccaaaacaaaaatgctctctacaacactttaaaaattgataattccactcaaaaaatatttaaaaccaacaattatagaagaagagattaatggatgggggatatcaattgagacgctgattaatcgatcctatatgatcgagcaatattctctcaatctcgcccatctcattaatttatacatattgtaaaataccaagcaaattttgttcattttgatactgtactcaaccgtatccccgtatcgcgcacaattcctgatcccntcccctaatgtcatccgatccccaattctctcacataaatcggtgctgaatatgagaatgtgtacgggttgac

SEQ ID NO: 17798 - DNA, 2949 bp, Heterodera glycines
ggaagagagcgtgcgaaagggaagaaaagaggccgagagaaagagagaataacaaagaaagagagaaaaaagcgatggagagagagagaaaaacataaagagaaagagatgaataaggagaagggaaagaaattgtcagagaggaagtgagggagaagatgtgagagagagataaagaaaaggagagtataaagagagagaaagagaaagaaaggaagagaaacatttggaggaataatataaatttttaaaattttgactagcgcggagtgggagtgcccgagcgaagcgagcgtgcctgcgctagtttaaatgaaaaaagatcttcaaatttcatttttattaggttattcattttgataccctatggcattctgccgggccagggcgttttcgcgccgccgttttcgcgcgggggtcgttttcgcgccaatgcgtttttagcattataatttgggacggatttatacggacaaaaaaatccaaaaaattgattataatatggaaaaaaatcacaaaatatggacaaatatgaacaaaaaacacaaaaacattgacaaaaaatttctgaaaaatggcttgaattttcgaaaaattcataaacccttttgagagcttaataatacctagtctaataagtttaaaaatatcaaaataatcttttcctccagcgggattcgaacctgatctcccccggcctggttcagaatcccagatacgcagggattctgcggccatagcgattccctaattgaaacctgatttcagattctgatcagcagggtctggaactaatttatttgatcagcggcataaattaattagccccagaaaacttttttgaaattttccgacttccggtttccgacgtttttggtatcggaattccgatttccgaaaaatttttgggcctcggaatgccattcctgatacagaagtcgaaattcggaaaatcgttttaatcgtagagcacaccagagaaatgttctcattctgatggacataataattttttgcaggaaaattttctgtcccctaggaattttcgaaaattttcccgattttctgtgtgttttggggcgttccgattaccatgaaggaatgatcttgggtctgactgggtcgaatgggcgtcgccaaatggtggccaatattttttttcagttgcacgtcaataataaaaaatatttttaggattattgttatttcaatattttggggttttcaattttttatattttcacctttttaaggcaaaatttcagcaggaattatttaatagttcagctaaatcttgcatgaattcgtttcggaatataaaatattttacacttcattagctatgaaaaaacaaaaattaatatcctgccatagcaaaattggaatcctatggcctttcgacagtgggagcgatggatatcttttcgaacgtgcaaaccaacttgagatggccgatggagaaggcagaaaataaaaaatcttttttgtttaaaaaaaattgcgcggtcacttcttgcgatgttaaacatacttttcgatccaattttatctgataatcggatgagttttgctggagaatttggaaatgcatctcaatatgggtagaataattcccaaccctaaatattacagtgaaaaaattattttccttaaattcttgatcaatagggctgggatttttagacaaatgcctaaaatttctgcgccttgatacgcttagataagcatgaaaaaagcattttccgcttggtttggggtgtttacgatgacttttataatgcctaactttgcctattttggactttttgtgcttaatgcctatttttatgcctatttcgccaattttggcgcctactttcaggattttcgaaaaataacaaaaatgcaataaaaatgaaaaatacacccctaaaaatggatctgaaaaaatttcagaaaatacaccactaattgtaagaattgaaaaaaaaaatgttcaacaaaaattcttccccaaaaattattttgtttttttcattatttttatcgaaaaactttaaaacaattgaaatataagcaaaaaaaaagtggtttgatggatttttacgtgttttcctactaaaaagctttaataagaaattttatttgcctattttagtgcctatttgaggatttttgtgcctgtttaatgcctattttgcgattttttgtgcctaaaaatcccagccctattgatcaatatttcggactttttagtaaatatctatttaatattccaggttttaataggtataattccctgtcctaattataacctaaggttttgtcaaacattcaaagggactaattaaaaaataaacataataatttttgaatacaattaccctttttttgttgcatatccattcgtacgaaaatattttggcccggaataaatataccaatcgcttcttctcgacatgtaaataatatatccgaaagaatttttggacaaaataaaattgacaaaagttattggtcctcaaaaacctccgaaaatgactatgataagaaaaaataatttaggtgagcagtaaacacataaaatcactttcagacttcgaacttcgcaaggcgttgttcctttgctcaccgccctccgtttctttccgctgtttttctcttcctccgctttctccccttttcttttcctctcttccgcccttttcctcccctttcttttgctctccgccgcgcttccgttgctgtctgagctcccgcagcatcgccttttgttccgcgcgcacttcgctcactgacatcgctagccgagtgcgcacttcgtccatgcgagcctcgcaccgacgcgtgcatgccgcctgctcctcgcgtaggcgctgctgttgccgtgcaagacgtgcgcacaacggacgaaagaagcggggtggctccggttaggcagaaatgacgccacccattggcctagattga

SEQ ID NO: 17799 - DNA, 1487 bp, Heterodera glycines
  misc_feature (1414)..(1414): n is a, c, g, or t
  misc_feature (1446)..(1446): n is a, c, g, or t
gcggtgcgctgcccgaccattggccgcgccgcttctgtccgcagggaccgcccattttggcacagccgaccaccacatttaagcgctgattaaagagataatcctaaggattaaaattaagcacaactgaaaatgggcattttaagacttgaaacaaataaacaaatataagaagcaccgatttgaatttctatgtgtgctcatccaaaagcgaggatgtccaaattcaatctgcacgtttgatctgtaccccgagacgattgctgatatggatgagccaaatgaaatttctgcttgccaagcgttgtacaaatggttgcacatttcgagacatgatggacagccaaaacgattgcgctgcttcgattctttgaatgaactgaacaaaaattgtgaatggatcaaaagtttcaaaaaggtcgccccagttttcttttgataaatgcaggcgatggtgctcttatgagtagggatgcaatttttagactctaaaaaaactgcaaaataggtaggatttaggttctaaaaaccccaatttatgatcaaaaatttaaaaagctgttccattccaaacatatttaacgtaaatttttgaaacttaacaaaatttatattctattagaaagtttggataattgtggaaggcgttataccaaaaaaccgggtttcgcccagttggccatccccaatttagaataaaaaataataattgaaatcgacttgggcactcttggcccaaaagattgagaaatgtcgcgtaacctataaaagtggtaaatttttaaaactcgtttttgcgtttgatttcctttcttcttattcaggcatttctctgttccacctcttcggtcaattatttaattatttttgaactgtctatattatttgaaattgtgcctttcgaatttgttaacgagcgaaccatggaaaagctgacattgcaagaagaatccgatagcgacgaagttgttatattcaaattgcagagatgtccaattatttgtgagacggtggcgggcgtggagggcgttcagtgggcagtagagactggacgggatcggatcccgcgggattaaattcgggatcccgacctcgggatccgtcccgaacgattttttaaattcatcgggatttatcgggatcgggatttcatcgggatcccgaatcgggatccctcccgaccattttaccaatcccgcgggatcccgcgggattgaagtcacgataatttttcgaaaattctccattttttaattaagatcttgattaaaaattaaaaaatattgtcatctgctaatttttcttaaaaaatctcttacaaatcccaaaaaatttccacgggtctccaaaataccactaaaattttcaaaatttgacgtaaaagttggccattttgtgacttttatttttttanaaaagaatatcaaaaaatttttcatttcctanatattatttcgaatctttttaggtagtattatgacacaaca

SEQ ID NO: 17800 - DNA, 1732 bp, Heterodera glycines
ttttgaaaaaattcgctgcgaaaaattcttaaaaatctatttttggtcccgatgcagttacaatttcttaatttccctaaaattattaaaatgataataggagacgaaaatacaaaaattgacattaattgataaaattataaaaatatatatttaaagctatgttgttaaatgttctaattcttgaccttaaagtctgactttttaggcaggatattctctatttttggaaaacaaaattctataaaaagctgatataattaccatccatatttttctaatcgaattgatcaattataaatatattagataagcatttgaacaaaacttatcacaaaacttgaaaaaaattgggttttagcaaatcccgataatcccgcgggatcccgaaaaaaaatcttcgggattcatcgggattcggtcgggatccgccccgattgtttttccaaaatgttcgggattgatcgggatcgggcttcagtcgggatcccgactcgggatccctccgacccctgttgtccggtctctagtgggcagacgaaaattcggaaaatttgaaccacgtcatcatcgatttgtctgctggtgtcacttacagcgctgatggaccagcgaaaatcagtcacttccattaatttattcagcttttaattaaatagcattcaattaaaatggggaagggaaaaataataattcctttcggtttaaatacagctctttggaaatgaatagggttccgaccatgttgtatttaagattggaattttatgttttggtgggctttctccctccgggtggaaggaacttggacaatttttacgtgacgtgtcacagcacaccacccaagtccatcccaccccccgccctgctgggctggtggttggcgccaaagaaataaaccattttcattaccagaaaaagcaaaagatctcatttaagaaaaatagtaaagccattaaagctatatcgaatgctgggtactaattgggtttgggtcccatattttggtcaaatttttcaaaatttaaaaaaaaatttttttaccgtgtaaaacacatttccttggggttttctaggtcgcggatcacgaatctggattttgactaatttcgaatcccggacccgaattcgaacaaaaagtcgaaaattaaaaaatttcaaaattgtaactggcaacaattagcataattggggaattggccacaattagcgtaattggcgacacttagcgtaattaacatctctttactgccccaaatcgcttatttttattttttgcgcacatggtagcgtaacaatatgttacccgtgctcataattgcccaaacaaatggcgcacattctgctgattgttcaccctcttggacaattcgttgcggcactttgtaaaatatttatacttgaataaaaaaaataaaaaattacgaaaaattaccatatttccagtaatatagatctcttttcccagacgcaacaaaattgtacattcttggtatcataagatagccattggattgcgttattagcttgccaaatttcaaaaaattttattaagtttttcaaaagttctagccaaaaaaatgaaaaaattgtcataacttttaaaaaccaataaaattttttgaatttagcaagctaataaagcaactcaagggctatcgtatgataccaagattgtgcaatttggttgcgtatgagaaaagttacgagtttatttagtcaaaaacttagc

SEQ ID NO: 17801 - DNA, 3041 bp, Heterodera glycines
  misc_feature (92)..(92): n is a, c, g, or t
  misc_feature (131)..(131): n is a, c, g, or t
ggtagacatgcacctgctcaaaaaggaattgaaacccccaaaatgaaaaagcgaaaatcatttaagaagtacaataatttgtatataaaagnccgcccgtggccagttgtcaaaacttgagcaaatacggnccgaattatttggaaggcttttattgggctaaacaaaatttaataatggtagtcttaatcaaatttcaaattttttccaattattttaaacgaaaattgcacgatgagattattattattttatttttttcatttttacattcgtctcattgaatgaatatttcgttgttattaaagcccggattttaaggcatatgccttttttccttacctctacggcttaattcacacgaaaattaattttagcttggttttcagcttatcaccttttagtattttaaaaataaatttcaaggtcccggtcccggtcctggcttctcaggtcccggcaagtcccggtcccccggtcgcgtctatagtaaaaacattttttacttttaaatcgtttttttgcggcgcgccttttccgaaatcttgttggaactgggggtccggtagtgccgataggcaccgtcgggtttatgaaagaaaatggacggacaacaaaaaaaaaattgataattatgaaagaaaatggaaggacaacaaaattaaactcagtaaaaattgaaattaatgttcaaatgctaaagtaagaaaagttggttatgaattgtgtgtgcctttgagatttactccatccatcatctccaaccaaacatttcttccgtacatggcatttcttccattttccatttctccactttttgctccgcattcagcaaagtattcttattttaccagcagacggcaatgtgaatgaggtcaatgaagattaaatttaatggtactcaaaaattaacttagaaaaaagtacccgtaagaaaatgggtgaaatatgcataaaatgctataaaaataagatcacctttatagattttgaaattaatttttggtattttttggtttaaaaaaataaaatttttcacaagaatttctattatttttcaaaaaatacatatttacacaaaatttacatttcttattcattactgttcattcgtctcttattataaaaaaattattttaaaagctctctaaaactaatttttggtaagagtaccaatgatagcccccctttctcgtaaatttttgaaatttaaaaataaaaatatgggtttcgaggtcgttgatcatgaaattaacttggccaaaatgaaatgaaactgctgctcgctgctcatattcagcaaaatttgacgcgaattgttgaattagtcaaagtgtatggtctcgggtcggggggctcggggtcggagagcaaccctagtttatttaataaatagagccaaaatttgcactttttcacgcggcgacgcctaaaacgatcaaatttttctcaaaaattcgtttcataattctaatttccccgttggagcggacaaaaacaaaaccattaatttttcctaaaaaaaaattcgatctaaatcacaaaattcttgtgaaaaattttattttttttaaaccaaaaaataccaaaaattaatttcaaaatctataaaggtgatcttatttttatagcattttatgcatatttcacccattttcttacgggtacttttttctaagttaatttttgagtaccattaaatttaatcttcattgacctcattcacattgccgtctgctggtaaaataagaatactttgctgaatgcggagcaaaaagtggagaaatggaaaatggaagaaatgccatgtacggaagaaatgtttggttggagatgatggatggagtaaatctcaaaggcacacacaattcataaccaacttttcttactttagcattgaacattaatttcaatttttactgagtttaattttgttgtccttccattttctttcataattatcaatttttttttgttgtccgtccattttctttcataaacccgatggtgcctatcggcactaccggaccccccagttccaacaagatttcggaaaaggcgcgccgcaaaaaaacgatttaaaagtaaaaaatgttttcactatagacgcgaccgggggaccgggacttgccgggacctgagaagccaggaccgggaccgggaccttgaaatttatttttaaaatactaaaaggtgataagctgaaaaccaagctaaaattaattttcgtgtgaattaagccgtagaggtaaggaaaaaaggcatatgccttaaaatccgggctttaataacaacgaaatattcattcaatgagacgaatgtaaaaatgaaaaaaataaaataataataatctcatcgtgcaattttcgtttaaaataattggaaaaaatttgaaatttgattaagactaccattattaaattttgtttaagcccaataaaagccttccaaaataattgggcccgtatttgctcaagttttgacaatcgactggccacgggcggccttttaattaacaaattattgtacttcttaaatgattttcgcttttcattttgggttttcaattctttttgagcagttgcatgtctaccaaattgtatagaatggcagtggttaagcgggccagaaggtcctataaatgggtcataaagataacggacaactccactcgcgcaccccacggcgctctctctctctctctgcaccacaacccatccatgggagagacacttttcttttttatgaggttttggcgtctttttttggggacgagcacaggcggggggggggggggcttagccgcctcagcccctcccctcccccccacccctcccccgcgtaggcccttggggacgagccaatgcgcatatggacattctcagagagggatggattaacggcaagcgaggcgcagaaattgcgaggaattagacagggattctgaggttagataattatttgtttgcagctccactttaccttggtatttcttatgaggaaatgactactttgcctaattgagccatccaggctctggc

SEQ ID NO: 17802 - DNA, 1578 bp, Heterodera glycines
  misc_feature (1532)..(1532): n is a, c, g, or t
  misc_feature (1565)..(1566): n is a, c, g, or t
tatgacaccaattgctgttgcactttcatgacccttctctattggcatttgcttttgccttttttggcatttcctcccccttaaaaaagccaatataggtaatagaaatattcagctgaacccttaaaaaggccagtcaaattttgcctttccactgcttccaacccctcaaatgatgctgcgctgccctctgatgacctttctttttgtcctttgcttaatgtgtgtccattgtaacttggccaaaccgaccaattcgatgacgcgaattcaggcaaagcgaacggacggacggagaacagagtgaaagtgcctttcccgttttaggaagtgtttcgaactctcatgggccccaagccgatgatgttggcttctcgtggcaaaaaagccgatggactgcgcggcgagaacactttccctgaaagcgccgcagaacgaccgacgcaggccttgggagaccgaaacgcggactcattttgggtggtggcggatgaacgcgtcccagtggcggtgttgaggaacgattggacatggccaacggacgcgagacgaagacgctgacaaaggcggacggagagaaaggcaccgaaaggaacggcacttttgggcaacgaaaagcgaagtcaaaagcacaacaatcagcgaaaccattctccgatcagaccattcatttgtctattcttttgcccattccaatttcattattgttttaccaagtaagcaaattataattaaatctttttatttattatttgatcagctgatcggccgcgagaattattcaactcttgaaattgtgactcgtttaaaagaaataactgaattagaaaagtaagaatttgcattccagaatatttatatgttacactagcataaaaaatttataaatatatgtggaaaaaatttctcgcagtcagcaggattcgaacctgcgcgggcaaagcccaattgatttctagtcaatctccttaaccactcggacatgactgcacgtgtgttcgtttgccattttttctttttaaggtcattttttaattcaaattaacaatctttctttgtgcaaaatccattcgtcttttcttaaataatttttagctttaaaaaaaatttctttttcttgacgactttattcgccaacgaaattattgataaattggattaaggcctttttcgcatccattaattaatatttatttaattaattgatgaaaagtcaaaaaatttggatacgccaatattaaagtcatttatttaaagtaaagtgaaaaatacttgtaagaacatttaaacatatgaatcatcagttttgtctttcttttcgtcctttttcctcttctctcacttttcctttttttctttgtccatcattctttcttttcctcttttttcccctctctttctttttccactaaagcttttcgtcggagaattcgccaaagcaaatcgggcgcaaagagtcggagaacgatggccaatcgaatgggcagtggggcgagcaccaattcggtgctgcgccgctccaactcggctancatgcgacgagcggcgctttccggactcatccnnccgcactgatca

SEQ ID NO: 17803 - DNA, 1685 bp, Heterodera glycines
  misc_feature (138)..(138): n is a, c, g, or t
  misc_feature (278)..(278): n is a, c, g, or t
aaggataacagaatggaaggaatgtcatttacgaatggtaaaaactcaaccaatttatgtaccggccattcacagttagaatttggagttgcggtcgctcttcgccgcggagactgtcaaagaatgccttaaaaaaantttgaaaagaagggaatttagccgaattacttgaatggcatgcttggagcatgaatagggactgcggtagggaagtgccactctgccttggatgctgttgatgtttagaatggcaccatcgtcgggaatacaccccaaanagggatttggtgatggccacgaagccgaagaaattcacctgaaaaatgaaataaatattcacagttttgtgtagactaaaatgattctgtggggataatttcgaccccttcccttacaccttttgtctcaccatttcgattcgaactcttacaccctctgtctccccttttctctcccccccctcgttcggttcggcctcctccgattaacctccatcaatcgccgatagacttccatcgatgtctcatcacatgatcctcggctggaaagtcccgcgttgttaaccaaaacatcaatggttttcccatcaattgaacattcgcataattcccttatttgttccattccatcgccgttaagttccgaaatgtccaaatagcggaagacaggcaaattggcattttcaacgccattttcgtccccccatttgattagttcggcacacagtgcttttaggcggtcgatgcttcgggcaaccaaaatcaatttggagcccttaaggaaaactttatttaacagaaaaagaattttttgaaaatcgttcattaattttttttctgacctttgcgtaaaactcaaaggcaagtgaacggccaagtcccgagctggcgccaacaattagcacagttttgtttttcaattcgagttttttttgcgattgtccgccgaataaatatttaattaatttgtaagcggcgaaagcacaaaatggcgcaaaagcataaggaagaagaggaaacacattttgcgaaaaggcttttaattgggcataattatgggcgaggcgcgggggcggctgataatcggcggagaaacgaaagtcggaattcataggcaaaagggtaaaacagacagacaatgcttagaagaaaaccaaaattaatatgtattcaaaataatattcatagcacttagtgctgctaattgtgcgctgatcatttaagtaccgccgatggctttatgcccattgttcaaggtctcatttcgtcactgatgagaacaatattaaaaaatattggataacttcaataaaattatctaaagtactaattaccgtacttaatcgaattctggcgctttttaataatcagcaactaaatgtgaccaacgctgaaattctttcagcatcccttttaacaaagccgatggtaaaaatatattaaaaaatataaaatcaagatttccattatattattttaaaattaattctcagtgacgaaatgatcggcacagttttcattggcattttgtccaatgttaaattgacaaatgaaatgaattgtcctccctcaattcgcttcgtccgctttttctccttccgtttcgcttttttcttcttccattacgtcttcgtcagcagtggggcgggatactgctgatattcgctgatcagatcgcccaatgtt

SEQ ID NO: 17804 - DNA, 355 bp, Heterodera glycines
aatttatcgtaaaaatcatttttttttgtaaagatctgttagaaatcgagcttaaatttcaaaattcgccaggcggcctatcggcaccgccggccccccaaaaacctattttttcttaaaaaattagccaaaaatctctaaaatttggtaattctttagacaaaatctgtgtaatttatgccaaaaggaattgaattgaggcgatacattgaccaaaggaatgtggagccatcacatcattcataaaaaattaattttttgtaaaattttttggagttaattcaaatcaaacccccgcccccgcccccgcgggggcggaattatcgtgcccccgtccccgcccccgatactctga

SEQ ID NO: 17805 - DNA, 1834 bp, Heterodera glycines
ttttggtatgttgctccttgtccctttatgaaagttgcagcaaaagctaatcttactggaaactgatgtctttttaacggaacggggaattcgctttcagttattaaagaaattctatgtatgtaaacttctgaaccatttttatcgcccccgagaattacacatcttaatacgttttcttttaattctaaaacttgcaacattgtcccgttacaaagtccttcttcaatattaatattacgtaacaacattactttgcagttctgttttagttttagctcgtgtaaaggaaagccaggtgcattaaaagaattcattatttcagtagttactggaaaattgtttgtggtttcaacttcatcaatacttaaatagctaactaactgtcccggaaaatgttctaaagcaactgcattatggtaatcagttaaatcattataaggtgaaagaataatacggtttttaagttcattaaaattattatttaaaaatatatctccatatatttcgtgaactaaatttgaattttcagataatatacattcgtttggaagttgaataaacccattttgattaaatccatttcctatttcgagtacttgttttgaaaaactttcatcttttgctctgttatttataatcaatttcatatgctcaaatttattccaaaaaatcgaccttttaatcgttaaatcaattatttcagattttactgcaaacttttttacaggtagtgtttgtcgaaaatcaccagcaagtattattgtttttcctccaaacaattgattgcttttagttaattcgcgtaattttttttcaatagcatcaagcgcaaatcttggagccataggcgcctcatcgattacaaaaaaatcactccttaaaatttcttcagatgcttttgtaccattaacaacaccggaaacagtatacgcgttaagatttaatggaaatttaaatcgattatgtatagttctaccattttttaataaagtcgcagcaattcctgaaaaggccatattagttatttgttttttataaccacgaatcaaatgataaagcgtatttaaagtaaaagattttcctgtgccaccaggaccatcaatgtatattaatttttgtttaatttcacccgttaacacttttttaataatatcataaatttttttttggtcgttgttcataaatttatataaatcttccgcaatttttctttcttcttcatagtttatgttttcctgttcttcttttgtggttgtttcttgaggtaggtttttgaaatcagctaaggatttactttcttgtaataattttttatttataattgttaatgacaatttataagcaacactttcagaatttttttttaaaaaatcttccgataaattatttttaaattgttcccataaaagttcgggatattttggatcgccaaataacaaaatacttgtgaatagactccttagtgcagctgggaatcgaaactgacatgcttcttttaggcaatatttccattcgtcatcgtttttggttaaaccccgtgccaaacatgcttttgcgaatgtgttatacctttcaccatttacaacttttagctcatcaaaatttttaccatgcacatgaagcaaaagatatctaagataatatttctcaccttcagtcggattaactgggtacattctaccaattgttttacttatttccgggttttttcgcaataaccattttccttgtttggaattccacgtacaaaatttgggcatttcaggatacaaataattaggtgcctgaggattttctttaaaaaaatcgaaataagccatcaatttgcttt

SEQ ID NO: 17806 - DNA, 1469 bp, Heterodera glycines
  misc_feature (75)..(75): n is a, c, g, or t
gtgggtcagcggaatggacgaatcaaaaagaacacaaagaaacggaatgccaaaatgtgctaaattattcaaatntaaacatggaaaggctaaattcgctgtttgaaagtgtggaaaatataataaaatcagtggaaaacgcagaaaaaatgttaaaacaacagaaaattggtaaaaaatataataaaaagttgtaaaaataattaaatttctaaaagtatcaagccgacaggttggtttcctttctccttaatttaaattaaattttgtatttttagatttttgattttattgctccgtttgaaatgggccaaaataaaaagaaaaaataacaaagattaaaaataaaattggtgcattaattgcggaatgggcagcgaagcacaacgccatcatcagttgatatgcacttaattgacccttttctgatttgattatattaattagtgattcctttttcaattaaagctccaacaaaatattattaatatataaaaacatgaaagtcaattataaaggggatttccttttaaaatttatcaattatttactaatacaacctttaaaaatgtgtttgcttgagcagagctgcactaatcaaacctccatctatttccattgaaacagaagtgctcttcaatgggtcattggacaaatccaaaacgaatcaggcatttattcgttagggcacaaagaatttgcgaaccttttgaaaaccataaaaatttgggcaaaaagtcgcttatatgtttgaattttgctttccaattttgtttttcagctcgactcatttgttccggcatttttggctattttaacggcgttactttggcaattatggcatcaaaaatttgtctactctttcctaatgcgcctttatcatttttactgtaccaatttttctccgtttattcaaaatggtaaaaaaaaataataaatgaaaattatttaaataatttaaatccaaaatctactcggaataaatatttcatggattggatcaatgcttcgattttgcttggaattgttaacgccaatgacaattaatgcaattgtgtcacgttggcccccattaattggccaaagtgtaatgactgtaattaccccaaaatttccggagcaaaacgcatctttaaatgtgaacaaattcacactccaaacaattctcgaagaattagccatcggtaaaaaaggatattcattaaagcaaaacccaatttaattattcaaattcctggtaatttagcaagtgaattctttccgaggaccaaaaaaactggaaagcaatttttgaagaaattaaaattgagcaaaaatttgaacttttgcgctcattgtctgctcggcttcccacttcgagaatttcactacaaattgtgcttttcaacggagcaaaatccaaacaaatttgctgaaatgggccaattcagcaagtgttgccgacaaattggtccattaccaattaatag

SEQ ID NO: 17807 - DNA, 1565 bp, Heterodera glycines
  misc_feature (168)..(168): n is a, c, g, or t
aatggtatttctcgatttttcgttcccaattttcaattgtttgctaatgatttcgcgcattttgacgaagcccacaaaagcaacctgaaaatgaaaaaattaattaaaatttgtttttggtgttttgtttaccaggctgggatgaccaccgtggaaaggtcattaacncatgggttctggttaaaatttgcgaaaaaaagaatgtcattttgggccgatgagacattaaaccattcttggacataggaaaagcgattgttgtgctcgtcaccaaaatttgttgcagttatgcagacaaaaaactgaaacttatataaattataaaattgctcaatatttccatcttttggcattaattaatgtgactgatttctatgtaatgtcggttctaattgtgggccctaatttccccgtacaataataatatacacatggaataatgtcctttattccgaaggcggatccaagaaatacaatatgctaatataatgagtaaaaaggggaaagggaccccgatacgtacaggacggaaggggaggggatcgggggtaaatgtgatcccggttataagaatgaattgaggtgattgatcgctaggaaatgggccacattacgagaaggggcggagttaaagttgatcagagtgatcagaggcactaacaaaaccagacagtcagataataagaaataatgtaatgtacaattaattatagagatatcatgaccataaataacgccatgagcagttggccaaagaatgtggccaccgtgtaaatggtcattttacattcatttgccgcattttggccattttgttggtaattgctgcgcaatttgtagaccaaaagtgtggccacattcagaaaaaggcaaacgatgccaaaaagaacggcagaccaagcggcgatttcgctgctgttcaactcctaaaaggacaattttagtaaaatataattaaaactattaattaaaataatacattttccgtcttatggtcgtccagagtaaaggtggcattgtcattttgaacatggatgtacatgtccaacccaaaaattggggcggtgaaaggcagcggaaagatgaaagagaaagcgacaacaaagggcaagccgacacgccacaactttaattaaatgggaatttaaaacaaatttaaaataggttaacaccttttcatatttcatcgggaaaagaatggcgcttaatcgatttaacagcaaaaaagcggtcaacaaattctccacatgaaaaacgtaataaccaataaaaaacagaaatgccagcaaaagccgcggaaatttgaggtaaatgggaaggaaaaggccaatcttgccaaaacgatgggccaaaaatgcaacgaagtaattgatcagactctgaaaaagagattaatttatgtaaataaagccgtaactttaattgcaatgattaatttttaattattttcctactaaaattgcacggatgataatgaggatgaaaagtggggacgaaaagtgtttgaagttcgcgacgatcacagtgaggagcgagcagtacagcacggcagacggaatgccaat

SEQ ID NO: 17808 - DNA, 1346 bp, Heterodera glycines
tcattttaacatactttgaatttttattaatctgctctttttatttcagtatcaaatggtgcaaaaagagctcattgggaaattcgcatcgggagactatgccaagaaaccaataagtttccgtgagtcagtttcatgtttaggggagaggaaagaattagtaataaacagtccaagatgaaaaccaatgaaagttcatgggaatcgggagacgaactccacccccatcctatggatgaatagttttaaataactaatattttcaaatgggtaccgtaacaattgtttagtcggataaccattactctttgcaaaaggaatcgacgaaattacgcttgcgggggcggcagcacagaaggctttcaatcctggtccaacagtcgctgagtactttttgaagaaaaatggtattacacttaaacatccgcaattgccttgtttggtgcaaagcggcggtggaaaccataaaagcttttatcccatggaactgttgttctttgcccaataatttgaagatgtccatttctttttcattttttatttgtttatttttctataagtaaaaatttcgattgttcgattatgctaattaatttgttttattacaatattcaattacctttttacttgacttttcatttcaattgtcctatgttaatttgttacttactgttagctattacaacaatttcaaatcgtccagcaaccacgaacgtcttttcttttcagaatatgccgatcttcggcgatccttcctccccttatgacgaagccgtagagaaagcgactgcggagacgatgacaaatgagaactggacattgatgttgtgagtgcgtacggattcacacaattaacggcgaacaaattgttgattcgttgcagatattaggaagggactgaaggcggacagaaaccttaagtaatggaatgaatgaaaggcaaactaataaaatcggtaaatataatccaaaaggcgacccgctgtccctctgaaggatcgggccagacgacgcgccggttcccctgccaaaattgggcaaatttccttctgccccaccgccgtctctgctggacagcagtgatgagagcgttctgtggccctgcgacgtcttcagtagtcccatggctgctccataaaaatcagtgacaccgaatggaagcaaagcgttgacatcgtttgcagttgaattgccggagaaggtggggaaggtaaagggaatccgtacgacccatggccatctgaaaagggaaatggacagatttcacattgcaaaatgaacgaaagaaagcgacgaattgctaacgtgtttgttcgttcattctttccccttctctctttgtcttt

SEQ ID NO: 17809 - DNA, 1373 bp, Heterodera glycines
  misc_feature (1359)..(1359): n is a, c, g, or t
taaagaatcgcaaaaatttggcagtttttaatgaaaatatgttaacaaattgcactgaattttcaaaaaaaatttccggcggcgcctagcggcaccaccggacccccccccaaaaaaaaatttaaaaaaagttgtttgaaaagccaaaaaaaaggtcgtcaatttcatggctgccctccagaccatttcacaaaaattttggttgactcccccccccccccctcttctcatgtatggatactaaaattattctcccccccccccccccctaaaggactgagctttgagctcgattcgacaaccaacaatcattgtcagaagaagaaggcgattgtcagcaacgatccgaatgtcgtgtcgagtgagcaggaagaagcggacattgcgaagggtcctttttggttggcttaaactgagaatttaaatggttcagccattgctttgtcattgcaagagggagggaagcagcagcaatcctcacaaaatttctacccgagtgccgtcgttggcacagctccgacaaggttttggcatatttcagaaccttcaattgaaatgggacaattattcaaatgttaagccaaatgcccattaatcccacgacacaaaaatcgcagttcaaaaaagtgaaggccctttatgactttgaggcggcggaggacaacgagttgtcctttttagctggcgaattgataatcgtatacgacgataggtttttattttttggcttttcgttttgcgatcacttcgaattccgtccgttgtcagtgaccaaaattggtggcgcgggtcgacggaacgcggcggcggagcgagcggactttttccggcgagttttgtgaccgaaaacttcgacaacggacaaatttcgaacggaacggaacgaaacggcgagagaacggaggcagtggaaacggcggttgtcccaaaagtgcaaatcgatgaaactgtgctgatgaaatgcatcgaactgctcgagaagtgtgaccccggggccgacccgtcgtccgaccctgccgaattgccttttctcgagcaaatggcgaaggctcaagcaccactcatcgatcagaaactcgtcaaaattgacaaagtgagcaaggacgggtgagccattgtccacttgaggtgtgtttagcagctcagcatgttggccgaggtggacatcgcaattcgcgaggtgctcaccgcgtatgacacggcccgtgcagcgggtgcccatgccaatgcctttctcctctcccgcgggctcactcgcctcgtccgcccctccgcccgtctccttcgcctcacccgctttcaggtccgtctgttaatacgccttcttttcccacccaatggactatgaatggacagtgncaacagcagcagaa

SEQ ID NO: 17810 - DNA, 1485 bp, Heterodera glycines
ccccccccccccctcaaatgctttgtcttcgcttttttaaatgcgatttttttttgtctcacaaaaaaagagctgaaaatgatcgcccctcttcccaaacccaaggccaaaaaacagcgaattgtaataatgacaaacgattgaatgttatgcaatccgtcggatgcccccgccctttggcaaactttgcaatttcttctccaaaatgaattcgtttcgttcatcaggttgtgaccgtccgtccgtccgtccgatctgtccctcccttttccacttttccctttcgccccccttttttcaccaatcattcgttgcgcatattatcaatatttatttatttctctattttcttcgcaatttcattttttaaattgcaattgcctcaggtcaaaattaaaattcgatttgcgtcggtcgcctttttccgtcttcgccatgaattacttctcttttcttattcttttgaatattatttttttgaattttggcctttcttccgcaatcgaagggacggcaaacgaagaaagcggtaataaattaattagaaaataaaaattaataaaattgaaaattaaatatttttagttaaagagacaaccgaaaaagacatttaatgtttttatgaccaaactcaagaaataaaataaaagaagacaaattcacgagacgaaataaaaagaaagtaatgaaagatggacacaaaaacaaagacataaattttgatttaataccatcaaaatgcgtaggaaaattcaaatgccaaattggtcgaaattgtctcgatttattcatagtgccactttagcgtgttctcgggtcggatttggcctttttggcagaatttcatggccaaacgatgggacaaaaggggcggaaaagaaggacaaatgggccaaatggctgagtgtggagacaaaagcgaggacggtgtcagattgtgtcaggcaatgttacgaataccgattttggtcagtttgtggagggaagaccatggatcaaagcgagaatcagtcgggaatgagagtcaggaatggaaagggccgagtcgagagtgagtctcgagtactccgctgattccctttcagccattccgtcctcttcgagttcaaaacacacggcgcttcctccaaaaagggacagtgtcaaatgtttttgcacgcctcggacaattgtcggggagaacaattgacgccaatttaccgggtaaattccaactaattttttgcttcgtaactttaccgtatcatatcgtatgccttaacagattgaaccgacgctgggaaagccgagcaaagtgttcgtggaatgtttgaaatgtgctgcattcgcaaaggaagacggaacgccaacgacagttatttttgagcaattggaaaagccgcaagaaatcgccggaaaacggaaaagcacacgtaaaattaaaaaaaaagcatgaaattctgaatttaatttgaagcgattctggaaattcaatggttgaaatga

SEQ ID NO: 17811 - DNA, 2076 bp, Heterodera glycines
  misc_feature (57)..(57): n is a, c, g, or t
caaatccaaccaaaacattgtccgcttcagcgtgtgtggtcacttcgaaagttctcncagcggacgcctctgaaaaggcactgcaacaattccgagcaacaaaaacggcatcagtgagcaggtgaagcagaagtcaaagcaaaggaaagacaaaatgaagtgggaaagaacagcagggagaagccggaccaaatttcccagaaaactcaaaaatcgcaaattaaaactttcccctctaccgttacctcttttgaaaaatagggttgaaaaattctttaagtgaattaagcacgttaaaatttcagtaattcagtcggtcattccacggcttggggaagggccgtgggttcgagaataaataatgaatggattgttaagtctgaacgaatgtgccttcatttgcttccaaaatggctgcctaaacgcattctttgagcagagcgaagagtcggagaggacggcgaaatgccatttggacatggaaacggaaaagtggggaaaacggattcaattgtcagagaatatttccatttctatgggcttttgtagtgaaatttgcacgcccggccaacagagggattattcgtacccaaacaaaaacggatcagtgatcagttgcgtacgctgtggtaagtgaagtggcaaaagggcggcggagcgattcattagaaaaattaataatgatttatcacattaaaaagttgccactttgccatcgactttggtgccgagaatggaagggacgacaacaacaacagaaagcgcaacaacagaaacagcaatcgaagcagagaaaaatgccaccgaaattggggcaagtgaaaaagggaaaaattaaggacaaaaaggcataattaaggacaaaaaggcataattaaggacaaaaaaggcataattaaggacaaaaaaggacagaagaccgaaaacaaactaatttctttttagatagaaagtgaaaccgccacttcgatgcttttcagtcagccgatggaattggccggggatgtgagagacgaaacggaagggaacggaacggaaaaggtaaaggaaaagcggaaaacggaaaacaaattagcaaacaaatgaaggtgatcgagacgacgggagaagcaaaaattgaaacgatcactcaaaaaggaaaaacggcggaggaggaagaggaaaaagaggagaaaaaggagcacaaagagacaaaggaggagccggaattctcaatggacgaagagaatcagacagaaaaggaaaaagaaacggtaagggaaaagagaaagaaaagaaagagggaaaaagggagagaaagagagtgaaaaaaagtaaatttagacggaagaaagcacaacagtgacggacagagtgccaacattgccaattttgataatgaatgaacaccaaggcagtgaaggaaggccaaagtcagtgggaatagcagtgccaagcgaaacgaacccaacggcaacaacagcaacaacagaaggatcagaagaaggcgaagaagaggaagaagcacaaaagaccagggaaaacggcacgacaaaggcagctgatcagccgatcagcgaaagaaaagtcatgttgaaaagcgaagaaaaggtgcaacagcaggaggacgatgtaaatgcaacgacggcatcaagcagtacagaagaaacagcagtgactgtaaaggtggaacagcaggaggacgatgtaaatgcaacgacggcttcaagcagtacagaagaaacagcagtgactgtaaaggtggaacagcaggaggacgatgtaaatgcaacgacggcttcaagcagtacagaagaaacagcagttactgcaaaggtggaactgcaggaagatgatgcaaatgcaacgacggcttcaagcagtacagaagaaacagcagttactgcaaaggtggaactgcaggaagatgatgcaaatgcgacgaaggcttcgagcagtacagaagaaacagcagtgactgcaaaggtggaactgcaggaagatgatgcaaacgcaacgacgggatcaagcagtacagaagaaacagctgttactgcaaaggtggaactgcaggaagatgatgcaaatgcaacgacg

SEQ ID NO: 17812 - DNA, 3690 bp, Heterodera glycines
  misc_feature (44)..(44): n is a, c, g, or t
  misc_feature (117)..(117): n is a, c, g, or t
  misc_feature (126)..(126): n is a, c, g, or t
  misc_feature (133)..(133): n is a, c, g, or t
aaaggcctaaataggaaacagagctggcttatggaaaaaatganctgctaattaagagttttaatagttcaaacgctacgctaaaattaaggtttttcatattaaaaaaaaaacacnaatttcctnttattgnaatgaataaaaaactattaaaaataattattaaaagaatcatggcgaacaaattgctctcaaaaaaaacaacaacaccaaccaacttattatttatgcatttgtgcataacatttttggtgtcatgtagtggtgacgaaacaaaaattattattatttgttattaatttggttttagtatttgcccgcaggtggcaggcaaataaatgaatgaatgaatgttaatgacaggcgcgagaaaatataccgtaatcccctgtaattgatccctttgatgcccggctaattaggccttgtgctgctttctgaacaacaccaccgccccgaagctgtgtatgtacaacaacgacaacaaaaataataatgatgacttgtttttacttgaaaaattgagtacgggaaaaaggaattaatgacccctgagaagaggaagaagccatttatttaatagccccctcattaattggggatttttattcgagattctcgagatcagccttttgccggtgaagaaaagaaagataattgttgagaaggaaaatgcttaaaatgtatttaatagatagaaaataattaaggaaaaatttataaaataatatttttaaaatattattattattaaacgaaaaatcgttaaaaacactaaaaatgccaacatcagaacaaggattagagtttttttaattagttagtatagtcccaagttttttttatccaaatttaggacaaaaaagttaataaatttagattttggccaaaaattcaggtttgatttcagcacaaatatgaaaatcagcaggaccaccttctctggactctgtttattatagagcgggtttttagttattaaaaaaacgaccaaaaaattgttggaaaaaaatataaaataaaaatagaaatagaaattaaatagaaaaaataaaataaaataaaaagtgcgaaacattacatttttattcaaaagcgtctaaattaatgcacaattttgtatttaaaaaaaaaataaatgaaacattgaaattttacaatattattagattatcaaagttagataatagaaaatcgaaaatacatattgtacatagcaacattattgaattgaaatttttaggaagaaaaaaaaattaaataattttttttttaatttttcccccaaaatttgggggatttgagaggcaaaaacatcaaaaggaaaggaaacagagcaaataaaatatgcaaatgagcaaccctctccaacaaacacacatatgtaggtattatgtgtgcaatgaaattgattggctcccaattcgctgcccctcgggggaaattaatatgaaaaatatgcaaaaaataaaaattggcggcttcgattttaaataaaaaataaaattttataatttttaattttttgaaagaatatgtattataaaaatacggcatttaagtccccaccttgacaagtcgggatttctcctggaccgggattttttctgggttttttccggaacatacaagtttaaaaaaaaattatacataatatctttgaaaaattcctagaattgtttgtttaggaactataacaaagtttcattgaactgaaaaaatttaagcccatgtatttcggccagcaaaattttttaatttaaaaacaaatttttaaaattttgcaggctatggctagtgcctacctagcccggcagcaggtggtggctctccaagcgtataaccatggcaattaaataaattaatattaatgttcgatttttttttttgctctaagctaacttaaacccaaaatttcccaccactttttggtacaaatcgtcggattaaagtggaagaattttttttgttttctgccccattattatggtggaatggagattttggttgtgtagtgacttacttacttacataagtgagtggagaatgaatgaatgaatgaatttgtatatggaaaatgggggaaaaatataatttaatgcatttttgcatccgtccgtccgacgacggacaaatggacacaaaaatggggggggggacgaagacggggggtgggggacgtccacaaaaaaaatcattttatgcacataaaagcgctttcgcaacagtaataaaatatattttttttgtgaaaagtgcaaaaaaaagcaaatgaagcgacgatatttatgagcggcaaaaaaatttgtgcgttggaataaataaatcaaaaatttttttttaataataatagtaaaacagataggttcggcacgaagataatgtgcggcatttttttcagggggggggagaaaaattttaatctttaaatttgaatcgattgctttaaggaaggcctttagtgaatgggctcagtttttctattattttcgttcattttttccccaaacatatccatttcttttggatatccgctgaaggaataaatgaaatgcgaaactgtttattttatgggggcattaatttgaaattcaatgaaaaattcaaaagaattttaacttaaaatatttcaaaactcgaaaaatattatttttataaaacaaaaaagtttaaatgtgaattcgagaaaattgtgcaaaatttaaaatgtaaattcttggacagaaatcgaaaggatttgaaaagttaaaaatgcaaaattcgaaagaacatttcaaataaaaatttaaagatttgaaaataaatgcaaattcctaaatatttttttgaaaattgtcgatggcactttttgcctttcaaattacttcgaacccgaaagcaaattgaatttgcattttcaaataaaaaaaaatgttaaaatgaatgtcagcagtttgtgacagacagcagcaagtttctccaccggattttattatcggacaatttaatttcggcttactttataaaaaatgcttgcactaaagtacatgttttgttacaaaatgctaaaaataaaataaaaatatatttaaattttatttaaatttaaaaaatgctaaaaaaaatatgaataaatcttcgaattttatgttggcagttgaatttaggtgtactttaattcttcctacaaattgcttaatgtatggtattgtgtaaaataatatggcctttttgttgccatggagaaattaacgaattaaaagtaaatgaataaaacaggtaaaaatccaggtaatttaaaataaaaatttataatacaaaattgaacaaaatttagtttaaaaaattatgaaaaattgttaattttttgtgtaataaagccattaaatttcaaaataattttaaaaatattttggggttaaaaatatttaaaaataaattttaaagaaatactgaactacgaattaaaaaaggctattcgatttctatctataaagatagaaaaacccgcattcaacaaatttaaaattttttttattagaaatgtgaaaacaattcgtttaaataaaaaaaaatgagtgaaaaaatgtttttttggaattaaaagatatatttaaaagtaaattatttaaataaaattaaaataacatacatttgtatgatctatctataaatggtataacagggaacagcaattctgattgaaaataa

SEQ ID NO: 17813 - DNA, 3346 bp, Heterodera glycines
cctcattaaaatagaattaaaatataaatgaaagctatacttttattgcttatgtttttgaaaattcttttaaagctaaaatttcttaattttcactgacgaaaaccaaaagtcggaattccgtgggtacggcggggctctcagcgagcggcgctgcggaatgagtgtgcagcagagaagggccaaacctaaaaataaaatgcgaaacgctaaatttattaacatctcggttatacggactataaaacaaaagaaaaactgacaaaagaatttctgaaattaaaaaagaaccccacacgaaaattctaattgattggccaataaaatggatattaacccaaatcaattttgtaattaatcaaatgcataaaataaataaatttcgacatgggcaatgatcattagagtttttcatggatccaggtccaatttatttttgtcaacctaggtttttcctagtcctaattttcttggatttttccaaaatgccgaggcacagattcaataaatggaatcaataatatttgagtcatttttgattggataaattgtaaaataatagattagaagcaatttcacaaaatgttctgatgttcgactacataatcaggttttttgactcgatgctctgatttttaaaaatttttcgataccataccctgttataacattcaattttttaattgttaattttattttgggttttttgccaattatttaattttcaaataattttcatttatacgtattttgaaaataaatgcctcctattgttatgaatagggatgcgacttttagtgacgaaaaatcccaaagtagttaactaaaatagtgagtaaaaatgccaaaatagtgagaaaatagtgccaaaaagtccaaaatagtgacataattttcagccaaaaattgagcaaaaataatttttattcactatttgcagttgcaaatgagtaggactgggatttttgagggcaaaaaatccaaaataggtacctaaaaaataatttttagaattaaaaatttttgcaaagaaagtgaattttgtgaaaatttttctatttcttaggagtgatttttgaaaatttttatgtcgattcttaggggtgtattttttgaaaaaaaattttaggtcgattcttaggggtgtattttttggttttattgcgtttttgttaaggaattttccaaaaaatgttgaaatagtgacaaaacgccaaaatagtgatttttaactattttagtgacgaagtagccaaaataatgatttctagtgaccgatagtgacatcagaatcgaaaatttttaatgcagtaatgcgttttttgagctcctttcttcaaatcaattgagcaaaaaatttagttaaaacctaaaaatcgcatccctagttatgaagatcaaaagaaagcatgaaatcaaatgtacagaaatttgctaatgatttcattcctccagcttgttgtccccaaatttttcttccatttaaaaatggtctttttgacaatttccaaaatttaagcaattttccgataactaatttttaggttttgtctttttattttccaataatttttaattttttttttcattttttctttcttcgttattttttatagctaatgcaaaattgtttcttccatcactcaattgtaccattgattatgccaattttcttgcaaatttctatataattttggtgcgattctatgtttgatgtttttttttttgcttaatttcacttttcattaaaatgaattttttacaatttcaaatgttactttatttgcttttaatttaaaatgagttttattatcagggttgccagattaaaatttttaaaagcttcatttggcatgcaaaaaaaactcatttgggtcaaaaagcttcttttacaaatttattcaaaacacatttaaaatgttcaaatgttatatttttgattgtccatgatcaatttgaacaattttatgttaggactaagtattttgtgaaattctatgcatgaaaaatcgaatttgatttttttgcggcactttttccaaaaaacttctggccaacaacaggggcaggcggtgccatgctccgcagggaaacattttgtgaagaatttgaccatatttttagcagattttcattaaaaaattcttaattttatgccttttccccaaaagcaccaaaaatcctcaacctcaaaatttttcagaaaaccacaaaaagcctcattttaaaaagctagcctcatttacctaccacaaaatgagctaaactagactagtgataaaaacaaaaacttcaaagatgctaaactttgcaaaaaaaaaatacaagaaacgagagcttcataatatataaatttaaaaaaagtaacaaagtaaataatacattaattaaaaaataaaataaatttttcaaaataacgattaaaaattataaatattttttaaatataagcgcaaaatcaataattatattaatcagtgagcaaagtgttgtttaacggatttttttattcttgaatgcaagatgcgcaaaagaacagattgttacatttctttagaatactattgattttttcttaaaaacaatttatttcaatagtgaacagcaaatataaatgaaaaatgctttatacacaaaataattaatttaaatagttgaaaggaattattaacattaattgatcatggtttgaacagataagtctacgatttaaagaaaaaaccgattttaaaatatttttaaaatccttcatttgttggtaccaaaatgaacaaataaatatatgtcaaattttttaaatggtataatgatggttagaatctagcatataataaatagtagaaataagtatacaaatgcaaaatttgaaaataaaatgaaaaataagataaataaaatctattataaataaagcaaaatttaaatttgaaaaaaaatcaaatctatctttaattttatttcattttattttataaattatgtacttgttcagaaaaatgtaaataaattattatataacatgaaatgtaaatgaaatacaaatagcatttacagtgcataatgacttttaatatgcataaaaattaaaggaagaactattgttttcgtttaatccaatgataaaaatataaaagtgaattcaattgaaaattcattttaaaatattttaattaatttttaaaaacaagttaattgcctttgcttacattaaaatataataaaatataaatgaaaatgaaatatccgagacaggattattaaaagtagaagaaattattgctggacgagagttgtaggggttggatgagaaaatctttcatatatgcattaaaaagctaaaattaca

SEQ ID NO: 17814 - DNA, 602 bp, Heterodera glycines
aaatttaataaataataataattaaaatttatttttcttgtttattctcatttctcttcctctttcttctagagtagagcggtaccgggaccgggccgggaattcccggtcatccgaggtcccggtcccggttcccggtcccggattttgaaaagctcaggtcccggtcccggtcccggtagggcaaccgggaaccgggaaaaacaagcactggtaagaatggggtctgagtgaaaaattagtgagaaaattggagttaaaggaaaaaatttagaaataataattaaatatattcataaagtagcaagaccaactgtgcaaatggcctagtggctagtagtctccttcactttcccttcttctttcccctggttcgatccctctacagaaatgaaaatattttgaaatttctttttatatatactcatggctttcctatcgacaaaatatgattcttaatttttttttaattgtattttatcatttttaaagaaaatccgtacaaattgagcctagtaatcccaaaaccagccttttttgttgaaaatctgttaacaaatctcactcaaattttcaaaatttccaccggcggagcctatcgg

SEQ ID NO: 17815 - DNA, 1473 bp, Heterodera glycines
  misc_feature (1449)..(1449): n is a, c, g, or t
tgcaggtcctaaaataatatgcactcaattaaaataacttaatttaagccaaaaataaattaatgtaagccaaatattactataaaattctaactctaattaagaatttggcgcagaaaatttttattaattaaccacaaaattattgattttaaattatattttctcaagactaatttggcttaattttcttacttttaaattttgacattttacacccctaaattttaaagtttttagtgaagatattataattgtaggtatagttcgatttaatgtaaattaatttttggtaaatataattttatcatttaaaatctctcttcagaaaaataaacttttacaaaacatttatggttttttcacttttttttactataatcaccggtaaaaagtatatcagtgcctaatttatattcttattaagaatatattatttaaataaattacttgtataatatcaattttaaaatttaataaaaccgaaacaaatataaatatgtttataaaatatatattttcgttcatcacttataccaaaattgactatattaattagattcattaaatgtatatttaattttttttatttatcgaacaaaccacaaggtgctgtgcactctaacagtggcgtaaacacaaaataaaatcaaaaattcaaaataaaatattaacagtagtcaaaaatcacataaataagtgtcaaatcacaattctgatttttttaaaccatttattattgtataggaattaattttgtgttatttttttcaaaatcttacttttgttcctaaattgattaaaacaactaaatttagtcacaagtcactgaaacaccaaaacgtgatcagttgtacagaaagggtaataaaaataaattttgaagattttaaattttcagtttttatactccggtccggggtttgaaattgttagaaaattgctctttgttctttcctatattcatttattactgaaatttcatcccttttcagaggatcttaaattgagatttaatcattattttaattattcaagtttgattagtatattgttaaaaattattattatttttatacacattattaaaatatttactgaaatggtaatagttttttaaatataatttatagggtaacttttattaattaattatataaaatttatagtgaatatattaatggcttccttcttttaaaatacttatgggttagataagttttacaccaaaattttttccattaaaatttatttttaaaaattcaagaagaattataaatgatttaaaaattttacattattatcgaggtaagagatcaatagaaattgaaaaatcattaatgagtcagagatgagaatttgggtctaattccaattgttttaatttttattattttcattcaaaaaaatagaagcactatttaataaacacaagagggttttaccganataattagccaaaattcttttatt

SEQ ID NO: 17816 - DNA, 2554 bp, Heterodera glycines
  misc_feature (2349)..(2349): n is a, c, g, or t
  misc_feature (2442)..(2442): n is a, c, g, or t
tgcactagtgtcgggcattttgacattaaaatgccattaaggcatcgttgtagcaatgatgcacgtgatcctgggaaattcctcagggaataatccctgaatttcttctattttcttatcactcacaaatcactaagcgaaaattaagaagatcctgatcattagcgttcttgttctatttttgcgctattgtgatatttattctcgtggtcctggaaaccacttaggaagaattattccgatttttcgaaaccataaagttatcgaaagaaaagcattattgacgggccttttccaattataatgccatttcggcatcggtctaacaaagatgtgcatggctttgggaaattcctcaggaattaaatttcgttttctaaagaaatgcactagtgtcgggcattttgacattaaaatgccattaaggcatcgttgtagcaatgatgcacgtgatcctgggaaattcctcatgaattaatccctgaatttcttctattttcttatcactcacaaatcactacgggaaaattgagaagatcctgatcattagcgttctcgttctatttttgcgctattatgatatttattcccgtagtcctggaaaccacttaggaagaattattccgatttttcgaaaccataaagttatcgaaagaaaagcattattgacgggcttttccaattataatgccatttcggcatcggtctaacaaagatgtgcatggctttgggaaattcctcaggaattaattttcgttttctaaagaaatgcactaggtcgggcattttgacattaaaatgccattaaggcatcgttgtagcaatgatgcacgtgatcctgggaaattcctcatgaattaatccctgaatttcttctattttcttatcactcacaaataactgggagaaaattaagaagattcctgatcattagcgttcttgttctatttttgcgctattatgatatttattcccgttcatggacggtaaaaaagaaaaaaaagcgacaataaatctttttatggataattatgggaaaaaattggcgttctgtcacatttactttttatctttatttctctcacttttatgtactatctcttcattgttaataatgtaaagaacaacatttacttcgctctatagaacttttttttcgccttacagaatttcttcatattttgcatatcgatagagaaaaaaatataggatttttcaatcgcttttttaaagaaaacaatcgcttttatttaactttaatttttattttaaggcaaatttattcttttcctctccttttggcgtactattttcatgtctctaacacattaaaaatcatgaaattcgcaaattctaataattttggttataagggtacaaaatcactttgaacatttagaatcaatagaaaaaagaataaatttagcattttggttaaaaagagctggctaggacttgagttataacatgataaaagtttgaaattccgacaacttttttctgagatgtcaaattgcttagcattcacttagaaaaagattctccttttcaaaatctttttttagataccaaatttgttcatttttgttgggaatgaagcgtattatggctgatcaaaataaaaaatacaaaaaaggcatttaccagtgtaagtgcatatactttgtttttgcgtgtgttggcgttttgttttacgccaattattttttggcaatttttttcgttttttaccgtccatgtttaaaactatttcacccactcttgaagaaaattttttttttattgttgtggcctaattgtaagccaaattttaatgcgatttcattataaacaacacacaatcatggtaccccttttgttggttcaaacaaaaattacaaaaatgaattattttcgttggtgtccaaaatttatttgtcgttgtcaaagaccaaacacaaaagcgcatggggaagaaaccacgcgttttacaaatgtataaaagggcgaacaaacagcggagagagagggagagaatgcattatatgtataatatatatttttttgtatgacatatcacaacaactcattcagtgtctttttgttttgtctgtccaaatgtgtgcaaatcgttcgcctccagcctccatgaatccgtccgttccgtcgatgacattatttggggtgtgttggtgtcgtgttttgctggcagttcgtttaacgtctcagaattgtcgcggccttttccggggcggttggttcagaatgatgggcggcgtctgctgggtggccaacgccttgaacacctgctcgagcaacggcgggtgctccttgaccagaatcttccacccgtccgactccatcacctgngagaggtggaaattgaattatgatgaaaagcgaggaaatgttccaataaaattcttctaacggcacttatcttcatcgccggaatattctctnaaaatgttcccccgacgataaatgcgccgaattttgcccaattccccaaaaccctcgtggcgtgcagttgatgaactcacagcctgcgttttcaggtgttccgccgagtgca

SEQ ID NO: 17817 - DNA, 2302 bp, Heterodera glycines
  misc_feature (2146)..(2146): n is a, c, g, or t
  misc_feature (2177)..(2177): n is a, c, g, or t
  misc_feature (2222)..(2222): n is a, c, g, or t
aaaagggatgagaaattgagatatttttatttcttgactcgcaacaaccttggtttttttgttgtaaatttatgtcttttttttaaattttatcatggtaaatgaaaaattgaacataattgtagaatggaacacagagaaatatgtagatagagtgaatgatcacagatagaaagaaagagagacagacagacagtaaagaaaaaaaagggacaattccggcacaaatgccaaatgggtgccgtcgccgcccccctttccatcgcccagtttttcgcgcactcaaaaccaatccaaatccaatccatggctttacggattcatgcaaaagccgatgttcactgcggtggccccattgcattgcacggtggcccgtttgtcatcaaatgcgaaggcgtacgaattgccggaaatggcggtgaacgcgtcgtatgcgtgtgtctgattcagtgtccatccgctttttcctgggccacaaacgcttggccccgcaaactcattctggcaacacacattcggcgcattataaaactcgcacacacttttcacttttgtttgctgtgaagaaaaaaatacagtagtggtgataaccaaaaaagtgatgaaaataatgacgaaaaaaacaaattattttttaaaataaaattaccgtattatctctaattagcccaccgttctccatttattcgcctttatctaattataccccccccctttcagaggtgattgaaaaataatctcctcgggaggataaatagaaataatacggtaaaaccagggctcccagatctgaggctttagcctcattttgtggttttttgataggtcaatgaggctaaattttaaaaatgaggctttgagactttttgtggttttttgagaaattttgaggatttttgaggcttttggggaaaaaacgaaaatctcacccaaattttccaaaaaaaaattgttaaatttttcataaaaaccagaaaataaccaattttttccaaagttcacaaaattaagaatttttttcaatgaaaatctgctaaaaatatggtcaaaattcttaatttttcccccggcggcgcctatcggcaccgccggcccccccccccttgttccccaaaagttttttggaataagcgtgttttgaataaagttgtaaaaatgaggttttttgactcaaaatgaggcttttttgcataccaaatgaggcttttgaaacttttaatctgggagccctgtttttttgcattttaattttgattcataatttttcagttgaataaatgcaattatttcaaacgtaatagtaatttttcataatttttaagaaataagaaaatttaaaaaaaaagtaatttccctccaagtagttgtttttcttctaatttttcaaaattattcatttttcggtgggaattcaatcataattttaacaattaaattcgtaaaatattttcattttttggactaaatcagttaacaaattgcacttaaatttaatgaatttttgttttgtgcgtttttgaaatgataaatattgtaccaaattgaataaaaattaaaaaaaaaccaaaaattagttaagaatagagtcaaaaaatgtttttaacaatttttaagcgaataggaaaattttttgaaaaaagtctcgagtctcgggttttttgggtctcggtctcggggttttcggtctcctcgggtctcggggtcgagtctcggtctcgagtctcgggaaatttttggtctcgaacagcactactaattagctttcgatcattattcagtatttttttgtcttttttctgcagatttattttgctaaaaactacaaaaaaatgtactgttttaattcacaatatatcaatgaataaatttagtttgatgcttttaggatgcgttttattttcatgtttttccatatttcaggtttttatccatatttcaattttttacatccatattttggcatttttaatgaaaatttcaaaaacacatacctaaaaagatgggaaattttttgaaatttatgggaaatacacccactaaatcgaaaactcttgaaaaaaacaaaaattgtgaaaaaaatttcattgacaacattcgcttaaaattactttttacagaaaatttctaatttttgcaattttttttncaacttttaatatttttccttaagtaataanagaaggagttctcattatggaatttcacatataattccaatattnaaatgattttttcttcttgacaaaaattttatggttttaagaatttttttttcaaaaatcaaatcaatttcaaaaatttt

SEQ ID NO: 17818 - DNA, 802 bp, Heterodera glycines
cttttaaattgtttacatttataggcatatgaaaatgtattttatttcaaagttggcggcgccgaaactgcagatgacccccgactcgatgcagaatactttaataaatgagcctagaaggattttaatattttttctcgatcattcaaatataatttttaagacagcatttttcatgattaattattaaaataaaattttttaatttacgagtatttaataagtcttcgagaaatgaaaaagcactttatttatgaaaatccattaaaacgtttataaatggataagatgtcaacatcaaatcaccttttacaattcaccctcctcactggcacttccattcgtaataatccgccacatcgttcgctgcatttcacgcactcattgtgagtgggcccagaacctccgacaagaaaaaccacaagaatgataagcactatatatgtgtataaagaaattaagtgagaaaacacttaccaatattgagcgcaacgagaacccccaaaattatgcgatgaattaacaattgtctttggtaacttcggttcgaggcagtcagctcgcggttcgtggcggtgaggtcggaaaccatctgaccagccatttgtggcacaacaccgttctaaaagcgaaatgaaatgaaaagtgaatttgaaaatttgattatatttatcactcagaccttttttatatcgtctaaaaacaatattctacacattttcaatgtaagaaatagtaaataaaaagaaaaagttcctaaaaagttgttattttaattttaaaagtggaaatagttagagat

SEQ ID NO: 17819 - DNA, 1692 bp, Heterodera glycines
acaaaaaaaaaacaatttcaactaaactcatctttatggtattaaacacacaaaatcggtaatttttcaaattgacttacgggctggttctggttttccgcgtccatatctaaaattaaaatcacgtagaatatgaaaaagacgaatagagtcataagctacatattttctcttaagtattttcaaagtttgttaaaaagttagaatttgcggtttttgttgactagaaaaaatcaacttgtgcccgaatgtgtttattggcactaccgggggaattcttattatgaagctaaaatgaaaattaccaaatttctttttctcccatggccattcctcgccgggagcgctacccccaccccgccggttacattcccgaaatttaaaaaaatatataaattttcacgattttcggagccgctgatcatgaatctgccaataattttgactaacattaatccaaactagaataaacgtccaaaattcaaatttttatgaatttggtttttcaattgggaaaaggtttggacatgatgaaataactgtcagaatcgtaatcaacgacctcaaaaccacctgtgaaatttttcgggtaaagtgaaagcatcggggtatttactgtaaaaaactgccaaaatcataacttttttctttgttgaccaaattttaggcttactattagtcgaaagctctacatgtttagaagctaagcaattgaacaacttataaaaaagttgcaacactaaaaccacaaaaaatccgaatttttgcatatttttttttgttactttttatacattttggttaatctttgtgaagccaatagagattattaagagctttcgaatgataccaagtttgttgaatttgttcaacaaagaaaaaagttttgccattttaaacttggctcatatcagacgcaactgcgcgttccgttcgccagcaccataggaaagagtttgtttttatagttaaatgcttttagtagtaaatgctctattttcaattaattaactatccctattttaatatccgccttaaaaactgagactaaccaattcaacgtgtgtgtgtgtgtgtttgaagtcttcagttcacaaacgacgcctcaggagccgattggtccgcgtacaatggaagtccgtgggagacagtgaacggcaacaaacaacaaacagtgccgagttgaggccgagttcgtctgcaatgacaaaaatacattttataaaaaaagcatgtcagcattttttgtatggcggcgattttttcaacccttcggctgatttttcgcgcgatttttgcttgaaaatcccagtggtctcggtagacgcagcaggaaaattcaatgcttgaaagagatttttcgtaaaaacttattatttgttatagaaattatttcgaaagattttcttttaatgagtaaattcgaaaaattttggatgaaatgattgcctgcggtgctgataatctttgtttccatgtgtttagcgttaccttagtgagtgtgtgcagcaaacgcacaacgggatgtggaagcaaatggagcggtgttgaaaagggactggaaaaatttgtttgaatattatacgctaaaagataaaattagcaaaaaatggctttcccttgtttattatacatctttaattatgttaataccatacacgtgcgaaagaccgactcaaacagacccacaca

SEQ ID NO: 17820 - DNA, 2343 bp, Heterodera glycines
aaaaaccatgacaaaatgttttcgggatactctccgattaaatagtgaagcccgagattttgctgctgcttctcatagggcaattacggaggccgaaaaaattaagactcgtcatcctgaggcaccgggtatgaaaacgtggttcggtaggctattagaaggggtgagaaaggtacaaggaatttccgaaaaaattaacgaagaaagacagaaaatagggcacattagaaaagaaatggacaagtgtttggaccgaaaagatgttctaatgtgtcgtgaattggcagacgaagcgaagggggcttttgaaattgttaagcagtataggttggatgccggtactgcgtaccgtaacgcctacactcagtcagacctcggaatcggggaattggccgataaagttaaggaaacaatgaaggaatatttatcccgccccggaccttccccaagaccaacatttaaagaccaatttatatctgattaatgtataaaagagaacaaaaaaaagataaataattaatttaaaaaatggttcaaaaaacagaaatagggacggcaattttgcttgaagctgtgaaaaaagaggcagaaagggcatggaaggaagtctcggtattggcagatgaagttgatgattattccaaatccgcccgtggagcccttaatcgggcaattaaatcccgagaaaaggccccctatgccccgggggttcgagaatggtttgtaaaattatcagattgtatctgggaaatttacagtgttctagataaaattaattccgagtctgatagaacggagtctatttggcacgaggtcgaacgatgcaaagacctcgatcaagctacgaaattagaggataaggtatttaagggtttgagtgaatcgagaaagctacacttagaatctcgcaaaattcacacaaaaattttggagttggaaaacagaattcaatctgttgtttggcgttttattgagtttcacgagtaaaaaagaataaaaaatgacaactgttgaccaagaaattaattttataaaggatcaaattgtcagatggtggaaaagagaaagaaaaatggttaaagaggcagataggttagttagttactgtaataaaatttctaaatatgtaaaaatatttacaattattgccttcagtgcaccaggaatacatttattatatgaaaattttttagattcagttgccaaaattcgggtgctatatcaaaaaatttctgacgaatataaatacatttccaattcattaagcgaggttgcaaaatgtagtctacccaactgtcaagagaatgaaaatgattcaaaaaagagtattacaaaatgtttcaaatttagaaagcagatgacaaatctcctaaaacatgtggacgagttatttaaaaaaaatacaagcatgtgctataaaccatttaaccgcccaataaaaaacgagttattttatgcgccatatgttaaatatccaaatatagaaatattctatagtccatttctagagaataattagtaaataaattatattttaattgttaacaatttcaacggtttttatttattgttaaaaatttcacctcattttattttattattaattttttcattggtggtcctccctccccctccatagtcttttaaactgatcagaaaatagttcattggcagacgggtgatgcataggggaggcgggcgtgcgtcgcttcgcgcccgtcggttgtgttggggttgatggggctgggggtttgagtgctagtttcgacgtttcgctggcgggcaggtgcccgtggggcagggggttggtggggctggggtctgaatgctcatttcaaagttcgctggcgggcaggtgcccatggggcagggggttgggggggggatggggcggcgtgcgcatcgacctttgggtgcacttcttacacacgtgccgcttgaccacacgcaagcacgttgaccaacgatttttggtgtcacacgcccctcgggatttgctggggtcattttgagggtggccgccaattacccgccaagaatccccccctaatactactgaggggcggggagagaaacggcaaaattgccaaatgaaatttggttgtggccgcttaaataacaataaatttaaataaaaagtggcaaatgtgagcagaacaaaatgggccgaaaatttgggcacgaaatgaaaaacgggggacaaaatgaacagatgaacaaaatgggcggaaaacgggaaatttgggggttcatcgttctttggagtctcattcgccgaattggggacggcggcagaaaagtagcggttttgacaaattggtcattaattgtgcgcggggcatg

SEQ ID NO: 17821 - DNA, 2252 bp, Heterodera glycines
  misc_feature (13)..(13): n is a, c, g, or t
  misc_feature (65)..(65): n is a, c, g, or t
aaaaaaaaaattnttatcatttcagtaaatctcattgacctattaagctgaatttttttaccatncatatcttccaatatttaagaagtatacaaaaataaaagtatagaagaaatatttttttatgaaatttttaacgtcatttgatcctaatttgctgtttcaaaatatagaatcaaaatttaatgcaactgttttctgcacttgataaaaatgtagaaaaattcatgcctataattttcgatgctgatcaaaaaagtcaattgcattaaggtggtgcaattgacttttttgatgagcccaattagtgatactagtatgaatttttatatatatatttttttgctttttaaaaaagtttgatttttttaaaattttgattctataatttggaacagcaaacttggactattttcgtgaaaacacgttaataaaatttttcttctacaatttcattttgtctgcttcttaaatttatggggaagatataattggtaaaattttcagcttgataggtcaatatggactaggtgtaatgacaagaacagactgtatttaatttattagtgttaaatacatcaaaatttaaaattattgtaaattaagctccgtaacacaatgtggagtgatgatcggtacagtagcccggagcagatgaaattgtgcagcaagaagaaaaagaaagttgaagaaggagaggaagaagaacatatttacccggttaaatacaaataaaaaaattattaaaaataataatattgttttattattaaaggtttcatctaaatcggacatttgggcaattggcatgatgctgattgagttcttgttgatgacaccattgttcgacattgacccagtggtgattaagcgttccaatgatcaaaagaacatttacaatgccgtcatcaacctgaataggttttgagtgaaaaattgcaaattaaattttaaataataccattttcttagatcttattatgatgcagaattggtgcaagaacccaaaagaacatataaaggctatctgagagagattaaacgcaatttccccaatttttataaaatcattaaggtcattttaattatttataataataaaatattttttcactttgaggcctgtcttcaaatagatccatatcgaagaccaactgcacggggaattgagaactttatgaaaggcgaatgcgattttaaatggctaacgctcaagccatgcgacgagggagccgcagtgaactagcaaaaaatgggcaaattttgagagaaaatgtacaaggaaagaaagttatgattagggcatagaattatatttgtgcatatttcgctatttatgtgcatatttggatatttgtgcaaattttggcatttcaaaagaaattttttagcaaaattttgtcgaaaatattgactaaattaaattttcttaaaaattgattaatttatgtctaaaaatagcaataaaacgaaattttgcttttcaggttgatttttcgtaaaatttaagctgtatcgtgttttttcttctaaatgattttaataccatattttagtcatttttgaaagttttactttgcgtttagcgaatttaaagaaattttgaaaaattatacactcaatttggaaaaatttatgtgcatatttttcacttttatgtgaatatttgccatttttggtgcatattttatatgcatataattctatgccctagttatgatccaccgaaagtgtagctgtttgatttaattgtttgtgatttttagagtaaaattttgcatttttattttttggacatattaaaaccgatagttttttgaaattttatcatgcgaaattgtacattgtttaagtgacgatatcggaatggaatttaattttagaaagtttaaaagcaagaacgtcggagttaggggtcatcaaaaacttcataaaattagcttggtaaaaaaaaattagatgtgccaaaaacacttaaaaccagggtcgcaacttttagttacgaaaaagctcgaaatagttaactaaaataatgaggaaaaatgccaaaatagtgacaaaatagttaaccaaaattgtcactatcctttctgttatgccgtagagtggcaaacaaataatcaatatttatggagcgaataaaagaaataacaaaattgggggaaatgatgcgaatgagacatatgacgagggaagttcaaaaagcggggtatttatggacggagggagagaagagagataagggggacgag

SEQ ID NO: 17822 - DNA, 1487 bp, Heterodera glycines
ttgcgcctatgtcaaaatcgggttcaaatgtgagttttttgaatccttgatagcctaagtagcatcaactaattgataggaagtaattatgtccgataatttaatcattagttagtttttgaaaaaatcatcaattattcaaacaacagaattaatgctctttataaactagaaaacattgttttcttaattttaatgctatttaagttatcagggattgaaaaaatgtaagtttgaaccagattttggacataggcgcaaaggtttgggcgcaaatgtccgaggcgcaaatgtagggtaaccgaatgaatgcatatatttcgttatagggattttaaaaatacatcggaaaattttctaagtgccataaatttttttaaatagacttgaaatgggataagtatgaaattaaatagacttttccaaggacgtacctaaaatggcacaatttattttttgacatttttgcggtgtttgccacgcgtgtcatatttggttctttctctttacctgtgtcgtgccgagtcactccattgatggtcagttcagtaccgtcagcacttacctaaataatgccaaaaaattaatttagtttttttttgtatgtataaacttgaaaatgccctttcaaatcggcaatttcgacaccgttaaagaaccaagtgatggtgggcttcggttcaccgcgtgctttacaactaaatttctttaaatttcagcgatttttttagttgcaattataaattttattgacggatacggtaccgaattttgagcaaactctccgggtactgtttgtcatgatagacttgaatctcgaataccttagggttaggcgctggcccggacgagcggtttgccttcggggcccttcaattattgtcggcggcacactttggatcaaaaatattcaaaaattgttaaataaataagattaattaaattttattgaaaacaataaaaaacattaaaaatatataataaagcatccaattaatccgccgattaaactacattataaaaggttaccccgagattgaggctttgcagaattccaaaaaaaaaataggtcaatagggcaaaatttacaaaatcagcaatttggtttaaaattttaaataaagtagaatattcataaattacttttaattacagtaccaatattaagcatattatttttattattatttaaataaaaaaagaaaaaaagttaattattattagtaatatttatttaaattacaactaattagtttcagtaattgccaaccagtccaatttgtgccgcctcacttttcactcgaccgttcaaatttgtggcttcgcacgcatagctgcccacatcgtgctccaaaaatggataaatcaccaactctgtgtgctcttttttgaattcaaatttccgcgacggctcaatgggacggccattgaaaaacctgaaaaaaatgaagaataaaaataataaatataatttatttgtttttatt

SEQ ID NO: 17823 - DNA, 1800 bp, Heterodera glycines
agtctaaaaaagcaccatttttaaaaatttattgctttgagcactccaacattgattttccgacctcatcggaacaaaaaaatagaaagattaaaaatgaaggagaaatgaatgaacattgtgctgtcgctaataggtcactaatatgtattaatgagagggggggggggagggggtcataaataatttacggcaaaacgatgacccaacaaagtggaaaagaacagagacatttttgaattgaatttgcatcttttccaattcggggacattcactttaatataaacggattatttcctaaaaatatattcgagtcaaaacatttagctgaaactagttaacaaatttaagaatgtgttagtatttgatttttggcgtttaaatttattttaattatatgtcccttcataattttgtctctttgtctgtgattgaattttacaaaatttattcaaaacatgcttaaatgttcaaatattatatttttgattttccatcagggacggtcccaggatttattcgtgggatctgggagccctgatgataatccaatgaagagagttttcgcagatcatattgggtatttatgatttgtcctccatttttgcttctttcacggtgacatcaatggccaatgtcactttgtcctcgcctttgtcgtagaagcctttgctcggttccatcaattccttaattaggccaaattgtccaattaatgaaattagttatcaattaatactcaccgcaaaggcaataaaatataagccacaacctgctgtttattgttaaaaactaggtcatagaattttccaatggaattctccgccactttcttttgcaagacaattcgaaaggttcattgtcatttcttttcgtcttcgcttttagttgtgccaatattttccaaaaaagtccctttatgtatacggtatcgtcactgaatctgtaactctccattggatgtcttgcaaattcggacactttttcaattttcatcgaaattgtcccaaatgtccaaattcgccaatgactcggaaatttcagtgggtgaaatagttgagaatacattccacgaaaattctgttgacaatagaactgataaatgccaatcttttcttcggctgttaaaacctttgaaggaactgaaaaattatagaaaaatgaaaattattcaaatttaatattttttttacctattttatcaaaaaattccttttttgagaagagagggaagcgaatttttaaaagtgctggaccgagaatggcacgacgattttctgaagaactttcaatgccattttgacggcattttgcgtctgcacaacaaagtgcctttattaatgagaataacgaattattgaatttctttcttatttatagtaaaattacagcgttccaaattgaaatttctccacggatttgcaattcgtctcgttccaaaaggcaggcctgggcatatgccaagaaaacattgcgtagttttaaaattggaatttgcaaagatggatcgactagaccagggatgttgtactttttggctaattaaaaataattatttaatttaatttaattactataaataaaattcaccggcgtaaagcactgccattgcattgtctccgtttaattcactcaactcttccgtatagatgaagctcaacatcactttgaacgctgctgcttcaacatcggggacctccacgggacaattagcagaggctaattgaaaattaattagtgtaattagtggaggctgattgaaaaatgaaaaaaagggaaagagtaaagtaacccaaaaa

SEQ ID NO: 17824 - DNA, 1346 bp, Heterodera glycines
tttgcttctttcaccaccaaatcaatggccaatttcactttgtctccgcttttgtcgtacaattctttgcccgggtccatcaattgcttaattacatttaattagggatattattataagaaaatcgtttcgatattggaaaatatttaaaaaatctatatttagtataaaaataatcaatgaatcaattttacaaatatttttttttaaccaaaaaatcaatttttttttggtttttctgctttttatttattgggactcaccgcaaaagaaatgaaattggagaatccccagcagttgcttgctttcattgttacgtcattgaatttgtgctggaaatcgcgcacttcgttcttttgtgagacaattcgaagggttgccgaacaaacgcagcccaaattggagtcttaaaaccaattaatcagttaattagcacttttaattgcccaattaattttcatttaccgtcttttggagcgtcgtacaataggaaaaagcccagccatttctcagcgccagcaatttccttccactttttgagttcttcccatttttcttggcgttttttattcgtttcaatgctttctttcagtttttcacttctttctttactgattttttcattgttttccttcaattttttaccgttttcttccaatttttcacgaatttccaacaatttcttattgttttctatcaatctttcagcggtttctttgaatttttctttttttttaatttcaatcaatcttttgccgtcttcctctattttgttggcattttccaccaatctttcaccgttttcctctattttgttggcattttccattaatctttcaccgtcttcctccaatttcttggcattttcctccaatctttcacccttttcctccaatttcaattttttggcgttttccttcatttctcgtgtattttccttcattttctcaatgttttccaataattttttagtgatttcttccaatttttctgtgttctcctccattttctcagtgttctctttgattttttcagtgttctcctccatttgctttgtcttctccttcagtttttcaatgatttgctcccatttttcattgttttccttaaattttcctttattttcttccatcttctcagtgttttccttcaatttttcgccattccgacactttttcaatgtccatcacaattgtgccaaatgtagaaattcgccaatgtcttggaaattgcagtgggtacagtaagccaccggatgtgccacagaaaattcggatggcaaagaaattgataaatgccgctcgggggggccatttttaacacaccggaagaaactggaaaaacaa

SEQ ID NO: 17825 - DNA, 2586 bp, Heterodera glycines
tcattcccccgctttttttttctcccccctttttttcgcctccgtttgactttaaaagtgctgcttttctcttcgtcggtagtcagttcagtcccccactttcgtcgtccaaaatttttgtttttgccccattaaaatttggggggattttaattgatgtcggatcaaacacaaaaacgtgttaatttataattcggacagaaaatggtagtctactattttggcacaatcggctgctgttttatttttgaattttccaaattttaaaatttgaattttttcattaatattttatttaacattttcctcaaaaaacatatgtttatggagataatcagtgaaaatcgagtttttatgagttttttttgttgttgttttttgtttacacttttataattgccatttttccgatcagtctaggcccaatctgaatatatctgatatcagatttaacgtttaaatgtgtttagaatccatttgtttatgacaattcattttccgatcatactttgaacctataatcagttttttctttgcagttccgagtgtcaattttgcattttcccgatcactctatgctaaatttgaatgaatctctctgatcagctttaggcgttttcagtgtgtccatttttcatttttccaatcaatgcccaattaggcatttttccgattaattatcagttttccgatcagttaacatccacattttaatatctgatccgttttaggtgttggaaatatcaattttacattttcccgatcatctctttgcattttccgatcactctatgcaatgaatctctgatcagttttaggtgtttggagtgccaattttacattttaccgatcagtctatgcccaatttgtcacttttggacaaacttatttttacttcatcctgtttttccaacctcatttgtgcaccaaattgacaacatttgagcaatgaatgttcagcaacagcagccggtcacctcggcataccctcagcagggcaattttgcggaggagaagcagctgcatcccaatcacaatgtgtataggaaaatggaacgactgatcaggtgaagttcaaactgatcatcgatcaaattatttggcatggttgatcggattaatcggtgtgtatagatctgtagtggattaatcggtgtgtatagatctgatcaatgatcagtctgtgtttaattaatatgtgatcagaccctggttagggctaattcgtcaatcaatcatatgggattaatgattgatcggattgaattttgcgtatcaaatttttcgttaatctggttcattaataaatatgtgatcagatcctggttagggctaattcgtcaatcaatcatatgggattaatgattgatcggattgaattttgcgtatcaaatttttgcgttaatctggttcattaataaatatgtgatcagaccctggttagggctaattcgtcaatcaatcatatgggattaatgattgatcggattgaattttgcgtatcaaatttttgcgttaatctggttcattaataaatatgtgatcagaccctggttagggctaattcgtcaatcaatcatatgggattaatgattgatcggattgaattttgcgtatcaaatttttcgttaatctggttcattaataaatatgtgatcagatcctggttagggctaattcgtcaatcaatcatatgggattaatgattgatcggattgaattttgcgtatcaaatttttgcgttaatctggttcattaataaatatgtgatcagaccctggttagggctaattcgtcaatcaatcatatgggattaatgattgatcggattgaattttgcgtatcaaatttttcgttaatctggttcattaataaatatgtgatcagatcctggttagggctaattcgtcaatcaatcatatgggattaatgattgatcggattgaattttgcgtatcaattttttagttaatccgattaaattttcaagaaaaaatttttgaaggttttttataaggaaattctaagaaaaaaaattcaaacagtgattttttggaaaatttttacaaaatcttaataattcaccacaaattttttttaaacttttttccttgaaattttcttataaaaaaactttcttagatttttttcttaaaaatttctacgttggtaatatttttttaaaaaaacttctcgagggggggggggggtgaacgagctgctcccgctggatcagtttacaataaaatttgttcagtctgatgctgaatgttgatgatggcgtgccgatcaagacggtcaaatcgtttctttcaaagtgaatgatgcttttggcaccgattttttggcacatttaaatcaaaattttggattgccaaggattccgtcggtgttcacgggccaagacttggtcggttggctgctccaaaatgtggacattgctgaccttggcgacgcgttgcatttggcccatttgctcgcctcccatggctatgtgtttcaggtgggtgagccaaaaaatgaatttttgaaataatttttaataaaatattttaaaaatttttaatttttatcgataataatggg

SEQ ID NO: 17826 - DNA, 3171 bp, Heterodera glycines
  misc_feature (94)..(94): n is a, c, g, or t
  misc_feature (106)..(106): n is a, c, g, or t
atggactgtcgacggcaatgatgcgcttttgtacacccattaagaaatgcaagcagccgaggacggactcggcgtggccctagcgagaaatagnaaccatgggggngcaattcaaataaatccaacttcttcaaaaaaataattttggtaaatcattttgtgattttcttaagaaaaattagaaattttaaaatttatcttgacatgctgatttcttatttcttcccttcagctgatgaccccggaggagttgaccaaccccaacgtggacgagaagagcgtgatgacttatctgtcgcagtttccgcgtgctcgtccgctctactcggcctcgacccgcgcccccttggaacaacaagactccgaaggcacaaccttggacgactccaatcaatcggatataccggtgagtttggaatgggatggaccatttcgagtaattattcttgggcaaaaacttgttgggaaatcctatcatagcttgtcaggcattaattcttttttgctaggtcccggctatccaaccgttctcttttgacgaagaaccgcttgacaatgttggggaagagtgccagcaattgactctgtcgcaaatggacgacgacgacaacaacggagtgaccacggcactcacctgtgtgaccaaaacgaccacatcttacacaattgggcagcagaatgaggctgatgacgaggcaggcatactttaacccaatacaaacaatgaatgaatggtctaatgccacacggacagaccattctgaaaatgggaccaaattgcacccggttaagtttttcaaagtaatttcaatttttctgatttccctcacgaatgggagggggagcgttcgtgacatatgagggacggtcggagatcgtctgggtcgacttattatagcttttttcagtttccaaatgagccgtctttgcccactgacatggaaaacattccgcaacagaatcatcagctgtacaacctcatggtttgtgagtcggacttaaacgacggaattgccgagacggcggcagagccaacgactgactttgacgctgtacggatgacttatcggcacgaggagctgcaatatgagccgttggtggtggtgtcagacgaagagacggttgccctcgggacgaccgccgtacgtcctcagcccggctttcggtcgttgtgccgggaacgatccaccgaccacattgaggcggctgcaatggtggcggtggagggccacggactgcaaagctttgtgcctggtcatgcggcaaagtttgcggtagacgcttcgaacaccggtgggtcagagacgcgaggattctcagaattggaccatttgcaattcaaaagcagagttggcctgcccaaaggcgttgttcgtcggcgttgtcacttcgcatggaccggcggacaaagtgacggttgagcatgtgggcggtggctgttacgaggtgggtaataattaatcgttctattcgaaaaaaatggaattaggtatcctacacggtgcaagacgacacggaagcgttggtgtttgtcaaatacggcaaaaacaatgtggacggcagcccgtttaggtcaaattcagattggttggaccttggaatacttttttgatttttccgctttttaattccattaattttgctttttgtttttcagcgttcgtccgatgcgtttccgcaacaatcacaatgacgacgctttcttggcggaaatgcgaacagacgatgttaattattatcggatgtgaatttgacaaaaatgattttctgtgtcctccccccatttccttatgtttcactttatgctatggcttttaattaattttaaattgactatcccattttccaggtgttttttgaaaattattaaataagtattgtgtgaaaaatcaaataattcatcaactgtcgagcggatctgaacccatgccaatggtcattaaaataggcaaaattgcttaataactattttcagtattttcctttgaccgaatttttcttttggatatttatttgccaacaaatgatgtcttttgatcacaaatgcttttttttgtgattgaccacatttttagtgctcttttccgtatggaattgctttgaaataaatataaatttaaaaaaaagaacggaaattgaaaaaataattatttcttttcgcttttctcattttcatcatcgaaaatgcgctccataaaggctttgagctccaacattgtctttttgaaatcattggccattttgttcattttgcttttgattgtttcgactttgcttctaatttctgcgacttggcggcccattctttccaattcctgaaaaatgcaaaaacatttttcactttccttttttcctcacctttctttcttcactttccgaattttcattttgaggagcgaaaagtgttggcgaactttgcttaaatttatttattgaaataaaagcgaaaataacagcaaaatataataatttaaaggcttatttttgaatttctataatattattgttttccacagttactttttgtttgttgtcagttgcttctttcccatttccttgtgacttttccttttgtaaaagattaattccattttcagaatttatttatgagaatttaagaaaacaaaaaagagaagaaaaatgcatttttgtaattattttttagagcgaataattaattactgataaaattcgttttacaattgcttaaaagggctcccgaaaatgcgtcagtaataaatacagtatttctaaggtattgtaatacaaaagacaaaattgtataagaacttcgttctgaattgtcagttcagttttactttaataaaattttgaaaatgtatccaagataatactaccgagtctcatttccaagaaattctgattcactgacgcattttccactaacccttttttacgctaacgcttaaaatccgactcacttttctccattcacttcccttggctttgttttgaacattttgcggaaaaaaagaatttccataaaaatttgacgaaatttgctttaatttcaattattattatttttaatttgttctttttttactttctgcttctcttcgctgttttcactttctcgcggcgttttcttttgaagagaaatccctccggcatttgaacattgcctcattttctgttttatatataaaa

SEQ ID NO: 17827 - DNA, 3639 bp, Heterodera glycines
tcaaaattggggggggggagggcggcggctcaaatgtcggcggcgcaagtgtcattttggctgggcggcgcaagtgtctgcggcgcaactgtcgcggcgcaagtgtcggcggcgcaaatggcagcggcgcaaatgtcggcggcgcaagtgtctgcggcgccaaatgtcggccaatcggttctgatatacaataattgtccaagggttctttctgtatatgcccaaattgtgtcgctgaacaaaatgtggtgtaaaaggcaaaaaaaataggtggcggttaattacgacaagggtaaatttgacactgaatattttcgacacggagaaatttcgacaaattcttagaatgaatttattttttaaaatttttggacaaaaataaatataaatactcatgcagcacaacggactcgaacctccgccctttgtcactttactatcttacaaaaaaccactgagccacacatgcaaatctttttttggtactgtggctcagtttccgccggacgctgtgtgtaaattcttttttcattccggcccattctcatgcggacttgcatttgcttttcattccgcttttgttgtgcgtttaattccatttgtcaataattcttataattattcatcatagcccaatttggcaactgatgtttaagcgtttcattattcgggctttgcaaatacaatttttgcccttggctttttgccattctttgttttatactttctttcttctgttctcactcttggcgtactcttttattcacttttttttaaatctaattaattaattaatttactaaatattttataaaaccattccccaacagtcctgtgacgggacctccaagatttcggtgtgatgtcagttctaatgttgagcactaatttcccagtacaataataataattagggctgccaaaagtatgcaaatgcatacttttttcctggcttctccatgctctaaatagtacgaaaaacactttcttttttgtgtttgcgtataaaaatcgggacttttatttgcatattttgggcctttatgcatattttggcttgttttacattttcatgcatattttgccattttttgtgcatattttccgattttttgcatattttgccatttttcgtaaaatattttccgttttgaatatcccttaagtaaattttggcagacaataggatgagctttagtgccgaaaatcttgagaaattattgattttcaattgcaaaaaaaaccgataaaatttatgaggaataaaaattttttattggatttgcacccctaattttcaagtttttttgtgcatatttcacgactttatttgcatatttatgcgcatattttggccacttttcgtgcatatttttggcagccctagatattaccaatgtgaattatgaaatgccaaatttaattcaccgtcttttgcagtattgccaaattgacccccccccccctaaattaattgattaattatatttaatcaaattgtaaattcacttttggccataattgagacagtttactttataaataacataaagcagaagcttgaaaaatcatccccattaaacactgtgtcatttcgctttcgctatttgtgccattgcaaatgcaaaattcggaagtacaaatcggcatgttcgtccgctgctggctccattttttgactgtttttgtttttgcgtctcaagaaatagtgatagaccaccaaagtgatgatggcatgggcgaagagaagccaaaatggaaaatgtaataattactattttaattaattaattcagaaaatcgcaccaaagtgattgtttcgtacgtgcgaatgtacaccaaaatgccaaattgttcacgtttgattcgaatataacccgaaaggatgttgaaaatggagaagaaaatggtgtaggagaagtccaacgggaaaatgatacgcatggtcaaaatgttttcatttgtttgatagtttctgctcagtgaatagtcctgcactttgttggagctttggagggaataaattagtttttaaagacttaaaatattcaaaagttgggaaatgatcaaagcacttggggattggctcagattttcgggatgaactctttttagaactaattaaataatttgtgctttggtgttccccactaattcctccttttctttccccccttttttacaatgcccgctttagtcgtcgattcattctgatcaaaaaataatcggcgattgaaatgcaaatgacgagaaggagaaaaaaataatgtgcatataataattcggtggcattgtaacgaccagtgagcgtaaaataaacctaattaataaagcaattaaaatggcaaataaatgatgtattaattaatgagttaattaacaaacaaaccatgggtttctcaaaggtcgggtcaatgattgtgctgaagtaaacgtaaacgcagaaagcaaccaacagagttgccttaacgaattggcatatgtcgtcaaatattttccctttttaccactaaagccaaaatgccaacggcgaattttgtgctggccctttcgtaattgtgaacaaaaagtgtggcacggaccctttcgatcataatggcaaaatggagcattggtgagccggcgatgtacaaataaaagggcattcggacggcgtaaaccaaccaaacgggggacaaacagtcgcaagggtcggagtaagtcaaggcgaggtactgtaatggggaatagcagaaatgatccgggtaagatacggtaattgagtgtcgagcaaatttaataaaacaaattccgaataaaaaaggcttttcgtgttattcaattaactgacaaaattccaagcagccgcaacaacaattgaccaaacgaaaagagcatagagcaaaaaaacactgatcagaattatctaaaaaggcaggaatttacattttattggtctgacatagtaattcgttcattcgttcatttaccaccaaattcgcatggagtttcaccgggtgattcttacagtaccaaaaaatcctcaacaacagtacggtaatgaggagtccggttacagtctgcacggctctcacaatgttgtactgtacgttgatgactgatgcttcagcagccgcacagtcttccaattcggtgccattttcttgggacaaatcatcgccgggggcgaaatgcatttgaatgaaaagagaaaattaaatattaatttatttaattatgtaaaaagaaaaaaaatggtccaactcataatgaaaaacatcattagaataacatttaaaataattgactattgctaaataacttttatcatttaaaaaattataactctcaatagtaaaaaaacatttgaattaaaattaagatttttaagtgctgtaatcattaaaaattgtctttatatggccaatgttttcatttgttaattcttcgaaattactcgccggcacaattgaaaattaattgtgaagagaaaatgccgattcatgcgcattgggtacgatttgacagcttacggatgacgaatttttgcaaaaaacccaaaaatttctttttgttatttaaataaatcaaaaaaaatttcaattcgcaataaaaaaatttattttgaaattcaatggcaaatagagaaaatgtgcaaag

SEQ ID NO: 17828 - DNA, 1194 bp, Heterodera glycines
tttttctgtttttatgaaggggcttggggaggtggaggactaagtgtgctcaattatccttaaatttaaatttactacataatggctttgatttatttttttaatttggacctaattaccattaattaggtaactaattaatttttaaggttcttccaattattcactttcaatttatttgtactaattaattttttgcttacatgtgatttttttaatttgacctaagtgtcaataaatcaccaattaatgagattttttggattttttttttcatttttaaattgccaaaatgtgttcatcccctttcaataaaacccgtccccatttatttgttcagatttccattcgaaaatactatgacgacattggaggctcgaccactatgtcaacaaccgcttcttcgtccatgggctcgcctttcagggtgagtgggagggcataaatatatatgcctcgggggcaatatgcctttttcgtcacagttaatttgttgattaaatttgaaaagcaatttccgtcattacacacacatttacagtaccacacttgtttgttgtttttgttcacgcatattctgaatacacaataatttacatgaattttttaccgtatcgagggcagggatggtcccaagatctctcggcgggggtgccgctaccgcaccccgcgcgacgatttttttgtttgttactttttacgccaatttttgttggcacgctttttttttaatttttggggacccaggaggggtcctgcgcggtgccgacaggcgccgccggaaaaaaaatgaaattcaatcattttttttaacagattttcacgaagaaatttgttgtattttgaaaaaattcagtgaaactttttggaaaatttgggttccggaggtctggatgggtaccaaataaggaaaaattgaaagttcagtacaaaatattaatttccattaaaaatttcgagtgggaggcgtcttggccccctccagctgggctatccatgctcggtggttttttcacttctatcaaaataagttttttgcagatttttatatgtattttaattaaattaatgaataattgaaattgagaaatttgataattttaaatttttgatggcaccgaaaatgagtataaaataaatgttcaaaattattgtcattagtgctgattgtgttctatatatatatatatgcct

SEQ ID NO: 17829 - DNA, 1771 bp, Heterodera glycines
  misc_feature (1747)..(1747): n is a, c, g, or t
ccccccccccccgctgccgcctttgaaaagcaattttggcgcttttttggcaaaatgttttttttttgaattaatgaatggtattgtgtgtggtttaaaaacagggtttaataaaaagcatttggatgatgttcttcttccccttatttttaatattcaagaggaaatggaaaaagatgggcatatctgttcctgttttattgtatataaggccccaaaattcttaaaaattatttctgaattttccggtacagtaccaagcccgtaatccgcctaacaatagccgaactaaaagattcggtaccagggccgaccgcgaaccaaaattttctgagacttgaaaaccaaaaccaagacagggaaaccccggtactcgagactaagactgagcattggtcctcgagaccgagaccccccaaaaaaatgagaaatttctcgactctagagtcgagaccgagaatctcgagaagccctaataattagggttgtaaattatatggactaaaaaacccaaaatatggacataaaatatggactaaaaaagcacgaaatatggactaaaaagctcaaaaatagccaaatatggaccaaaatatggactaaaaactgccaaaatatgtgttttaaaccctcaaaaattccaaaaaaggtgtatgaattcaatatttgcttaaagaaattaaaaaaaaacaataaacaatcaaaaaatggatttaaaacataaaaatgcaaaaaaaatttattgtcgtccattgtataaaaatattttcaagtttgccaaaattttaaaaaaattattatttaaaaaaagaaaagttcgcaaaaaatgatgaaaagatttattaaaaatgccaaaatgacgacgaaaattcaaatttttcatattttttgggctgtaaattttaaaatttccaaaaaatcaatctttagggggtgtatttttcccttttcttgcattttcttgtgaaaatttgccaaaaatggccgaaatatggactaaaaacacaaaaatggctaaatatggatttattcccgaaaacccccaaaatatggatttatatggactaaaaaccttcagcaaaccaaaaaattttaacgcagaaatgctatttttgagcccctttctttatagcatatgcgcagaaaaaatatgttaatccatataatttacaaccctactaataattaaacgcattttttaaagtttcacaatttttcaaatttctctaagcataaatccattaatttaatgccatgcctttcttaaaactggaatccattcctattttataccattatttcttgattccttgggcattacatcaaaatcacatgcattactgtatgtaaactcttaatccctgataaactattttaaagctgttttcggtatgctttggtcctttttgcgtcaaatccctccttaatcggtgatggcaattagcctaaatgccgttcaacaaattttttccaaaaatatcgagagcatcagaccctttaaatccaaatcccattgagaaatgctaagtgcattttatcgcattaatttagctgaaagaaagagcttttaaaggaccacaaaccatcttttgaattatgttatcaaatgcatttaaaatctgacatagcaaattttttaattaggcagtttattattttttaattaattatttataatttgtaaattttattacaaaattctctatattttttactttattttaattaaatggtgttttttcatgtngtaagcttttctgccgtttatcta

SEQ ID NO: 17830 - DNA, 1890 bp, Heterodera glycines
  misc_feature (1842)..(1842): n is a, c, g, or t
  misc_feature (1874)..(1874): n is a, c, g, or t
ccgttgtaacccccgggggagaaaccgtcgacggacgccaccgacagaacaaacgcaaacgccgccaaagacacgggaggcggaagaagaacaagcgacgccgacaacaacggcaatttcagcggaacatggcgtcgaaacggtggcggaagaaacttcggataatgcgcaaaaggaggcggaagaggagcaaacgcaacgaggcaattagaaacaatgaaaagcaattgaaattgaaatgggacaattgggtaaaaaggggggggggtaattaaattaagcgaagggtcattcattccgacaaaataaagacacataattaaactaataatggtaattaattaaggggatttgcccatcgacgagacgacaaaaacgaaaacagaagcagaggaggtgaatttgttaaatttaaataaataattattaatataaaatataatgattttgccaatttaaaaattcgttttccattttcgaacgaaacgacgccaattccaacggcagccgaagaaggcgaaaagggagggaatgaagtgaccgaaaaaagcattgagcaaacgacgggacaaagggaggacgaaacggcggagaaaaacggcaaaaacagcggaaaatggcaaatgaaacgaccattcgcctcccaattcagaattggaactcgcccgagccttccgcactcccttccttttgcgcctctccaaaatcgaatggcgtgccgaatttggcgatctgtcgagcggagcggcacggaagttgcaagagcaaatccgagcagatgtaaggcgattaaaccttcattttaactcccgccggaataaatccttcccatttctcagctccattccgcactctccgccgccattggtcccggctttttggactatcaaatcgaagcattgcaccaaggctcagtgattgtggaggggcaattgttgagccgagaagagataagcgatgcccaaagtgtggccatggccttggaacaggtgccattgagaagaatttgaaaataaatccgagtttatttggttacttcgcttaggcaattgtctcccgaggcggcgaattgggcggaaatgcggtggacacggaagggatcagtgtggcgggtaaccaactagcgatcatctgctgatcagcttatgattttcaaaattcacattttcaggccttcccgcccacgggccaaatggtaacggagtggcagcgaaccaaaggcagcaggaggaggaggcaagccaattcggaagcaaatgctcatttctcggctttgaaattcaggccgagagtaccggctacatcatcggtggtgccgtcgtcgtcggcgttctcatcgtcgtttttgccatttttgccattgtcgtttttggggtaagccatgggaagaacggaaatactactgatggtaatctctgcaattccttcaaaggatgagaaaaaacaatacaaattcataagtttatccccataaaattatgccatattttatttaggtttacgatgtgaccaaatttctggacgaacaccccggcggaatggaagttttaatggaaaaagcgggcgaagatcgaaccgaggcattcgaagacatcggtaaatgacaatgttttaataaaatataatggaattattcaaaatttaggccattctacggacgccaggcaaatgaaagaagattttctagtgggagaaattgtcgaggttaggaaaaagtttaattaaaaataggaaatattgttaattcagtccgaacattggaagtacagttacgacaaaagagagacgggcgcagacaaaacgatggaccaatcggaaaaaaggtaatgaccagaatataanatttggtgtaaatgaaaagcactcattgtgtngtccacaaactccatt

SEQ ID NO: 17831 - DNA, 1569 bp, Heterodera glycines
  misc_feature (1532)..(1532): n is a, c, g, or t
gaggacagctggggggtcggtgcctattgtcttgttccttacaggagggggaggggtggggggtgcgtcgcccatagtgctttcttacatgcaagatggggcgagaaagcgtgtgtggttctgaaacgtccatatgccatagaccacaacgtaaaatgggacaacattcataaaaaaaggttggcctcaaaagggcccattcccaagctaatttcggaatttgctgataaaatcaaatagcctaaattatatacgcattataaaaaggaaatgacagaagcctcgaatgttagttatattgcgtgtcacaaaatctcttccggaaaaaattttcaaaaaagtgttccgaaaaaaagagatagtcgtttttacatacgaatattgaaaagaaggcgtaaatggctctgaagcgtccataggccgcagaccacaaagtaaaatgggacaacattcataaaaaaggttggcctcaaaagggcccattcccaagctaatttcggaatttgctgataaaatcaaatagcctaaattatatacgcattataaaaaggaaatgacagaagcctcgaatgttagttatattgcgtgtcacaaaatctcttccggaaaaaattttcaaaaaagtgttccgaaaaaaagagatagtcgtttttacatacgaatattgaaaagaaggcgtaaatggctctgaagcatccataggccgcagaccacaacgtaaaatgggacaacattcataaaaaaaggttggcctcaaaagggcccattcccaagctaatttcggaatttgctgataaaatcaaatagcctaaattatatacgcattataaaaaggaaatgacagaagcctcgaatgttagttatattgcgtgtcacaaaatctcttccggaaaaaattttcaaaaaagtgttccgaaaaaaagagatagtcgtttttacatacgaatattgaaaagaaggcgtaaatggctctgaagcatccataggccgcagaccacaacgtaaaatgggacaacattcataaaaaaaggttggcctcaaaagggcccattcccaagctaatttcggaatttgctgataaaatcaaatagcctaaattatatacgcattataaaaaggaaatgacagaagcctcgaatgttagttatattgcgtgtcacaaaatctcttccggaaaaaattttcaaaaaagtgttccgaaaaaaagagatagtcgtttttacatacgaatattgaaaagaaggcgtaaatggctctgaagcatccataggccgcagaccacaacgtaaaatgggacaacattcataaaaaaaggttggcctcaaaagggcccattcccaagctaatttcggaatttgctgataaaatcaaatagcctaaattatatacgcattataaaaaggaaatgacagaagcctcgaatgttagttatattgcgtgtcacaaaatctctttcggaaaaaattttcaaaaaagggttccgaaaaaaagagatagtcgtttttacatacgattatgaaaagaaggcgtanatggctctgaagcgtccataggccgcagaccacaaag

SEQ ID NO: 17832 - DNA, 2081 bp, Heterodera glycines
ctctagagtcctgtagactaccgtattcctcattctgtaaataacatttaaaatccatttttatttgaaattattatggagccaccatttttaagtctttaatcaaaggtttaattctgctgaacaagcgaaaccaaggccagcttctcagtgagcaccatctccgcacattccgttgcacaattttcacgccaattttctcagtaagtcgacgcttcagctctttttgcgcgagatggaaacggcacacgcgttggaattggacgatgactgcactcaatgcttcatctcgcagttcttcaagcgaagcaagcactcccgaacagaagaaaaccttcggaagagaaggaggaatgatgaacggtgggggaaggagggagggatttatcccattgatccctcggcggaggaagggggaggggctcaaggaaggcacactttgttcgtcccgcattggaagccgtctctgctcagcgtcccgtccctttccatacgtaggcacatcgcttcgcccgccctcttcgggtccgtttccatcgcttcttttgttgccaaaatggcatagcgttgtttgaagtcggcataagcaactctgttgggaaatcccttgcggcaaattcggattccctccagcacgccgttgcaagtcagctgattgagtaccaagttggcttcaattctcgtcgacttcttctgttcgttcggaatgatgcagcggataaagtgcggatgcgtttggcttagcaccttcggcggatttttcgctttggtcggtctttggtcggccaactcaccttgaccaatttgttcagcgagtctctgtacatcatcgacaccgtttggaatgtgctcgcctttccctttttcttccccttcggcactttgcctcgcatttgttgttcttgcacatcctccttttattttgtagtttatcatttagcaaacttatcaattaattaattgattcacttgtgtttgatagtctgcccaaatggcattcaaaagtgccattttttgttttgtcttcaaaacggcgaccacagagtcattcaatgggtctttgttctgacaattttaaaattcaaagtaagcttattttttgccaatttggcaccttttccagccacgacttagcattgtatcggacagtcccggcgtaatgttgcaccgaaaaatcggcctccgcctgttgaggaaggactccgtctcattatgcctcccccccctaattgcctgtttgcccttaggcggctttgcttttttgaagtttggatgttttcccaggtgttggtcgtacagtttctgcacgaaagtgccgtccgtcgcctttggcacaatgcattcttcgtccaacattgagatgatgcccaatggctgcacaaaaagagccgaatggttctgtgctcactcagttatcggctaccttttctatcagttcaatgcacgactgcaggtccaagccgaagtcaatgaattcccagcggatggcctcccgacggtactcttcttgttcaagaacgaaccttaaggggagggggcaattggggggacagaaagacaggagcagaacatgtgctggttgaagaattgttgcagcttttcgttgacaaaattgatccacactaaaagaaaacgtgcaaagtgttttcgaaacaataattgaatttcgacagtataatgaccacagatttccgcccgtccgattacggtatttttaaaattcaacggcacccccagataaggaactcatacttctgtcaataaagataagattatgtaattctaatatagcttcgaaaatttttatgtattggatactgtcgaaatcaattaccgtcgaattttaaactaaaaatacatttttttgggtgaggatactgtaaattaaatatactataacagagactaaatttccatttagtgaatgcggtgaatgatttacactgttcgaagctgttgaggtcgaaaatttcgaacccggcgatgtccacacgcccacaaacatttcgcgctgcaatccttcgcttcaaactcgcgttgcatcgtctgataagccaagcgaacattcgcgcgtaaagtgc

SEQ ID NO: 17833 - DNA, 915 bp, Heterodera glycines
tcttttttcccccccccccccatccgaaatgtcctttttcttcctcctcctgcttcttctcccccctcctctttcttcccccccccacccgaaatgtcctcctcttccgcttgctcttccctcggcctttgcttaaagcgcatttcgcccatatgcattatcgcagctatcaatgcgtaaaggtccatcttctccaattcgctgaacatcataatgtcgaaggattcgtccgtggtcagcatttcctccccatcgtccatcccttcaatggccacttccgcctgggcaataaaattgtacgaatgcacgggacgatccaagaatagttttgctatagggggggggggggggggagaattgggtggcatggtcggcattggctcacttttaaggccgggaatggcaccggacattaattggtaaaatatgtggtaagagcgttcggtgggctgttgctttatcacgcgcgacttctccaaaaggtctaaacccttgtgaaaataaacgggtgttgtctcccctcacaatgttcaatgtcccctccggcgagctttccgccgttgttgaaataaatgcgaatgaacttgccaaaccgagatgaattgttgttgcgaacagttttggcatttcctgaaaagcgatggattgacataaattgtagatgatcgactcattaattattcatcatcgaacttaccgaatgcctcgaggactggattagttcgaacgatttggtcctccaaggacgacgattccttctccgtcgaaggcatttcgaactttgtcctctttttggtgttcgttccgcccacaacagcgaaaaaggagatcacctgacaatggagaaaaagtggagggggggaggaaaaaaggaaaagagagagaaaaggaaaaagaaaagaaaaagagaaaaga

SEQ ID NO: 17834 - DNA, 1343 bp, Heterodera glycines
  misc_feature (1124)..(1124): n is a, c, g, or t
ccccaagttgaggccaatttgtttaaagtacgcatctttgtcctgattttcttgctgaattcgttcgccaaatggccttccgtcagtgtccaatggttgtgccgtttcttcgagtggagaaacggcggacgaatttctcaacaattttttaatgatcgctaatgacgccttggcttttctgttcagcaatggatgataactgaataatttttgatagattttgtaaatcaatacattagcaaaccttgcgaaagacaaaaaaaatgaaaaaaattgaaattttttattaggaaataacccggaatttttcctgacaatcgaaactgaccaaagcattacaacgggaagagcaaggtcattgaaagcatgtgcaagaaataaaaatccgtaaaataacaacatatattcgtcctttgttataattccgaattggaaattcattgtcataacaaatgtaataaaaacggtgataaaatggcacgaaaaatttggtgccaattgtcgacccgtccgaatattttcatttaactaaaattaattaatttgtagggaaaaaagcgatatgcaataaaaatttgcttttaaaatgagctttattgaaaaaaatattttaagttgaatgttttaataatattaaaattatgacttttcaatcaaaaattaaaaaaaaaatatatttacattttaattaatttaataattttttacaaataattatcagccttttagggcttcaaaaaatttaataaaaaataatttttaaaattttattttacctggtaccgaacagatagttgtagattcttcccattgccatgatgtaaatcaaataatttttggttaaattttgtgatcattgaaaaaaccttaaaaaaatctaaagaaaaattctttaaattttatcttacaaaaatttctattaaactggcaatcattgctccgatgtaaagacccacagaaatatttgttaatgaaaacattgaatccaaaacaagcgtttgataaattgttaatgccaaacaaaggatgatctttaaaaacgataattaattagtctattaaaaattaattaaattaataaatagttcttaattaattcatccgcgttatttactcatcgatanaaaaaacaatttcattttactttatagacaattttattcatcaaaaagtattatatgtatgtagtaatgaacaaataatactacaaaattaaataattaaaatgaagaacatattttaccgtaatggacagccaaaccaccgtaaatgcccaactactgtagctctcgtaagtgtccacataaacagttgcacatattcgctcacaatcagcacatggc

SEQ ID NO: 17835 - DNA, 2157 bp, Heterodera glycines
aaattaaagccaaaacgtcaaattaaagaataataaatttaatttaaggccaaaaatgtcaattaagaataattatatttaatttttgaggaatttatgaatttaattttaaagccaaactgtcaattaagaataaaataattatatttgatttttggataattatgaatttagccaaactgtcatttataacaatatttgtgcttttttgataattatgaaataatttttagagccaaactgtcaattaaaataatttatttggtctttccttcacaaatgtaaatgaaattataataaaatttcttttgtgtaggccaacacaaatagaagaaattttttgaaaaaaagtctttgttatgaataaattttaattgaaaattcattattttaattaagcacaatttaagtccaaatttagaaattttataggaattttcaaaatacgatcataaaaatgactttccattaaaaaagtttcatctataaaatttaaaattattaaaaatttttgcaaataatttccttttctggaccaaaattttaaaaataaacaataataatttttaaaaattttgattattataagattatttgttttttatatgaaataaaattgataatggaatgaaaactaataattaaaaacaccagaaaaaaaattatattatcaatttatattttaaatttggaattttatgtaatattacaggcctattttcaaggtttttattttttgagcctaaaaacataaaaaaattttgaaaaaacctattttgacttattttcgcgttttggctaaaatttctcaacaagcaataaaacgaaaatacacccataaaaatcgtgcctaaaattttcaaaaatctacctttatcaaatgaaaaattttatcaaaaaccaatctctaaaatttattatttattttagatttgtacgggaccgggaatttttgccaaaactgggaccgggacttgctgggaccggttaagcctggaccgggaccttgtgaaaacgggaatttttttccaagaaaaattttcactcataagacccctattcatatcagtgcttgtttttacaagaatttttgattttaaatattatttatctaaataccgatggcttaatttttattactttttgaatagatttttgtcattttacgtccctaaattttaggttttttagtgcatactattttggggtttttagagcctaaaaattacatcccgtaataaccagagctgtcaaaaaatatgcaaatgcatatttttttcccggattatacatagtctaactagtaggaaaaacatcttctttttgtatttttgcgtataaaagtggtgacctttatggtttttatgcatattttgggtttttctgcatattttgtgtgttagtatttgatttttggcgtttaaatttattttaatatattgtcccttcataattttgtcttattgtctgtctattactctctatgtaatcgatattttgccatccctttccagcagaaaatgttcccccgtcttcgcttcaattcattctgttggcagtgcacttttttgtatttgttattttgtcttattatcctcggactttccccccattttattgttgctgattttaaataaaagtgatttgcccccgactttggaaatattgtggatgaaaagcagtgaataggccccgacccaaacagaatatttagcacgtggcgctcctggcgaagagttagctgtgcctgcattttgggatttttactgctgaggagaagccgattcgagaagcgtccagaacaaacgcattgttgcggttctgcaattttcttcgttgcggacagaacatacgcattgctgcggttctgctgtttaacgcattgctgcgaatttcaacgattttcgtcccactgcaaacgcattgctgcgataagtgaggacgtggtaccgacttattagcgcattgttgctaacttttggacttcgaaacgccaaattttattgccgccgcttagagggatgaccgaacacaactttgagcagaatcgccggaccaattcatcaattgttcatgaaggaaatgtccaattcgacaacgaaaacaacggaactgaaagagatgaaaatgaaattagacgccttctgcttcaagtca

SEQ ID NO: 17836 - DNA, 1483 bp, Heterodera glycines
aaatccaatacccggtacccgacccaccggtaggtccttgtccaaaagtacaatgggaagaatggggatctgggtcaaattatttggccaaggaaagctatgggaagaaaaatttaaaaaaaaaactaatttaaaatttagtgtaaaaatagatcatttatcgcttctgcagggacttagttggttctttttttggattaatttccttctttgttggggttcaattcgttctcatagcgttatgtatttgaatatatttttaaaaattttgcttaaaactatcatcattataagtaaataaagctcaaaatttttttaaataaataattttcctcttttaatacataaaagttacaaaaaattgttatttttttacaatttaactaatattcctaaaaattgaactttttgtataaattctgtaaacaacttggctcaaaatcacaatcgttttttgaacaataatttttagaaaacaattcgattaaaattaaatttttatcttaggccatctcagaatatatacaaaaatggaatttgcgaaaacaagttagaaaaattttaaggcctaacttcggttaagcctgccaaaaattgtgaaaagggtcttcagaacaaggcctcacattcagttaacacgctttaaacaagcatttcttaatttatatgaaatttttgctgtatttataatatgggatagaagcaatgcaagtgtaacgaacaaatcatgaacactctcttctttactctcgtttctatggccctttttgtctctctgcttcgtttttgtttctttcttcctttattaacggactctcacttattctctgttctctgccacctgtggtctctcgctctctctctttctctctctctttctgtctctctctcgccctctctctctctgcattcaaaataaaacactatttccttctgtagaaaaccaaagcatgagcccattttttgcacgacggccattgcaaaccacgccaattcgtcttaaaatttccgtcttttgatcccttaaaaattaaattttcattttcctttccccattttgtaatgattaccaaattttgacggttttccattaattaattaataaataaaaatgttaatgctcagcagcaaatttgttcgaagaatgtcatcactttttgttcaacagccgtcgttcagcggctcaacaccgaatttgagaagtttaagcgcagctgaagaagcaggtcaacagagtgccaaaaaggggcataaaagagaaaaagtgatgggaaaaagggacttttgctgttgggtacccctaaaaattccataggtagaacccttctgtatacatattttattgcttggataatctgatgagccccattttcgtcccaatgccaacggacaatttgtgccaacggaatcactggcacatttggcttggaagaagcattgccaatgagtcgggggcgtttgggccccagtttttggggccccg

SEQ ID NO: 17837 - DNA, 1867 bp, Heterodera glycines
  misc_feature (79)..(79): n is a, c, g, or t
  misc_feature (1856)..(1856): n is a, c, g, or t
gaggggagtccttctttaccatttaaaaaaataatttatgtatttttttcgctgacaggccacgtgcagcgggctcgancattttgtgcaaaacgaagtgatcccttcttcgtcccatttcgactcgactggcgaggttataccacataattttcgtgccctcaaaaaaaaattggaaaatatttaaaaaagggtgttttttggattttcttaaaaaccaaaaaaaaagggggaggggactctttgattagcagttttttttttgtcataataagtcgttataattaattccattgggttttctgagccgctacgaatctgacgcccatggaccgattcctaacccgaattcgaacaaagggccgaacaaataaactattcataatttagtgttttggttcgaattcggttaaggaattctgaatggcggtaatggaggctctactgcagaattaagcatccaatcaggatggtcattgattggacgcgtaaacggcaatagagccgaaatggggttcagatcttcaggttcttgaccagccccgcaaagcccccgggaaacggtttattatgacgaaaaaatttgcaattccatagtatttgccccctttggtttttaatagcattcaaaaaatgccttaccaaaattttgactcccaacttggcacttttgccctgttcatacagttcggcactttttccaatttgatgcttttctttagttcccctggccgtgggtgcgccgtgcccatgcgcttgggttgatgaacaccggcatcccccctgaacacggcggcattgggctaccactgacggtcaaagttggcattttcgagaccatcgcttacggcgacattggccttgggtgtgttttatatgtgtggctttgacatttcgttgtgtttaattgtgttattttagtacaactttgatggtcagtgaactgtctcaacagcctctgctggtaaacattaagaaaatgaattttctgttttaatgtaatcggaattttccccgtttttcagtacgccggcactttggagcaaaaacaaaaatttctactcccaatgttgggaaatccgtttttggcagtgcgttttaacataagggataattaaatatttgtaaaattgttttttatcttaattttgttcaaatttttagtaatttcccggggggcggacacctttttcaactttggccccaaattccgtttttattattattattttttaatttccagtcttttgcggtcactgagcccgaggcgggctccgacgtgtccaatgtgtcgacgagcgccgagccgagtgaggacggcacattttatgtgctgaacggtgccaagaaatggatcaccaattgtggcgttgcgcaatggttacatttttaaatgaaatttaattgtaaaaacaaagtcaaaaaattatgaccgatttttgtcccccccccccacccttaaattttgattttttttttttgccattttttatcctaaaatctgaccaaaattttctcgtttttttatcggggatttaattccgttagtttattgataaatatttaaattgccaagtgcaaattcgtcctccctttttcggttcttcgtgttggcgcgtacggcggccgacccggcgacgccggccaaagacgcgttcaccggtttcatcgtggaaagggacacgccggggctaaccgtgggagaaaaggtgaacagcaaaaccatttttagagatatccattaggtattttggctggaaattcggttaagggggcttcaggtccgtccgtgttcagaaaaatatttttggaggggcattcctaagatttttttcagtttaatgttatatccactntttattttttg
